United States Patent 10,407,724 (METHODS AND COMPOSITIONS FOR SCREENING AND TREATING DEVELOPMENTAL DISORDERS) - sequence listing, part 13

SEQ ID NO: 190 - DNA, 4997716 bp, Homo sapiens (residues 3,331,813-4,997,716 of 4,997,716)
cttcaatattgtgttggctattatggatcttttgcctctctttatgagttttagaagtaattggctgatacacatgaaattaatactgggattttgattaggatttcctcaaatctataaagtgggaaagaactgacatcattaaaatattgacactttctatctatgtgcattgaacatctctccacttatttagatgttttaaaaaaattgttagaattttgtagtttttcttatataaaatatgtaataatttcttagatttatacttaagtattttatatttttggtgctaatttaaatggtattgtgtttttaattccaaatcccaattgtttactgctgtcatttaagagaacgattaacttttgtaaattatccatgtatcctgccgatttgctagaattacttatgagtttcaaaagttttttgttgtaaattctgagatttttcaacatgaaaattatgtcatctataaacaaagacaattttattgcttctttttaatcagtattccatttatttcattttcttgtcttattgtgttagctaggatgtccagcatgatgatgaagaggagtggtgagagggcacatctttaccttgttcttaatcttagtaggaaggcatccagtctgtccactattatgtatgatgttagttgtaggtctgttgtagatattcttcatgaagttgaaaaagttcctctctactcctagtttatagagcatttttaaaaatcatgaatgagtgttgaaatttgtcaaatgcttgttctgcatctattggcatgctcatataattttccttctttagtctgttgatgtgatgaattacattatttgatttttgaatggtgaactccctttgaatacctgcaataaatctcacttagtcatggtatataatttttataaattgttggattcaacttgttgatatttcgttgagaatttttgcgtctatgttcatgagcaataattgcttgtagattttctttcttgaaatatctttttcaggtttaagataatgttgaccacatgaaatgagttaggaagtattcttcctgcttttgtttttgtttgtttgttttttgattttttttttttttttggaagagtttgcagagaattggtataatttctttgttaaatatttggtacagttcaacaataaactcaatctgggcctgttgtttcgaaaggttttagaaggctgttaatttgtaattcatgttttaatagatttaagactaccagattttttatttctccttttatgagttttggtggattgtgtcttttgcgaaaagaacatagaattgttcatagtactcctttatttctgttttaatacttacggaattaaaagcgatgatgactcatttattcctgatattggtaatttgcatcttttttcttggttagtctagtttatcaatattttttaaaaatacttttttaaaactagcttttggtcatgtttattctcattgatttactgtttttattgatttctgctctaacttctattacttatttccttctgcttgctttacacctctttttctagtttcctaaggtggaaacttagaatactgatattagatttttcttattttctaaaatatccattctataatacaaatttccctctaagcaccagtttgactgcattacacaaattttgatgagttgtgtatttgttttcaaatattttaaaattttatcttgaaaatatgttgttccatatataatttagaagtgtttaatctacaggcattttcttgttttccagctatttttctggctataatttttaatttaattctattgtggtctgaaagcatagtttgtatgatttctattcttttaaatgtgttaaggtgtgtttgatggccccaaatatgttatatttggtaaatgctctgggtgagtttcagaagaatatgtaatatgtatggtttttggataaaatatctgtttggtaaatgctctgtgtgagcttcagaagaatatgtcatatgtatggttttggataaagtatcctataaatgttaattaggtccagttgattgatggtgctattcagttcaactatatccttactttttcctgcttgctagatctgtcagttatcaaagagggatgttaaagtttccaactgtaatagtaaatttgtcatattctctttgcaattctatagtttttgccttacgtattttaatatttttgtgttaggtgtatgcacattaatgattgctatattttcttgaagaatttggcccttaatgattatataatgccccatttttttctctgataatttttcttgctccgaagtctgtacttactgaaattaatatagctaatctagatttctttttatttgtgttagtgtggtatgtctttctccaacactttactatctgtctcttttatttaaagtagattttttgtagacaacatatagttggttcttgttttttgactcactttgataacctctcttttaattggtgtttttagatgattgacatttaaagtgattattagtatagttagattaacaaataaccgtatttgttagtgtttccagttcattgcctttgtggggtttttttgtttgttagtttgcctgtgtgttttatactttttttctgccttctctggttttaactaagcattttctataattctatctcctttgttagagtatctattacgtttcttttttactatttttaatgattgctctagagtttgcagtactgcagtataaatttgcaactaatttaaaccaatttttaaataacactatactacttcatgggtaatgaaagcatcttataacatattatctctagttttttccctttcttatttcataactgccatttcacttcacatattcatagccaaaaccactgagtatatggtgctattattattttgacaaaaatctgtaatctgttagatcaattaaaacaaaaaaaaaaaaagagtctattataccttcacttattccttctctgatgtttttcatttcttaacatagatctgagattctgacctatatcatttttttccccctctgaagaattctaacatttcttgcaaggcaggtctattggaaacaaatgcccctagttgttttgtgagaaggtttttgtttctttttcacttttgaaggataatttcacaggatacagaattctatgttggtaatttcttctttatttttctttggacactgtaagtatttcactctaccctcttcttgcttgcatgctttctgaaaaattggatggagtgtttacctttgcttttctttagctaagctctttatttcttctgacttctttaaacatttttttatctttgatttcctatagtttgaaaatgataggcctaactgtagactttttatatttatcctacttggtattctgtcattcatttcagaaaattctctgccctatgactatgacttcaaacattttctctatttctttatctctttcttctacttctggtattccaattacacatataacttttgtggttgtctcacagttttgaaatattttgttttatcctttttttctctttgcatttcagttatcaaagtttctattgcattttctcaagcttattgattctttcttagtcatatccagtctattgatgattccttcaaatttctgatacagcatcttttatttctagcattttcttttgattctttcttggggtttttatttatcttctttcagtttctgtatgttctttcatattgttagattgtttctactttttccaatatcgccctttgcatattaatcagagttgttttaaattcccattctgatagttccaacatggctgccgtacctgaatctcgttctgatgcttagtttttcccttcaaacactgttcttaaaaatatatatatatacatacatatatatatatatgccttgtaattactcgttgaaagctggccataagctagcaagtaaaagaaacttaggtatatatgcctttagtgtgagtgtgtatgtttattcagttaggagttaccttgtatttactgtttgctctaggtgtggtgtcagggctaattttctctgatgctcttgtttttgtcttttttgttgtagttttccctagtgactcttacatgatgtttgacattttcaattccttcatctgtattatcctattatcttctaggagctccattgaggtaatgatagggtgttgggggagaaaaaatgttctgtaaaattatgattaggtctctttcttttaccaagcctgtgtccttgggctgtgaccttcacaaatgcttctcacttttactttcttttatttttctatgaaggtgaggccttttggcctcatctaattggagctgggcgtttcctttttgccatgtagaagacgagagtgggcaagagttgtatatttcccttcatacagtttgcttaggttctggtaaaacaccagtcatttaggctctggtaaaatagtttcccttgtgggcaggttttgttaaggagaacagaatattctaaacatatttttaaatggctattttccctttcctctgctggaaatactaggggtttgtttttttctttttctgattttcactgtgagaacatggtagagctcctagaagtaagcttcagaaaagtgtggaggccttcctatgactgagtctccttggagttttaactcttaagcttgtctacctttatcttccagcaattcaattacaagtttaagttttcttaaccctgtgctggctccagcaatggtttctgctcctcaacctttaccccagtaagctatgattccctttaacttcctgtctctctctctccaatttgaggggcaatagattgctctgtgagctcacatttctctaaagaatcctagaggaattgctgattttcagtttgttcagcttttttgttgttgttgcaaagatggaagtgaggccttttaaggtcattacatccttgactagaaattagaatgccactaaactatttttcaatcatttgaaaattttatttatttatcaacttttaagtccaggggtacatctgcaggatgtgcaggttggctacataggtaaacatgtgccaaggtggtttactgcacagatcatccgatcacccatgtattaagcccagcatccattagctgttcttcctgatgctccccagcatcccatcccccaacaggtgtccagtgtgtgttgtttcctgtcccccatgtgaccatgtgttctcatcagccagctcccactataagtgatgacacgctgtgtttggttttctgttcctgcattagtttgctgactataatggcttccgcctccatccatgtcactgcaacggacatgctctcattcttttttatggcttcattgtattccacagtgtattgtaccactttttctttatccagtctatcattgatggggcatttaggttgatgcaatgactttgcattgtaaatagtgctgcagtaaacatatgtgtgcatgtatcttaatagaatgatttatattcctttgggtgtgtactcagtaatgggattgctcggtcaaattatatttctgcttccaggtctttgagaaatggctacactgtgttctccaatggatgaactaatttacactcccaccaacagtgtaaaagtgttccgttttctccacaaccttgcccgcatttgttgtttttgactttttaataatagccattctgattggcatgagatgttatctcattgtggttttgatttacatttctctaatgattagtgatgttgagctttttatcatatgattgttggtcacatgtatgtcttcttttgagaagtgtctgttcatgtccttcgctgactttttaatggggttctttgctttttttatatatataaacttgtttaagttccttgtagattttggatattagacctttgtcagatggatagactacattctataggttgtctgttcactctgatgatgtttcttctgctgtgcagaagctctttagtttaattaaatctcatttgtcaatttttgcttttgttgcaattgcttttggcatttttgtcatgatatctttgcctatacctatatcctaaaggtattgcctacattttcttcaaagatttttatagttttgggttttatatttaactctttaatccatcttgagttaaattttgtgtatggtttaaggaaggggtccagtttccattttctgcatatggctagccagttctcccagcaccatttactaaatagggaatcctttccccattgtttgtttttgtccggtttgtcaaagatcagatggctataggtgtgcggtcttatttcagagttctctattctgttccattggtctgtgtgtctgtttctgtactagtaccatgctgtgttggttactatagccttgtagtatagtttgaaattggatagcgtgatgcctccagctttgttccttttgcttttacaaaacattttagcttgagataatagaagaacacatgcagttatgataaataatgcagagacagtttgtctactctttttctagcttccttcaataataatatcttggaaaactgtaggataatatcaccacgaggatactgactttgatacaatccacttatcttgttcagatttcttcagttttacttgtactgatttgtattcatgtgtatgctttttcagttctatgcaattttatcacatacataggttagtatattcaccacttagttaagataacagtactttcaacatcaggagaattcttcctgttgcactcttatgaccacacccattttcttctcaccttatcccattcttaactctacaaaccattcattggtctccatttctatatgtactacctttttttgatgcattgaatttgtaatatgtacccaagccaaacaatattagaatattgggaagcaaattctccttctatatcgtgattttataaacagcaaaattaaatttcattttatatatgtatatatatatatatatatgtatatgtgtgtgtgtgtgtgtgtgtgtgttctgtgtattatgtaaaaagaagggacacctacttcaaattggatgctagtctaactactcaaatatcatgagttaattctgagatgaaagtcagccatgccaggcgcagtggctcatgcctataatcccagcacttcagaaggccaagacaggcagataacttgaggtcaggagttcaagaccagcctgagcaacatagtgaaaccctgactctactaaaaatacaaaaattagccagcctgtagtcccagctacttgggaggctgagacaggagaatcacttgaacccaggaggtgaagactgtagtgagtggagattgtgccactgcactacaaccgagtgagactgtctcacaaaagaaagaaagaaagaaaatcagctggtgacatttattgtcatgaaattccttctcttgtcactgaatatagaattcttatggtaagagaagataaaagcgaatgtcaaaatggcctctccccatgtgttaacaaccgaatgcccctctcatatgtctgccaaacacaggcggccactttctttaaatatgtaccaagatgagagtatttttgaatgagtggctctaaagctaaaggattcagaggataccagtttagaaacggactatggtggaggctacaagacactggtattttctttactgcaatttctatttctttgagtccataaaatgtaatattactatgtgaaattgttacttttttcattcgtttatgttaatttttaaattcaggagtgaaaacaataaaatggttggtttttaatttcaaatgagactctgtttgttcctcccctgattttcttcatatattgtaaatttatattttcttatatatcattgaaaggtgttttagagggctgggcgaggtggctcacgcctgtaatcccagcattttgggaggccaaggcgggcagatcacctaaggtcgggagttcacgaccagcctgaccaacctggagaaaccctgtctctactaaatattcaaaattagccaggtgtggtggtgcatgcctgtaatctcagctacttgggaggctcaggcagaagaatcgcttgaacctgggaggcggaggttgcggtgagccgagatcgcgccattgcactccagcctgggcaacaggagcgaaactccgtctcaaaagaaaagaacaaaaaaaaagaagaagggttttttagtctaggtgcggtggctcatgcctgtaatctcagtactttgggaagccacggccagtggatcacgaggtcagaagttggagaccagcctggccaacgtagtgaaacctcatctctactaaaaatacaaaaaattagccagtgtggtggcatgcgcctgtaatcccagctactcgggaggctgaggcaggagaattgcttgaacccatgaagcagaggttgcagggagctgagattgcgccactggactccagcctggacgacagagtgagacttagtctccaaaaaaaaaaaaagtgtttttaccttaattggagacactgagctagctttctgctttattttgccaagaaaaaccttagtgatcttatgcatagatttagtgctgaattgatatttgtattgattatccatctcacttttaaattatgcaaaactccaattaaaatataaaaacaaaaatgtgaaagcagggaaggattaggtctttgaaaaatgcagatcagataaatacacttaatttgggacattctttccttctttttgcatccgtattttgaacatatctggttatattccaagaatagacatagatattacagggaaaatctgctgttaaaacatactcagtaactattcactaatcctttcctctgagagcttagtcggctaaatatgatacaatggattctcttgcatgcagtgactgaatgccagaacaagactctaaagacatcgtaatttaaatacccaacggtcctgggagaggagatgatttaatcgatatctgtaacacaaaaggtttagcaaaaagaaagacatttgaacattgtaaaatcagtgaggaggatttaagtttgtacaattttatcaattccaaaaatactatatctatatcaatttatttatttacctatcttactataatgtatatattagagagagagagagataattcacacacacacacctaacacaagcatcctaaaatcagatgaaatttcacgataagcagtatcattagtagcttcttgttcataggacattttatcctgagaaagctgccacatttaaaacataagaatatggaaaaccattattgcatgaatataactgtcctttaacctcattcacttagaaaaaaatgccagtatcagtggtttatgtgtatatttgctttggaaaaaaagattgagtagctggcgagagtattttccttgtctgatacttctcatcccaatttcaattttttgaaatttctcttttatggacttgggtgagtccacattggacaacctatacatgcatttaaaatgaaaaaaggaagttcatgtaaaaagtaagcatgtgatgaatcttatatcctcttcccttattcggatgatagaaataattacttctagatatatcattgcactgggcacagttggcacccaggagttggccaggtgttagatgtgataggaaatgcactgcctgattagacagactagagtccaagtgcaaaaacattctgtcttaaatgagatgagagacagaaatttaaagatgtcatttaatttttcatctgtggccaacacatgccagtgtttcaagatgattttgttaatcacatgggactattcaatgcatgtggtaatgaaaagatagaaacatgtttttttcaaacaaggcaaacactgttcaactcagtttcactgcaatcatttcagttgaggttttttttttttttttaatcttagttgatttctttttatgactgcgtaaaggtattttgctttgtttgcttttactcaggtttttatcccactgtgtcttttttattgttataattcaatcatactctggactctaaggatgctatgggcacaataataccgagaaaggtgccctgaagctcagtgttcttagcaaagaagttgaagatcttttctaaaaatatatgttatatacataagattatctaatttgcattcttaattttcaactatttactgattcaattatttactgattgttaatacatgttaacaatccattgatagcagtaattgccagcatttactgacagtttataatagtcaggcactttgccaagcattttatatgcatcatcataataaatttttgaaattgatactattgaatgtgtcagtttatttcttatattctacatagttgttctcaaagttctttcagggtgttcatgaggtaaaaattattttcatgataatactggcattatttatctattagaatttcacttccttacaaatgttaagagcacaaaaacttattaataatctatattgttttagagtccatattacttctaacctttaaaaaactactaacaatgagttttaatgcagtatgaaagaggaatattctcaactacctaaaaagattattagaatacatctctcttttccaattacgtacatattgaggtcagattctagtgatattttttgaccaaaataatatatcaaaacagactgaaataaaaacaggcatgaagctcagatgtagtataagacattttctagatgtttacaaaatataaacagtgtcactcttttactttttgtttgttttgaaaaattatagttaaatttcacaaaaaggttgtttatgttaaaattgaatttattattttttacatgaaataacaactatattacttaaatacagataggttgacatttctaacattaatagacataaacatataaaaagctggtttttgctttttttttttttttttttttgagactgagtcttgctctacaactgagtctggagtgcagtgtcatgattgtagctcactgcagctgcgacctcccaggctcaagcaatcctcccacctcagcctcccaagtatttgggattataagaatgtgccaccatgcctggctaatttttctgtattttttgtagagatgtggtctcaccatgatgcctaggcttgtcttgaactcctggcctcaagtgattcacctgccttggcctctcaaagtgctgagactgcaggcatgagctactgaacccagccaaaaaaatctttcagtaacttttgatagcctaaaagtattctgacaccaaaatacttcagaaccatttttctaacacattttccaaaagaatgtttttttttttttttttttttttttgagatggagtcttgttgtgtctcccaggctggagtgcagtggcgctatctcggctcactgcaagctccgcccctggttcatgccattctcctgcctcagcctcccaagtagctgggactacagacgtcggtcaccacgcccggataattttttgtttgtttgtttgtttgtttttagtaaagatggagtttcaccatgttagctaggatggtctcgatctcctgacctcacgatccgcctgcctcggcctcccaaagtgctgggattacaggcgtgagccaccgcgcctggccagaaattttcttttacatcatgtgaagtacatatgatttctacgaatgattcagtaggtaaatatgtaattttgttactttattcatatagccaaactctattctttcaacagacaatgtgataatggtaatagcccagtgacttccaagtaaggtgaattttcttcaccaacttaagaattttaaattatgtcttgaaaaaaatttttaaaaacgtaatgcttcctaggttagggaacaaaataattatgtttaagaattacagatgttaaaataattaggtttaagcattacagatgttgttcaagttgtgtttatgagcaagttagtgtgatagcatacacagggaagcaaaacacctaaataagatctgcctggagccaagagggactccccattagaaagaaaaggtaagctagagatttctagcagttgccattagcactggagatacctgtaatcctagttacagacaagtcccacaattctcacaatggattcagggacctgcctgaagtccatgcagtttcgttgatccagagaaggaacacacaccgagtcctcccaccactaccacccaactccctgggaccaaaactgctatgagacaaaaccatgttgggaatggagctacttctggagtacatgagtacatcatagcctggggtttaatagcccctacacctccacaacatttggtccctgccatcattccactacatacacacagaagactacatacagccatgaccccagcatctgagcccacacagtgtcttatattctaggaaacaagaggtccaacatagcagaaggccttcccatgaccaagggagcaagtacatgtgctccccacggccctagaactgactacctgtgactctccatcatcccagctgccacacaatgcatgtgcctcttcagaaaccaaaaacccattattttggtgtccaccataggtggcattgctaccaccaaacctggctaaaccactgtgccaggcatgtacctccccaaatcccaaaagccaatccacccagtagatcccaccctcaacaaagctgtggcactgcttccgtaagcaccaacagtacaggccactaaggcactcaagacacctctgatattgatcaaaactgaagaaatcacatggagaacttactagtgcacccacccagaatgaaaaccaaagcacactacccaactgatactataggacatagctacaataaaaagtatttttctatgaaagctactccatacaattggaagggataactgtttcaccagatgtgaaggtataagtgtaggtacacacacacaagaaaaaaaatttaaaggaaatatgatacttccaaaagaatacaatatatttttttcagtaccacattccaaaggaaaggaaaacaataaaagcctgaaaattaacttaatttaatgatcttgaggaaattcagcaagatacaagggaatacagatagagaatttaacaaaatcaagaaaacaattcatgatcagaatgagaaattcaacaaagagatagatgtcataaaaaattcgtgaacaatctcggagctcaagacatcaatcaataaaataaaaaatgtgattgaaagtttcaacaacaaacaaactcaagcagaagaaagaatttctgaacttaaagtgagactttttaaaataattcagtaaaacactgaaatttaaaaaataataaagaagcctatgggacttatggatcaccattaagaacacagacacttgcattatgggattttcagatgaagaagagacaagaaaagacataggaaagctacttgatcaaaaatagctgaaaacatcttaagttttggaggatacatggacatctagatccaggaagttcaaaagttaccaaatagattccattctgaggttcattatagtaaaaccatcaaaagtcaaagacaaagtgagaatattaaaaacaccagtaagaaggaatccaatcacatataagagagtctctattagattaacagcagatttcttagcagaacttttacaggccaggagaaaaaggaatcatatattcaaagtgctgcaagaagagaaaaagataactatcagccaagaatactactgccagcaaagctactctttagaagaatagcttatacaagctatccttgtaaaaaatcagtagcatttatatataccaataataaactacttgaaaaaatgtcaagaagcaattcacttacaatagccacaaaatataaaacctagaaagaaacttcaagatgaaactatctctacaataaaaattataaatctatgatgaaaaaaattgaataggacaccaacacaaaaaatgaaaaggcattccatgttcatgaattggaagacttgttattgttaaaatgaccatactacccaaagtaatgcacagtcaaggtgatctgtatcaaaaaaaataaaataaaattcttcacagaaatagaaaaaaatcataaaatttttatggaaccacaaaagacccccaatagtcaaagcaattctaagagagaagaataaagctgaaagtatcatacttcctgacctaaaaatatactacaaaactataataaccaaaaaagcatgagattggcattaaagcagacatacagaccactggactgaagacagaacccagaaaaaatccacatatttacagcaaatatattttgaataaaggtgtgaagaacgttgggcaaaggacaatctctaataaactgtgctgagaaaactggaaatccacatgcggaataatgaatccagacccctatatctcagcatataacaaaaacaactcaaaatggattaaagacttaaacataagacctgaaactatgaaaatactagaagacaacatttgggaaacactccagaacactggtattagcaaagatttttatctataaaacctcaaaaggacaggcagcaaaagcaaaaatagacaagtgagattatatcaaacgaaaaagtttctgcacagcaaaacaaataatcaacaaagagaagtgataatcttcagaatagtagaaaatatttgtaaattatgtatctgataagatatcaatatccagaatatggaaggaactcaaacaactcagcagcaaagaaccaaaaatattacttaaaattggtaaatgatctgaatatacatttcttaaaagaagacatacaaatggccaacaagtatattaaaaaagtatccttaatagggatatgtaaatcaaaaccacaatgaaatatcatctcactctagttagaagggctattatcagaaagacaaaacataacagatgctagtgaacatgtggacaaaagggaactcataaactggtggtgagagtgtaaattagtagttattataaaatgcagtatgtagctttctccgaaaactaaaatggcactaccatatgatccagcaatgccattatgagatatatattcaaacagaaaaaagcaatatgtcaagagatatctgcactacctcgtgtattgtagcactattaataataaccaagatatgcaatcaacttaagtttccatcaacaaatgaataaataaagaaaacgttgtatataaacataatgaaatattatttagccataaagaagaataaaatcctggcatttgtggcaacatgaattaacctggaagacattatgttaagtgaaataatctagccacagaaagataaatactacatgttctcactaatacatggaaactaattcagtagaactcacggaagcaaagagtagaatactgataactagaggctggaaaggatgaggaaaataggggacagggagaacttggttaacagatacaaattacagctgggcagaaggagaagtttctgtgttttatagcactgtagggtgactgtagataacaatgatttattctatattttcaaagagtagaatagatgagtttgaatgttcccaacacaaagaaatgatgaatattatagtgattgataagtaccccaatttgattcattacacattgtatatagatatcaaaatatcagactcttgtcatatatgacccatcattatgtgtcaattaacactaacaaaatagataaataaataaatcctaagcaatctaaaaaaaaaacctactaaataaacagtatgaatgggtaagccagactgggacacaatactggcaaagcaaacaaacttcttcagagcataggaaactaataaaaagatacaaaatataatacaaaaaggggaaggatatgaaggcctttctcaaagcaaggtatgttaatggaaaataagcacataaaatcatgctcacatgaacattattgttcatgagggaaaagtgaataaaaacaacaataacaaacatacccactagaaagtctaaaattataaagactgacaacaataaatgtagctgagtacctggagtatctgtaactctaatactttgtcactgggaatgtaaaatagtacttttgctttggagaaagttcaggaaatttattttgaatctaaacacacacatatttcatgacccacaaatttcactttctaggattgaccttagaaaaataaaatcatatgtccataaaaagacttgtcaaaaaaatgaccataggaggcttatttgtaataacctaatactgtaaatattccaggtgtacatcaagagtaggatagataaacccaccgtgttaatctatagaatgggatatgatccaacaataaaaagatttaaaatattgatacacagaagcagatggaaaaatttcaaaagcattatgttcagtgaaagatagcttatacaaaagtttatatcttattatttcatttctatgaaatactagaacaggaaaaactaatctatggttgaaaaattagaatagcatttgcttcaggtgttagattagaggcaaagattgggaaagggcatgagggggtggtaggaatgttatatttcttgctggtggcttggcttacacaggcatatacatatgccaaagttcattaaatagtaaactttaaatttgtttccttgtttgaaaattttacctcaaataaaaaaaaaaaagaactgtaaacaaatattgaaccctagttgatactttgaatgctgaagtgtttaaggagaaagtatattgatgtctgcaccttagtttaacatattcataaaaactataagacagattgacaaagagatatatagaaggatgaatgagtggagcgctatctaacaaaataaatattgtaaaaataatataatttaggtagtgggtatgtgaatatttattattacattcttttacttcatgaatgtttgaaatttttaatagtgtactttggggacaatgctaccaaaaaacaatgaaggcacctctgtactgtgtaacaataaatgtcaaacatcataagctataccaaacatagcaagaaaacttttactttatttttttaatttaagacattagtcaaatctgtaaacatgtgacatttaagaagaactatacaaagtgcttttaaaagtttaggtgaataatcttaatgggatatgatatttgtaattagttttcttgcacatttaatgtacgtatctttgttgttacgcaatgtgcatttcctcgctaagtaaaaaagttacctggcctctcacagtcggaaagcagagttagaatgagagaatcttcagttttaaactgattttagccctagaagttataattaaaagtttcttaatttaacactagaatacaaagtgacttgcctcaggccttttgcttgggtgatagagtgagacaaggactcatgttgtctgactcctagcaaactgctcttcctaatacactatactatcttttattgagcagccaagtttaaatttgtattaaaaaatcatataagactctatgtaaatgttttaatcatttccaaactgctcatatttttgttctttaattgaaacataaattcagaaacaggatattaattttgttttcatttttctacacgatgttctataaacattataaattattctctaataatattacattatatatgtgtgtatacacacacatatgtatatttcctagaattaggagtgttgaaacaagtcccttaatttccagtgagattattagttaacacaatagctaaaaaaatacatacatacctttcaaattgtggaaatcattctataatagagttttatattcaaattacttattcaagaaagatacttttaaaaaatgttatcagacgcaatataattacatttccaaataaaaggacaccttcttgaagatgctcttaagattccgataggtcattttttttaaacttctgaagatcttaattgctttctattgtttggatgataaatgaatatggcaaaaagtttaacaactcttttagctctccattttctcttgtcaacttggcttactaaaggaaacactgagagaagcaaattcctgtgagtgagatcagagagttcagtttattcctacaaaggattattactggcacatgataagatcccccattaggtattgaacattatgttcttaaatttcacaacattttactataaaatctttttgttgagatttcttggaatatagaaagagtagaatttctgtttttttgtcaacttggtaaacctttgaatgaattatatccccagagaaaaaatcatttagtatattccatgttcttaaagaagagattttttttctcagattccactgtgcagtagagttactgggggcaagttcagaaggtttttttagcttgagcttaagaaattttgatttgtagaagcaccccttagatgattttgagatcagtgttcccaggtctaaattgctttaacaatccctacaatttttagaattgatcatataggatcaatcaagtattatctgcatagtctgtatggccacaaccctagtgattctagaagaacattttggtctaatctcaaatcttaggagaagaatttgttgaaaatcaaatctgtgaaaatccaaggaactaaatgccctggatcccctcatagtccttaacaccgaatccaggccaaatgctattgatgatcattgcctagctgactggatttgagcttttgtcattagttggaggctggatcactgtgactctgctcctaccttgaaccttcctcactaattacagaatcagcctgaacttgtacttctaaaaatatgtcaagtgggtttagtcttttcacccagaattagcactgagggctcttgctgtcatggagtatcaccaaagaccgaattatagaactatgttgcagagagcctattttcaaggaagcttgagagagcaggagaaacaaaatttagcattactgatgaacatattcagcaatataaaaactcaaagacaggggaaaaattaatgacatctttttggtaacagtggtgaaaagcaagattttagaaaatagctaccattcattctctggaaagaacaaacgacaacattgtttccatggcacaaaaacagatagagacttttttatttatggaacaaaaatgatatgatcatcagtaaaatgctgtgtagtgaagccaaccctgaagaaatctaggtcagtgaaacagaaaataaactcaaggtgtatattcttgagtctaatgtgtgtatgtgcataaattttgaagcttggagacatcaaataacttgcctgtggtcaaatggttagtaaggggcaggcagagttacaattcaaattaaggtactgctgacctcataggctgggttctagattctaagtttgtgtttttccatcgtgctattcttctgtagtcaatatatatacatacttacatatatatacacacaatacatatatatgtacatacaaggtagatatatatgtatgtttatatacatatatgtacatatatgtatgtgtatgcgtatatgcacaatatttttaccttgtatgtttgtgtatgtatatatatgtatgtatataggtaaatatatatatgtatgtctttagctattgtgttaacatgtatatacatatatgtctgccctgtatgtatatatatatgtgtgtgtatatatatatgcatgtatatatatatatttactacagaagaatagcatgatggtaaaatataaatttagaatctagaacccagcctatgaggtcagctgtaccctaatttgagttctaactctgccccttactaaccatttgaccacaggcaagttatctgatgtctccaagtctcaaaatttcctttctcagtaaaattaaaattaaaacctacttgacatggtcatagggaaaatgcaactaaaaatttatgcaaaatgcctagtatctggctcatggaaatccaataaatgacaaaagattacaaacacataggagagaacattaaaattcatcatgcatttatagtaaattgctaaagagaagtggcaagaaacagaaaaaactataataacaaaaagtaataaacagttaaattacttaccatcctaagtgtcttacatatattagctcatttaattctaacaaacctgtaaagtaagtgcaacatcatcattttacagataagggtattgagtaataaaaataattggaacttagaggaggagtcacagtgtgatattttggaaaggggctataacagtctaggaaaaactgataatttatgtcttttaagaaaaaagttctagtgaaattctacaatttaagaaaataattgttatgtaagtctctaaataagagagaagaaatgctaccaccaccaaaaacaacaaaacattatttctgcagctgctaacatcagaatggctttggaaatctacatgaccaaaaaattgttgcaaataatcaagctagaattcatgtacaaagtggaaagagaaacattcatacacttccaaataattaaaaaatatagcccttctgcgagagcactggagagactgcaggtggaaaattcactactggtgtaatttataaaatcaagctctcatagaaataaataaaaaacatcaacaaaaataaaagattgttttgataaagaaataataatatggacaactattatatggtgccactgagagttggcacataagcaactcctcatcagtatattaaaaattgttctacttgttcctgcataggtaatgccaacctcgcgatagcaataaaagggagaatctgaaacagtgttttcttcttggaaatacatacttactgtacagatccctttgtacactaaacattcattgaaatagccttgttttctacttgtgtttcctatactttgtacattgaatggccaagtttcaaaatggtttggttcaaagttgtgatctaccagaactgcttctcaatccttgaaaagagtcagtagactgtggttatactgcaaggaagaggcagtaggctgtagttatgcttctgtgatatttgtcaggctctgcagaagacttttttaaaacaggcttgtttatttgtcaataaaaatgcaccatctcatgttgttttgacatcctttacaaatacacaattatcttcttttctataaggttaaattccattcaggtacatgatgatgctttcccaatttaaatttgcaaatgaggtagcatagtaagattaattatgcagtacccttggtatttaggggttcacattcaaagtgtgtgtaggaagaccatgagctggtgcaaagattaactctgacattatcactgtttttagatctgccgggtaacagttttcattttatttatgagcctcatattttaaattgacgtttatgctgggcaatgtgtgaaattatttgactgtgaccagacttatttataaattcaatgtgaatactgacacatttcatatgctatttgtattttaaatatattggaaatggtacaattaaaatatctgagtttaaagagtgaaggggagagatacggatccagttaagaagtaatgtttgagtgcacacatatttaaaaagttataaaaggaaaagaagcaatatgaactacttatctcagtgcctgaaaatatgcaggaagcaaaaataagacctgctaacgctggcatatgaaaaggacttcatgaaatgttaacttaacacattcaaaatcatattataattagtaccgggtgagccataaaatgttcctaaaaacacctagaagttaatatgcttttttctctctctctctctcactctctcgctctcttactcttgctatcatcttcatattatcaagtataaaggtcttaattgaaagttgtgttcctagagagtgtgtaccttgtcaaattgcaaaatattacaacctcagatgaagttctcttcaggtattgtgggtctgagtggactcagagcttgagtgaaaacttaaaggtgtagggtcaggttttgtacgtgactggttgccgtttactctgatctgttcaatttaagctggtctccatatgtacaatgatactaacaaggaaaggacaatatatccaaggagttctaacaagttcatcttatgaatcttatgattctgaggcatccaggaaaaggaatgatactataattaccagcaatttttctaacaaggtacacacaatttgttcccttttgtgtgactcaaaatttctgactcacatttagcataattcatttccctttagtgaaagtgtcagtactattcttttcaaaatattccttcttcagaattcccctctgcattcagaatgacatatgatagcaataatagcaataattatagtaataacaataccatgtatttagtgattcaggataaagtgattgacactgaaaacaattattgctagcatatagtaaagaaaaactggtttgttggtaagtagaagcataagacacttggcactattgaaatgatgaaatctgttaccaaacacacagctcactggaatcaatgagtttatcatgcagacggtggcagcagaatactgtggacttttgatttttatatatctctcacttatctcactagtgggcacacagtaggcacttaatacagtgcattttatcagcagggactgccaagtaagcttttcagacaagaagaattgagaaatccttgagaaattaggaaagacttaatttctgaaaaaaaatgatttgaaccagaagtatgtaaggaaattagaatcaaggcatatatcaaaaataaggctaagttaaagcagaagatcaaaaattctgttcgacagtcaagaacaaaaggatgcatatacaagaaaaaaagtgataggttcaaagtctagtcattcagtcaggaacttagcatcaacagatgttgatattaaaaaggaagaaaggaagcgaaggaatgagagatgctagcactaaaaactgtgataaatgatccaagagtaactctagtctagtatttagatgaactcccctaaggaaatacataatgacaaagccagatatgggagtggagacggatgttaatgataatggataataatgataagaacaacaatggtacttctaaactagtagtagataatagacatgatacgagaaccaaaaattctgaaaattgacaagtaagtttgtggaatttactattgtaagtttttaaatttaaagtttacctgaaacatttatttgagtgcataattacaatactgaataaattatataagttttcagatgtttgagtagtaatgtagtcaagtttttatggttttcccttcttgccttgttagtagtctaacaattataattaccacgaatttgatcatatttccctgaaatatttaataatcatatcatgtttatcttaatacccaagatttagaattcttcaactactagcctttccttccagaaagagaaaatggtatcaaaatatcagctccaattcccttggatgaagaaagctgggacagagggagaggaaaggaaagcaatggtaatagaaagaggatgaagtgtaagggggctgacctctatatataaccatgcctctgtcaatggcacagaaaataactaaggcaggtttaccttagagaaaatatgatttcatgggtggcaagtagattttctcattcaattccttcagtaaagatagaagaaaagaccaaatcacatttactagtgatgtaaatatattttaaagaacacaaaaaatttaatacaacaataaaagttgagacaatataattttcttttatcttctttctccatctagcctcttactggaattccctcactctttactcctcttatatagtcctaaaaatgttactttgcactcttcagaaggcattaatcaatggttgttaaaaaaaaaaattcacagagcctgaatctactttacttcaagaatatattttttaaaatgaacataagattttttaatgtcaaaaaattttaaagttatagtagtattacatagtacatcaagttaagtgtattcaacagtttgaaaagctaaaggtttgattgtctcttttcactaagtgtaaaaattaactttaaaatactttgaggtcaaagaaattttagttttgttattccagagaaatagaatacactcttacatgttaatttctaatgctagtcatagaaaaactcaaaaaacttacagatgatgaacagattaaatagggacaaaaaagaagtcaaatgagataaaaattaaaacagtggaattttccatatatttcctatctcatcctatcttcctagccctgatgaaatagaacattgaaggcctatccactgaatattactcaagtcttaaagaattttaatgagtttgtatcctattaaaattcatatatgtcattttataactaagtatgctattaatttaaatctagtggtttttttgcacattcatggtttagattacctttttcaattctttctgtatcttcgtattattttagggaacaatgaagcattaaatttaaaaaatccttcaaatatccactttgagctaaactaagtgaaaaatcatcagtggaaaaacatgctcatattttctaaataattgccactaatctttttgctagcaagaaattagagtgaaataaaaaataatgtatgtaaacttataaaattcaagtttcactctattaagtacacaaaaaaagtaagacatactgtatacttcattgactatttttaacctgtatgacctttaatttgactttatatggcattctacctctttcattgttttatagtgtttgctatttttccattttttcaacagtagaatatagttacaaatgaagagatcattcttttaatttgagacaataatccaactcttagtggttaatatgtattttcctcattttccccaagtaaatttaactgatgactagttttatgtatgacaatagattactgcttttcactttttgaaaaagttatggtaaaatattttaaaaacataaaatttattgccttaacaattttagatatagagtaaaacagtgttaattatatgtaccttgttatgcaacagatctctagaacttcaactagcaaaactgaaacactatactcattggaaaaaacttccatttagcctccccacatgcccctggcagctaccactctgcattatgtttctaaaagtttgactactttagatactggaataagggaatcatgcagcatttttttgtgtgtgactggcttatttcattaaacatgatattatcaaggttcattcatgttgtagcatataacaggatttcctccttttttaaggctgagtaatatcctgttgctaagaaactatcaacatgataaacagaaaacctacagaatggaagaaaatgtttgcagactatgcatctaacaaaggtctaatatccagcatctataaggaacttaaacaaatttgcaagaaaaagaaacaacactataaaaaagtgggcaaaggatatcaacagatacttttcaaaagaatacatacatgcggccaacaatcgtatgaataaaagctcaacatcactgatcgttagagaaatgcaaatcaaaaccacaatgagataccacctcacaccagtcagatggctattattaaaggccaaaaaataacagacactggtgaagttgtggagaaaaaggagcgcttatacactgttggtgggagtgtaaattagtgtaaattggttcaatcattgtggaagacagtgtggtgattccttaaaggcctaaagacagaaataccgtttgactcagccgtcccattactgggtacatactcaaggaaatataaatcattctattataaagacacatgcacatggatgttcactgcagcactattcacaatagcaaaaatatggaatcaacgtaaatgcctatcaatggtagactaggtaaagaaagggggaggggccaagatggccaaatagaaacagctccggtctgcagatcccagcaagaccaacagagaaggcaggtgatgtctgcatttccaactgaggtacccagttcatctcattgggactgattagacagtgggtgcagactacagagagtgagcagaagcagggtgaggtgttgcttcacctggaagtgcatggatccaagggaagcggtgagagactgtgctactcaacccgggcactatgcttttcccatggatttttgaaatccacagatcaggagattcccttgtgagcctatgccaccagggctctgggtttcaaacacaaaactgggtggctgtttgggcagacactgtgctgcaggagtttttttaatactccagtggcacctaaaactccagtgagaaaggagaaccgtccactctcctggaaaggaggctaaagccagggagccaagtagtctcgcctagcaggtcccactccaacagaacccagcaagctaagaaccactggcttcaaattctcaccgccagcacagcagtctggagtctatctgggacgattgagtttggtgggggaaggggataccgccattattgtagttttaggaggctgttttcccctgacagtgctaaggagactgggaggtttggaccttgcagcgcagcaaagaggctgtggccagactgcttctctagattcctcctcactgggcagggcatctctgcaggaaatccagcagctccagtcaggggcttacagacaaaactctaatctccctgggacagagcacctggggggaggggcagctggggtcacagcttcagtagatttaatcttcctgcctgccagctctggagagagtggctgatcctgacaagggggattctcccagcacagtacaccagttctaagggacagactgcctccttaagtgggtccctgacccctgtgcctcctgactgggagagacctcccaacaggggttgacagacacctcatacaggagagctctggctggcatcaggctggtgcctttctgggatgaagcttctagaggaagaagcgggcagcaatctttgctgttctgcagcctccactggtgacaccgaggcaaacaaggtctggagtagacctccagcaaactgcagcagacctgcagaagaggggcctgactgttagaagaaagactaacaaacagaaagcaacaacaacaacaacaacaaataacgccccaataagaaccccacccaaaggtcatcagcctcaaagatcaaaggtagataaatccacaaagatgaggaaaaaccagtgcaaaaatactgaaaattccaaaatccagaatgcctcttctccaaatgatcacaacacctttccagcaaggccacaaacctcaatggagaatgagattgacgaactgacagaagttggcttcagaaggtgggtaataacaaacttctctgagccgaagaagcatgttttaacccaatgcaaagaagctaaggaccttgataaaaggttacaggaactgttaactagaataaccagtttaaagaggaacataaatgacctgatggagctgaaaaacacagcacgagaacttcgtgaggcatacacaagtatcaatagccaaactgaccaagcggaagaaaggctttcagagtttgaagaatgtcttactgaaataaggcatgcagatgagattagagaaaaaaaacaatgaaaaggaacaaacaaagcctccaagaaatacaggactatgtgaaaagactgagcctacaattgattggaatacctgaaagagacaaggagaatggaactaagttggaaaacacacttcaggatattatccaggagagcttttctaacgtagcaagacaggccaaaattcaaattcgggaaatatggagaacaccattaagatactccatgagaagatcaaccccaagacacataatcctcagattctcaaaggtcgaaatgaaggaaaaaaatgttaagggcagccagagagaaaggtcagatcacctacaagggaagcctatcagactaccagggaatctctctgcagaaacaccacaagccagaagagagtgggggccaatatttaacattcttaaaggaaaggattttcaacccagaatttcatatccagccaaactaagcttcataaacaggagaaataaattcctttccagacaagcaagtgctaagggattttgtcaccaccaggcttgccttgcaagagctcctgaaggaagcactaaatatggaaaggaaaaaccagtaccagccactgcaaaaacataccaaaatataaagaccaatgacactgtgaagaaattgcatcaaatagtgtgcaaaataaccagctagcatcatgcaaatcaaaaccacaatgagataccatctcatgccagtcagaatggtgattattaaaaactcaagaagcaatagatgctgaaaaggctgtggagaaataggaatgcttttacgctgtcggtgaaaacgtaaattagttaaaccattgtggaagacagtatggcaattcctcaaggacctagaaccagaaataccatttgacctagcaatcccattactgggtatatacccaaggaatataaatcattctactataaagacacatgcacacatatgttggaataagtaaaaaagctaaataaactaaaaaaatcaatgttaaactctttttaggtaagtagagaactgaggtagtggcaaatcactgctctaaacatagaggagatggatggagcatcacattttctgttatcagaaacccaggaggaaaaattttccaggaaaccagtattgaagtagaaaaatctgaactgtaattgatgaattgctggaggctcactgtggacaagttgagagttaaaaattcagatgaactgttatgtcacaaaaagatagagtttgaagagataaagcaagcatcagaaccagagtcagatatggtagggatgttggaataatcagacaaggaatttaaaacatgtatgattgatttgataaggactctaatgcaaaacatagacaacgtgcaagaagagatgggcaaaataagcagagatattgaaattctaagaagggattagcaagaaatattacagattaaaagccatgtatcagaaataaataatgtcattgaggggcttattcgtagactggacacagctgaggaaagactgagcttgaggttatatagttgacatctgtagactacttcatgcaacaacagtagaataaaaattcttctcaagctcacatagaacattcactaagacagaccaaactctacataataaaacacaattaaacaaatttaaaataacaaaagttacgaaatctatacactcaccacattggaattaagttagaactcaataactgagatatggctgaaaaatccccaaagtgtggcgattaaacaacatattttaaaataaatactacctgagtaaaaaagaaattttaagagaaattttaaaatatttcgaactcaatgaaaatgaaaatacaacttgtcaaaatgtgtgagatgctgtgaaaagaatgcttaaagggaaatttatagcattgaatgcatatataagaaaagaagaaacaactaaaatcaataatctaagcttttacctgaaactagaaaaagagtaaattaaatgcaaaataataaaaattataaaaattagacaataaggaatgaaattggacacaaaatatcaatcaataaaatgaaaagctggtgttttaaaaaggtcaaaaagttagcttaagtatgaaaaaagagaagggatacaaattactaatatcagaaatgaaagataggacatgattccaaattccatggacattaaaagaataataaaatagtatgaacaactctatgccacagatttcacaactgagatgtaatgggccaattctttgaaataaacaatttactaaaactcacataagaagaaacagaccaaccgaataggcctatgtctcttaaacaaattgaatcaatatttaacaacttttcaaaacagaaaccaccaggccttggtgtgttctttgataagttatatcaaatatttaagaaagaaattgtcaaccctcaaaatctgagacaggtctgtcaattttggaagtttattttggcaaaattaaggacgcgcctgtgacgcagaatcaggaggtcctgacgacatgtgcccaaggtgtttcgagcacagcttggttttatacattttggggagacatgcaacatcaattaatcaattaacatatgtaagatgaacattggttcagtccagaaaggcaggacaacgtgaagcaaaggcaggacaactggaagttgggaagaggcttccaggtcataggtagataagagccaaattatctcattcttttgagtttctgattagcctttccaaaccaggcaatcaaatatgcatttgtcacaatgagcagagggattactttgaatagaaggggaggcaggtttgccctagcagttcccagcttgacttttccctttagcttagtgcttttggagctgtgagatttattttaattccacaaaattttattaattctctacaatttcttccagcagataaaagaaggggtaacacatactaactcattccataaggctgacattaccttaatactcaaaccagacagacattacaagaatggaaaactacagaccactatcaagtcattaacgtatatatacacacatgtatatgctaaacaaaatattagcaaatcaattccagcaatgtagaaaaagaactatatacaacaaccaaatgggatctactacagttgtgcaaagcagaattaacatacaaaaatcaattcatataatccattatagcagcaggctaaagaagaaaaatcatatgaacatatcaacagatgcagaataagcatttgacaaaatttaacacttattcatgatttttttaaaaagcactgagtaaactgggaatagaaggggacttcctcaacttgacaaagactatctacaaaaagactagttaacatcataattaatagttagaaaaaagagtttctcattaagattaggaacatgggaagaatgtcctcttccccaactccttttcaatatcatactgattgtcctagttaatgaaagataagaaaataaaataaaacatttacaaactgaaaagaaataagtttatatatatgtgttgaaacctatagaaatatataagacaaaaagtgaaccctaatgtaaactggacttacgcaataatgatgtgtcaatgtagctttatcagttgtagcaaatataccatctggtatggaatgctgatatctggggaggctctgggtgtatgggggcagggtgtgtatggaaattcttttaactttctggtcagtttgtctgtaaatctaatatcctttaaaaagtaaagtcttttcattaaaataaaaaacaatcctacattactttattggtgaattctaccaagcatctgaagaaaaattaataccaatacttgacaaactctttcaagaatcaggagaaagggaatagatcccaacttattttatgaagccagtgttacctgtatgtatacataaaagacatcacagagaaaaagctgactaatatcccttataaatatagatccaaaaatcctaaacagtatattggcaaactgaattcatcagtatttaaaaagcactggtcatggagttacgactaagtaatatttcatccaggaatgcaaggttaacttactatatgacaatcaatcaaaggagctgggtgtggtggcacatgtctgtagttccagctaccgaggaggctgaagcaggaagattgcttgatcccagcagtttaaggctgtagtgacccatgattatgggtcactgtattttagtcgtggggacagggtaaaacagtgagatccttactccaaaaaaaaaaaaaaagaaaatcaaagtaacatagttttattttatatattattttattcatttaagtattcataattttgttattttatattttattatttattaatatgttcaagagaataaaggagaaaagtcacaaaacatctaggccggtagcggtggcttgtgcctgtaatcccagcactttgggaggccaaggtgtgtgggtaacttgagatgatgagtttgaaaccagccaacatggcaaaaaactatctctacttaaaatacaaaaattagcaggatgtggtagcacacacctgtaattccaactactcaggaggctgaggtgggagaattgctttaacgtaggggatggaggttgcagtaagcagagatcccaccactgcactccagtctgggtgacagagcaagactccatctcaaaaaaaaaaaaaaaaaaaattcacaaaacagctaaatagacacagtacaatcatgaggtaaaaaacatttcttgataaaaaacatttaataagctgggaaaaatgagcttcctaaacctgatgaagactatcaacatataacttaaatttaacttcatacttattgatggaagacttgaatcttttcatataagattacaaacaagacaaggatgcctgtgctttctactattttatgttgtactggaggttctaggcaggacaatcaggaaagaagaaataaaagtaatctacattggaaaggaatctattcctctttacagatggcatgataatgcatatggtaaataagaggaatccactgaagttttcaaatgaataaatgcattcaccaaggcttcaggatataacataaatatacaaaatgacatttaaaataactacattcacaataatatcaaaaagaataaaatatgaataaatttaacaaatgaagtacaaaatatatactctgaaaactgcaaaatattgtgcaaagatattttggaaacctaaataaatggaaatacatctcatacgatgaatagaaagacttaatattataaagattgcaatactgaacaaattgatctacagatcaacataaatcatcttaaaacaccagaagactcctttgcaggaattcaaaagttgatcctaaaatttataacaaaatacaagggaacaaaaatagtgaaaacattcttgagaagaacaaaattagaagaatcacactgattttaaagactaaaagtctactggaatcaagacagtgtggtactggcatagggacagtagaagagaattgagagttcaggaaaatatataccaaacccctatatttatggtcaattgcttttcaacaaggatgccataaaaatttaatggataatgattaatcttttttacaaaattgtgctggaacagtaatcaatatacaaagaaaaaaagaagattgacttctacctcataccttacataaaaattaattcaaagcagagacctaaatttaaaagctaatttttttcattaatgttttctaggtttttaatgtacagatctttcacttctttggttaaatttattcctaagtaccttatccttttttactttattgtaaataggattattttcttaatttcttactttggatatttgttgttagtgtataaaaatgtacctagtttttaaatattaattttgtgtcctgcaattttattgaatttatttataggttctgagagttgtggggatctgtctatgtatatagtttttaggattttatatatataaaataatgtcatctgcagacagataattttactgattcttttccaattttgatgacttttatttctttttcttgcctaattgctctgtctaggactttcagtactttgttgaataaaagtgataagtgaaggcatccttgcctttttcctgattttagagaaaagctttcagtatttcatcattgagtataatgttagctgtgaaaaattcatatgtggcctttattatgttgactaaattcttttatacctagtttgttaaaagtttttaatcatgagtgttgaattttgtccaatgcttttcctgcatccactgaaatgatcatgtaatcttttctttcacttcttaatttagtgtatcacattaattgacttgcatatattggactatccttgcatgacaggcataaatcccacttggtcctggcgtgtaactgattcttttaacatgctgttaaattttgtttgctagtattttgttgaggaattttgcatatatgttcattagggatattggcctctatttttcttcttttttttttagcatctgatctggattcagtatcgggtaatgctgaccttaaaaagtcaggttgaaagtgttcctttttcttcaatgttttgaaggaatttacgaaggattggtgttaaatctttcaagtttttgatataattcaccaatgaagccctcttgtcctaggcttcccttttttggaagtttttgattactgatttaattttattacttatttgtctgttcagattttctatcagatctcaatggcattttttataaatgaaaaaataaatttagaatttttatgaaatagaagcaacctaggtgaccatcatcagatgagtggataaagaaaatatttattttctttatctatatggtatatacacagtggaatactatccatctttcaaattaggggaaatcctgtcacttgtgacaacatggataaacctggaggacattatgttaagtgaaacaaaacaggcacaaaaagataaataccaaatgatgttatttatatgtgaaatctataaaagttgaactcatagatgtagagagtagaatggtggttataagaggcagagggaggggagtggatgaagaaaggtgagatgctgatcaaagcatacaaagtttcagctagagaggaggaataagctctagcactctattgcatagaaggttaactgtaatatataataatgcattatatatttcagattgctaaaagagtagattttgtgtgttttcaccacaaaaaataagtataggacatcataagcttgtcaattagcatgatttaatcattctgcattgtaagcatatatcaaaacatcacattgtatcccacaaatatataattactatttatcaattaaaaataaaatttaaacaatcatatggaaccaaaaaagactatgaatagccaaggcaattctgagagaaaacaaagttggaaacatcacacttcctgatttcaaaatatattataaagctacagtaattaaaagagtaaaacactgccctaaaaacagatacagtgaccaatagaacagaatagaaagtaagaaatatactcacacatataacaccagatgctctttgacaaagtgtcaagaacacaatggagaaagggtagtttttcaacaaatggtgttgaaaatactggatatccagatgcaaaaaggtaaatttgggcctttatcatatgtgatactcaaaaacctacacgaagtgaattaaacacttaaaggcaaaatctgaaactgtaaaatttctgtaagaaaactaaggtaaagcttaatgacattgaatttggcaatgatttcttggctatgacaccaaaaacacaggcaagaaaagcaataaaggagaagagggattacttcaaactgaatagcttctgcacaatgaagaaaacaatcaacagagtgaaaaaacaacctgtggaactggataaaatattttcacagcatatatttgatatagggttactctccaaaatacataaggaactactacaactcaaaagcaaaaacaaataaacatgcaaataacccaatttcaaaatgggcaaatgatttcaatagacgtgtctctaaagaagacttacaaatggccaaatggtatgtaagaagagactcaacatggcaaatcatcaagaaaatgcataggtaaactacaatgagacaccaccttactcctggtagaacggctataatcaaaaagatgaaataaatcttggtaagcatgtgtacaaattggaacctttttacactgtcagtgggaatgtaaaatgtgctgccattatggaaaatagtatgaaggattttcataaaatttaagaaataattactatatgatctagcaatcgcactcctgggtatatatgcaaaagaatagcaatcaggatcttgaatggatagctgcattcccatgttcattacatcagtattcacaacaaccaagatatagaaacaacctgagtatccattgatggatgaatgcataaaaaactgtgttatatacatacaatggaatactatccagctttaaaaaagaaggtaatcctgccatttgtaactacatggatgaacctagtgggcattatgataagtgaataatcacagaagacaaatactgcatgatctcacgtatatgagttatccaaaatatgcaaacttacagaaacagaggatacactaattgttgccaagggatgaggagaggtggaaatagggagttgctcttccacaggtatgtagttttagttatacaagacgagtaaattctagagatttgcagtaaacgttgggcttatagttaacaaaattatattttgcacttaaaagtttgtcaagaggatagatttcatgcagtgtgttcttacgacaatttaaaaacaaaactaaaagaaaataaaatggttctgtacatgtcatccacattaagaaaataaaatttcctctcaaaatgaaataaaatgaaagttaatgctatataactcttaggaaaaaaattaaaagtaaatttttatgactggattacataatgtccctagatatggcaccaaaagctcaagcaacaaagaaaaatagatgaactggaccttatcaaaactaaaaatatttgtgcttcaaaagacatcatcaaggaagtgcaatgttaactcactgaatggaagaaaatatctgcaaattatatgtcagataagacacttgtatccaaaatatatcaagaattcttacaactcaagataaaaaactctaatcaccctattaaaatatggggaaatatttgaatagacatttctccaaagaggatatataaaaggtcaataagcacaagaaaacatgttcattatttttaaagaaacgcaaatccaaactgtaatgttatatcaacttcataccactaggatggatacaatatttaaatttaaaaaaaaacatagatggtgacagatactggcaagcgtatggaaaaattggaaccctcatacaaagatggcagtgattagtgtatcctctgtttctgtaagtttgtatattttggataactcatatatgtgagatcatgcagtatttgtcctctgtgattagattattcacttatcataatgcccaccagtttcatccatgtagttacaaatggcaggattaccttcttttttaaagctggatagtattccatagtatgtatataacacagtttttatgcattcatccatcaatggatacttaggttgtttctatatcttggctgtcgtgaatactgatgtaatgaacatgggaatgcagctattctttccagatcctgattgcaattcttttgcatatatacccaggagcacgattgctggatcatatagtaattatttcataaattttatgaaaatccttcatacttggtgtctaaacaccaagaagagttcagctgggctggttggagaggagatcaccccctggactgccaaactccaaacaccaggggaagatcatcttcctactacatcccttgctaagggatgtaaattgttcagtcaccttggaaaactgttttgcagttgctcaaactatcagacatgttaactttttgatacagacaggagacagggaaatactgggtaaagagtgtggttccctgtaaaggccccacactcaagcctggaaacctgcagccctaagcgggaaaaggcattcttgttttcccacccaaaagttgccttttggcccaccatgcccctctatcctgtacccatgtaaaccccagaccccaggctccagaagcagatgaggaagagatgaacggaagagcagaggaatggcagaacagcatggaagagggaaatgaaggagtgtctgaacacaaagaagagttcagctggggtgtttggagaggagatcaccccctggactgccagactccaggggaagatcatcttcccactccatcctctttcctgctcctcatccatcctgctgagagccacctccaccactcagtaaaaccctcacattcatccttcaagttcatgtggaccttatttttcctggatgctggacaagagcttaggatacataaagaatgctttcatactggccctctgctcttgtgaaaaggcagagggtccactgagctgtctaacacttaagctgtctacagatgacaaagctaaaggagcacactgtaacatgtgcccacttgggtttgggagtcacatactcccatccctggatgctgctgtggggtcagagcccagggaaacttgccctggctcctgaacctgcctgcctgcgtgttctccatcgtttcaggggtttgagcatgcatggcaatcgaacaagacgaggcacacccctgcaaggggaatcagggaactctctcgtttcattaagacttgcaattccactactaggtataagaggatgaaacatatgtccacacaaatacttcatatcaatgtttatagtggcattatttataataaccaaaaagtggaaacaattcaaatgtacttcaaataaggaatggataaacacaatgtagtataagcatactaaggcctattatttggtaacagaaaagagacttagtgatacaaactacaatgtggatgaaccttgaaaacgttatccgaagtgaaagaagtcacacataaaaggccacatattgtatgattctattgacatgaaatgtccaagtgacacaaatccctagggatggaatgtagattattggttttcaggaaactgttgcaaaagaaaggtggaataactgctatttggcaggaggtttcatttttaggtgttgaaatttcttagaatttttagtagtaaaagttgcataactctgtgaatttactaaaaacactgaattgaataaagagataaattttatggcctgttaaatatatttcaacgcagctgttaaaaagttaggaaaaattactcaaaggaaattaagaaagctctctttcaccccaggagcatttctacagttccagacatgcaatttctgctttaaacatctgctagtaaagtatttgaatacttgaagttcaaaaggtcaattccacagctatataaaggcagaaacagctggaaatagatgtcttcaattttattgaaaaggtaatgttaattggtattgcaaatatttgaatcagagaaaattgtaacaaatcaactagttaactgtgtaaaatatattgctacctccataatgtaagaagatttttaaatatataatttctattatctgatttaatttttctatttacatttaattttgaggtttaaaataagaagtgaacaattgcaaatttacaatcaagcaaataaaagttttcctttatttgtgccacaaaacttagcttttattattaaagatttccatgctttttaataggaaacatcctacaatgttgtttttatttacagccttatataaatataaaacaaacaatggagatataaagatacccattttggtagaagcaaaacaaaacccacattttttaataaaatgaaagaacagatatctgtactgttcattcatactacagtctcattcattctaaaattttatgaaaaatacatctgtaacctcttttgattcagaaaaacagaattcatttgcctaagttgaatgtgtggtttcctcagagcctccactataccataataaaagaataatgaagaaaatattgctatcctaaaaactgagctcacttccttcttttggggttgatcgtggacaggagcattttaatatcctaaaatttgctatgaaagaaaccattttccaggcttaatgggcatacattttgaatatcagctaatattctcagcaaggaagagcaattggcgaatttgtggcttatacttctgcttatgtttttatacaaagaactaatactagtttattggcctttatgccctgatcacaggtattagcatatgaaagtggtgaataatcttgacttcctgatgtggaatacaactggtgaaattcaaacctacttgtgaaattcaagaactgtttcacagatcaatcaccagtaatggcctgtgcatgtgcaacctgttacttaaacaaagaccgtgcctgcagttgaaaatgtaagcagaggatttatgaatttttctgctacttttcttactgtagacttgagctgttctcctggactcaattatggtatgtgctgaatagttaatactctaatataccaccaaacacagtctagatacttacagtcccataaaacgtaatgcttcaaaaaccaatgacataattgatttcctgactttatactgacttcattctctaaattttggggattcatatacaatctgatgatcttttgcatctgttttgcagacttaactagaattaggtttcagagaattcggcaatgtgactaaattttggagttattctctttttgatcattaatgctctatcccctgttgaaaggcagagtttactgcattacaagataattacctttagagggttttataaagaagcaatattttctagcaggaagttagtcactcctttcattaatacaataattaggaataatatgtcaagtgcaagattctgttgtatgaataactcttgttatgtggaatcattctagcctaaagaatagttttatgtataactttttattttcctttttatatttgctatattctgcccaaatagcattaagataggagagaaaaaggtaacacagagaggaacttcaggctatagtaactctttcactatttttgcaatttacgattccagtattaattgcaaaactctctctggagtcttgctctttaaagtaatatttgtggaccagcagcatttgcacaccctggaggattttaagaaacccagaatttcagatttgacctcagatgtactgaatcaaaatttgtattttaacatgatctcaatttataatattaaatgacaaacaccaatctacacatgtctatgtgtgtacatacatgtttgtatatgtatgtacatgtatgcatgcgtgtacatatattaattgcacccatttccatttctaaagataacttttcaacacaaacaataaactaacagtgtggggggaaagttcaccataatacaagaaggcaacaaggaagagtgtggctatcctcaccttctggcatttagaggtctctataagaaggctttgtgttgaagctatgtataaataagtgtgctgcttaacacaagtttctggggaacactatctcctttatgacactgtcttggggcattgttgagagagtctcagttttatatgtttcatctttataaaagtcaaacaggtggacgcacgatgttttttaactaagaattgtgaatctaagctttaattccctagttttcacttttaaaaagcttcaagtccccactctctggagtctcatctttcatacactatttaaataatggaatctaagtaacatttaaacaacactaactaagctattttataatatttattgaaggaaatatttaattatttcatgaatagtctgtttgatttatctgtattggaagtagatttacatagctcaacaccgattgcatatgtagtataaacagatgtaatgaaatatatgaaggtcctggaacatatgaaaacagtagttattataatgagtgtgcccatttaatatcaacaaaaagtctaaaatatattattatatggaatcaagattatagcatgactttattataaaattggctatgatatcaatgttttattaaatattgcttcagtacatatttgtaaatattttctccagttcaaaagctacattttctggttcacaaatattaatatatttgcttcttttacttctgttcaaaagtaagaacttttttaaaaaaaaaagtataagtaagcttttgcttaaaagtaagaacttttacagccattcatgactaagatttttaaaaactgagagcaataaatagtttctaggtgtattgatttcatagtaattaagataaaccactgaaccactgaagccatgcttccctctcattgcaaggagtaaagtagcaaattctatatttgagtaggcttcaaataaaactatttttgtaccttaaatttacaaaacatcttcagttggaaatgctaaggctttgcaaaaaaggaagaatatggaaacatacagaattcagccaggctataaagagattgatgaaaaacttagctacaactttgataatgtgtgtggtgaagatcttttttaatcaaatcagggaaaataattatgtaactgcctgaatggaggcattcatatctcccagtcaaacagaagtatactaaattgtatttggaaaacagagaaacacaaatttttcactgcaatcaagcgatgaaataaaatacttcagattttagtggtgttttaggatgtttgctcaaatcaaataattatatagccatatataaacagaaattgtgaaaatcaacattttataaacagtatggatctgtggttctctgatatcatagcaaccacaataatggcatatcatgtccatcagtgatgtagaaagaatcattctgacaggtgcattttgaattgaattgaaaacagcataatttccatcagttggcaaatgtattattatattgcacaacttcttcatgaaagggaattatacagacgaataagaagaattggcatagctctaatctactgacttgcagaaaaagccatgttttatttttaagtgacaaaagcaaatttcagagtaatgcgattaagatgatgctattcacgcgcaaacaacaacaaaaacaatatacagaagtttaaatgtatatgaaaaaacactatatgtatgttatgataaatgttgattgtctatagcaggaatgagtgatcctacaaaattcttctgcttccccattttattagtttgttctcatgctgctgtgaagagatatctgagactgggtaatttataaaggaaggaggtttaattgattcacagttctgcagggctggggaagcctcaggaaacttacaatcatggcagaaggggaagcaaacacatcgtacttcacatggcagcaacaaaaagaagcaccaagtgatgaggggaaagccccttataaagccatcagatctcgtgagaactcactatcaaaagaacagcatgaaagtaaccacccccatgattaaattaccccccactgggtcttcccacaagatgtggggattatgggaaccacaatttaagttaagattttggtggggacacagtgaagccatatcattccgccccaggccctcccaaatcttatgtcctcatatttgaaaacataatcatgcccttccaacagtctcccaaagtcttaactcattccagcattaacccaaaagtccaagtccaaagtcttatctgagacaaggcaagacccttctgcctatgagcctgtaaaatcaaaagcaagttagttacttcctagatacaatgagggtacaggtatttggaaaatacacctgttccaaatggcagaacttggccaaaacaaagaggctaaaggccccatgcaagtccaaaatccaatagggcagtcataaaaccttgaagtcccaaaatgatctcctttgactccatgtctcacatccagggcatgctgatgcaagaggtgtgctcccacagccttgggcagttctgctcctgtggctctgcagggtgctgctccactcctcgctgccatcacaagctggaattgtctgtggcttttccaggtgtaagctgctggtgtatctactattctgggatctggagaatggtggccctcttctcacagctctgctaggcagagcccacttttcccttccattctgctctagcagaggttctccatgaggactctgcctctgcagcaaccttctgcttggacatccaggtgtttccatacatcctctgaaatctagaccaaggttcccaaacctcagttcttgacttctgtgcacccacaggctcaataccgcatgtaagatgccaaggattagggctttctctctctgaagcaatggcctgagctgtacgttggccccttttagccatggctggaactaaagcagctggggctcaaggcaccatgtccagaggctgcatagagcaggagggccctgggcccagccaagaaaaccagtttttcctcctacacctccaggcctgtgatgggagaggctgctgtgaaggtctccgacatgccctggagacattttctccatttgtcctggtgattaacatttggctctttgttacttatgcaaatttctgcagtaggctttaatttctcctcagaaaatggggttttcttttctgtaagatgttcaggttccaaatattttccaaattttatactctgcttcctcttgagtgcttggccacttagaaatttcttctgtcagatatcctaaatcacctctctcaagttcaaagtttcacagatatctagggcagggccaaaatgcagccagtttgtttgctaaaacatagcaagagtcacccttattccagtttttaacaagttcctcatctccacctgagataacctcagcctggacttcattatctctatcactatccacattttggtcaaagccattcaaaagtctctaggaagttataaactttcccgcatcttcctctcttcttttgagccctccaaactgttccaacctctgtctgttacccagttccaaagctgcttccatattttcaggtatcttcatagcattgccccactattcagtattaatttactgtataagtccattctcacgctgctatgaagaaacacctgagactgggtaatttatgaagaaaagacgtttaattgactcagagttctgcatggctgggcagacctcaggaaacttaaaatcatggtggaaggcaaagcaagtacgtccttcttcacgtgggggcaacaaagagaagtgccgagcaaaaggggaaaagccccttataaaaccttaaattcccaaaatgatctcctttgactccatgtctcacatccagggcatgctgatgcaagacatgtgttccctgagaactctctatctctcgtgagaactcactctcatgagaacagcatgagggtacctgcccccatgattaaattatcttccactgggtccctccaacaacacatggggattatagaaattccaatttaacatgagatttgggtggggacacagagccaaaccatatcacccatgtttaactaattctgacaaatacatattatatctgcaattcttagtagaaatataaaaattgttcttaaaattaaggtagtaaaaaataacccaaatttaatcaagattttacatatagctactagtttccaggaatgggaagaatttaaaaaattattaaaaaatactgctaaagtaaaagaaaacataaataaatgaacacatatacatgtttatgtattgagaaaataattattgttaaagcacccatctctgcaaatttatccataattgttagtgtgcgtacattgacaagccaattctaaagtgaatttggaaaataaaaattattgggtaaataatacaattttttaaaagaagaacaaagttggaggaatttacattgtctgtttcaatatttatcataattaaaatagtgtctttctagtgcaaggatggacaaatgaaccaatggaacagaagagagattaggattatatattcagttacatgttttatggcaaagatgttactgcaattcagtggattaaaacatttaataaatgatgttagattagttggatatccacatgggaaaaatattgccttacacaatacacaaaaatttattcacaatgagtcatactcataaatgatatgtaatataatgaagcatgtaaaataaaacatagcaaagatcttcatattattgatcaagatttttgaatgtgacaaatcaaaaaaatctataaagccattaaatccactgaaaagtaaaatcagagatgtgcagaagagtcttgctgtctatctatctatctatatataggaattttatacagacacataaagatgtcccataaattaatgagaaaaagatatataatataatgaaagcatctggattcctgttttctaccaagacagaataacagggataaacttactctcttgtgttaaacaattagataaatacaaaaaaactagaacacaaaatactaagctatatgaagcagctaaacaactaaaatatattacagtaaaatatatccccccccaaatttcagttttttgacaattaatgctggactgtggtatctaagaaaaaagaaagaaacaaagtaagccctcattgtctccaggaaccagcttagtgcctagagaaaatttctaggacacagaaaagaaagggacaaacagagaatggcggtctcactgaattgattaatcagagattgtacgtcaggaaatttagggtagctagaatttaggatcagaggactagaaataaagaagctgcacaaagggagagctcatgagatctgcagaaaagtctccttaagactaacaactagtctttggctaaagtctgttttgcaaattgatgtgagaaaagtactcaaggccgggagggaatcataagacagcaatacaaacaatttcagagattatttcgggctcaaaataattcatgttccactagccacagtggaatcatgacacacaaacacaaacaaaaagtcaatttaaaaaagatagaataggtagtataaagaaacaatgaagagatgggataaataggaagcaaatagcaagatggcacattttaatttgagtaccttttaatttaaatatactatctcattagatataattagtctacacactaccaactttaatgtaaagatatatacattagctaataatgaacacatcaagtcatcttatatgcatgcagatataagagtttcaaaatatatgtctaggaatggacaaaatctagcttatctgtaaaactgtatctacataaaaactttaacaactattatagttaatagagtgatattgaaagcttttcctttgaaatacagaaggtgtcaaggatgatagctatcactacatctactcaacatcaaacagagggtctttggcagtcaaataagttttatgaagaaaaaagatgtgtaaatatagtaaataaataaagtttgaattatttataaattataaggttggatacacataagaaattcaaaagtcaaaataaattaatagaattaagaaacaaatttagcaaagttgtttgtattaataataagtttagaataaaatactaaattaaatgtctatatccattaataattaattaggacacaaaaagctttcaagaaggaataaaaaatttatcaattgtttaggcataaacctaaaggaataacctgctaagttccctattatattctaagtatttattcttattaaaaagaaagaaactaaataaatgtaaggattcttcttgttcatgggttggaagactcagtactagtaagttgttcattctgccttcatttatctacagattcaatgaaatacctaactaaatcatgacaatctgggggaaaattctaatatatatgtcagaaataaccatgactatcttaaaaaatgaataaactatgacaacttattgtactacatgttaataattattatgtgataattaagattaatgataatcaaataaccaataaaacaaaacagtgcacccaggagcaggatcatccatttttgatttatgacatatttggtactgcagagctcgtgaaaaagacagttctttccaaaataaaattctatgtcaattaaacgtatctgtgaaaaatcttgacccctgttttacaccatacatatgtcagtttaaagtgtgttgtaaataaaaatgtgaagtagaaaaaaaataaagattctagaagaaaatatagaagaatatctttacgtcaaatacttgaacaagataaagctttttttcaaatggtaaaaagaaaacatgaaatataagagaaactattgatacattgttgtacaataaaattaagatattctgttaatcaaaaggcactagtaagagagagaaagacaaaccacagtgttgatgtacgtatttgtgatatataatacaaagtccttgcatacagaatataaaaagctcttacaaattatataagaaaataagcaagcacaccactagaacaaaaacagggaagagacatggataggcagtttaaaaatatagagatgcaaatggaaaaaatatataaagaagttttcgattacattattcatctaaaaaatactaatcaagagttcagtggtcgctagagaaatcaaatccaaaccacaatgtgataccatctcaggccacttagcatggcaatcattaaaaagtcaagaaacagatgctggagaggatgtgaagaaataggaacacttttacaatgttggtgggagtgtaaattagttcaaccattgtggaaaagagtggggcgattcctcaaggatctagaaccagaaataccatttgatccagcaatcccattactggatatatacccaaaggattacaaatccttctgttataaagacacatacactggtatgtttattgcagcactattcacaatagcaaagacttggaaccaacccaaatgtccaccaatgatagacagactggataaagaaaatgtggcacatatacaccatggaatactatgctgccataaaaaagaatgagttcaagtcctttgcagggatgtggatgaagctggaaaccatcattctcagcaaattaacacaggaacagaaaaccaaacaccgtatattctctctcataagtgagagttgaataatgagaacacatggacacagggaggggaacattacacatcggggcctgttggggggcggaaagcaaggggagagagaacattaggacgaatgcctaatgcttgtagggcttaaaacctagatgatgggttgatgggtgtggcaaaccaccatggcacatgtatacctacgtaacaaacctgcatgttctgcgcatgtatcccagaacttaaagtataatttcaaaaaaaaagcacatgctagaatgtctaaaattaaagacaaaagtgtcaggaaggatgtagtatgctgacacacttctgttgggactgtaaaattgtacagccactctgggaaactatttgaaattatttcctaatgttgagtataggtcaataaataggtaaattagcaaaagataagtacatagtagcataattagtagtaatccccaactgggaaaaagtcaaatgctcatccataattgaatacataaacaaactgtgatatactgaaaatggaaaattacaaaatgaaaataaatgaattacagatacacataatatgaacgaatctcaaaaacaagatttatcaaaagaagccatatataaggatacagactgtataatttcattgatgtaaaactcaaaagcagctataaatattgtgtgaaaactcgggttagctgttatctttagggaagggcaaagggtagtgattaggatggaaatagtaaggcagctcctgagtgccagcaatattccattgcttgattcaggagggtagtcatatagcaatttgcttcatgataattcattcatctgtacaattatattttataaactttacattatgcttattatacctcaaaataaagggttaaataaaaaattaaagtattatctgctttaaaataaatacacatatggtaagaaaaaaaattcctgttttaaaagcctggaaataataaacaaaatggaacagaatagagaacatagaaaaaaacccatgcacttacagaaaactgattttcaacaagggtgccaagaacacacaatggggaaagaatagtctcttcaataaatggtgctgggaaaactggatatccacatgtaggagaatgaagctagacccctatctctcaccataataaaacatcaatgcaaaatggattaaagacttaaatgtgagacccaaattgataaaaacaccagaagaaaacaagggaaatttttcatgactggcctgaatagggattttttgaaataaaccgaaatagcagaggcaacaaaagcaaaaatagacaaatgggattacctcaaactaaatatcttctgcataacaaaggaaacagagtgaaaaacatccttcagaatgggagaaaatatttgtaaactatatatctgacaagaagctaatatacagaatacgtaagaaactcaaacaactcaactccaaaaaaaaaaaaaaaaaaaaaccctgaagagaccgttctcggaagaaggcataaaaatagccaacaagtatgtgaaaaaaatgtttacattataattatcagggaaatacaaattaaaaccaagttaagatatcacttcaacccaattagaatggccattaccaaaaagaaaaaaagtatcaaatgctggtaccaatatagagaaaggtgaactcatatcctgttgatgggaacataaattagtatagctaatatgaaaaacagttcatcacaaattaaaagtagaattgccatacgatccaacaattgcactattgggtatatatgcaaaagaaatgaaattagtgtatcaaagagctatctgcactcccatgtcttttgcagcactattcacaatagctaagatatgaaatcaacctaaatgtccatcaacagatgaatgcataaaaaaatgtggtatgtacacataattaaatactatttggccaaacaaagaatgaaatcctggcattgtggcaacatggatgaatctggaggacattatgttaagcaaaaaaaaaaaaaaaaaatgccaggcacagaaatacaaataccacttgatttcactcatatgtggaatctaaagaagctgatctcataaaggtagagcatggacgagtgggtaccagaggctgaggtggccagtggggagggagagataaggagagatcttgtcaaagggtaaaaagttacagttagataagaggaatgagttctggtgttctattattatattacatgcatgttctttacagatacagctgcaaagactgcaacctcctattgttaatttgtgcactcccactaaaaatggatcatctgggccaggtatggtggctcatgcctgtaatcccagcatttggggaggtaaggcaggcggatcacaaggtcaggagatcgagaccatcctggacaacatggtgaaaccctgtgtctactaaaaatacaaaaactagctaggcaaggtggtgcgtgccagtaatcccaactactcaggaggctgaggcaggataatcgtttgaaccagggagtcagaggtcgcaatgagccaagagatgctgccactgcactccagcctagggacagagtgagattctgtctttaaaaaaaaaaaaaaaaaaaaaattcatctgattgtaaattccttgtaagtaatctagcagaggtagtcataaaatcacctccataattctgcttccactgcaatgcactgagtcattggaatggctattttctttttatgtaaaaataattcctgatacttttatgaaaaaattataatcttactctttcatctcatgtttcttctccttgtaaatcctggagaatagttaacacatggacatatcacagcaggagagtagtgcatacatggggatcatttagaagagactgatatttagaaaaatgctttagaggcagcctgacttaagaagtgcaagactgctatgaatagtcaatgaactcctataaatgtagagcccatgtcttgatcattactttctttatagtacttggccacaatacttagcacacataagaattcacttagtgttgaatatattaatgaccaagagataatgttcatttagtacatcaaaacttggcttgtcctacctcagttgtgggaataagtaaaaaccacaccagcttaaactgcaaaaagcaaatggcttgaccttctttgatcttgtagactccctgaaaaataactttgcatgactgcaactgtcttctgaaatgattggctaacgctctaaattcagaagacttgaactttttacacaaaatttaattttatgttgttaatctataagagttaatcccctatttcataaattttataataaaatttttctacatactcatcaaattaaattgcatactttctaattattgccatgctttcaaatgaagttgcataatattttatgcaaatgataatgggactaataatcaaaagagccacattctatcaaatcctgccatgaattcttaagaaaatgagtttatttgcctgggaccttagtctgtgtttataaaataaataggttaaagtcgatcaaggttttctaaagtgatttttttaaagcctcttaaaagttcacaaaatcaattaagtggttaacatcagcatttcagcatttttaaaataagatggaagggaaggaatattattatagggtatcacatataaggataaataaagtattatgagaattatttgcaaattctaatgtgtgccagtgtgtatattgcattgtgatgaaacatgcctttactgtggactctattttttttaaaaaaggcactgggccagccaacttccaaagttgaccaattccgatttgcagattctatcagttttaatcaatcaaatcatttttgcttcattcatcttataaaaaaacataagataaattatcatatgggaagatgtacaaatgttgacaccaaataatgtaagacactaataactttggattgctagctatcaataataactttgtgtctttagacatttatgttcccagaacactgtgatattccattcttgagatactaatttgctatttgttgtgtctaccggttcatttccctgtgtaaagtataatattgttattattgggaggtcatctttatttgaaagtgctttcacaagcactttctttgtctgccttgactctggaggaggcaatgactataatttcacttatattttctttctagattccaattccttctacatattgatagtttctcacaggtaacccttgtagcataaaaataacaaactgctgtgttaattcctgagaagaagcatgaagtatttctatcccttattcaaagatgctgcagcccattggagctgcaagttttatgttagagactccctttcagatttcttgctttcttggaaaccagggcaatacttcaacccccaggtacctgggtccttacttaaaaacaaaacaactgagccctcagttttggcatccttgtctccactttctgaattggttttgattttgctcctttttttctagcacttaaaattctacattaaggaaatttttttcttttgaaaatcatatttatttagaatttctgtgtctgcatcagttgtgctactctgccatatcagctcaagtttccttaaggacaaacgtcaatcttcaagatttttttaagtgaaggtttcattactcatatctactttttgaaaggtgactcacttccagttcaagaagaaggactagattggttgtctctacttcccagcataaattcctcatgaaaaaagaatgtattgttaaagtacataattatcaaatggaaaaggcccaccaagtcccagttaggataaatgaccaaggaccattcttagactatcagggcaaaatttagaaccctggagtaaggaagaaaaattataaaagcttcctaatgaaaagtaacagactatttaaataacaaaaaatcagattcgtctcagctttcttatttgttacattgaacgtaagatgacagtggaatgttgtcttcaaagcaccattgtaaaaaaaatgaagttaaaattttatacatttatagatataatgaaagctaatctatcactaatttgtaagggagaaaatacagatcttcggaactgcaaagacaatgaacatttaagcattactaacggatgtattttagcaagaaaaatacattcagtaagaaatgggatacaggaaataaacactagggaaaaaatacctactattacatgtaaaattgatgcttaaaaataaaagtttgaagctaaaatctcaaatgatatttttaaaaattatgtcaaacttattttttcatccaaagagaatacacatcagtcaaaattaggttgagttgcacatagcagtaataagtaattccaaaggacagagttatctttctcatgtaaaataattgtcttgaggtaggtgatccagtgctaatatgatgactccactattatttatgtaacatttatattaaacatttaatatttaaacatatttttccatcaacatggaaaattaatcagcaactataacatttccttccaaataaaaatgctttttgcaagctgtcactttcttcctcttccaatatcccatattttgttgaaatcttctggagttttaatatctggtttttattatattttcaatatgcttctactttcatagatgtaaattttatagattgtcttaaggtttacagccacaccttcaactattaaatatacttaactataaattttgctggtttatttgttcaacaccgttttacatattttgaaagttcaatagttcttgaactcaatttttttttatttggtaggaataactaatttggtgtttcagaaagactttcgtatcatcctgcaaattggaaaatgtcatgagcttattctcaaaagcgaatgatatttttgaaggacatagagttttacatttatacttttatttagaaatttaaaaatatttctccacttttttcaaacaccctgagttgcaaaatataaatctgatgccagtctaattctaatccttttcacagtaatcaagtacacttgattgtttacttttgtttgtctcttttctgcagagaaagctattatgaagcttttaaaattctggaatacttaaatttctacactaattctctaggtccttccccattaataccaccatgatcttcagtacttatgggactgttttcaaagcttaatgctttaatcagctcagaaaaattttatttttgcatttcttcttttgcatgtcttttactttctttttctacaactcctattggataggttgtccaaatttaatttagtaatctcatctctttatctttttacagtacatttaaacctaagctattgactccatgtaccaatcaaagattcagctttcagctgtttactctaatattgagtctgttcaatttttttctttgttgtataattacttttaaaatttcggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaatttcacccacgtttttatttttcattgctctaattgtttcatttttatatgagaggagcatataagctaaatgcacaatttaaataacagtggctttgattaaacaaagtacaaattttattttaccaaactttattttaccaaataatatattccattttttaaatcgttaattgaaagtatagcccagacttcctcacttctttgaaatgctatctttaccaattactatattttaatgagccagggacttgggaaggactttttttgctgttgcaattatgtatatacctatccttgcatcagtgatccaatacttgaattatgacaggtttataatgtaattaatacccatacaaaaatattttttcagcattttttgctattttcaccccttacctctatcctcatatctaaattattttcagttgaactcttgaggtttctgagtaattatatcatctttgtataaatgtcgtataatttttcctatagcatacaaaaatcattataccctccactgtagttgtaataatgttttttttttttttttgttccctagatcctggcttcaataggaagacctttgattctttatcaagtactcagttgtatcttcttaagaaacattctcttcacttttaagatctttctattcctgattcgaggtaaatttgttttctttgtttctctttgttttttaatctggatacttgttcacactccatagagattatcaacattatttctcttatgaaatatagatatatgagttatattattatactttttaataaaaaccatttttcataattttaataaagtttaatgtagtttctttggtcacaacttactatatattatgggtataaattgaccttaatttactgctgatgttctttatctttacattcagatatgtttacaaaataaaataatgagatcggtcactttttaatttgtaatacttgacatttaatttcacaattttttttttttcttttttgagacagagtcgctctctgtcacccaggctggagtgcaatggcatgatctcagctcattgcaacctccacctcccgggtttaagggattctcctgcctcaacctccctagtaggggggattacaggcgccagtcaccctgcccggctttcacaattttattagtatgagtaaaatgttcattttttatcctatgcaataatgtatatatatatgacatagaaattgtgtatttctttaaagttttagataccttaactgttggaattgttgaattttacgacttctatttaatattttaataattactatcctagaaaatatttcagagagcttattttaggctagagatatttatttttgcttagagtatatcttgaactattaaaattagattcttaattttctattttgtatatcctgcatatgtttgtgtataattattttacccaaaagtgaacaccgaatgatgaacaataaagtactcatttatatcctcttatgagtcttgctattgaatgttttatcagtttcaaaagaatttatcagtcaaggacaggactgttaaccatgtttatattcctttcattgattttcctttaattaatctatgtaccataaaattatttatatccctcatttctattttgcaaagggtttaattaaaatatctcaatattcttaagtttttttcttaaaaatcaccattatgaataaactttgagtaatgacacttccctaacctggaatatttgggattatttagcattgtttattttaatagcaaagcattacaaatagtgaaactgttgaactttcattccatcaccaatgatcaatcttaatatgtattccttaaatcatgttgctacctggctaatgagtatcatgtctttttacaccggattttattactacaaatctgttttcttatgtagtgtttgtaactattgagctgtacacagactaatattgaatagcttataaaataagactttaaaaatatttgtatcaatctgttgaattgagacattttctttattttgtagaatatatggtgctgcgagggcaacttttcaattctttagcatgcagacttttggaaaacttaatttcttaattgtaatgtaagctacatacttttggaaattttaatttttttatttcccacttattagttatgtaaagtcaacttttccatttttcaactgttctcccccatgtaaacataaatgacccactataagaaacagttttgctagttttatgagaaaaaccaacatagtatacacttttccctgccttagtagccaatttgaggaaagtaaatggccatagactccaactgatagatgcctcagacattcttaagtgcgtacttataagacaaatgtttaatcatatgttatttgctttcccataaaacgtttatacttcaacttgtacctcttgtaatgattttcttgggcaacactatggaatacttgtgagatctttttttttttttttttttttttttttttttgatacagagtctcgctctgtcgccccggctggagtgcagtggcccgatctcggctcactgtaagctctgcctcccgggttcaggccattctcctgcctcagcctccgagtagctgggactacaggcgcccaccaccacgcccagctaatttttgtacttttagtagagacggggtttcaccgtgttagccaggatggtctcgatctcctgacctcgtgattcacccgccttggcctccggaagtgctgggattacagacatgagccactgcgcccggccgtgaggttttaagatgctgaatttagactgaaataattatctgcaccatgcacaagtgggtcagccttggaagagaaaaattgcactgccagctttgagtaagaccctagaggcaaggaccagagcacatcatgtgggtcagccttgtttggttattttcaatgaagttcttcggctgttgttgcctaaatttccattaggttgcatcttttcctaggttaatagctttagatatgctcagtttctaaaggtaagtcctagacaaattttaaaatgtctacagaggactttcttttttttctttctttttttttttttttttttgagacggagtcttgctctgttgccccaactggagtgcagtggcctgatctcagctcgctgcaacgctcacctcccgggtcaaacgattctcctgccttagcctcctgagtagatggaattagaggtacatgccacctctaatttctttggctcggcttatttttgtatttttagtagatgcggggtttcgccgtgttggtcaggctagtcttgaactcctgacctcatcaaaactcattaaaagaattgtacataatcactctctaattcctcttctcttatccattccaaaacctgctgtacccaagctttttttctgtatattacaaacaaaattggttttgttaaaggtaaccaatgaactccatactgtgaatctcatggtgaattctgatttaccaagtgtcctatgtatcaggagtgtttgacacagcaaatcaatcattcaccttcaaacacttttttttcttactttacttccaggatgtgagtcttatgttcttgtattcttccctggaaggcttttggaattattatcgtctatgcctgaaattgtctcttcccattgctcactccctcatctcaaccatgtctttagttagatgctatcttctcagctaggcctacctggatctctctttaaaatggggttaaaattggattcagtgtatcaacaagccattgacaatctcacttactgggctctgtatttttgttttagtttcctgcctgcttccatgagaatataaaactccacaaggactgagatttttatctttttgctttactaatgtgctaccaaccccaagaaccactcatttcgtgtaaacacactcagtaaatacttgttgaatttaaatggttgctatttaagatttttttaatcatgaaaatgaaagtagttatatcttcacaaaagttatttaattggtgaatgaatcacaccaacttcaattttcttgctctcagatttctacgaattagttttataaggcttcaaagttagttacagatgttatcttgaatctgacctacatgagtgtagcttttcttgatcctttctcttgactttaactatatagtacttgcattgtttcacaagaaaaacaggacaattgtcacagaaagaaagaaaggcctcaaaataaaacagtcatagcttcttcatagaaccaccatctcatattttagtgcctatacagtttcaattagttttatctatattttctgattgatctccttctgcagtttaataagactgcataaggttcactgagttagaaagctttacaaaaataatatttacataaatctattatttcttgtgtggtggtggttacatcaaattatttccatcaaaggtcttcgtcattcccaagaatctatttaaaagaaaatatgtgtgtgtagctatgtatatgtggtaatgtagctatctagaaacagatacatgcacatagttaaattactttcacttttaggttaacttctcagaaaaattgctttgccaaataatctatttaaattgttaattttacgaattgcttacaaatgaaaatttctttggcattcacagtgaagagtcatagtgactatacagtagctatgaaatcttgattgggaatgtcaactttatcatgaaagaaactttttctaaagagcatagattgttgagaatgactgacttttccagatgcatatattgcttgagactggcaagacagtataaagaaaagttatttgactcttgtcagagtgatgaatttgaacaataaaaaggaaaacataaaagttgacatgggaaatatttggaaattttcagcaatctcgttaaaagtgcatgttgaacttcctagtaccttctgttttacattcatgtccacaggaaaagccatatttccatgtcaggcaaatgtatcagattaaaaacagttcatctacattatgtaaaatacatttttttcagcagactttgcttttccaaaactccttgccatttagttccattggcactgaaatgcttacgtattaaatgtctcataatttgaagggcacataactaaaatgatgcgtccatgatttactagtaaatttataaagctgactcaaacaatgttcctttgccaatgcaatacttatgccttagaattacttcagtttcacaatattttatcagacatataaagtaatgttctctagtgaattcctgaaagtgatttcctagactcttaattttaaattactttcactcagacacacattcccagacaccaagtacaggctatagttttgtttttcaatcagcccaagacaattttcaaaaagtgtgtcaataaactgttgagatctgagaaaaaataatacctaactagatcaagtatttacaaacatgagatggaagaataagaatggttaattctgcatacatgtatatatacataaaaatacgtatgtctataatctgactgctcccttttcatatcaatgtgctttcattacctaatctttcacgtcttattgtctttgttgtcaggcatttcttttgcaatgaaaatctgatgctcttgaaatttacttgtgattcatattattactttttttaaaattctttccactaacccattagagctatgcatattcttttcatttttgctgtgtaatttgttcaaagaacaggtcaagtctatttatccctaattgagaataaatctgtctgaggcagatgtttggcaaaagtagtgtgagtgggttttcgttaggtcttttaccgttcttagaaatgctgtcagcatctgccagtcagatcataaaccgtagaaccatgtgatgtagttctagattatcatttcaggaatcccacagctctggtggagtgaggagcaaggagctgggagcataagccatcctaaaagtgaggtctacatgatttctgtcctgtccggcatttgctaatgctgctgagccagggaccagcttttcatagttagttttcaatgtaccctaggatctacgctgggccccaccgtgcctgagactgactggctttctctccagtgctgttgcctctttaactgaagagttcctgctccattacgaaaggactgtgctccattgggaaaaattaaaatgtagtcattcaaagaggaaaatctgcatgtaaaaggaggctctgcaaccaaaagactctggatttgatgtagtttggtacagatttcaacaagtgttgagaacctccattggaaagggggttttaagtgaaataacaccttcacttaactagaacttcagtttttaagcctctaaaatgtaggataatcagcaaattctgccactatttttacctgtatttcatgaatttcatttattcattgctgtgttttattcattaagtgatttagtaaataaataattattaattgaattacaactatgttctaggtaatgcgatagtgagcaaaacagaccaaatccctgtcctcaagttcttgctttctaacaggaatgttaacctactttcttaggaaagaaagttataagtcaactataaattatgtcctttaatctggcaccaatttacctatatctagtaataaacagtaaaattttattcaccagacttttatattgttgtagtgataatgtgagagttctttctctttggttctttaatcatttaaattgtttgtggagaccttattctagaggaatggacttcaattttttcagaagggagaacaaatattatctgaagtaagtaaaatatgtaggatatatagagtcattttctggacttcactgggggaaaagttaactttctcttctcacaaaaaacaattctcacgctgttcctttcattttcctgtgacccctttttcttctctatggaatggcaattcctagcacagatcagagattaatgcagtttagaaaaaaataagaaaaagaaatattgaggcttaatgttttgaatataaaaataacaacattatattttctactaaaattacattaataataacataatattagaatatgaatcattttattgacaaatgggtctatagtataaatatgctaattgctttgataagatatatttcaacagtgctatgtaagaatagtgccagttcaatatatgagcattcactttcaaaaataacactgataattattggccaagtaaagttaagcatcaaaaataaaaactatcctgaaaaacataaaaattatttaccaaaggagaaaaagcaaatgcccagctgcaaaaaaatccattttacaggtccaagccaatgtcaacgctgagatctggaaattaaagctgcattatcttgaatcttttataaaagtgtcatgagacttctggttctgggatagactatatacaaattattttttaacttagacttgactcatctcaagacacagagttacctctcgttttttttttaatggaccatatttggcaaaatgaagaggaggcctgtgattagcatatcaaagacaaggaagtaaaatcctccagtgcgggatatgtagcatcaataaggaagtagcaagtacatctaaacttcacaaaaatcattagcagaacagaaataaatgggaagcaggaaaaccatcagtgtggtgactaagacaacttgctaataactgaggttgataaaacgcatatgtatagatgtaaactttgttttgaaaggaatttgggatgggggtgatttgagaaggaaagccccttgtcttatctattgtggattgaatctttcaaggtgaagctattttaaaaataaattaacatacgctgtattatttggataacagaatatttatgtaaagttactttaaaatgctttcatggccatcagctcacttgagagttttatgaggtaaggcaggaaaggcattattatcctgagattcatgaaagtgactgactgtctagcaagaattggaacagagatcccaatctaaaccttcactgcatcacaatgaaattttcctgatatggtttggctctgtgttcccacccaaatctcaccttgaattgtagtaattcccacgtgtcatgggagggacctggtgggaggtaattaaatcatgggggtgggtttttcccatgctgttttcatgacagtgaataagtctcattagatcagatggttttataaaggcaagttcttctgcacatgccctcttgcctgccgccatgtaagatatccctttgcacttttttgtcttccaccatgattgtgaggccccccaagccatgtggaactgtgagttcattaaacctctttccttttattagcaacatgagacagactaatacaataccttcatacatatgctaatgtgtttgtaaacttaatatgtaagtattccttgtatttggaaaacacccttagattcaaattactctaggagcaaaaatgataaaaaaatataagcaatattaggtattttggggatcttcatgagacctaaaacagtaacaactacctggaattgaaaacttaaccaggcaaaggaatcacaagaacaccaaagttacatgcaaactcacctcccttttcatccctgctcccctcaaaaaaatgaatccaatctttctctgacttattttttttatgaatacatactaaagacttatttattcctgtgttctaaaatgtaatctttttaatggtgtcttacaatctgaaacttgatgtgtttaagtatagaaacttttattttctaggataacttatctcctaacacttctattgttccctccttccctaattacaattagactgattttcacttctctaccccattttgtgtagcattttaacttctatttctacttcaggattatgcctcagctatctattttgagtgtctcactaaatttttatatatctgcttacatgctttaatttccagggctataatttactttttgattgcttctttgcaaaaacgtctgttcttattgcatgaatacaataactttcaatctttgtggggtattaattataaatatttgccatattctgcttcttctattattttttcttctttttgttaatttttgttactgtaattcgtacgtgaggcttttcttaaatgtatttgattttgtgttttgtattcatactttgtatcctgcagcacatccaaaagctcatccaccacgatcaagttggcttcagcttggcatgcaaggctggttcaacatatgcaaatcaataaacgtaatccattacataaacagagccaatgacaaaaaccatatgattatctcaatagatgcacaaaaggccttctataacattcaacaccttttcatgctaaaaactctcaaaactaggtattgatggaacatatctccaaataataagagctatttatgacaaacccacagccaatatcaatatatttgggcaaaagctggaagcattccctttgaaaactggtataagacaagggtgctctctctcactattcctattcaacatagtattggaagttctggccagggcaatcaggctagagaaagaaataaagggtattcaaataggaagagaggatgtcaaattgtctctgtttgcaaatgacatgattgtatatttagaaaaccccatcgtgtctacccaaaaacttcttaagctgataagcaacttcagcaatgtctcagggtacaaaaccaatgtgcaaaaatcacaagcattcctatacaccaataatagacaaacagacaggcaaatcatgattgaactcccattcacaattgctacagagataataaaatatctaggaatacaacttacaagagatatgaaggacctctttaaggagaactacaaaccactgctcaaggaaattagagaggacacaaacaaatgaaaaaacattccatgctcatggataggaaaaatcaatatcatgaaaatggccatactacccaaagtaatttatagattcaatgctatccccatcaagctaccaatgactttcttcacagaattagaaaaaagctactttaaatttcatgtggaaccaaaaaagagcccatatagccaagacaatcctaagtgaaaagaacaaagctggaggcatcatgctacctgacttcaaactacaccacaaggctacagtaaccaaaacagcatggtactggtacgaaaacagataaatagaccaatggaacagaacagaggcctcagaaataacaccacacatctacaatcatccaatccttgacaaacctgacaaaaacaagcaatggggaaagaattccctatttaataagtggtactgggaaaactggctagccatatgcggaaaactgaaactggaccccttccttacaccttatgcaaaaattaactcaagatagattaaagacttaaacgtaagacctaaaactgtaaaaaccctagaagaaaacctaggcaataccattcaggacataggcatgggcaaagacttcatgactaaaacaccaaaagcaattgcaacaaaagccaaaattgacaaatgggatctgattaaactaaagagcttctgtacagcaaaagaaactatcatcagagtgaacacacaacctacagaatgggagaaaatttttgcaatctatccatctgacaaagggctaatatccagattctataaagactttaaatttacaagaacaaagaaacaacccatcaaaagtgagggaaggatatgaacagacacttctcaaacaaagacatttatgcagctaacaaacaaatgaaaaaagctattatcactggtcattagagaaatgcaaatcaaaaccacaatgagataccatctcacaccagttagaatggcaatcattaagaagtcagaaaacaacagattctggagaggatatggagaaacaggaatgcttttacactgttggtgggagtgtaaattggttcaactattgtggaagacagtgtggcgattcctcaaggacctagaaccacaaataccatttgacccggcaatcccattatatacccaaagcattataaatcattctactataaagacatatgcacacgtatatttattgcagcactgctcacaaaagcaaagacttggacccaaaccaaatacccatcaacgattgaatggataaagaaaatgtggcacatatacaccatggaacactatgcagccataaaaaaggatgagttcatgtcctttgcaggaacatggatgaagctggaaagcatcattctcagcaaactaacacaggaacagaaaaacaaacaccacacgttctcactcataggtgggagttgaacaatgagaacacatggacacagggaggggaacaccacacactgtggcctgtcagggggtggggggctggggatggatagcattaggagaaatacctaatatagatgataggttgatgggtgcagaaaaccaccatagcacgtgtatacctatgtaacaaacctccatgttctgcacatgtattctagaactaaaagtataatacaaagaaaaattaagtactacaaaactgtttggtctttccacatatatgagtgatcatctgcactattcaacattgcactggaggcattagctggcaataagaaaaaagatcaattagatacacaagaaatataaacaattctataagaagaagtaaaacgattgcactttgtagatgctgtgataatatatatggaaaaccccaggccataaaagataaaactaacacaagtaatacaataatttattgtgaatatatcatgaagctagctataaaataaacagtcagaaagcaaatagctctcatatacgcaaacactaaccagttagagaagaaaatcaagtttataaaaacagcaagatttattaaattgtttagaacagagtgaaaaatgttataaaaaaacttttaaaaaatgactgaaaatgcaaagtcaccctatgttaatttaaaaactgaattaaatccaaactaaaacactttgttatgttttttatcatattagacagtttgacactaaaactgacatagaaaaactaacattcaagaatagtcataaaaacactaaaaccaaaaactatgatggagtactagccttctagacattaaagcatacaataaaactttagtaattgaaataatatgttatcatgcatgaatagacaaagcataattgactaaactccagtacctatggatatttaagaataaaccttagtacatatggatatttaagaattggtaaaggtggcatctcatattactgaaacaaaaatggagtttaaaaaaatatatagcaacaaggcaaatggctaccattggaaaactgatgaaatcggatgcacacctcacattatacacaagaataaattttaaatgtttcagagatctaaatgtaaaataacctctgaaacaatgttatgcaacaataatgaaaccatgcaaatactggaagaaaatatgggtacattctttgataatgagtgtaggagataagatttataaatatgactcgaaatccagatgcaatgaattaacagattaataaatttgacaatgtaaaatattttaagaaaattctcctttgcaaaacacaaaatcaagaaaggcaaaaggcaactgaaagactgggagaaatttttggcactgtatatcatatataaagagttcatgtcattactatataaagaactcttatatgctgaggtaaaaacagatctatccaacaggaaaaaaatgggcaaagacataaacatacaattcacaaaaatatatattaaaatggtacttaaatatatgaaaagatgttcatttcaattatatttttaaaaatatatattaaaactacaagaagatattatttctaatatatcacagtggcaaaaattaaaatttataaaaataaattcctgataaaatcatcaaaatgtaggaattctgctggaatagctgtagggagatagggactctcacaaatctacttttgatcctacaattttcacttattggaatttaccctgaagatatacttccaacaatatttttctatattgttggacacaaacaaagttattcattacagcattatttataattgaaaaatattaaaaataaataggtatacacgggagagtgaataaactatggtacacataaaaaagtacaatagagctagataaaagtataaggtatacatttgagaactaatacagagttgtttacaaaatatatatttcccagagggaaatgcaaagggcaaaagaatatctttagctttatcttttctgtaagaaagaaattttatgtcagtgagacaggatttttcttggcccctttgcccggctcacatcaggaggtgccctggctactcagctggctgggccacatctagcttgcgctctggctggcggctcccacagccactgcagctgcctactcagcccctgatgtggggtggggtgtgctccatgcagggcttgctgctggaccaggcatgctgctgtgaggagaacgcagtggtgcccagacaggggtgctggtgaccctgaagccctagaaggagtgttgtaacatgctaattagctcttttagtcccaccgtctgcagcctgagggatggtggcatgttaacagttcagtcagccccttgcctcattccagcctgcagcgccagggctggctcagccccattgctgcttcttgttacatggggtggctgccctccactggtggaaggcagagggtcacagcattacacccttctgagtacccacatgcagtgggttctgagttcttgtcctgtgtccaagaagaaagaggtcatgctgacaattgaagggtaacaagggtggagaactttattgagcaacgaaaccgctctcagcagagaggggatgggaaggtggtctctcacccaaagtcgggttgtctcttccagtgtgcctgagtctggggtttttacaggcacaggatgtggcaggggcaggttgtaggtagcattggaaaaggcaacgtctgattggttaaaaagcattattcagaaagaaccaagagagaaagcgtgggcaaactcgaacagaaattctcactctaggttgtggagttcatccagaaccaacagtcccttctttcaggcttcaggctgttttgaccttgaaggtgcagtttcacctggaatctgcccctggaatctgcccctatctgcctaggcatttgtctgcttcctgccactatcataaacatattgtatgcttttaatatatgcacaaaaatatgtatataactatatatatttactcatttgtgcaaaaagatataaatagaaaaagttaacagaaacaaacagaaacgataaaccagaaatgaatgaggttggttttctgtaagaagtgaatagaaatggattgaaaaagatagactaaaatgagagagaacggagacaagaaagtacatttaaatataaatatgtaggatataatgatctgagatgcattttaaatcagccactctaactacttattaacagctttgaagaaagatttctttaaggaaaggctttaaaactagaagctaaaaagaattttttggattatctgtggattttatttcatccttgataagcatgagctccgtgtcctctagggatacaaatgaacaagtaaaactctaaaagtcagaagtcagtttcttcaaagctggctgtattttagatttttcaacagatttaatttacaatattttctaatatctgtcattgtaagttggttatattgaggtacaattttctaaatttatttctaaaaactacaaacatatataaatgtttgattacgtaaaggagattttcctcaaaacatttttcttttcatacagtctccaaagagatagtaacacgcaaagtttgcgattgaggtagagaccaaaaaacccacaaccaaaccaaaacagcaagatttctgatcagggcctattggaggtaaaagagccaaatttcttgagaggagaataatgttattcaagaagattttctaaataaagatggttaggccaatgataaaaatggtaggtatttttttgaaccagttttactcttcttagaatttaaaaatcaagccgttcaaattaacagttgcagtgttaacagtgaatgcctgttaaaatgaagcagttaatcaccaggaacagcatattaaaactgttaatttgtaggtttgaaacttccctttaattaaagctgtaggaaaagcttcctgttctaagcaaatctgagatctcacggcctctgtcatgcttgtgaaatatcacaaagaaaagctcttttggaggggagggtcaaggtgatgatgaagggaaatctgagtgcttgatttgaaaggattaaactttcttcccccttagcctttaaaaataatctataacagaatagcaatacttttgatttctggaaagtgacaaatgcaatcagactgcataagtattctacagagttagtgggctgcatccagatgacacaaatattagaagagaaagaaagaagaaggcatttctagaaacaaagtctaaaaagctagcatggctgggcttggtggcttacgcctgtaatcccagcactttgggaggctgaggcaggcggataacttgaagtaaggagttcgagaccagcctggtcaacatggtgaaaccccatctctactaaaaatacaaaaaatgtgccaggagtggtggcgcatgcctgtaatcccaactactcaggaggctgaggtggaagaactgcttgaacccgggaggaagaggttgcagtgagccaagatcatgccactgcactccagccagggcgacagatcaagactctgtctcaaaaataaataaatgaataaataaacaaacaaataaaactagcatcacagagtgagattttgggggtagggagttgttgataaccatatatttgaagttagtaggttttgatccctgagaccagcttcctagaccactgcctctccgattctagtactacatgagggagatttgtgaaacattgattccaggaccattgctaatagagattctgatttagtaagctttaactgagccgggaatctccatttcactgtctatcccacaagttgttcacacaggtgcttcagaggctgactttgagatatgctttttaaaaaaaatttacaccctcaagaatgctttttcctcaagaatgctattctggtgagttctctgtatggatgaaaaaaacagcagaaaccagagggcatattagaaactatagtcataaataaataacagttacaactatcatgaaatttttaagtactaagaggtggaaataataaggaaaatagataattcaatttctaatgtaggtatgtttatactaaataaaacatgtgttgtgaaaatcagcatcaaaaaagcagcaaccaggataagttacatcgaatatcctcatactatcgactctaaacatgggcttctaattctgtttacaaataaatcaaaagcaatgactagcatgtattttctacagatactagttatgttgaaagaacattgaatatactaaattttaatagttgcaaagcgctatgcaggatctacaattaaactaatcattttcaaaatactgaaaactgatagataatatgaaaaacttttttcaaggacacaaatgtatcatttgctggtaccaggacttgattaattgcttaccttattaaaaaatacaaagattttgtgtatatgcatgttgagcatttatcactcattctgtgcctggccagatgacgtatttttagatcctcagatctagcacaatttaaggtatatatcagacagtatgtaaatgtttcttgaatgagatcactttccattaaaattttatattttaaagaaaatcatgaaatattatttttaaaataaaacatgatttttattacttcccacatgttgcaacccaactaacatacctcaatatgggcatccaccttggcagtgatggcaatgtaggctactagctaaggatgcaggctctgggtctgcaagacttgattgctaatatttacagactatgtggtctaatgcaattacttcacttctcttagtctcagtatattcaattataaaattagataataaaaataattacctcaaaagttgtttcatagattaaattagcattgtttgcatcacacaaatgcccaataaatataaattattcactgaaacagctgtaggcagtaatgaaatttccatttcatgaataaaaatgtaatgtttcaatcacatatatgctacaatattaattatgttctgattgtcaggtcaaaaagtagaaattcaacctataccactacatctaatgtatgataatgataattaaggagaaaggatgtgttattattggtaatgacaggaaaagattattccaaagtaaattcaacaaagaattcttagaaaaactgcagtgtacatttgttgacacaaacaacactcacatacatattcacatggacatatacacacataccactacatatgtccagtattttttaatatataggaataaccatagcttctaacagcttatatagcatgtaactgacattcaataagctgtacataaagtttataatttcataaaatttagcacatgtaaacaagcatgaaattcaagaatcaaaataataaacatacgtatcgtgttcaaaagttttctcaagcccttttgtaatttattcctctcactgattttttatatctatacaatctatagcgatatctcctcttctgtaactgactttagtaatttatgtttttaatttcccccaaattagtctgactagagatttattcattttaatgatcttttcagagaatcagcttttcatgtcactgatatttttccccattgaatcatattttttatctgtttggtttctcttctttatttcataattttggcttgctttatgtctaaaatgtgttttttttaaactggtatcttaaagtggaagtttagttaagtgaattttagatcatgtttttttctgatttatgctctacatacatttctctctaaacattttattaactatatctcataaaatctgaaatgctttatttttattgtttcatgtgtgtatgtatatatgtacacacatatggaaaatatttctgttttcctttacttttttattgatcatctttaggttacttagaagtatgtagtttaatttcacatatctgtgaattcctagatattgttctcttattgctttagaatttaattctgctatggtaaaaatgcatactttgtatgattttagtgtactatactaattgaaaatatactgagacatgtttatggcccaaattatattctatcttgatggtattttcataggcacatgaaagaaaaatggatgctgctatggctaggaggagacttatacaaatgtaaactatatcatgttacttgagagtattaagttctttatacctttactggttttctgtcttttgttctatcaattactgagagaaaaatattataagagtatttgagtgttttcaattttgttagtttgggcttcatgtattttgaagaatattttgatataaacacagaagtgttatatcttctttatgaattcacctttttatcattatgaaaaggctctttttaatattctacagtctactttgtctgacattcagatttcagatttcttttgatcattctctgtatggcttgcattttccaaacattttactttcaatctgtctatataattaaagtatattccttgtcaaaagtatatagttagaccttgctcatactatcttacaatctctgcttttcaaataaacttttaaacccatttacatttaatgtaattgtagatacgtttggttttaagtgtacaccttgctgttttctatttaagctatatgttctttatctcttttttccccatttttctgtcttcttctgaaaaaattgagcatttttaaaattctatctccactattggttctttaataatactcttgtttattttaaaatttgttttccaggcttacattatgcatctttaaattattataatctagtgtaaaataatgttatggcatgtcacatataatgcaaggataatgtaagtatccttacaaaagcatacttttatttcctcttctttttttttgctattattgtaatgtattttatttctgcatatgttggagatttaattatctttaagagatctaaaatgaaaataaaattattttttatgtaacaacatatttaacatttacagtgatcttctaaagctttgctgttttgatacagattctgtatggtttcattctccttctacttaatgaaccttcagtgttttttatagaacacatctggtaataaaatatttagcttatatttcttaaaattactctttattttgccattttatttttacagatacatttgctaaatatatatttctaggttgaaattcctttttcttttagtgctttaataataattgatttctagcttgcattgtttctgaaaaaaagtctaatgtcattctgttttgctcttctctatataatgtatcttttttctctacctctaatatttagttttcatcactgcttttcgaacatttaattattatacatattgatgggttttttcttatttttcttctgcttgtatttcacatagtttcttgaacttttgatttcaaaaacaacttcagtatattttcagtcatcatttcttcaaatattaatgcagattgtttttctttcaaatatatagtctgggttacctttcggatattataattttcgtctacagatgacccatgatatggtttggctatgtttccatccaaatctcatcttcagtagtagttcctataattcccatatcttgtgggagggacccagtgggaggcaattgaatcatgggggcgtttacccccatactgttctgatagtgagtgagttctcacaagatctgaaggttttataatggtattttccgtctttgctcagcacttctccttgatgtcaccatgtgaagaaggatatgtttgcttccccttccaccatgactgtaagttttctgaggcttccccagccatgctgaattgtgagtcaattaagcctctttccttaataaattacccagtcttgcgtgtgtctttattagcatcatgagaatggattaatatagtaaattggtgctgggaatggggcagtgctgtaaagatgcccaaaaatttggatgcaactttgaaagtggataacaagcagaggtgggaacagtttggagggctcagaagaagataagaaaatgtggaaaagtttggaacttcttagagacttgttgagtggctttgatcaaaatgctgagagtgatatggaaaataaggtctaggctgaggtggtctcagatacagatgaggaacttgggaactggaataaaggtgactcttgctatgcaaagagactggtggcattttgcccctgccctagaggcctgtgtaattttgaacttgagagagatgacttagggtatctggcagatgaaatttctaagcagcaaagcattcaagaggaagcagagcattaaagtttgaaaaatttgcaacctgacaatgcaataaaaaagaaaagcccattttctggagagaaattcaagccagctacagaaatttgcataagcaatgaggagccaaatgttaatcaccatgacaatggggaaaatgtctctagggtatgtcacagacctttacagcagcccctcccattacaggtctagaggcctaggagagaaaaatggtttcctggactgggcccacagatcccctgctgagtgaagcctcaggacatggtgccctgagccccagctgcttcagctgtagccatggctaaaaggagccaacatacagttcagggcattgcttcagagagtgcaagccccaagccaccagcattgagccttgggtacacagaagtcaaaaactgagaattgggaacctctacctagatttcacaggatgtatggaaatgcatggatgtccaagcagaaatttgcttcaggggtggagccctcatggagaccatctgctagggcagtgtggaagggaaatgcaggattggagccccccacaagagtccccaatgagacactgcctagtggagctatgaggaaagagtcactgtcctccagaccccagaacggtagatccaccgacagcttgcactgtgcacctgaaaaagtcagtgatactccacaccagcctgtgaaagcagccagcaatgggtctgtaccctccaaagccagaggggtggagctgcccaagctgtgggagcccaattcttgcatcagtggatgtaagacatggattcaaaggagatcattttgaaactttaaagtttaatgactgccctattggattttggacttgcgtagggcctgtagcacctttgttttggccaatttctcccattcagaacaggcgtatttactcaataactgtacccccattgtatctaggaagtaactaattcccttttgattttacaggcttataggcagaagggacttgccttgtctcatatgagactttagacttggatttttgggttaatgctggaatgagctaaaactttggagaactgttggagaggcataattgtattttgaaatatgaggaaatgagatttggtaggggccagtggcagaatgatatggtttgtctgtgtccccacccaaatctcatcttgaattgtagatcccataatccctacatctcacaggaggcatctgctggaaggtaatttaatcatgggggctgttacttccctactgttctcgtgataggtagttctcacaagagctaatggttttataaggggatttcccctctttgcttggcacttctccttgatgttgccatgtgaagaaagtattcgcctcccctctcaccatgattgtaagtttcctgaggcctccccagtcacgctgaaccatgagttaattaaacctctgttctctataaattattaagtctcagttatgtctttattagcagcatgatggactaatgaactaatataacccatttgtttcttttttatatcgcatttctgtcctcatgtttatgttcaggtttcccttcaactaattgagttcgtaaagtatatttattacagttactataatgtttttggttgataatcctttcatatgtttctatttattcattgactttttcctagctattgataacatatacttgcctcatcttatgtaatttctaattgaacatcagatattgtgaattttgtcttgttgagtttactcaacaagtattttgttgtatttctttaaagtttgttggacttttcctggtatgctgttatttaacttgctgatgagcattatcccttttagtttctttttaatattttggagagataaaatttagcttttatcttagagatgatttatattcatttcttcatgtggctttctgcaggttttacttaattctctgtataattggtgaagtttctccactctggcttggaagaacataaatgattgtctgctctgtgtttgcactgggaattgttttctatacaccaaccccattaattgttcttttctcataagttattcttaaccaacagagtttggattttatactctgcatgcacagacttgtatccagccaaatattcaatggtaccccaccacagacttctggacctcattatctgcctaacccatacttcgtgaatgaataaaagaagatgataattttaatggcttattctagtcatttgttggcttattagcacatcattaaagcttatgaagaaaaatattattttaaattcatttaacacaggaaaaaagaatatgaagcttagctatagaagatcaagatattttccactttaccatagggtgcagaataaacttaataaagtaacagcaatgtgagaaaaaattattgttattctaaaactgttaattttgatccatgatgttaaatatttatagacagtactaatcagcatcgtacctaatcttggtactatgcaccaaattttggtgcaaacacttagtacctgtattatatttggcaagttatataaaataaattctaatttagttattgataattttagtttcacaagatgatgagattaaaagtaaaccatatgtacctggtacaaaatagaaacttaatacattaataaatcattaaaatatgttttaagtaagctagatggctgtcatcaaatccaagcagaataaacattaccatagacagcttttctggagaaattaaggtctccttcattcctaagaggtttgaatacgggtggtcagtaagatggatagctccccgtgaggaaatggttttaagacactccattccatgtaagcctttatctttagtgctccagggtttattcagttactactatctgttctttgagactagcctctttttttgtagaaggctgtctctgtggatttgtgcaattatatttctccctagagtttttggtcttcatcaattttgttacatttgttttctttttttttttttctcaaaggtgtagtaccttcttatactgagtagccttttccatgatgctcccatcttacttagatgagatagtactcatgtcatggtataaccctaatgtcctcttaccacaaaatacagtaagtagattggataatacaaaaccataatctgtgtgcaatagcaccctcattttaggcagtaatgtctcgtctttaggacattcatttcttcttaatcatttatcacatgtgctctactcctgaagcctatactttataagactctctttttttgttattccccaaatgagtacctctattataacttcaagatatttcatgttgtgtcacaattcaggtttcccttcaaataattgagttcgtaaagtatacttattatagttactacaatgtttttggttgataatcctttcatatgtttgtatttattcatttactttttcctactatctctcacttttactttctcttgctatctctttatcacctccatataacgtgattatcaagtaccaaagagtatttttctcctcttatatgtcactccttcagttcacctctcttaacttttaggtatctcgagtatctttttctccagtttatccgcttaatgattatactacaacacaaatcagagtatgctgctctcctcagacatgcctttcaaaaccttaccttttattataatattaagaaaagcttttcaggactagatctgtgataatgtttaccacactatcaaattctatgaaacatagaatttgttcttgaagctatataaccatgtttatattttttagtcaattacttagacaatgtttcttgtaatatgcctcattcccacaaaataaaatagcagtcattgaagtgggccatgtgtattttttagtattgagcatgttgaagagggtagagagacctaaaagaatgtcacggtgtgagaaatatttttattcactacaatttgccacatgatgagggtgaagaataatttataatattagaactgagagtgaaatgttatattaataactcatcccagaaattttctcaaagagaaaatctgtccttttttggagatatttcaatgtacttatttggtaataagttgagattttctagttatatactgagagaactgagataagacaaagaaggaactagaaaaaagatagattcctgataataaaaaatataatgaatatgattttgactgggtagttgtggtttagcaaacttgggataatagagcaggaagtcagtgtgcctaataggctaggactttctatgtacaaacaatctgtgtgaaccttctgaggataaaaatggcaaaggaatttttaagaatatgaatggatattaatagtaagggtatgctttatatatagtaatatgatgccatttctattatatcaaaccatcagtagatagttatctcacaccaagtcttatgctactacccctttatggaaggaaaaagaatgggacctattaggatgaagaaatgtgggaaaacaggataggcatatgttccaaaaatcatagagacttagaatataattatgttatgtttggaggacagatatacactggtaaaagagatactccctggccttctaaaaaattaataaatctacagatattggaagaaacaatagtttcttcttaaagattttgagtgaaattaatcaaaatttgtaaagacgggctatctgggttaaaatataacaagcatcaaagaatactgctatcatttgaatgtttttgtcttctttaaaatcattgtgttggaaacttagtctccaatgcaacaatgttgggagatggggactaatgggtttagttcataagggctctgtcctcaagaatgggttaatgccactgtgtttgcagaaacgggttttgtctctttcactcttctgccatgtgatgacataatgttcttcccctctggcaaaagcaacatttaaaataccatcttggaagcaaagaccagattcttatcaaacacccaaagtgctggcttcttgatattgtaacttccagctccagaactaagagaactaaattttatcctttatacattacccagtctcaagtattccattatagcagcacaaaataaactaagacaaatattttagcatgatatgttttcttatagttttaatatataatttattctcacacactgtatttattaaagtcttccatttatttatttaaactgcatagttactagtaattgtgcaagtttgttattacagcaagctgaggatactacaataatatgtaccttaaagaatacagttacattttttgggggggtcaaataagcatataatcactgaatttacagaattatttgtctttgatattaagaagttaataatgtgatggttttggtaataatagtgacctctaaactctgtacccataacaactgttcttctttttatggacagagttttattaacaagaactgtctttatgcttcagtcacctttcaataccatacccctgcatctcagcttttccctaagcctaaaaattttatttatagttttaaactaaacacttctaaaattgaaattatgtctccctttggttctatcaagcttacatctcttccctgttttttaattctgttaataatatcaccatctacttacttactaaaatgtaagacatggcttcatctgcactatttctctcactatctctttgtcacctccatataacatgattatcaaggactaaagtgtatttttctcctcttacatgtcacacttcattttacctctcttaactttttggtacctcgagtatctttttctccagtttatcctcttaatgattatactacaacacaaatcagagtatgctactctcctcaaatatgcctttcaaaaccttgccttttattataatattaaggaaagcttttcagtactagatctgtgataatgcttaccacactatcattttaaccttattatataatactttctaaaatatcctttatactctaaacatatcaaatttttctgtcattctaagtacaacatattcattcttccacattatgtactgacattcttttctccctctactgcatgaactactacttatccttaaacactgagttaaaatgtcagcactcttctaaggcaaggtataaatttcaatggcagatcaaaaatacctgctactacttaacttattcacttagaatctattagaatctacacgtctctcaaatgacaaattgactttctcagatttagttgtttcctaccaatccatagcatattgaagagtgagatgaccaggaattaaaattccatgatatgtcacaggcctgtgccttgctgcaataaagtatatgaacatttatatcagatagttggtgccctttaatatctatgaacaaaagtcattgatacagatatttgagaggaaagttaatgactttgctctgcatatgctcatttaagaaaagggattataaacagatttgcaaggtcagcagagcactgtaaattaaggatatgcctggagaagattgaggtcatgtagcagattgcattggcttaccataaagacttaccttcagtaagcttagagaaatagcagaaaatatcctacatgaaaaagagtcaggcaataaaaagaaagcttgattcactttccaagaactgggaatctaaagtgaagtaatgctccatcaagaaattcaaaatgccagctggataacacatagctgcagagagaccaaatactcaattaggacactcatgaaaagggagacctaagccaactaaaggaagaacgtgagcttaaaccagaaactaaggacatatttcttccaagaagtatttcttgaagtttttttctagtcatctgagatatatagagaatatatttctctatgttttatggggattacaattttgaacagatgggaaggagtaaggggatatagccctgaaaaagattagaagaacaagaaaccttatacctaactaaggcaaaccacagcattttgaagatgagaaaactgaggctcagagagggtaagatcatgctctcaactcacattccagtgcgtgactccagtaaggattggctttttagtacctaattcaaggtctgatgtcaggatgtcatcataaattaaaagctttagaaaataatgaaccacatttctggaacaatcccctttatgaccatttgggtagaactcttttagtatgaatattattgtcatttttggtatcttgagatttaactatcttgatgatatacaaaattggaaagatcaatcactaaattctgtgggggctaaaatcatttttgctttttcttggtcttaactagtggatctaactatctgagaacactccttagatagaggtgaaatttatggttagtgttcatcctatgagtagagagataaagaactggtaaatcagtgtttgcagaaatttcatttttttctttcttatagcttatgtaaacaaacaaggaagatctgtatgcttccagaaacaaactgtatctgcaagtcaaaaatttatgtattgtcattgtttatttattctttgccctgttaagcattttactaagttttttttcattttataatgtatcaatattttctcagtcatgtgatggataataaaaaagtttatattcataacgggacataggcttaaaagggaagctgtattactattaccttatgtagtatataagtacacaaaattaaaaatatgtaattaaaatacaaatatctcttaacctgaaagagttaatgcatcatttcctctctagttagaaacattaacaatttaggtctctgtccttcatgttaacagattcaacactttgatacatgactcaaatgtacagaaaacatgtttataatataaaactgatagaaatcatgaaataataacaattacagtggttacagaattaattaagatgatcttggcaggttgaaacaaacggccatgtgtttaataaaatgaagaaaagtgaatatcaaatactgcatttagattgaaaaaaatcaaacaagaaaagtttgaagaactatgttatttctaaatgcatttcaaagttttgaagtatattttattttttaagctatcttttaagtgtaggtttttgagttgccttatggttaaaaatgtgttttacgggtaatcatttctttgaaattttagttagttttatataacaatgtgttgaatttaaggtattttactttgcttaatatatcagtgtctgatgacactgcagagtttgcaatttttgctttactacttttttgacaatgttgttatatacataaaatgtcataaccttctaagtaaattttattttaattattatgcatatacctatttacctatgttaatgccattcccttaattttaattttgtctattactatattggtataataacattcttctgaacagtctttgttcattagatatttttcccatttctttatctggaacatttcaaagcaattttatttgtggtatgacatttaaaagcagacgatagctaggtacatttttgtttctatcaacaaagtctttgtattttagttagtaggtatatgtaagtcatttacatttattgtgataatatattttaccttttccattatcttactctgcctttcatagttaccttttttttcatttttttctgtaactgttaaactgatactattttgtacaacttaaccttttctttattaatttactggtttggaagttattaagtataatatagttttccttcactatccatggaggattggttccagaattgtttcaagaatagtgacaggagcgggtggagccaagatggccaaataagaacatctccagtctacagctcccagcataagcgacacagaagacaggtaatttctgcatttccaactgaggtaccgggttcatctcactggggagtgccggacagtgggtgcaatgcactgtgcatgagccgaagcagggtgaggcattgcctgacccaggaagcgcaaggggtcagggaattccctttcctagtcaaagaaaggggggacagatggcacatggaaaatcgggtcactcccaccctaatactatgctcttccaaaggggttaacaaatggcacaccagattatatcccgcacctggctcggagggttctacccccacaaagcctcgctcattgctagcacagcagtctgagatcaaactgcaaggtggcagcaaggctgggggaggggcacccatcattgctcaggcttcagtaggtaaacaaagcggctgggaggctcgaacttggtggagcccaccacagctcaaggaggcctgcctgcctctataggctccacctctgggggaagggcatagacaaacaaaagacagcaataacctctgcaatcttaaatgcccctgtctgacagctttgaagagagtagtggttctcccagcatgcagcttgagatctgagaaagggcagactggctccacaagcgggtccctgaccccggagtagcctaactgggaacaccccccagtaggggtggactgacacctcacatggcagggtattcctctgagacaaaacttccagaggagcgatcaggcagcagcatttgcggttcaccaatatccgctgttctgcagccaccactgctgatacccaggctaacagggtctggagtggacctccagtaaactccaacagacctgcagctgagggtcctgactgttagaaggaaaactaacaaacagaaaggacatccacaccaaaatcccatctgtatgtcaccatcatcaaagaccaaaggtagataaaaccacaaagatggcgaaaaaacagagcagaaaaactggaaactctaaaaatcacagcacctctcttcctccaaaggaatgcagctcctcaccagcaacagaacaaagctggacggagaatgactttgacgagttgagagaggaagtcttcagaagatcaaactactccgagctaaaggaggaagtttgaaccaatggcaaagaagttaaaaactttgaaaaaaaattagatgaatggataaaactagaataaccaaagcagagaagtccttaaaggacctgatggagctgaaaaccacggcgtaactacataacaaatgcacaagcctcagtaaccgatgcgatcaactggaagaaagggtatcagagatggaagacaaaatgaatgaaatgaagcatgaagagaagttcagagaaaaaagaataaaaagaaatgaacaaagcctccaggaaatatgggactatgtgaaaagaccaaatctacatctgattggtgtaccggaaagtgacagggagaatggaaccaagttggaaaacactctgcaggatattatccaggagaacttccccaacctagcaaggcaggccaatattcaaattcaggaaatacagagaatgccacaaaatactccttgagaagagcaactccaacatacataatgggcagattcaccaaagttgaaatgaaggaaaaaatgttaagggcagtcagagagaaaggtcgggttacccacaaagggaagcccatcagactaacagtggatctctcagcagaaacgctacaagccagaagagagtgggggccaatattcaacattcttaaagaaaggaattttcaatccagaatttcatattcagccaaactaagcttcataagtgaaggagaaatacaatactttacagacaagcaaatgctgagagatttttgtcaccaccgggcctgccctaaaaaagctcctgaaagaagcactaaacatggaaagaacaactggtaccagccactgcaaaaacatgccaaattgtaaagaccatcaaggctagggagaaactgcatcaactaacgagcaaaataaccagctaacatcataatcacaggatcaaattcacacataacaatattaaccttaaatgtaaatgggctaaatgctccaattaaaaggcacagactggcaaatcggataaagagtcaagacccgtcagtgggctgtattcaggaaacccatctcacatgcagagacacacataggctcaaaataaagggatggaggaagatctaccaagcaaatggaaaacaaaaaaaggaaggggttgcaatcctagtctctgataaaacagtctttaaaccagcaaagatcaaaagagacaaggccattacataatggtaaatggatcaattcaacaagaagaactaactatcctaaatatatatgcacccaatacaggagcacccagattcataaagcaagtccttagtgacttacaaagagacttagactcccacacaataataatgggagactttaacaccccactgtcaacattagacagatcaatgagacagaaagttaacaaggatatccaggaattgaactcagctctttaccaagcggacctaatagacatctacagaactctccaccccaaatcaacagaatatacattcttttcagcaccacaccacacctattccaaaactgaccacatagttggaagtaaaacactcctcagcaaatgtaaaagaacagaaattataacaaactttgtctcagaccacagtgcaatcaaactagaactcagtattaagaaactcactcaaaaccactcaactacatggaaactgaacaacctgctcctgagtgactactgggtacataatgaaatgaaggcagaaataaagatgttatttgaaaccaacgagaacaaagacacaacataccagaatctctgggacacattcaaagcagtgtgtagagagaaatttatagcactaaatgcccacaaaagaaagcaggaaagatctaaaattgacaccctaacatcacaattaaaagaacaagagaagcaagagcaaacacattcaaaagctagcagaaggcaagaaataactaagatcagagcagaactgaaggaaatacagacacaaaaaacccttcaaaaaatcaatgaatccaggaggtggttttttgaaaagatcaacaaaattgatagactgctagcaagactaataaagaagaaaagagagaagaatcaaagagatgcaataaaaaatgacaaaggggatatcaccaccgatcccacagaaatacaaactaccatcagataatactataaacaactctacgcaaataaactagaaaatctagaagaaatggataaattcctcgacacatacactctcccaagactaaaccaggaagaagttgaatctctaaatagaccaataacaggctctgaaattgaggcaataattaatagcttaccaactaaaaaaagtccaggaccagaaggattcacagccaaattccaccagaggtacaaggaagagctggtaccattccttctgaaaatattccaatcaatagaaaaagagggaatactccctaactcattttatgaggccagaatcatcctgataccaaagcctggcagagacacaaccaaaaaagagaattttagaccaatatcctcgatgaacatggatgcaaaaatcctcaataaaacactggtaaaccgaatccagcaacacatcaaaaagcttatccaccatgatcgagtgggcttcgttcctgggatgcaacgctggttcaacatacgaaaatcaataaatgtaatccagcatataaacagaaccaaagacaaaaaccacatgattatctcaatagatgcagaaaaggcctttgacaaaattcaacaacacttcatgcaaaaaaccctcaataaattaggtattgatgggacgtatctcaaaataataagagctatctatgacaaacccacagccaatatcatgctgaatgggcaaaaactggaagcattccctttgaaaactggcacaagacagggatgccctctctcaccactcctattcaacatagtgttggaagttctggccagggcaatcaggcaggagaaggaaataaagggcattcaattaggaaaagaggaagtcaaattgtccctgtttgcagatgacatgattgtatatctagaaaaccccattgtctcagcccaaaatctccttaagctgataagcagcttcagcaaactctctggatacaaaatcaatgtgcaaaaatcacaagcattcttatacaccaataacagacaaacagagagccaaatcatgagtgaactcccattcacaattgcttcaaagagaataaaatatcaaggaatccaacttacaagggatgtgaaggacctcttcaaggagaactgcaaagcactgctcaatgaaattaaagaggatacaaagaaatggaagaacattccatgctcatgggtaggaagaatccatattgtgaaaatggccatactgcccaaggtaatttatagattcaatgccatccccatcaagctaccaatgactttcttcacagaattggaaaaaactactttaaagttcatatggaaccaaaaaagagccctcatcgccaagtcaatcctaagccaaaagaacaaagctgggagcatcatgctacctgacttcaaactacactacaaggctacagtaacccaaacagcatggtactggtaccaaaacagagatgtagaccaatgcaaaagaacagagccctcagaaataatgccgcatatctacaactatctgatctttgacaaacctaacaaaaacaagaaatggggaaaggattccctatttaataaatggtgctgggaaaactggctagccatatgtagaaagctgaaactggatcccttccttacaccttatataaaaattaattcaagatggattaaagacttaaacgttagacctaaaaccataaaaaccctagaagaaaacctaggcattaccattcaggacatgggcatgggcacggacttcatgtctaaaacaccaaaagcaatggcaatgaaagccataattgacaaatgggatctaattaaactaaggagcttctgcacagcaaaagaaaccaccatcagagtgaacaggcaacctacagaatgggagaaaatttttgcaacctactcatctgacaaagggctaatatccagaatctacaatgaactcaaacaaattataagaaaaaaacaaacaacccatcaaaaagtgggcaaaggatatgaacagacatttctcaaaagaagacatttatgcagccaacagacacatgaaaaaatgctcctcatcactggccatcagagaaatgcaaatcaaaaccacaatgagataccatctctcaccagttagaatggcgatcattaaaaagtcaggaaacagcaggtgctggagaggatgtggagaaataggaacacttttacactgttggtgggactgtaaactagttcaaccattgtggaagtcagtgtggcgatccctcagggatctagaactagaaataccatttgacccagccatcccattactgggtatatacccaaaggactatatatcatgcttctataaagacacgagcacacgtatatttattgtggcactattcacaatagcaaagacttggaatgaacacaaatgtacaataacgataggctggattaagaaaatgtggcacatgtagaccatggaatactatgcagccataaaaaatgatgagttcatgtcctttgtagggacatggatgaaactggaaaccatcattctcagcaaactatcgcaaggacaaaaaaaccaaacactgcatgttctcactcattgatgggaattgaacaatgagagtacatggacacaggaaggggaacatcacactccagggactgttgtggggtggggggaggggggagggatagcattaggagatatacctaatgctaaatgacgagttaatgggtgcagcacaccaacatggcacacgtatacatatgtaacaaacctgcacgttgtgcacatgtatcctaaaacttatagtataataataataaaaataaaataaaataaagataaattaataaaaaactagaatagtgacaagaaaaaaagagtatacatgctcagcagatgtaaccatccattttttaatcaaatatatatatattttgttatatttaatcatgtgtgtatatatatatatatatatatatatataaaatagtttgtttgattgtttgtttgcttttgagatgaagtctcactctgttgcccagactggagtacagtggcaagatctcagctcactgcaacctctgccttccaggttcaagccattctcctgcctctacctcccaaatagctgggattacaagcgcatgccatcacgactggctaatttttttagttttagtagaaacagagtttcactatgttagccaggctggtctcgaactactgacctcaggtgatccgcctgcctcccaaagtgctgggattacaagcatgagccaccatgcgtggcctattatttttgatccatgggtagttgaatctacacatgtggaacccacagatattgagggatgactgtatatggaatttataatatatttatatgtatatgttcaaataaaattttaatataaatgaagtatgtatcgaacaaaatcaattgttattcagtatttctgtctttctcccaatatggcaggaaatctctccatgctttacccattgtaactactagcccaacctgcatatctttttaatattttaaagtgtctatttcacttttttaaacttagaaaatagttattattaaatccttaatcaaatttactgatatcattcatcaagctctatgcttgttcttccttgtaatctgtatatgctctcttggttcattgggttcactgaccttctaatcaagtacagcctcccaaagttatttgagttacttagggtgctaaactctttctattataacttgaaaataataatttagctctctctctcaatcattaagctgggaatataaacaggtaaacagcttcaccttttaatgtttgtttaactttaggaaattctcttctcaaggcctcagctttctcatttgtaaaatgggaataagagtaactatctcacaagatatacaaattattgagaacccagaataagtccagtggaacggtcaatttttatttttagcaactacattgttgtttctggaatatattgttactaataatacccattttttatatgagtgtgcttttggttttatcattaccagtagattttaagattatctctgttttcttcaattttttgtaatttgactgcagtgtttcgtggtatgggtttgctttttcttaaatgaatatggctcagtacttaaatttgtaaactgggaactcatatctccctttatgtctagaaaactctcagcaattatttcttcaaatatattctaccattatttctgtcattcattatttccaaatagtcttaaagtgaatactaggattacttagtctatcttctatttctcttaaatattcttttgtgttttttaaaaatctctccacatttaaactatactcacagagtcaccctcatcaaaagtcaagacacacaagtgtaatacaaataatctcaatgatcagagttatagatatgtcggtagtttcaagggaaatgatgtagtgataaggtagtacttttatcattcctctagaaggtcaccttcttcatctacatttatagtgttaccactttcctaaagaacgtgaaaaatgagaattgcttattttatcatagagatcagtgacagtaacatatattgaaagcttgtgatgtgccaggcagtgttctaagtgcttaaaattatgtttttaatatatgcaaagtgaatgcatttaatcttcacaacaatattaggagcagatcttctcatcatcttcttttaaagatgaaaaaaatgaggctcacaatggttaattacctttcaaatgtcacacagtgagtgaataacagagttataatttcttctttttttttttttttttttttttttttgagacggattcttgctctgttgcccaggctggagtgcaatggcatgatctctgctcactgcaacctctgcctcatgggttcaagcaattctcctgcctcagcctcctgagtagctgttattacaggcatgtgccaccatacccggctaattttgtatttttagtctagatgggtttctccatgttggtcaggctggtctcaaactcctgacctcaggtgatccacccgctttggcatcccaaagtgctgggattacaggcatgagccaccgcacccagtccagagttgtaatttcttatgcagcagtagcaaactaatacagcaatatggatatattttatttaagccatgatgccattttcctttacgagagctgtaattgcctcctatggtttccatgaccatataggctgttgttgttgcttctgctatttttagttgttattgttacattattttcataataataatgttaataaccataagacgttaaacagcactgcaacagagcttaaaaatgctatttgttccttacagtattatgttagtgcaacattcttaagaaagcaggtgaaaagaaagcaaaccagaaatgaacacacttttatggaataaaaacttataaatttgggttttagttaaagctacctgagagggggaaaaatgtactttaaatatgaggtcaaggacagggctggattacacaaaatgtgcccacgattcgtgtacaaatgagaatgcccacagagaactaaaacccacatgacacacagaaaggaacatctgccagcatcagcaaattgatgacatgtataaggcatttcttagaccgatgtgggagtaggaaaacatcacttctttagttaatgatgcttcggcaatgaacatattcaaatgccttggttctgaagacagtgccacttaatgagcatatcatagaccacaagatattgccataagtcagaaatgtataagcaacacacaatttcaagctcttaacagctttaaagcatcttcaccaattacatctggtcacttcctttctagtactcctagaaacatacgaagtagtgttgggtttaggtgtgtgaatgcacgcctatattatcaccattttccctaatgcattatacgtgtataaacttgtgctacacccatttctattaaccttgtatctcactcttaacccaaagagtagcagcttaaaaaacaaaccccctcatataatgtatggataagtccacacaaataattgtaatgtttaattaaactaaactgtcatcaacagaggtcatctttcaacaatcatatatcaggggctttaactgttggaaattaactgtaagattggcttgacttttaaagacagtacgcgagtttctcattagccttattatcatttttgaatcataaatatgtaaatgatgagtttcacacgggagatttaattctgcactcttatttctgattagctggaaatacactctggctctgtcagataattggtaacattgcacaccaataaggcatttccctacgcttcatcagaagcagttgaaattaaagaaggcagagctgttacgttttcgacagttttgtaacaccaacttgttaaagttttaactcagccattaatatagtccatgaattattaatacagtttttatgtcaaggttattttttaaagttgagatccaagtataaagtaaaatgctctaggaaagagaactcttacattattttcacttaaaaaatctatactaaacaatagtaatttgagaacaagtaaaaaacaacaacaacattttgaccacttactgtgaaccacatactcatagtatgtgccatcatactggcacatattggcactcatcatagtgccaaaatgtttgtaaacttttagaagtttggcagtagttgaatttttactgctttaatatatgatgttttgtttttaagatatgcaccttcatttctttgttagtagaaagtatgcataaggaatatcatatcaatttttcttaagttgccttctcctagaaattaggggagttcagtttacctcaacttgaagaagtttaagcagttttaattcataaacatttctcttttttcttctgtcaagatgatgctaagaccttcaacaagacaataaactcctatggataaggaataactctttttatctgtatttttgtcttccatgctagtacacaacaagggtatgcattaagtgtttgtttatgacataaagaaataagttgccacttaaagacatgtaatatttctaaatatgacagacatatctctagtggaaatttttgttttcgcacctctttaagttggctttaaaaaatatttatacttccttaataagaaatttcaatgtctaataactagccatatgtaaatctactagaaacattgtcaaagggactgcaatatttggttggctactattttattttttctatttttaaattagattatcaatatgtttatgaatatttgtgctatatatgatcataaaagctttcaaaacaattgagtatatacttcaaagtttttctactggataaatcctttattatcaccttcactttttttttcaatttttatcatcatcttcgctttataataacaatcaaggtgtagattgattaagtgcaatttttaataagaaaactaaagagggctccctagtgtccgccttgcaataggcagcatttgtgttactgccaacattgcattcattgaaactcattccccataactcctttctcgattttcatcactttctttaagagttgatcattacacagcaccctttttacagtaggattggtgtcctatacgaagtccaaaacaaagagtattccagtgccaactaaagtactaatattttaaagtcaatacatatttgcaaggggtggcttctttttttccaacaaactcacaatatttattcaaaaaaatgtttatgtttagagttgaatgaagaacatttgtagtatagggaaaagatcacacattcatttttgcaggcctttattctagccactatctaattcattcacagctaatttctcagcatcagtaaattttatctaaaaaagaaaagtaagctattacatgaaagacaagatttggtatgaaatttaattgcaattgtcagcatacacaattgaatagagtacattctctttaatcaatcttgtcctcatgtgcttctgcacatttgattccatagtaagttgtgaaacaaaacaaaaataacagaaaatgtgctgaatattaccaaattgagagcaggctaaatgtgtagaaagctatatccaagaaatttaaatcaatcgtatgaggactataatatagaaggcaagaaatcaaaccaagcggtaaaatttccactgagataggcatgtgactgttagaagaaatagatctatggctattaaaaacatgatactagatattcttgttaattagaaatgaatgctcattgctgatctgagaactgagctcaggtgcacttatcttcacacatgaagccatcgtataagatagagtaaaatgagaaatgagccatcaattcccaacttaattatcagccatcatgagtggtgttatgctaccttactgtagtatattaactacacacaattaatgatatggactgtgggcccaagtagacccaagttcaaattctggctttgccattacctaggcacagtatctttgaacttcagtgtcttattaataaaataaggagataaaatctaccttacttgttgttaataggattataagagctaatataaagcttattgaataataagcaggcccattgcatatcactagactttaaaaaaaattcttttctagattttcaaagaaatagttataaaacttgaaggcaaaatctgtctctcatacacacatacatatacatatatatatatatgcacatggaaattagcctaaaatcttacccttcaaaaaaagcaatattgtccattgacagttgtgtgtacagtcttacagatttaatttgtcttactgactagtgtaggcaacgtatttttagaggacattgctctgaaatgtagaatactttaaaaaactatcaatgttcaggtttgaaggggtctaaaaatagcactacccttcccaacataaggaacaacttaaatgagtagtaaaccaaaagcaaatcacacagaacccaatatagcagctatattagtgttaaaccaagttgccttcttggtctatcagggacagtcctgatctagggtggatagatcaattaacatttgtttattctgtttggtacattcttttgttctcaaaagtctctccatatgggcaataaatacataattaccatagccaaaagttatgtggaagaatgtcacttagttttaaagcaacatttaactgccaaagaagaaatcccaccattaaacagacatgtctatctggtgactggcagtactgaatcaccacaggtcttcccgtacagtgacatcatcctacaagcttacagcaaggagggggagcaaggagagaacagcagtttcttgctgtcctcctggctcttaagagaaatggcccagaaagttacgtgatacatgcctcacatattttcctaatctaccagtttggtagctcacttaccatccataggtagcactgaaagccaggccaggacaagaacacaagaatgtttcactgctggatgataatcaatgtagaagcatgaggtcgaggaaaggagtgacccaccttttctaaataaagaatctggctttctatcttggggaggtcactcaataaaaggctaagggagcctaaacaatggctcccattacattttactatgtgaactaagtttttttatattattatgttaaacaaagggaaaatatagaagagtaaaaataaaaaataaaaatcaccaataatcaaaaatcacaaataatccaatgactatgacatacacatatttttgtatatatccttccagtctttttaaaaaataagatgtagttagacataaagaaaagataaacagtaggtatgtggccttcctttatatgaagacacttgagggtttgttctctggttgaatcctccttataatggtaacttaaagaattcaatgaagtgttacaagatcccagaaaaagaagaatctggcaaagttaccatgcacaagatcaaacacctaaaaattgttgcccagattgtttattgagtaatgatatttatgaaatgcagttatatttgtaaatggaagttagtcatgtacccctcaagaggttaagtaactattgggtaagctatggtttgcatgtggtttgtcccaccaaaatttacgttaaagtttaattgccagtatggtagtgttaagaggaggggtctaaagggaggcatttggaaactgaggcatttgatcagattaattaaattcaacaaaattcaggtacctacttgtattagtccattttcacactgctataaagaattacctgagactgggtaatttgtaaagaaaagagattgaattgactcacagttccacatggctggggagacctcaggaaacttacaatcatggcggaaggtgaaggagaagcaagcaccttcttcacatggtagcaggaaagagagtgcatgagaagagaagtgccacacatttttaaaccatgagatctcatgagaactcactatcacaagaacagcaagggggaaatcagcccctatgatccaatcacttcccaccaggcccctcctccaattcaacaagagattttggtggggactcaaagccaaaccacatcactactattagacaagcagtatgcaagtacttaggatgcaaaggcaagaatatattgcctcttatttatagacaaaatagacaccgatcttttttcttgtgtcttccatagtaccctccttgaagacagtaacagaaattgtaaaatgatgttcaatattgaatcagtgaattaccggggaaaaaaaaactggtctcaaatgattttcaagcagatggctaagaaaaggtccttttctaaaaggattattaaaaaaaaaataaatacagccaagccacacaggcatggcgaagcctatggagttttaaaaggttttcttcaatgactatttttatctcctgaagcataattattaggcatcacaaatacaactaagtgaagatttactttcatcttacattattttcatttaaaaatcacaaagcatcaggggacctttctttctatcttgacggttagatgcttctgttccctgctgctattagtcccaaggataaaaatgtgaagttgctataaatgactttgtcaattttatttagaaattcaaagtttcaaactgacaccaagtcaggcaactctaaatcttactgaacttcacccgcatatgtataccttcatggtaattttcttgcacgaagaagagaaagtagcagcagagaattatttttttaagcacagaattatttcccttgctactggtatcacctatgtaatgacaacaatttcaaaatagatatttgagctttgccatttgttttcattaaatcagtcctcagaggagatagtttttttcagtttgttagataaaataatttttctctattattgtacctatcaggctatattacttaatatctgcacaacttgccacaatccagtacactaaatcatctggggtaattataattaaaatattgagtgaatatatagaatatggcagaaaacaaatgaagtaatatttttacctgagttaaataaattttattgtccaatatggtaagcaagaataaatggggcaaaggttggaaaagcaacaatttatagaatagatatcaggaaaggagagcatgaaatagcaaaaagaaacaaaagggctttagaagtcaaattgaaatcataagagaaataaaaataaaaggaatttgtagagtttctgatacagtggcacctcctgggttatatcaaagttattagagattcaaatcaagtagtagaaaacaagcttaatgacagaaaagaaacttcaaattaccttttgaaaatttccatgtgttcatgtccatttacaatattcactatttaagtctgctgagatgttatttttgtttttagagaaaagcaaaacaagtggtttcataatatcttgcagtaatatgtcattgcttcttccagctgtggttgcacaagctgtgagcttattctagccctactctcactttaatcagaatggatttaatagaaccttcccaaggttttggaactacacatctagattctcttgctttgaacctcctcctctcaggtctataactggacttctgaaatgttcctgagatatcaacttcactttgtgccccagtttggataactgggtctctgtcttctctcctctgcttttagttcttatttttatcatctaagcaattctttaatgctgtgaggactgcacctctgctgttttcatgaaagtcacctaaccaggggagggacgcggcctctggatcacagccaaatactcaagcactggtacttgctgacagcctaaactgtgcctatgcttatattaccattgccatgtccactggtatgttttatctactcattgaattatttttgctggaatgaattttttattataccattagcttacatgaaagaacattataaaaattagccagctcttgaaattcatttatgtacggctactactgagactatttctcatcaccttgtataaggagttctttatgaggatccataggaagacttcctctttgaacctacacacaggaatcgttatatctgaaactcattattttgtatttattgtcatgcttgtttttattttttgaacattcaaattatataactgactgttttccacttttcgatagttgttagaaaaattcagcctccacctttatcaactaggcagcacctcacagccaatgtttgtttgcagtaatttcatccctgtctttccctacaaaattcatctccccaaagtttagaaaggctcacctaattatttttagtttgctcttatcttagtgagttgagtgtatttttgtaagctgtttatagttttggagaggataaagatggggtaaaataaatacattctacagaaacatcacttcctgttccagcctgcaatcatgtaatgccagttacgtcagggcagaggttccccacccatgagattctgattcttccacaccgtcctcaccgtctacagtgactgccagttttcaggctctacacacaggtctgtgttcccagtgtctgtcttaggatatgggggagactagttctggggtctaagtcttcagtctgtctgtgttcctgaagatgacttgtaaaaagcgaggtaggatagtagaatctttcatcccttgaccttcagctatcattggcttcaaaaatatctttctcacctttagcaatctcatttttaaagttctttccaaaatgaaattttactccctccttcaataattcatttcaagtataaagtatccaagatttaggaaattctatttgtccctaaccaaagtcgatgtattgctttacattatcattattgttaagactgaaaggtggaagagaaaatctattcattctctcctcattatcttgaagatgactattaaccataaccccagaactaaacatcttaaaaatattcaactcaaggattctttaagtatgtcagtaaacattcaccaggcagtgtatatgaaggaggtgtatacagggttagatagtactactattactggctgtcagttaccttgaatacacttttgcatacgaatttatacattcttcaaaaaataattatgagataaaggctataattatgcctctagcatagatgtggaaactgaggcacagagatttagaaaatttcctgtggtcacaagctttttcaggtgatggaaccagaatccaaacttgggacacctgacaacatagctgtgtaagctctgctgcttgtaagcgccaaggcctatgccagtgaccaaatgtcccctatttttgcagaagtcttttttaatgggtatttattattttctaagaaatcaaaatttcactcaaccgtatctaatataacactgtacattttataagaaatttgtgtattttgatttaataagtgctattataatcacacaattttctattgttttcagggcaaaggaacagtttcagacccgtgcaagcttgtctagactcagctcttcataattatgatttcgtttctatggacagagggaaaaagaaaaacaatttctactttctatatatctgaacttgaggactaccagtaaatacagaatattcataattcatacaataaaacctaactccattttgcatacaactgttcacaactattatttacaactatcagctatcattataccaattatgccgatatggtgatattatattaactatcatattacaactgtcactttcagcagtcatttctccagtacttcaaaatcacagagctaagcctttgtaatatattttctcatttattgcatccgagaacactatgacctagataaaattatcagccctattttacagttgagaaaattaaggatcataaaagttaagtaactggcctgggtttagtgctgaggcagaattggaatgtctttctgctatgtatgtctgacagcaaaaagcatggttttattatagtgacccgataacagatcctgggcccaagggtaattatttttgaacatactatacttgtcaggctctcactgtatgattgccactttgcatcaaaatttattaaaatattttttcaatctcttgctgaacaaattttgcaaaaccaaataaaaagaaagataatgaagcatgtgtgttggccaccagggggtgcaaggtccagcatcctaaatcatgtcctcaactttgcaggccttttcttgtggtatatgaaaaagggaactctcttaagaaaggcatagagtaaatctaaggggttttgtaaatcaaaggtcaacattcgtttgaactacacctggtggtaaattaatatctttgaattatgaaacttgatcgaggatgggccgactgtgataaaaagaaatcaaataaatggaacttctactatttctacactattttcagcataataaaaatttgaaagtgtctggcagaacatttagccacaagagtttttaaggtattgatttctgggagacaatttctcttgatagacggcctacattttaacaatgaccacttctaagggtggtcttgcctgtcttcacgtcaacccacataaattggacagagtggggtatatatgcccagcaaggcaggctgggggctcagctgtatatctttgtttctggaagtactatttctatatctaaaatgtatctgaaggcatgtttccttggaggtataatgcaactattgcctcatacctgggtcagttttgtttgaatatttctgttgtcatgccgattgtcagcatggtccataattatgaagagtccctgattgtaaaataaaataataaagagaaaaatcagtaggagagtgcctggggtgaatttataatgcatttaaagtgtgaagctgtccatttaacccttaacaatattcattttcttcacaatgtgcaaaccttgtcagtagtttgaaaagctatgaatttaaataaccttaagcagcctcagaaatgaataatttgataggtatatctggcagatggttgaaatgtcgaagcttttttttctttttccctgagaacatgctgcagggtttctgccaaacttaggttgtaaggaaggcaaaaatcaaacaataaatgctccatatttgcaaactatcaacactaagatagcatttaagaacagttgccagtccctcctcccttgattctttggtggaatgacctgaaaagcaatacctttttatttaagatgaaattttttagtttgtcaaaataaatattaacctcgactaagtttaaagtcaatggcctactagtggctctccagcttgtctttgtggtttcataaatcttaatgcttatttcaatattaatgtgagtactgacaactggactagcaaactttgattgacatctcattggagggactctagtgagaaagagaacacattttttttttcctctggctgttgttgatataggtagacacacaccttatcttgtacaaataggtggaaaaaaaacccagctgaaaataatattgtagacacaagtcaacacacacctttaacaggatctatttgttacaaaccagtgtctttaccagaagtacagtcaggatgtagagtaaatgttccaataacatctgttgctgtaaaagaggatcctgatataaggatgcctaaaaatgatctaattcatattcagaaaaaaggaacacatacccaaggcttcaaagaccatctaaacaaaaatagcaacatggtagcattctttggaaagtgtcaaggtgggagaagacatttttaagtaagaatcaagaatatgctaaatataataatataaaaggccactaattatttacctgaagttatgttggccttcagagggtatgttaagtcagaaatgattgaggaaattttagaaaacaaaattccaactaattattattagaatgtttaccattcttaaatacttcagaaagttaagataataataagaacaataagagttaaatacatataatattttaaatgtcaaaacaacttatatatatatattttattcaagcttcacatcttaatgacataggtgagcaaaggaagcaagtcatgcaactaatgatcagaattagattacagattttagaattcttaatccaatgtcttttactatgcaaatttaacatgtttataaaaaatcattgtaaaggactttcagatttataattgaaaatgaacacaacaattacctcttccaattacgttaaaattttatataggagaataaataaataagaagttggttttcaaatatttatatttattggtattattatgctaattatcagtatgtctttggtttgagtttgatgtttcaaaacatttatttatattggaattcaaaatgttctataatttgcattgactgagtaggacagtcattgtttctgtcctggtgaagcttctattcttctattgggggagaaaaaccttcaagaactattaatcaattattcaattattgctgagttaaatattttgaaatagagggtaaatagggtttcctgaagttattaaaggaaggagtcagcaactcatctttagaaagataaaatcaagatgagatctgaagaattaattagttttgtaaaaaagcaaagtgggcaatagattttggcaaaggaaacagcatatacaaagtcatagggatttttttccaggggcttataaactttattttttatagcaattttaggttcacagagaagttgaatggaaaatacagagagtgcacatatacccctgttcacctactcatgtaaatctactccactattgacatcctgtatcagagtggtacgtttgttacaactggatgaacctacactgacattattatcacccaaagtccatatgtacattaggattcacattggttgttgtagtacattcaagggtttggacaaatgtataatgacatggatccaccaggacggtatcatagagtgtagttccactgtttaaaaaaccctctgtgctttccctattcattcctgccctcccccaagacctggcaaccactgatcttttactgactctgtagtcttgccttttccagaaggtcatatagttggatcatacaatatgaagtcttttcagattggcctcttatacttagtaatatgcatttaagttttctccgtgtctttccatggcttgatagcttatttctttttatcacgaataatattcttttatttggatgtaccagtttatccgttcaccttctgaaggacatcttggttgcttccaagttttggcagttatgaataaagctgctatacaatccatgtgcaggtttttatataaatgcaatcttcaattcatatgggtaaataccaaaaagcataattgttggatcatttgccaaaccgtcctctggaattgctgtaccatttttcattcccacaataaaaatgaatgagagtttctgttgttccatatccttgccagtatttgttattgtcattgttttggattttggccattttaataggtgtgtagtggtgtcttgttttagtttgcaatttcctaatgacttaaaatgttgaacatcttttctatgcttacttgtcatctatatcttctttggtgagtcgtctttacaagtcatgaggatattttgaggagacaaagcatgtttgaggaacttcagggaagtgagctatagtcaatataataaagggggggaatcaagaggtcagccttgtgcagtggcagagaccacattatgcagatccatgtaaggacaggttaaggattttattgcttgtagtaagagaattgtattactcaatggactaacatgtttcaaattacatagcttggtccaaattcactagcttcatcttccattcctttgtgtattgaaacttcgttctagctaaactgatctactcactaactcttaaatatataatttagtttcccatcatatttcaatttcctctatcattttccttccctaaaattatccatatttcttgaccaataaacgttttttggaaatagagccatccctactagtctgaatgtttgtaagtacttaacacatctatatttcacatactatggttataccactgtgaataactataatagcatagcacatccatgctgaactttaccctggacaacgagtctttgtaatcaaaattttttctagttctcatccagaaagatactgacagactcagaagaagaaaaagaccaggtagtgaattgggatgaatgcctgagtatgtgggcctatccatacatctaaaattctttacgctaagaacagacgtttaaaattaataaatacttagtgcggaagaacagaatactatctgtgtgacggaatgttggaaattcctaaaagatcagaagatatgtatcagatgtatagaagtgactatatccaaaatcatacatagaagagtagttctgcagaggtgggaactttccgtgatatagtaacctcggaagtaatgaacaaatggtataataaaagtcctgggaaatgttcagggtgataatttgagaaatagcacttggagcagcctagaaatttggcctctgaaggagttggtagcataagtatttgcttataagtatgagtaactgtaccttggaagcagagcagtgccgcaaaagatagtttatttcttacagaggttttgtgaaagaattactaatggatatacttaagcaaaataagaaccaatttcatgtaaactcctcagggacagctacatcacattaataagtgcccactcatcaattacaagttactcaataaactaattcaatcatgagtttctgatgctcagcctgtatatggcatttatcttggatccagtatattcctataaggtctttgatttttgcattgtgagaaagattctaccaagggtcaaatatcatgtatttctgataataaaggtcacagaccaccttttaaatttttggcacatcttaactagcagcacctacctactttacatatacagaacattacactcaactgcagaatacatatcattttcaagcacacatgaaacatgcaaatatttacaatatgctaacaaaatgtccagtgaatcgaagttatacagaatatgttctctgaccaaaatgcgctgttaaatcaatgtaaatagataaccataaaatgtccatatgtcagaaactggaaactacatatctgaataatctagggtcagattagtaattaaaatgaaaatgagaaaatattttaactaaatgataagcaaagtgtatataaatctatatttagatggaaattatagccttaaatccatatattaaatggcagaaaaataaagctaagcaaacgcttaactcaagaaattagaaatataaagaaaattaaatacaaagaaatcagaaataaggaaataatatagataaaaacacaaataaaagaaaataagcatataatgaaagaataaacaagtacaaatgttgggtacttgaaaagcttagtaaagtaggtatctgcctaggaatactgattaacaaaaataaagagaagacgcaaataactgatattgaaaatttaagaagggcattagtaaaaatactatggctatgaaaatgaatataatactacaaaaaacttaataataacttttaaaatgtagattttttaggacatatttctagaaaaaacatgaccaaaactaacattaagatatagtaaatctagatgatcttacaaatattgaagaaattatgtttctttaattctatgaatttcaattattctttaatttaacatacttatactaaaaagtttgaggatcagatggtttctgtaggaaattctatcagcttttaaattctcagtttgataatcccaatgtctgacatatctgagtgcaattttgatgttgctttgtctcttttaaccatttagcatgcattgttaattttttaggaaatctggacatgaatgtattgagtaaaaaggactgaggtagataggcttttggtgtgaaatttaacatttatgtcaccagcaatatgtgtttactgtttgctgtgtcttgtttttatcttctctgttgtctatgggcttttctagaacctccttaaatagggtttgtttaaggtttgcagttcttttggctgcaatggttgctactatataagaatcctatttgataggggtggagggaggggaagtgtcgtgtgattaggtctcagtctttctgcaagcctgtgttggatatccatttcccttcgccgaagttggttagactctggtaaaaccccagcctctcaggctctggtaagatagttcccttgaggacgggtcttgttgaggagaatagagacctctggatatatttcgaaatagttaattttccctccccactgccggaagcaaaggggatgattctccaatcttcacccagagaaccaggtaaagctcctggaggtaatagtcatgaaagtgtgagggttcccgctaagattgagtcccctagaactctcaagctagttcatagtgagacaccagcaatttgtcaattgcagtttaaagagttcctaccacattggctttagctgcagggttccgctgctgggctcctgctcacaaaaagctctaagtctctgtgtctgcctgtctgtctctatagtttatagagcagaagttttctgtgtaacctcaattctcagatgtatctaagaagagtggttgattttcagtttgttcagcctttttcttgtgaggataggagtaaagacttccaagctctttacatgggccccaaactagaagtctattagcttttcaagatataaatattaataatattacataaacacttttagcaaataaagctgtaaaccactcaataattttttttttaactccgtcgcccaggctgggatgcagtggtgtgatctctgctcactgcaacctctgactcctgggttcgagtgattcccctccctcagccacccaagtagctgggaatacaggcgcatgccaccacacctggccaatattttgtatttttagtagagacggggtttcaccgtgttggccaggatggtcttgatctcctgaccttgtgattcacccacctcggcctcccaaagtgctgggattataggcatgagccactgctcccagccaaccacttaataattttatgaggccagcaaaatacttaaacctgacaaacaagctgaaaagatattccagaccaaaaccacaatttatatagacatacccactaaaatataatagcagaaaaaatttcagaaatatccaaatgttgataatagcacaaataagctggattcgataccaaaatcctaagataatttaatatttaaaaatcaatttgattcaacatatttactgaatagtgtggaaaatatcacatgagcattgcagtagatacagaaaagcattgataaaattcagtaaattttcattaagaaatttgcatgcaaagttaaaaatagaaaagaattcccttatcatgggttaaaaaatatatttaaaaatctatattataaaatccatatataaaatataccaaaatatctataacatatattatatctaattggaaaatattgaatgccttctcttttaaataaaaaacaaaacaaggtacccaggaacaacattcttttcaagtctcaacttgatgatgtagtaaaacaaaaacaagcaagcaagcaaactaatatgtaatataaggattagagaggggggaaatgaaactctcattgtttataatgatataagtgggtttacaaaatccaaaagaatccacaaatacattattaaaataagttagtgagctgaaaaagtttactcaacacaatttactttgataccactaacaaaatgttagaaaataaccattgtgtaagtcagtgtggcgattcctcagggatctagaaatagagataccatctgacccagccatcccattactgggtatatacccaaaggactataaatcatgctgctataaagacacatgcacacgtatgtttattgcggcactattcacaatagcaaagacttggaaccaacccatgtgtccaacaatgatagactggattaagaaaatgtggcacataatacaccatggaatactatgcagccataaaaaatgatgagatcatgtcctttgtagggacatggatgaaactggaaaccatcattctcagcaaactatcgcaagaacaaaaaaccaaacaccgcatattctcagtcataggtgggaattgaacaatgagaacacatggacacaggaaggggaacatcacactctggggactgttgcggggtggggggagggggaagggatagcagtaggagatatacctaatgtaaatgacgagttaatgggtgcagcacaccagcatggcacatgtatacatatgtaactaacctgcacattgtgcacatgtaccctaaaacttaaagtataataataataaaagaaaagaaaagaaaaagaaaataaaatgttataacagataccttttaccatagcatcaaaaaatattaaatatccaagactgaatctaacaaaaagaatggaagatatatatgtatgaaactataaagcctttgatcataaaatgaaccaattaaatgaagttatatatcacattcatagatgaaagccttaatattatgaacagcattcttcttaaactaatccatagactctaatccttattttcttatttctatccttattttcttaaatctacatatgtttggtgaaactttccaacatacttctagaattcaactatcccagaagggagtctgtggagaagtttgcttggaaggcctgccatctattcctttttctagaatcgtatttgttcactttccaagatggggcacttaattatgtgcagagttcctttaggtttcaaatgtctcatgtcatccaggataaactacatgcttgggatgtgacaggaaaattattcactgggtgctgatattctgcatttctcttggctctcccaagcagtcattttcaaactacgtctaatagtgaagggatgtccatactctacatctgcctcgctctaaattgaaagacattggtcaattatttcctggatttggtagacttactttttcccatttgactatgctttgaagcatgcatcagatcctcaccaaactatacaaaaatttctatgaattattagatactactttctctatgtttcaaacaaaacttttcaaagattttgggataaagttggagtctaccttttttgcttaataactgttgatattttttgctagttctaattcagtttagaccactatgttggaaggggtagaatttcagatctgctcttttggtgtagtttgcatccacaagtgtaaatactgatattttaacatgatttttagctagtttattgtgataattatcttacaaaagtagacctaataaatgccaattgtataaccaggccacattaaacactgcaaaaaattcaaaatgataaacaagaacatgcttttagcttgaagaaaatttgaatcattagtttaactaattaaatatttctttcttcaacacaaatgctccttgacttatgatggggttatgtcctgatataccgattataagttgcaaataccgtactttgaaaatgtatttaacctacagaatatcatagcttaacctagtgtactttaagtatgctcaaaacacttacattagtctacgatcaggcagaatcatctaacacaaaacccattttataacaaagaattgaacatctcatgtaatttattgaatactatacagaaagtgaaaaacagaatggtggttgtgtattcaaagtatggtttctacagaatgtgtattcctttcacaaaatcataaagttggaaaatcttaaatcgaacagtcatgagttgaggaccacaatgcagggaggagagacagggagggaaagaaatagggtgagaaaaatagaagaaaggcaaaggagaaaaagaaacagagtgggaaatagggagtgagggagagaagaaggaaggaagagaaatgggccacagggtcatttagtctagaaataaatgtcattttattttattaatcaacactcagttaatacaattgttttagatgggaaaggcttccctgcttgatttcacaagtgaagaattaaagttttgctgtgataaaaatgatttaaaagtcattctggctgtaactgtgaggttggaagtgacaggatgtttataatacttgcttggatgctttacacatgaattaagcctacgttaaaaagataataatatacattccacgtcatttagcaatcattagaaagaacaagaaaggctacagaaatagctttaatattccctcttccccacccgactagaaaaaaaagaatgaaatgcacaaacaaatttaataacacatacacatacacaacaggcaaactggtctcttaaaatctaggggcaaatggcaaagaagaaaggcaaaaaaaaaaaaaaaaaaaaagattgcatggcacattcactttttttccctattctaactagattattgtttacaatatggtatttaaggactctcatatctaagttacatttcccagcacaaaagcaaattattcttttgcattactttaatactttagaacagtatgcattgcattgagaccttgtagagcaaggtgttacatttaaatctttgatctccaaaaaaatagcaggatcaaagttttccatcatttggacataaatctcagctcaaacaaagtgataatagtctagtcaagaaaaagcaacctggaacaaatgcctttgaattggtgttagtctacgtggttggtgcattactgaattaattaatcatttctttgaacttcgatattctgctgtctctaggttaggagtaaatgtcagtcactgttcatctatttgaaattcattctcaatactaatattttgtaaatcaaaagagaaaagagttaaactttgtggctctgggaaacatattatggggaaagtttatgatgtaaagaaatgcacacacaaaatttaacatctttactgctctcaatgagaaaattcttatcctaattaaaggactgattgaatttgtggggtttttttattgttgttgaagttaatttgattgcctactgtagtaattaatgtagttattaatgtgaaatcaagcaggttgagcagaatcacagctcttccagttacttgttacttgaacttgagccaattacatgacctccctaccacacaggtgctccatttgcaaaatggggatgttaatagtacccatcatataaggtggtcataagcattcatgagatagcagttgtaaagtgttttccacaatgactgattatgcaatacttcctattcataattaataagtatatcactgatattttaaaagtattcatcaatgacaggagttttaaagcttgttctgaggatttatggagagtctgtggaagagttaataagcctggaatttcctatcctgtgtttcaaagagtgcagttctattcttacctctttatatatttttaaaatgagatttaacatattcaaaagtagtgagagcattataaaaaaatctcctatgtacctatcacccatttttatgtaattaacatttcaacatattttattgtgattttcttcataagatttggcttgcaaagatttatgatgttaaaaattaatttgaaaaccactgacttatagactaaatatattctagcaaaaatgcgtgtttccttttttcttttctattttttattgatatatcactgttgtacctattttgggggaacatgtaacatttcaatacatgtatacaatatataatgaccaaatcagagtaattggggtattcatcacctcaaacatttatcttttctttgtgttgagggcattacaattcctctcttcaagctatttgggaatatacaataaataactattaactataatttccctactgtgcaaccaattactagaaaatattccttcaatataatcgtatttctgtacccataaaccaacttccatacaccctccctgccccttctcctcccagcctctggtaaccaccattctactccctatctccatgagatccacttttttatctcccacatatgagtgagaacaggtgatatttgtctttctgtgcctggcttattttacttaatataattacctccaattccatccatgttgctataaaggccaggatttcattttattagatggctgaatattccattgtgtttatatacgacagtttttaaacccatttgtgcattgatatacacaggttgattcaatattgtggccattgtgaatcgtgctgcaatgaacataagagtgcagatatctctttgatatcctgatttcctttttttaaaatatatacttagcaatggaattgctaaattatatagcagttctatttttaccttttttggggatttacatacttttttttataatggctgtaataattcacattcccatcaacaatgtataaggttctcttttctcaccatcctcaccagcatttgttatttattgttttaacaatagccattctaactggggtgatataatatctcattgtggttcaatttgcacttcctcatcgtaattctgagcatttttaaaatatacctgttggccatttatatgtattcttttgagaaacatttattcagttattttgactattttttatttagactatttgtgaggtttttgctattgagttggttgagttccttatatattttggttattgatcctttgtcagtttgacatattttttccattctagaattgatctttatcaagacccatgtcctggagaatttcaccaatgtttccttctagtagatgcatagtgcaggtcttacatttaagtctttaattcattttagttgattttttgtatgtggtgaaagatggggacctagttgtattcttttgcatatggataccagttttctcagcaacatttattaaagagactatcttttttccaatgtatgctcttggcgcctctatcaaaaatgagttggctgtacatgcaggatttatttcctgggttttttattcattgatttttgtgtctgtttcattggtttaggtgtctttttgtgccagtaacatgctgttttggttactctagctttatagtacaacttaaaatcaggtaatatgttgcctccagctatggtttttttttttttttttctatctttttctccttttttttttttttttgctcagggatgctttagtcatttcagggttttcatggtttcatgtgaattttaggactttttttctatttatgtgaagaatgtcattggtattttgacagggattacattgaatctatggatagcttcgggtagtatagacattttaaccatgtaatttttccaacccatgggaatgtccttcaattttctgtgtgtgttcacttcaatttcttttatcaatgtgttatagttttcctcttatagatcttttacctcattggttcaatttgttcctaggtatgttttggtagctattgtaaatcagactgcattcttgatcactttttcagactgattgccctcaatgatctccatacctgttttattgcccttctataatccattctcaatgcatcaacgtgaggaatcttttataaacataaatcagatggcatcattccctggctcaaaatcctagctttctctgaatgcagtccaaattcatcacaagaccccatgttatctctccctccccctcctcacgtggtactcttttctaattcacagcactccaaacacatggatttgacaatgccattacttttcttcaaataagcacaccaaccttgttcctgtcttaggactttgtgtttgtttttccctctgccaggagcacttttctgtcagattttcactctctgtagcctttcatttcacaggtctctgcctaaatattgtctccttgaagagtcctttcttgaccacctaatctaaagcagtcaatctcctttcccagtcactatcacaggaagaccttattgcagttctcacagcacttattagtatctgaaattatctttctagtttattgatttcattttgtcttttttctctcatataattttaataagatgatggactttgactcttttgttaggtgaattttccccagtgtctatttattggctgatgcaataaatatttgttgggacagtagttaaatgaataaaaatattattaaatagggggtgtggaccactgtccttttaggccagacttcaccctaattgtagttccatccatttttaaaaaagctttatttaattactcatttcatttccctaagccattttctcttttaaatagaattattataagatatgttattcctgggaagatggcatgaaatgacatacaacttattctccattcaccactctactgcaccctggatctaccagatccatttcccactctactgcatcctgttctgtgctgtgactggtatccataatctgtattacctggatccattttcccttaagctcctccttgagatccaacaataggagaactcctccacttcccctattttcttttccagacatgttttctttaccagctgactctgaatgtaataacagattctgcctggctgctttttcccttccaagtcccagctcttatcaggcactggcaatgccattctttcttcttgctttccaggggagctaaagtcttccaactatttttagtacctggatgccttattgcccatatgtttataaatagttatttccttaattaacttaagctaaactctttcaggtgagcatttgtctcttgccaggaccatgattaacactgatactgtctgtgggcattttctacacttcccagaaacaatttattttaacaacatttattgaatgccaattgcatatcaggcactaagtaggcactcagcactatgtgtatctgatatatagacataagtgtcataatgatgatgttttcattaaacaagatagcaagtcttttaggcataattaaaaatcaaaatataacatcattaaattaaaatgtgggttaagaaaatgcagcagaagatttgtgttctggtgagtcgctgcttcttttgttagtgtttctgttggttttatgcacatatcacagaaatagaaaatatatacatatttacacgcatacacatacatacatatataaataggcttattcatgcttgatttgtgtgcaaagctgcatcttatcaaacttcacagtcaattatatattcactggcatgatctacaaatgcattaatgaatcagataaggcaaatacaataaatgcttatttattttcattttatccagcagaacttgctggtaatcagctacctgtacatccacactgcggtaacatttctacatattcatggcaggcagggatcagatcgttgattttcaaggtctctgactcagtcagagttctgaggttccaaacccagacccacatcttactagacttttgccttggataagctgctaaaactccaaacctcatctataaaaaatagacagaaataaacaatagtgccagtctcattgaatagggctgttgtgagaatcaactatgttaatgcatttaaaatgcttatcaaaagaacatggtgaatgcttaaaaagtagttgctactagtgtaattgttattagtgatgatcctgagactgcgtaaaattctgaaagatattcagaaacgtaaaatttgtagtctccttatttgacatagcatgtggctcctgatatctattctacatcaaacttctttgaactattctatatgatcactgtgtgttctctgtagtctacacatacacacacacaaacccctataaaatatatataaatatatttctgatttttttttttttttttgagacagagtctccctctgtcacccaggctggagcgcaatggtgtaatctcagctcactgcaacctccacctcccgagttcaagcaattctcctgcctcagcctcctgagtagctggcattacaggcatgcatcaccacgcctggctaatgtttatatttttcgtagaaacggggtttcaccatggcggccaggctggtcttgaactcctggcttcaggtgatccaccagcctcggcctcccaaagtgctgggattgcaggcatgagccaccacccccggcctatttgtgattatatatggagacttgattgaccaagtatgctacctttctatcaatccagcataattacctaaactctatagctctctagtctgtgaataatctaaagaggtagaaaagcaacaattattgctgaaatgggagtgaggctaagtaagcttgcctctttcatgaaatcattaggaaacatgaatagatctcttctctgtgatctcttgccttcatctctcaccaaagtaaaggatgtgataaagtaaaggaagtgaattagacattgtgattttcaaagagttgtccataaaacacttcaacaaggcttttgggtaattcttatccatgctgagtaccggatagaaaatggtctaaatggtatcttctaactgtattcttcagtgatgcatgtcaaaccattaccactacattaggaatatattcctgttaaactggcgactgcccatatgggaaagagaaaacggacactggtctaaaccattcagacctttctatgttaaaactgttactatctaccttatctttaactgttgtttttgcatcatcgcaattttaacatccgcaaaaaagcataggcttaatggactgtgaagcagtgagccaatcacaaaggcaacaaaaaattcaatcacaaacacctgcaactcattacaaatttagcagcacaaatgccagaggctgtaattggtctcaggtagtctctgcaactctgccaatactcacctataatttggagttgacatttacaaaaaaagacaacatttacaaaaagaaaagggcaaagagttttaccaaatagtgccactctttcaacttcccccttcctgccaagacacctcagggagaaaaagatcaattctaaatacaggtgctatttgtattccttttggagtacttatgaaacaaaattaattaatgaagaatttaaaacaatattcactaggaaactgggaggtattttattttcctccagaaactaacattctctacaagtatctctagtataaaaaaaaaaaaatagggacaaaagagagaaagaaggagggggagtggaaataaaaataatgtcagttttatttttagatttcctttctattttgatttaaggattaggtatagtcagtaaatatagacttaaaatcttgcaaatgaggactgttacatttgcaaatatggaacgttttggttgtcattttgtggagtgaaaagaaaaaaaatggaacataggcatctggagagttgaattctggtcctggatctgtcactggttgtataacattggagaagttgtttaactccttgagattctgtttcctccatttaaaattttgaagattgcaggctctggcttgatatccctctcagcagcttcagtttctgagcaagaactctccatcagatgcaagccgtaaaccgttaatttttctccccacatttcctttgacaatcactctcttctttatttttcacagcataagcctgatatacagacactgtcatttggaacagaccctttaaagtgcctactgctaacgcacctgctatcttaaggagaaattctactttgtacctcattctgtgttttaaaatgttagcaagatttttcctttctcattctctcagaacattttggaagttgcttcctttcagtgacatttgatgttaattgaggaatgcaaactcattttaatatcggaaatataaacagaaaagtagccttttaataatcaaattgtaaataaataaaatattttagtgttatgcttggcatggtagcccaacatttacaagcattattgaaagttttgtaaggaacaatgatttgtttcttacaaatacctgatttctcaactgaagtcactctcatttcctgtcccgcatgttccataacattttttgtcattttcttatactacaactaacaaacatgcttaaaattaacaaacaaacacctttcttaagcaaacccttcatctagcaagtatgctgctgaaataaaacagccctgaacgtctatgacttaggagccttattctcttattttaggtatcatatcaaacattcataactcatctagaagattcacaaacacaggtcattttcacaaaatttcctaaattgccctttctttcttcacctccggcagtttggaaaggtcctcttttcaaaaaaaaaaaaaagtaatgcatgcaatatcagagtatccagggtgcagtgtgacaatcaggtatgaagcgaagaaaaggaaatagaaatgggagaagataaccaaaaatgactagaggttatgtctgtctgtttgtcttagtcttctctggctgccataacaaaatagcacatactgggtggctcaaaaaacaaaggtttattttctccgcactctggaaggaggttggaagtctgagatcagggcaccagtatggctgggttctgagtatacccttttaggcttgcagacagataccttcttgctgtgttctcatatgttgaagagagggaaaaacaaatctcactctcttttcttcttcttaaaagaccacagttctactggggtatgtcgccaattttataacctcatacaaccttaatttcctcttaaagatcccatcctcacatatagtcacattggagcatcaaaatatgaatttagaaaggctacaattcagtccatagcactattattataaaataaggaggagaaacattcacaacatgtatttaattaaaaaaaaaagttttataaacaatatatactgatgttatacatatatgtattgtatgtatatatttgtatggtatatatacacacatgcatatatatatacttatagaaaaattactaaaatatatttggtggttacttctgggtgatcagattatgagtgatacctaattcatcttagttttcacttaaataatttcctaaaactgggaaaaatactgttaataaatgttacctcaatgaactgacatactccggaaaataatctgctaacttttatagtgatttataaacctttaactcaggtcactataagtgaaaatatttccctcttcaatgaactcgcaacctcagaatgcatttgtgagttctcttgcagtgtaaattatgagattattcctaaccttgtcaggttctggtgacatactgcctaccataatataatagaagcaattcataatttttttttttttttacctgaactagtttcaagttctgtggctttgcagctgccattgttcctgcttcacacagaacattcggtacaggggatactttatgggacagaacagatagttgaaagctgattttacttgctaattctcccttgttattctggcattaaggttgcattagaaggatgcaaagatgtttgatgaaagtgatctgtgctggggttggtgctctgcaaatgctttaaaggtgtggcacatgacattgagccagtgcatccaggtggagcctgggacagacataaaaccctaggttggtaaacacctgtcacaggaagcctcatcaaggaattcttggggagtggaacagtggagcaccctgcaatcctcacaggcagcagccatagtaagcaatgttcagcatttgctgtgcctcagagacacacacagcataaccctacttcagcagctcactgcagaaaatgaaccatatcccaccaaacgagcagtcaagtgcttgctaaaggacgttcccaaagagtattgttctgagcccaaggtgtgggctgttgggttcaggtgtgagaaacagacagaggcagggcaaggctgttggtatatactgttccaggaacaaatctttcccaatttaaggcactttatattgcagccaataaactcttttagtagcatccggttttgcttcatgagtgacttctgaaataatgtgtgctatttttaatactcaatatctgtgtttgccatgacattaaaaagattcagaaacaatgggttaaccaaacggcattttgtcattatctaaattcaacccaattatgagaaatgaaagcaaagggaaaaagtttaagaaatttggtagtaaagtaagaattattaaatattcagagtcaatgtctctccccacttaactggctctttgactaacagtttaatcttcacatggcttaaaattcgattcatttagtacctcctctgctgctgagaaaaacctggtgcacgtggtactctaagatggtctgcttcatcttcaatcacacactaccctggctggcagcttacctcatcactgggctaagagactttgaagagtatttatttcacattccactaattaagctgcgtatgtgaccttactaatcaaaggttcaaaagaacctgaagaaaaataatacattgtttttcaaaataatactgtctgagtgagagttagtataaaggcaaaagtaaagtcttagaaaagattttcaggtggtgcaaatattcttacctatttatataaccttacaatctcttattatcttgatcagaaaattagactaagtatttccatcacaaaagtgtctggtgatcacagaggaggtgtggtatgtctaaatgacatcatcagattcacttttgaaatatcatatgttataaacagtgctaatatttcagtagtccacattggagaaccctttaatgggttggttgactttctctatgaaagtacaaacacttattagcatattcaattatattatcaatacagtttgcttcaaaaatcccaaactctttttctgtttactctatggatttctatttataatatgcttttgttgttctttttagattcaatcaccttggaaagccatggcggcagcagagaaattgctttatcaatattgagatttatttctttataaatcacgatcttatatttactgccttttcttaggcttaaatgaaggataacagaaacatctaaaaatcttaaattatttgagttttattcacttttctttcttctcctacccccaaggcatattataatattaaatctcataaaaagaaggaagataatgtattagtccatttttatgctgctataaagatactacccaagatagtaatttataaacaaaaggggtttaattgactcacaattccgcatggctgggaaagccccaggaaacttacaatcatggcagaaggggaagcaggcaccttcttcacaaggcggcaggagagagaaagagtgtgtgtgggaggaaatatcaaacacaagtaaaagcatcaaatctcatgagaactcattcactatcatgagaacagcatgggggattccacccccatgatccaatcatcttccgccaggtctctcaacacctgggattacaattaaagatgagatttggatgggacacaaagcctaaccatattattctccccctggaccctcccaagtctcatgtcttttcacatttaaaaaccaatcatgccttcccaacagtcgcccaaagccttatcttatttcaatattgcccacagtccatagtctcatctgagacaaggcaagtttctgctgcctatgagcctgtaaaatcaaaaacaagttggttacttcctagatacaaaggaggtacaggcattggataaatgcttccattgcaaatgtgagaaactggtcaaaacaatgggctacaggccccaagcaagtgtaaaacccagtagagcattcagtaaatcataaaactccaaaataatcttattggaatctatgtctcacatctaggtcaggctgatttaaaaggtgggcttccatggccttgggcagctctgcccctatggctttgcagggaacagccccctgccccagctgctttcacggctagtgttgagtgtctgtggtttttccaggtccatggtgtaagctgttgggggatctaccattctggggtctagagaagggtggccctcttctcacagctccactaggcagtgccccagtcaggactctgtgtgggggctccaaccccatgtttcccctttgcacaaccctagcagaggttccccatgagggctccggccctgcagcagacttctgcctgaacatccaagtgtttccatacatcctctgaaatctaggcagaggttttcaaatctcagttcttgtcttctgcatacctgcaggcccaataccatgtggaagccaccaatacttgggggttacaccttcacagcctgagctgtaccttggccccttttagccctggctgctggtatgcagggcatcaagtcctgaggctgcacagagcagtggggccctgggcccagcccatgaaaccatttttttctcctaggcctctgggcctgtgatggaaggggctgtcacaaaggtctctgacatgctctggagacatttttccccattgtctttgctgttaacattctaattaattctaattctaattctaattctaacattctaattctcattactaatgcaaatttctgcatcaggcttgaatttctcctcagaaaataggttttgctcttctatcagatggtcagcctacaaattttccaaacttttatgatctgtcacctcttgaatgctttgctgcttagaaatttgttcttccaaataccataaatcatctctctgaagttcaaagttccacagatctttagggcaggggcaaagtgtcactagtctctttgctaaagcataataagagtgacctttactccagttcccaataagttccttatctccatctaagaccatctcagcctggacttcattggccatatcattatcagcattttggtcaaagcattcaacaagtctctaggaagttctgaactttcccacatcttcctgtcttcttctgagccctccaaactgttccaacctctgtctgttacccagttccaaagttgcttccacattttgggtatctttatagcaggaccccactctctatgggtaccaattgactgtattagtctgttttcatactgctgtgaaaaaatcccttagactgggtaatttgtaaagaaaagaggtttaattggctcacagctccacatggctggggaggcctcaaaaacttacaatcatggaagaaggggaagcaggcatgtcttacatggcagcaggtgagagagaagtgcaagcaggtgagacaccagacacttacaaaatcatcagatctcaagagaactcactcactatcacaagaacagcatgaccatattattgaaaaatggccccatgatccaatcacttcctaccaggcctctccctcaacacgtggggattacaattcaaaatgagatttgggtaggaacacaaagcctaaccatatcagataacatcatggttcctaaggctttgtttttatttgttaaggttcagaaaataataatccaaagtatgatgttttaacatgctgaacactttgaattaaggacattaaaaggccttagaaactgcctcagaatcaagacctctctaacctttcctgtttctaccctgctaagtgcagggaggggccctctttaaagttccattatcctgactgaggaaactcttccaaaagaaatgtcattatcttggaacccctttcctggaatctatattaaccggaggagtttaactcttattgctagagaggaaactaaaagtctccatgcgcagaagaccatatctggacagattttttttttttttttacctgttctttcaactattcttctaagagtttttagagagattttatctgcataataaaacaacttttgttcacagtgcaattccacccttacctgcccataactgttgccatatcccctagagcccaaagaatctttgttccaggctattgtctgatatttggttccattcatttcccctaaaactcatttactcttcctgtaaaattgtccacagttcccacttccctcccactatgaaatgggtattcaatccaacagtttggtcctactttgagtctcatttattgttgttgctgtttaataagtaaatgtattgtgttcttctatgactaccctctaatttctttgttttttaaaagaagattttgtgagtacttagtaggatgtttatatttatggggtacatgaaatgttttgatacagacatggaatgcaaaataagcacatcatggagaatggggtatccatccctcaagcatttatcctttgagttaaaaaaatccaattatactctttaaattattttaaaatgtacaattaagttgttaagtgactgtagtcaccctattgtgctatcaaatactaggtcttatttagtctttctttttttatataccaattaaccattctcacctaccacattcagccccccactatgtttgccagcctctggtaaccatccttctactctctatctccatgagttcaattgctttgatttttagatcctacaaataaatgagaacatgcaatgttggtctttccaagcctggcttatttcactgaacataatgatctccagttccattcatgttgttgtaaacgactagatcttatttttttatggctgaataatagtccattttgtgtacgtaccacattttctttagccatttatctgttgatggacacttaggttgcttccaaatcttagctattgtaaacagagctgcaacaaacataggagttcagaaatctctctaatataatgatttcctttcttttgactatatagccagcagtggatttgctggatcatatagttgctcaatttttagtttattgagagacttccaaactgttctccatagtggttgtactaactaacattcccaccaacagtgtttgaggattcccttttctccacatcctggcaagcatttgttattgcctgccttttgtataaaagccattttaaccattttaactggcatgagatagcatcttattatagttttgacttgcattcccctgatgatcaatgatgttagcacattttcatatgcatgtttgccacatgtgtgtcttcttttgagaactgtctattcaaatcttttgcccttttaaaaatcagattattagatttttttcctacagagttgttggagctcctcatacattctggttattaatcccttgtcagacatgtagtttgcaaatattttttcccattctgtgggttgtctcttcactttgtggattgcttctttgctatgcagaagctttttaacttgataggatttcatttgtccattttttgctttggttgcctgcacttgtgggatattgctcaagaaatctttcactgatgttttacagttttcattagtgagatctttcacttctttggttaattcttaaatatttaattttatgtgtggctatttaaatggaattaatttttatttctttttacgagtgttcactgttggcatatagaaatgctactgatttctgcatattgattttgtattctgcaacataactgaatttgtttatcagttttaatagttttcttgtggggtctttaggtttttccagatacaagattatatcattagcaaacaaggataatttgaattcttacttttccattttgatgccctttatttgttctcttctgtgattgctctagctaggacttccagtactatattgaataacagtggtgacagtgggcatccttgtcatgtttccgatcttagaggaaaggctttcagtttttccccattcagtatagtacttgctgtcggtatgtcatatacggcttctattatgttgaagtatgttccttctatccccaggttttgaggatttttatcatgaagagatgttgaattttaccaaatgctttttcagcgtcaatcgaaatgatcatatggtttttatccttcattctgttgacatgatgtatcactttcattgattagttatgttgaaccatcctcacatcccagggataaatcccacttgattatgatgaatgatatttgtaaactatttttgaatttggtttgctaggattttgttgaggatttttgtatcaatgttcatcagtgatactggcctgtaattctattttttaatctgtctttgtctggttttggtatcaggataatactggcctcatagaatgagtttggaagtatttcctgctcctttattttttttggaatagtttgagtagaattagtattagttcttaaaatgtttggtagaattgagcagtgaagccatcatatctcaaggttttgtttgtttgttttgttgttgttgttttattaactgggagactttttattatgactttaatcttgttacttgttattgctctcttcaggttttggatttcttctcagttcagtcttggtaggttgtatgtgtctagaaatttcttcattcttctagattttccaatttaatggcatatagttgcccttactagccactaatgagcctttgaatttctgtggtttcagaagtaatgtctcttttatcatttctgattgtatgtatttggatcttctccctttttattctcagtctggttaaaagtttgtccattttgtttaacttttcacttctttgttttctcagtctggctaaaagtttgtccgttttgtttaacttttcaaataaccaacttttaattttttctattgtctttttcacttcatttttatttatttctgctctaatctttattatttcttttcttcaactaattttgggtttggtttgttcttgcttttctaattctttaagaggcattgttagattgctcatttgaaatttttcctcctttttggggtagaaacttatagctataaatttccctcttagtgctccttttgctgtattacataggttttggcatgttgtgtttccattatcatttgttttaagaaatttttcaatttccttcttaatgtttttcatttacccactggtcattcaggagcatatagtttattttccacacattcatatactttgcaaaattcctcttgttattaatttctagtttaattccattgtggtcagagaagatacttaatattatttccatttctctaaatgttttaagacttgttttgtgacctaatgtatggtctattttggagaataatccatgtgcagaggaaaagaatgtgtattctgcagctcttagataaaatgttctgtaaatatctattagatccatttggtctatagtgcagactaagtctaatatttccctgttgattttctgttgggaagatctgtctcataataaaagttggatattgaaatctcaactattattgtattggggcctctctctttacccataagaatattccctttatatatctgggtgctccagtgttgggtacatgcatatttaaaattgttttattctcttgctaaattgccccctttatcattacatagtgaccttctttgtctcttgtatagttttggtcttaaaatctattttgtctcatataagtatagtgactgctgctattttttggtttccattagcatggtatatcttttaccttcccttttatttcagtctatgtgtgtttttataggtgaagtgtgtttcttgcaggcaacagattaatgggtcatctttcttaatccattcagccagactacgtcttttgtttgaagcatttagtcaatttatatctaaagttattattgatacataaggacttactcctgccattttattatttgttttctggtcacgatttccatctttcttttcttcctaccttcctctactgaaggtgattttctctagtgatataatttttagattcctgctttttgtctattcattgtatgttctttggtttgaggtcactatgaggcttgctaatactatcttacaaagttttattttaacctgattacaacctaacactatttgcataaatagacaaagaaaaatagactaatacaaatgccacagcttaatttcaccccccagttttttttttttaactttttgttgtttctatttatatcctcttgtaatgactatgtcttgaaaaattgttgtagttattatttttgattggttcattgttgagtctttctacttaggataagagtaatttacataccacatttacagtgtataatattttgtgtttttctgtgtttttacacagaaaacccaagagttttatgccttcgggtgattacatattgctcattattgtccttttctttctgatagacgtatttcctttagcatttcttgtaggacaggtctggcattgatgaaatccctcagcttttatttgtctgggaaagtgtttatttctccttcatgtttgaaggatagttttactggatttcctatcctagcataatttctttttccatcagcattttaaatatgtcataccactctctcctagcctgtaaggtttccactgaaaagtctgatgccagacatattggagctccattgtatgttatttgtttctttcccttgctgcttttaggatgcttttttaatcctagaccttttggagtttgattagtaaatacattgaggtagtcttctttgggttaaatctgcatggggttttataaccttcctgtacttgaatactggtatctttatctaggcttgggaagtttcctgttattaactttttgaataaactttccatatctctttctctacctcctcttttaaagccaataagtcttacatttgctgttttgtggatattttccagatttttcagatgtgcttcattttttattattttttcttctctgattgtattgtcaaatagcctgtcttcagctcactaattctttcttctgcttgatcagttctgctattaagagactgatacattcttcagtgcgtcaattgtgttttcaaccctaaaatttctgcttgtttcttataattattttaatctctgataaattgatctgatataattctgaattccttccctgtgttatcttgaatttattcaagttccctcaacatagatattatgaattctctgtctgagaggttacatatttctgtttctctatgattggtccctggagacttatttagttcatttgttgaggtcacgttttcctggatggtcttaatgcttgtagatgtctgttatgcctggacattgaagagttaggtgcttattatagtcttcactgtgtaagtttatttgtagctgtccttctggggaagactttccagatatttgaaaaaaattaggtgttgtgatctaagatgtttctgctttagggggcaccccaaacccagtaacatcatgattcttggagactcatagaggtactgtcttgatggtcctgggcaagatctggaagaattatctggattaccaggcagactcttgctctcctctcttactttcccctaaacatagtttatctgttctgagccacctaaagctgggggcacaaaacacaaacactcctgtggccaccaccactatgactgcattgggtctgacctgaagtcaggacaacactgggtctcacccaaaatctgttgtaactactacctgggtaatacctgtgatcactcaagtccctggacttctaaaatcagcaggtggcaaggccagacaggcctttgtcctttccttcaaggtgatgtagtccccgaggtgctgggtggctccatacgtgtcatcgaggagttagggaatagagtaaaaaaccttagtgtctacctggtattctattgtattgcagctaaaatggcacacaaaccacaacacacacttcttcccatgcttccgtcccctttctaaagacagaggagcctcactcggtagctactgccaccccaggccacaaagagtactgccagactactgccaatgttcccttaaggcccacgctttcttaagtcaacttgtccttaatgctggctggcctgggcttcacccttcagggcaacgggctcttctctgttccacagtaggttcacaaatgccatccaagagtcagttcctgcaactgaggacttcaggagccctcttggtgctgtacccatctgtggccatgctagtgcaaagtcatagtccccttcacttttccctctgcttttctcaggcagaaggagttttaccccagagccaccacagctggtaataagctgagtctcacctcaagccagcaagtttcagaggcttacccaagacccttgatatagtacctgggtatcaaagctaatgattcagggcccaatcagatgatgaatgcttccaggactgggtcattttcttcaagcaaggggttcccttctgacccagggtgtatctagaaatgtcatctggaagctagagtctggaacagtgccttcataactatgaccagtaccctatcctcctgtgactgagctggtatccttggtgcaagacaaagtcctccccactctttcctcgcctctctttaagtggaaggaaggtctctttggagaagtgggccatgcagcctggagtggtaatgccagcactcccttggctaccccaactccccggtccactgtttctggatctagttcagcactagggctcacctaagttttgcagtctttgtggcctagactgactttcaagtttactgggagacacagaatgctgtagccctcggtggtgaagtttgcaggcactcaagttcagaccactgggatcggtttttctcctctggctagagctggtttaaatgctcccttccttgctggggatcagctgagtttggtctgcttttcccttctgttctaataggacagcactaagtttcgtgcttcacaatgtaccagtaggtagctagtcaggcctgatcagggcaagagagtgctccccacaacctaacaggaatgtcaagtgaccatcacatgacggtcaggcagctgtcacaccgtttctccaaaataataattggtagcagccagcaccagggaaaggcagtatcacaataaatagaagcacctgaaactaatgatcagtagcttcccaataagctctcaagaattgggcaagtgaactcaagcatgcgcattaagaggcaaaatggcagaatttaactggtatatgacctcttagggatgttcaactggtaagagaagattgcttcaagtgagggtgcatgcaattccagtaaacacactgagcatgctcccctcccaagtgcttgcaggccactgtgcatggacagccaaccccaagggaagaatcaggggagaaagaactcaagacccagaagtacgaaaatgcataaaaccccaagtcaaaaggtgaaaccgtgagtgtgtctttcaaatcacctgcttggccctcttccaaccgtgctttccttcctttcattcctgctccaaagctttttaataaactttcactcctgctctaaaacttgccttagtctctccttttgccttatagccctcagtcaaattctttcttctgaggaggcaagaattaaggttgctgcagatccgtatggattcactgcaggtaacaacaactgctgtgttctcccctccccagcacccagacatgctttttgcaccacatcgctgctgcagggggatgggagaggggttggcaattcagaactgttttttctgtctcttcagtgccgctttcagcaatatgaagttaaaaccagatactatgagggcttaccggatttttggttcttaggaaggtgttttttctttgtagatgcttgttaattttggtgctcctgttggggggatgatcagtggaagctttattccacagttttgctccaccctctgagtctcatattttgtgtagctcccgcacatttttgcacgttaatacatttgtatgtgttttctcctgttaatctcttcattgtcaatttatttcagcagacagttaatcaaatcttcatagggaaaatttaaacttccctatatattttctatgcaagtgaaaatataaggttgtaggtgagaacctgggttcaagagttaaaaccaaaaagcagaattcacataccattttcactgtgtgaacttgaatgttatttaacctcaatatcttcatctctaaaataatgtattaataacaagcttcagagtgctgtttgagggtaaaataacaagcaaactataaggcatatggtgattacacaataaatcatatgttactattatctacaaatgtttactatgacatattattatgaccaatttactattttaaaaaagactgaatatattaaattctatgtcatagttcaccttgttggaaaaccacagtcccagttcctttaactccaaagtatatttttcctccaagtgcaaatatagatatgatagtttttttttatttttaaatttcagcaatctgtatcaacaagctctggaaaggtgttaaaaacaaacagacaaaagcctaatgcttactctttgtccttgatagaacgtatgttaatagttaatgaaatccaagcagaatgtcctgcttcaaccttttcatcttcaaatccatctagtcctggctgtcatgcaccaacaggaaatatctaggaggcttctttgccacctgaatttgtttgttcgtctctttctcctttactaggcctgcattaacattttctttcttttatgaaaatattcaaatgcaaacagaaagcaaaacacttaatccactctagtaggtctgtgagacatatggcctgtggagtaatttaatccagcccaccatggaatctgaaaattgcttcttcaatcccctgctgtacccaaatctgaatgcaggaagaacagtctcagaaacaagagctcctgagtgctgtttctaaggggcaaggccacagaggtgtgcaactgtaggggtttatgaattcaatttactcatactcaaagcaatgcaagagaaataactgtagttctcctctcctttaaagaactctgggttagaatggaaagaattcaaagcttctaactcatttagagaaaatacagagccagatctgacccaggaccagaaggagaccttctaaaaattcaaatagctcccattgataactaatcccttgatgagacaaaactgacattatcaccttttcaataatgatggtgctttgtgcaaactacacccctccacacatacactgtaaaagctagtgatttctgctgttttgtgtacacactttaacagctgatgattttttagattttttagggaaaaaatactatataaacatgcctaaacctttttaaaaagggttttggatattcttctgtgagtacatgtgattaaaatacttaatgatgtctctgcaaaaacgaaagactctacattttaaggagttacatcccttataatagtctcattaatttgttcactcataatgctcactccaatttaatttttattatattattttatctttcttgggtttcttagtgggttttcattacccatagggctgcagcatgtccaagcacgaacctcacaatttcattaagttaattcagtggccaagaaatgtagttcttcataaaaaatgagacatctccgagaaacacaatttggtagagatattaaaatagttttttttaaattcagcaagtcatcatcattatatcctagaatatagcaaggcacgcagaagatggcatacaagcctccctaactgcatgcaattgctgaatttggaattagagaatcttctgcctcatcttggaactgtctcttcatgcagctgtccattcagttagtctatttacaaataatttttgaatatttttatatctgtaggtgctgtatgcaaatatgaaaagccaaagtcctcttatttgctgtctgaacctagccacgtcacttaaacaccctgagctccagttcttgcatttactaaatggggatactactacttcatagccttactgtgaggattaaataaaattatctatgtaaaagtgcctcatacatctaagatgttataaaaatattagttggtgatgatttccctgctcactgtatacagaacacagtgactatgacattattaccctctcttaatttttgatgaccaagaaggaccttctcactaagaaatgacccttaaccaacatctcttttttatgtaaaactacattaaactctgtacatccagtccattgcatttccttccattctcatccttggcaggggtcgggggaggaaattgttccatatcatggaaaatgttccacacctgcactctcccaagtcaaaaatttacttatataatttactttaatctcactttctaaggacttaatttagtggtaaaatgagaggctttctcagacaaatctgctggtgactattaccaagttctatgacatttttgtctcttcatccgtaaaataaataaaatatctacttaatgatgaattatgaaaattagaaatgaactgtgcataccttacctagctgatcaaagtcaacgtcaacagtgataaatcatgttcaaaatatgtacacttaatataatacggcaaaaatggcactttacaaccgtggtcttattccccaagccacctgtgtcatgatgagaaaaatatcagaaaaatcccaatgaaaggatgttctacagaatacctgactagtactactcaaaactgtcaaggctatcgaaaaacaaggaaagttgcaaaaactgttacagccaaaatattaaggagatatgacttttaaatataatatggtacatggaggagatcctgaaacaacaaaaaagggccacttaataaaaactaagtctaaataaataaaatatgaacttcagttaataataatacggttcattaattgtagcaaatgtaccatgctaatatgttaccaatagaagaaattaggtgtggcatatctcaaaactctctgtattatttttataatttttctgattgtgaatcagaaaaatttagaatcaccattctaaaaataaagttcattttaaaaagggatggcacatgcaaataactagaaatattgcctcagatataataagtgttcaaacaaatggtagatgttattaccactattatgtaattgactgtaaggcaattaacaccaaaattatgaagagttatttttaattaatatgcatatgttttaagaatgtcatgagagcaaaaaagaaatattgaaagaacagcatcaaacacatctattctgatatttcaattaataaactaatctgcttcaatcttcctgggtgcgatagttagttttatgtggcaatttgactgggctaaaggatcctcagctatctgatacaacattatatctgggtgtctgtgtgagggggtttctggatgagatcagaaattgaattaataagctgcatagagaagatttccctatctatgtgagtgggtatcatcaaatccactgaaggcccaaataaaacaaaaaagcagaacggcgaattcactccctctgcatgagctaaggcatccatcttctgctcttggatagcagagctcctggttcttaagctttcagaattacactgtgacctacacaccattggctcctggactctcaggcctttggtctcagaccaaattataccaccagcttttctagttccccagtggggcagatagcatgggacttcttggccttcatagcccatatcggcatgagccaatgctttttttctttctttcttcttcttttttttaatacaaggtcttgctctgtcacctaggctggagtgcagtcatgtaatcaaagctcaccacagtctcaaactcctgggctcaagcaatcctcccagttcagcctcctcagttcctggcactacaggtatacaccctcaaacccggctatttaaaacaaattatttgtagagatggggtctcactatgctgcccaggctggtattgaactcctggcctcaagtgattctcatgactaggcctgccaaagtgctgggacttcatgtgtgagtcactgcccccagccatgagccaattcttatggtaaatctcttctctctctctctctctctctctctctctctatatatatatatatatatatatatatatatatatatataaacacacacacacacacacacacacacacacacactgactaatatactgtgttaatgtagatagctaggtcagctatttttactactctcaaaccaaaatatacatttgcctaggtccagttaccatgatcttatttctgtaagcatgtagagtgagatttacatgtgttcgtagacataattaatagcctgaacaatctattgaatcttcttaaattttggtcctttcttcatcagaaggttataatagcatcaacctcataaacatgtgagaattaaatatagcaatctgtaaaggatctgaatagtgaggtttaaataaagaagtgttcaaaaattcctttcataattttttggcctggaaaatgcagacatatttaattttgtgtacatgtagctcacacacttataggtacacatatattttattttctacatttgaggaactcctcaaattttactttgtccaagaagtctcccttgattaacctgaaaagtcacagagatatttttcagcactatactagaaatagaaagtgtgaacattgacattaataggcttaatagacattagtgtttgcatacactatacacaaatatatttagccattcactgcacaagcatttcaagagaggcttctatgtgtcagaagctcccaggtgatgggaacacagagacaaatattctccatgtcctgccttaaaaggacctcaataatatgagtaaataaatatccaaacgcagatgttaagttcaaaaaactaaggtacatacacacaattgagtaatattcagcaacaaaaagaaatgaggaagatctctattatttaatacatagtgacatattgttaagtaaagaaaaagagcatagaggcttcaagatggcggactggaatcatttcactccagccttctccacttagaagaaccaaaatagtgtacagacagtcatactttgaatgcattatccacaagagaatgctggaattcaacaaagaagtgaaagaaaacatcaaaagtggggaaggagaagagagagaggcagtctgcctggctggcatcagctgggagccaggagtgacttccaaatatagggaaagggtaagccacagactttcaatgccccacatcctgactgtggaatcatgcaatcctggctatggagaaccctttgacctttgttcccctgtcccatggtctcctggaagctttcttggtcccaaaactaacatacgaagctgccagaagaccgtgagacagtattgctccagagaggaagctcatgttgggtcacacaccctttttgaggcctaagccactacagcaaggtgccattttcaaacctagcctttggcagactgcatgctgtcctggagcccagtgacactgggactgaggtgttacaaaaacttggactgtcactactagaattgggaagcaagtttggagtcctcctacagctgggattagagagcaagtgaggcatgaactgcagctaccagtgccaggaagtgagtaccaccggaatggagactggaatatgagcagaacatgagttgctgctgggacttggttgccagttgggtgaggctcctgcaactggggaggagcatgagctaggtgtgggctactgccagcatggttggggaataagacctgctgggacttgggcatgtgtgttcttcaactgccagcccaggctgtggccatcaaggacagccctgccctctccagtggcagggcctcagcatggctactactgcccttcaccagagcattatacttggggtctgaggattgccctacccctgtccatcatggctggtgcctgctctcatcactgaagggcctgagcacaagcttgcccagcccagcttcaacccccttctttgagacccatccaatagcctgagatccaggggattgaccaatccaccatcttgggcacctaagtattcatcccaggggtctgatgtggggcttgaattcccagccttgaccaactcagctctgaattatgtgcaagcacgaccagtgctcccaataattggtgggcccagtctatctcagcaactgctaaatcaatgcataccacctaagacccatagattcatcttgccactgctattgccatcactcataccatgccagcttcccagaggccaaagaatctgcccatccacccagttccactgctgccactactggcatccaagcatgccacctggaggcccaagagttaggccagtgataaccaccaaaacaggtaccagcatataccgctctgggcacaaagataagtatgttcagcccactgctgccaccactggggcctgaagacttgcccatctggcattccgatacctagcacaacttcaccataccctaactcactaagaaaatcacagacaccactaacactgcttacagtgaaagaaatcatacagagattacactactgaatgcacccagtatcaaagccaaattaccctacccaacaacatatatacgtcttcaagaaaaagtcctcacctgtaagagtatactcaaaaataggaaaaagtgactgttatacctggtgcacagataacaacataaggacacaggaaatatgaaaaagtaagaaaatatgacacctccaaaggaacataatgattcttcagcaatacatcttaatcataaagaaacttttgaaatcacaaataaagaattcaaaatactgatcttaaagaagctcagtgcagtacaagaaaattctgaaaaatgataaaaaagaaatcagaaaaccaattcagaatatgaatgagaaatttacaaaagagatagatagttcacaaaggaacaaaatacaaattctgaaattgaagacatcattaaaacaaatacaaaataattttgaaagcttcaagagacttgatgacgggtagagcaagatggcaaaatagaaacctaaaccatttgcctccacaccactgcaggaccaccaaatcttaacagctatctgtacacagaaaagtactgttacaagacctaaaaatcaggtgagcaatcacagtacctagttttaacttactgtcactgatagaggcattaaagagggtaggagagacagtcttaaatcaccaataccacccctaccccctgtcccagcagcagccattcggcatggagagatagtctgtaaacttggggaggggggagcaccgaaactgggggactttacattgaactcagtgttgcccattcacaacagagagcaaagctgtgctggtctcggccagcacctatacatggaaggaacacatggaccggatctagctagaaaggaattctccatcccagtggttggaatttgaatttcccagcaagctttgccaccatagacctaggtaaacttgaaaggcagtctaggacacaaggactgcaattcctaggcaactcctactgcagggctgggcacagtgccagtggacttagggttcatggaacctagggagattccaacttgggtggctaagacagtgcctgtgccacccctccccaacctcaagcagcacagcttgcagcaatgaaagtgacccttccttctgcttaaggagcggaaagcaaagagtaaagaggattttatctagcatcttggatatcaggccagccacagtaggatacggcagtgggcagagtcatgaggaccctactccaagcctgagctcccagacaacatttctaaatacatccttggccaaaagggaacatactaccttgacaggaaggaaccagtactggcaggattcatcacctgctgactgcagagcccttgggccctgaataaccagcagcaaaacataggtagtaccccacaggccatggtctctgagatgtgctggctccaggtgtgacatagcacattcttagctgtgatgtctagtgtaaaagactctgtctactgcactgagcttctttaagatcaatattttgaattctttatctgcaatttcaaaagtttctttatgattaaaatgtgttgctgagagagggaaaactaaaaacgactttgtcttgcaccttaggtaccagctaggccacagttaggtacagcaacaagcaggctcttggggtccccaagtccaggcctagactcttggacagcatttctggaccttccctggatgagaggggagcttacttccctggagggtgacttgcagacatggcagcatttaccataagctggctgaggagcccttgggctttatgtgaatgtcagtgatgtcctctcataaacccctgtgggctggtgatggtagtgaccaaagaagaaagaggctcttctgcctatggaaaggggagggaagagcagaaaggactttgtattgtagtttgagtgccgccttagccatcacagaatagaacatcaggtaaatttctaaggtttataaatctaatatctggctcctacacagcatctctggacctgcccagtgcctcagggaactcattgccctgaaggcaagaacatcatcctggctggcttcaacaccttctaattacagagccctagggccttgagtgaacatgggtggtagccaggtaatggttacagtgggcactgggcaagacccaatgctgtgccagcttcaggtatgactcagtacagtcctagtggtggtggcaacaaggatacttgcatcactacatccccagtttaaggcaggtcagcagagacagagagagagagagagagagagagagagagacagacagactgtattatttttggagaaagtatgggaagagaaaaagagtctctgcctgtaatccagagaattcttctagatcttattcaagaccaccaaggcagtgcctctataagtatgcaaaaacacagcattattgggactggaacccaaatccctctgaatagctgaaaagccatctgaagaaggatgggcataaggaaacccaaactgtgaagacaacaataaatacctaactcttcaatgcccagacaaaacaaacatctacaagcattaagaccatccaggaaaacatgaccttatcaaatgaactaaataaggcaccaagggccagtcacagagaaacagaaatatgtgaagtttcagatagaaaattcaaaatagctatgttgagagaactcaaagaaattcaaggtaacatagagaaggaattcagaattctatcagataaatttatcaaagagatagaaataattaaaagaatcaagcagaaattctagagttaaaaaacatgattgacatactgaagaatgcatcagtcccttaatcgcagatgtgatcaagcagaagaatgagtgagcttgaagacaggctactcaaaaataccgtcagagaagaaaaaaaaaaaacaaatttaaaaaaatgaagcacacctaaaggatttaggaagtagccataaaatggcatatctaagagttattgggcttaaagaggaggtagagaatgagttaaggcctagattctttattcaaaataataatatcagagaaggtcccagacctaaagaaagatagcaacattcaagtacacgaaagttatagaaaacaaaacagatttaaacccaaagaagactacctcaaggcatttaataatgaaactctaaaaggtcaaggataaagaaagcatcctaaaagcagcaaaggaaaagaaacaaataatatacaatagacctccaatatatacggcagcagacatttcagtggaagcgttatagtccaggagagagtgacatggcatatttaaagtgcttaaggaaaaaagaaaaaaaaaaaaaaacttaaccctagaagagtatgtctggtgaaaatatccttcaagcatgaaggagaaataaaaaccttcccagacaaccaaaaattgaggggtttcataaacaccagaccttttgtacaagaaatgctaaaggaagtagttcaatctgaaagaaaatgaagttaatgagcaagaagaaatcatcagaggggacaaaactcactggcaatagtaggcataccgaaaaacacagaatattataacacggtaattgtgctgtgtacactactcaatgtaaaaaactaaatgaggaaaatcaaaaataataactacaacaacttttcaagacacagttcagtaagacataaagagaaacaacaaaaaattaaaaagtggggggatgaagttaaagtgtagagtttttattagttttcttttggtgtgtttgtttgttcatgcaatcactgttaagttttcattagtttaacataatgttataaagtagtagttataagtttcatggtaacctcaaatctaaaaacatataatagacactcaaaaatgaaaggtaagaaattaagtcacaccaccagagaaaatcaccctcacttaaaagaagacagaaagaaaggaaataatgaagagaacaaacaaaataataggcaggagtaagtccctacttatggataataacatcaaatgtaagtggactaaattctctaatcaaaagacatagagtggcttaatggatgaaaaaacaatacccaatggtctgttggcaacaagatacacacttcacctataaaaatacttacagactgaaaataaagagatgaaaaaaatatttcatgtcaacggaaaccaaaaaagaacagaagttgctatattcatatcaaacaaaatagatttcaagactaaaagtatatgaagagacaaagaataaataattaaatgaaatgaaatgtaattatataatgaaaaagtgtcaatgcagcaagagtatttaacaattgtaaatacatatacaccacactggaacacccagatatataaagcaaacattactagagataaaaagagagacagacctcaataaaataatagctggagacttcaacctctcactttcaggattagacagataattcagatggaaaattaacaaagaaacaacagccttaatcagtactacggataaaatagacctaatagatatttacagaacatttcatccaacagccgcagaatacacattctcctcctcagcacatggatcattctcaaagatagaccatatgttaagacacaaaacaattattaaaacattaaaaaatgaaatattatcaagcattttctctggctgcaatggaattaaactgcaaattaataagaggaatattggaaactatacaaacacatcaaaattgaacaatattctcctgaagtaccagcaaatcattgaataaattaataaggaaatttattaataaaataaattaataaggaaatgggaaaattttcttgaaagaaatggtaatggaaacacaacatatcaaaacctatgagatagtgcaaaatcagtattaagagggaaacttatagctataagtgcctacctcaaaaaagaagaaaattttaaataaataacctaatgatgtatcttaaaaaactaggaaagcaagagcaaaccaatcccaaactgagtagaagaaataataaaagatcagctcagaaataagtgactgaaatgaagaaaacaagacaaaagatcaatgaagcaaaaagtcggtcttttgaaaagacaaaattgacaaacatttgcccagactaatgaggaaaaaaagggagatgacccaaataaataaactcagacatgaataaggagacattacaactgatactgcagaaattcaaaggatcattagtggctactatgagcaaatatatgtcaataaattggaaactctggaggaaatggataaattcttatacacatataacctgccaagattgaacttaaagaaatcgaagaccgaaacagacaaataacaagatcaaagctgttataaagtctctcagtatggaaaagcttgagactcaatagcttcactgctggattcgacaaaatatgtaaagaactaataccaaacctcctcaaactattctgaaaaatacaggaggagggaatacttccaaactcattctgtgaagctagcattactctaataccaaaaccagacaagacacataaaaaaatagaaatataggacaacatcactgatgaatattgatgtaaacatcctcaacaaaatcctagcaaataaaatgcaaaaacacattaaaaagatcactcatcatgaccaagtgggatttatcaaaatcatatgaaaatcaacgtgacacaccatatcaatagaatgaaggacacaaaccatatgattatttcaattgatgttaaaaaagcatttcataaagttcagcatcctttcatcataaaaatatccctcagaaactggtgtagaggagcatatctcaatataataaaagccatatatgacaaacctacagctagtatcatacagaatgatactagttctaagattgggatcatgaaaaggatgctcgcttttcatcactgttattcaacagagtactaaaagtcctggctagagcaatgagacaagagaaaaaaaattaaaggcaatccaagttggaaacaaagaaataaaattatcagtgtttgcagatgatatgatgttatatttggaaaagcctaaagactccaccaaaaaactattagaagtgataaacaaattcagcaaatttgcaggctacaaaatgaacatataaaaatcagtagcatttctgtatgtcaccagagaacaatctgaaaaacaaatttaaaaagtaatcccatttataatagctatgcataaaattaaatacctaggaattaagaagtaaaagatctctacaataaaatctgtaaaacacttatgaaataaattgaagaggaaaacaaaaaaaatgggaaaatatttcatgtccatggattggaaggatcaatattgttaaatgtttcatgttaaatgtccatactatccaaagcaatctacagattcaatgcaatccccatgaaaataccaatgatattctttatagaaatagaaaaaaaactaaaatgtatatgaaaccacaaaagacccacaatagccttatcctgagcaaaaataacaaaactagaggaatcacctaacttcaagttatactacagagacatagtaagtaaaacaacatggtactggcattaaaacaaacacataggccaatggaacagaatagataatccagaaacaaatccacatacctacagcaaactcatttctgacaaaggtgccaataacatacatcggggaaaagacagcctgttcaataaatcttgctgggaaaactggatatccacatgcagaagaatgaaactatacttttgtctctatccatagacaaaaatcgaatcaagatggataaggacttaaatctaagacgtcaaactatgaaactactataagaaaactttagggaaactctccagattacttgactgggcaaagatttcttgaggaatattttacaggtgtaggcaaccaaagcaaaaaaggacaaatgacactccaataacaatgagcacacttattgtttagatcttggattgtaatactatttcccactaaaatgatcctcagagaaatgactgctccccagggatggtgcagggaaactcctagatgaaagtgaacatcttttacaccagaaagtaaagaattgctaaaagtaacattggagcgtgtcataaggatacagaatttaggttgcaggggctcttactagccaaatctaggagaatggaagaacaaaacaaataaagatagtagtgtattacaacccactagagagaataatgagtcactaaaattggtatgagtctacactgataatatttattcaaatgaatgaatgaatgtataaacaaataaaggctgagggaaagttcttgctcataatagaatgtgaagtgaatacaaagggagtttcaataatcaaagtaattatcatccatctttaggcaataatcatcgatagatgccaagtctaggggcaaaattttgatgaagatcagaatattttcaaagtctactcaccaattatgtactacttgcaagggaaaaacatagtaaatgtaccacagcaaaaaatgacaatacgtgaattgagtgatcaaaattaatatcaacaatgaggggcaggtagacatcatgtacttaggaatgcaagaccccaaaagactcactgtcacctatatagcattccagatttggaatttataatctaaagaaacattagaccaatcctaaacaagaaacactctgtaaaatatatttttcagaggactatattctttaaaaatgtcatgttcataaaagacaacaaaaagctgagtaactactccagattaaagaagactaaagagacatggtaactcaaattaatacatgaacctagactgaatctttgtaatagaggaaaacatactgtataaacattactggaccgttgactaaactagaaatgtgcactgaattatttaaggtaaaggaccataatctatacaatttactctcaaatggctcagaaaaaaatataaatgcatgcacacagacatcgatatacttatatacgtatatacagatggatagatagatggcatgtggcaaacaaatggagcaaaatattaacaataggtgaatctgagcaaagggcatatgttttttctattaatcttgcagtttgaacttaaaacttacaaatataaaattaatgtaatttttgtagtgaagataaactatgtggatatggcatagcttagcaatcctgtaaccagggatggtgaaggaagttgggaaatgcctggagtgctaaggagaatctgaggagaaactgtgaagaatttgaatttatcctgagaacataggagatgtataagatgaggaaagtctgccttctcacttgtaaaagagacagaaaaaaaaatcaaatagagtgtttaatagaacagaaagaaaactaaagagactcattatttcccaaccagtgatacattgaaatgtaacatattaaaaagcatttttagcttagtggtggactgtgcagattgttgtgctgattctctaggctacttttctgcagaacagtaatctggtacattaaaataaaaactttagataaatttaacagagttacttcagcaaaaaaacaattcatgtattgggcagcactcagaatcagaagaggctcagagagctccgcatagcagcataagcagtaagcttttacatgctgactagcagaataaaaatagagaaatcaacagattgtctactgacaggcatttattttatttaggcatgatgtcatgaggcatttgtttactcggacatggttttatcagttggctgcttgtgattggctgaagctcagatgtttgtgattggttgaaatccaggtatttgttacaaaaaaatacattactaggtttccgtttgtttatggactaagttaggttgcagtttgttatgtaggagctcaaagttcagagacatcctgaggctaatttaacagcttatttgatgtaacagatgaaatgtgcctgggggaaaaagtgactgtcaagtgtgggaaacattacacagcagaaagtcttgtcttagagactcacaatgtataaaagtatattaaggctctaagaatttcagaagtggttaaaaaaaagataattttaaggccacgcatggtggctcatgtctgtaatcccagcactttgggaggccaaggcaggtggatcacgaggtcaggagatcgagaccatcctggctaacacggtgaaaccccgtctctactaaaaatacaaaataaaattagcccagtgtggtggcgggtgcctgtagtcccagctactcaggaggctgaagcgggagaatggcctgaacctggtaggtggagctggcagtgagcccagattgcgccactgcactccagcctgggcgagagagcaagactctgtctcaaacaaaaaaaaaaaagatgattttatttaatgcagtgttccttaaacatttaataagaatttagtttcctggtatcataggttgtattctctgaagtagaaattgagatgaagttttgggtaccaggaaaagtattgcccatcagagtgcctcagcttggcccaggttctttataccacattcccccctcagtcaccaagtgaggaagaccaggaagttggctctctgcagctgaggcccatcctgaaggagctgggagctggaagcagtctactgaccacagcaggctgactgcatttcctacagctgagcaaaacatgcttcctcaaagagggtgtgtctccatgttgttcacatttatctacactgctttccatcctgcagaatatactttaggaaatgatatcctaaacttttaagagcaagcaatttatctctcaaaccaaatattaattaaattgccagagatagaacagtgagatataagaccattgctctccatctgtgtctgtccctgatagtatattcctgataatagaatatattattaaagaactgtatttgcttgacatagtgtttacacagtatcaaagaaactctaaatgtttctttgtttacacagtatcaaagcactctaaaatgcagactttgttatcatcatcatcttcatcaaaatattaccgttaacataagtaatagaatagaaatacacagaaagatatagaagagttcagccttcgtgtatttaaacatgtattcactcaacaaatactcttgttttagtatctatggtgatcaggtatgttctgcgtatagtatttttggtactcataccacagatgggtgtgttattatagaaaaaatttcagaggcatcagcattcgaaggtttaataagatgtgtatgtaacttattgttgcgaggactgtgactccaggcacagtcacctattaattaaagctgactattagtattacaaatttctggcagagcacttagcaagggaaagagaattccctgttgttaaatatttaccatttgggtcctgtactctcatttctttcagggcacaaacagtagctcctttgaaaactgcttgacagccaattcaccaattctgcttcccctcgaagaaaataaaagccaaaaacacatggtatattctagaattgtactattgagacaataaaagtagactagaagaggaccctacttgatctcagtgggaaagtgttttcctcagtatctgtagcattatcagtagaaagaattgggaagcagatggcagagaaataaaagaaggcaatattattttttaaaaattagagctctgttaaaaacttcccagggctcttaaatatatgaatcatgtatttcactcatctaaaatgttctatctattctgatactgttatataacacagaataaattaataacatttttggtatatttcaagaccctcctattattatctcttgcagctgcagagagttgggtagatagagagaagggcagaatggaaagacagggaagaagggagaaagaaaataaattcagtgaattttatttcactgagtgtcaggagattttataaattattggggaaagatacttagacaaaatttaaactaaatgaattattaaataaacagatgccaagtggaaatgcataatttattgctgccacgcataagctagtttaaggatcccaaggctttttcttgtttgctcaactaaaatatttccacatacgaccttgtgtacaaccgaggaaaaagtgtagtacagtcatagtcaattaatcaatcacgtttcagtttagttcagcacatatttatacaatgtataaattttcttatgtgttttgaagggtacagaagtaattgaagacaccgagatttaaagaagaaaaatacttaagcatcaacatttgtttccagactcatccttcaccaaatattttagcatgtttgccttgcccagttaagagtattttggccacatttcccaactctaagtcctggaatgtttctgcccacttcttagccctgtaaacatttccttcaatacatgattccagggtgttttccccagctggtgaatagattcatttactgcatttcgtatatacacttcataaaaatgtattataaaacttatcatggaatgtggttgttattggtttaggtaaaagtgtcatccagtaaactgtgagttcctgggcctgagaaagatgtcttattctgctcaagaaatagaaagtgtgttagtattgaaatagtaaacactgtgagaattgaaaaggaaattataaggttgtaaatatatgcagaaaaatgtacagaacaatgattcttaaactttagtatctacccctctatgccttggttttcttatctctaaaaaatgtattaatgatataatttatataattataagaataaaatgagttaaaacaagaaattaagtcaaaaagtggtctggaactagttgaagagttaaaacttgaaagagaacagtactaacacatgggaagtgttcaaaaagtataacaataatataatagtggtgatggtggtgatgatgatgatggtgataatgatgatggtatctgtaaattctttaggaaagtggttaacaaattatttgagtgggtgaatattgacagaatttagtttagttttagcttctgttctgccatgagctagctgtataacttgggtaaaatagtacacttctaaatcttaggatttctatctgtaaaatgagaggtttggaaaatgcttttgctaaggtttcttcccaacttaatgtctttttttattgtataagcatatttcctgcattgaatgtagcccatttatttgtgattttaaggtagaatattgatcatcagagatttttttttttttttttttttttttttttttttttttttgagacggagtcttactctgtcgctcaggctggagtgcagtggtgcaatctcggctggctgcaacctccacctcctgggttcaagcgattctcctgcttcaacatcctcagtagctgggattaattacaggtgcgaaccaccacacccagctaacttgtatttttagtagagatggggtttcaccatgtttgtcaggctggtctcgaactcctgacctcgtgatccgcccgcctcggcctcccaaagtggatcatcacagatttttaagttgttattctttagagtggggctaggataaataatagagctgttacttaatatggaggccaatggtgtaacaaaacaggagggagcagtgagaagaatagcttacctagttgataagttttcctcccaccagcaggaaaaaaaataattatttgctaataatagcaaatgttagtacaactggcactgctagggcctgaactactactttgttaaataaaatgagattagcaaactgacctcaaaattttctttctgcaagttgtcaaataccccactataggagaaaatgtatttttctgttaaccaaattagagtaagagcaattccagatgattattatgatctctacaaaatcaataaattgctttatttcgtttcccactttttctttgtctctattcatccttgtctctttcggaggggggagtttagaggctgatttcagcagaatacatgcctgcattgtgagagctacatatctggcccactactgctccctcttctgacccagtttcctcccttccacaatagttgtgaactaccaattgccctctgtttcttttttttttttaattaaattcctatagctaatccattttcaagacctgaccattcttttttttttgatgtatcacaacatctcccccaacccccctcctatttttctactgtagccgttggctttcagttcaggtcactaatatatcacttacagttttctgcactggtcttagttcaattcagtttagtaagcattcagtgactacctactgtaaacaaacctgcatattggccaaaataagctaactgacaaatagcacaacataagcccactgtggtttctacctagggttcctcaatcattacattttgtctctaaggggaccgttagaaatattccattcaagcacattcaaatagggctttgtgaggtgatgaaaatactctgcatgtgtgactactgagcacttgaaatgtgtctaataccactgctgcactaaatttttaatttaattttaatgtaaatagctatactactggcaaatctaatatggattttatacctgaggaaacacacctaaaaggttaaagttactagtccaagatcacatggctataaaacttctcagtcatggtacactttctttttctttctatacacacaccgagagagagagagagagagagagagagagagagagagagagagagagagagaaatagtgagagaccgatgttgcagcttgagtctgaaggcaggctggaggcagaatggggacttgtctttttctgttaaggtttttgacagattggatgagggccactcacattatgaaggataatccactttacttgaagttgatgatttaaatgttaattttatctaaaaaataccttcaacaggacatctagtctagtgtttgatcaactatttgtgtaccataggttagccaagttgatacataatgttaaccatcccatgctccaaaattgaggactgtttggggatatattatctaaatgcaatgaagccatccatgctgctatgtcctaggatttcagtgattttctttgagtgtgtggctttataaatacgatattgtaatatttcacttgaaatttctattgcatagctagagaaaacatgacacctcacgaaagacacattgttatgaatatgggtattcaatgggtattcacttagtctgcaatgattgtttcttttcaaaaagttgcattatctggcttttgtttgcatgacctaatatcaccctctaattaagtcagaatgacatattaaaagagattgaagtaaataaattatatttgtgaatatgactataataggtgtatgatttgccctcccatcttcctcctgcccctataagaaaacaagacacaggaaagagaacatccccacctatgtttcagatcatccccattctttttctaactccatccctcttcatcaccaaaacaattttcaaacacaataaacagcatgtgtcttaagcaaagcaaagtagaaacacgttaggatttcttggagtttccattttacagtattaatctttttatgtaaacttttagcatctctgtatttacagcactaccaggtaaaatataaatgcatctggctcttcctatgcatcggagtaccctatgtccagttttcatatgtcaagtatcagcacctgcactaaataaataataaaacgaattcagagactcaatatttatgataatccaaacacgctcaaattattttgaactccttaaagccagtataacagcttctattcagatgcaaaaaataccaaaaaatgaagggaggttttttactgtcaaaaataattattctttttaataatatgttttgagcaatgactacattaggaatcaccatacaaaacactcaaaaagtgagaatataaagtttcagtctatgccatcatggagattttagtcaagaaaaccacctttaacaaggaaaataaggacagttgaggaggatcttcaatgtcctagaagtggaactaatcttgcatggaactaattcttttcaccatgagcacttgtggctcagagaataaaggtaagaaaatctagtcaggtttcataactgctttattccaagctagatgcttggctcagatcacccccattgtgtttgaacatttggcctccccaataaaatacacataccacgaatcttcctcctgtagaattaaattgtcagcatgtcacaagatttttttttcttctgcagcaggaacccttctggttgaaatagcatatttcctgtacagcagggtttgcatgatatcattacttcgcatgcagtctgcatgccttccactggatgtttagtgtctgtgaatgttctccttccagagacttgcctatatttgtcttcattctgcttgcctgggttttagcctactcttaccctagtgtttgatattttggacatggtggcctacatctgtcagctttgcttcagctcactgcccctttcaaaactatgacaacttcttaatggtcttcctgacaacctacgaaatctagactaacaaatctggccctatctacctgttgtcctgcactgttgcttgcaaggctcttctgatacattacagtactgacccagtgggtctggtttgctaataacttactgtaaaactacagttaaattgtttttctctcacctagacatttttataggttattattaaaatgcatagataagctgctggagtataagaaaaaaaggaatcaaagatgtataattctagatttatatataataggagagaaaaaagaaatacatcgttttattatcttggatatattctatgtgccacttagtgattgagcaaaagataacatgattcctgactcttagcaactcatgacttacaggggatggtatgacttacatacaaatttggaaatattattatttttatagaatatatttatagaatttttttggattatttttatagaataccaaagttatttttgtagaatattgaatttttatttttatagaatattgaagttaatttatcataactacctttactgtgggaactcagactttatttggtaaaatcccgctattctgatcttttgaaagctatcaattaaagtaagtaataattattttatttttatttcatgtatataataaattctatgggatagagagaacatgctatattttcttttcctagaatatcataaatttttgccttcagtaacaagggtaagggagctaacaataagaacttactaagaatgagttattctactatgctctttacacatattagcacatttaatcctaataggaatctgataatcatgttttaataaattttacatagtggcgaaaatgtgactcaatagaactgaacaaatttctaaaaataaaatagctagtagatggaacacagtcaaaatttgaaggcatgtctatttgacttccaaatccatactccataaattgcaccctgagaaaaacatctttctagaaccaaacaataggaacttaaaatcccaggtaattcctacagttgtcctccacaaatgtaataaaattttatcaagtgttttttcatagtactctattttacttactgcagtatccccacatggggatacgctggtttttacatttccttcattttctgtaaatgttccagtgagtagacataagaagcaagtctgcttaggctgttactgtgtccctactgattaatccctagaactcactgcccctagaacacagatacttaatatacatttattgaatgaataaaaatgactgtaaagggggataaatctttttaaataactcatatgccttggtttaatagaaatctaataattatcatttaatcatttgaattatagataattctattctcatatattgattctatttcttttctataaatgagtaatatacttaaaaacagattaattcagtgatgtctggttttattattctgaattttatattttagcatgtttaccataagatatgactgggagaatttagttttactccctgggtttaatatctggtttcagtaatattatagtagaaaaaaatctgttgtgtactactattaagtgttgttgagcactaggagatctctattttactgtgtctttgatattaacatccgtatttcttgatggtactgagcttagtagttaacatttctccaaccttaataattgtgtatggcatattgacagggaaccaaaaagcttgcatgaatttgaactgtcatctttttttcttactaatttccaagttgggacataattttttatttcattatcactctgtgtgtttctttctttatatactgtactttgtttctccattttacttcctttaatagtctaacagttggatagaaaagaatgtcacttttatttattctcttttttctttttcactgaaggcaaggaaattagctccttgatggaaggcacactagtagaacacatcagcattatagaacccttgaaccttaaagacatcttatctcagcatattattattacaaaacttaaaggagccatcgcaatcttccatttgtttaagtttccacttcaactaccatggtcacacaaaatgatggtaataagaatgcgattgttgaaaaccaaaccaaacctcatcaacattgttatcagcctcactgagaaacaaggatcaaatttacatctacctgtgtctccttggatagtctaacaattttactttgccatttgctatcaaagaagctgtaggatattgaatatagaaaatacaagtctgcaatgcttgagtgaaatttcaatcactgcagacgtaaaagttttgcaatatcgttttgtaagaatgaaaataaatatagatatatatgtacataaacaaggtctcactgtcttgcccaggctggagtgcagtggtgcgatcacagctcactgcagcctcaacctcctgggcccaagcaatcctctcacctcagcctcctaagtagctgggactacaggtatgcatcaccctgcccagctaactttttaatctttgtagagatgggatctcactatgttgcccaggctggtctcaaatttctgagctcaggcaatccatccacgttagcctcccaaaaggttgggattacagctgtgagccaccaagtccagctggataattctaccacattatttgtcttgcctcagaaaatgttatttgacagaatttttatttttaaaagatttatcaccatcttccttatcaatatataagtagttggctcactctgtttaaaaaatagcacaatagatgacatctagaatataactttaaaaaaactaccatttgatagcacctagaaaatctcacacttcttgcagatcaaaaaaaattatgtttctatcatatttaaaatattttttcaaacctcaattaataaatatctttggtatgagtcatatattatagtttactgaggtcagaaacaaaaactattttaatggaattctgaaattaaccacaaaacagttttgttataattgagtgtagggctcccacatctctgtgggataaaagtggctatctatattttaatccctttacatcctcaaaaagtactacaaaatcacaatgagagaaaaaattcagcaaacacccattcctagccaagtctaggaggcattatgactgcatgaataccttaagccaacagagctggatccagagcccacactagcagagagaactggggaattttgcactggaagtagtgtacagcagagtcaaggtactggcccatcaaaggcaacaccgtataggtatcatacctggaaggaataaagtctactttgagtgggaaaatactgaaaagagccctgagacttggtggtttagtccactgtcactagggctaaaagtaaggagcttagtggcagtcttagaaaggcagtatcctgagggcagatggaggcaactttgaaaacgtaggtgttccctacaggcttattggcaaagcgaaaaaaatatgtgactaaagacataaagacgctgaaaaaggttagtatcaaaaattagaaaaaagcaagaagtacacatttatttttaaagcatattttgttgtggctcagaagagggtgctaagcaccaaaaggaccatccaaaatccttatgccaccctcactgaattatcaattatcatctgtctaaaaaaatacaagtacatataaataaaaaggaatccagtatctatagaagttcattaagaagaaaacagaaaacagagtaaaacattttcagaagattaaaacactaaaaagtagtgatgaaacaggcaggtattattataatatattccaagaagaattaaacatgaagcaagcaattgtaaacatgagggaccatcacaaacttagaacttaaaaactcagaataatactggataaacactacatggatatgaaatcagagcagaccaaactcaaaaaagaaactacagaataataacataatttcagaaagaagaaataaactacaaggtccaaaagagactagatatgtccaaaactacaataagaaatatatgactaaaagtacattaagcaatcagaaagaaatggataaaaaagacaagaagatctatttgataagtggagtccctaaagaagaaaaactaaacaactgggatgtttgatataaaaaccacaacttaagaaaactttactgaataaactggaacctcatattaaatgctgccatcaattatgtgggaaaaatcaatccattaccatcaaatattagacatatcttagtaaactattataattttaaaaaaccctttgagccacagtcaaatatgaagtaattaacaagcaaaaaaaaaaaatgtttacatctaacttttcaacagcaacataccagtgcaggaaacagcagaagaatattatgaaatgcaaagaaagaaagagggaaagaattaatatacagctgaactgtgtatcaagtgtataaaagcacagttttaatatgaaaatttcaagaaactttttactcaggagcttttcctgtaagatatactagagagaaagcttcattcaaccaagacagagaaacggcagcaaaactgctggtggtgaatgcaatgattatttaataataaatataattttaacataaaggtgagaataaatgtataagaatactatgtaaatgataatatggacattttttaatggaagaagaaaaaaaagaaaatgaaaaattggttaagctccttgatggccagataggtgctagtcaagggatatcacttaaaaatgtaaaactgttaccattttactatataatactgtattttataaaaccacccaaacctcagaggcttaaagcaagaatcatattctcgtggactgggctaaatcctatgaggcaatgctactaatctaagattgtctcattctcatatctgggtgttggctagggaaggctaaataaggtgaggctcagctgaggcagtttggctttgctacacaagtctcccatcctcaacttgggactttttggctcaggcagtgtcatgacaagccaggcctgtttgtcttatggcagtgggagaagtacagtagagcccatggaaacacacacaaagtctctgaactctgacttaaaaatgccatactaatgtttcaatctcattctattgctcaaatagggtcatattgtcaaactaaacgtcacaaggcatggaaaaatgcaaatatgcctaaacatagtgtgaaattactacaaaattacatggcaaaaaatttgaatacaggaacagttggataatcagaactaataacaaactacctacaaagagaaaaaaggctaaggagaggaaaaagagactatgttctatgaaagttaccactagaacaaaaccacaatatttatgaataccaaaatatatataaaataaaaatgtaaaaagaaaaagaaaagaggtcacatagtgaaacgtagtgaatataatatatttagtaattttaacttaaaataacatgagctgatgccaggtaaggttgtgtgcacctgtagtcccagctactcagaaggcttaggcgagaggattgcttgagcccaagagttcaagaccagcttaggcaacatagtgagaccctgtgccaaaacaataataataatatgtactgagcccaaatatatcagtcacattaacaaatataaataggcttagatgacctattaaaatattttcaaattggcttatcagtaaaatccccaaaacctctatgttgcatataagcaacaaaactaaggaaaaaggtacaaaaagcaaaattaaaaagaagagcaaaggaatatggggaaaaattcaagaaaattatgcagaagttgcaatgttgctacctgacaatgttaacaatcaggcaagatgctttacgcaagacaaaagaacaatgctccataacactacatctacaatttacaagaaagacagtgcaaccatgaatagctatgtaccaatcaatacagcagcaaacttcataaggaaaacactgatggttacacaaaaaagaaaaattgtagaaacttactaataataggagactttggcacagaatctcgttctggacagatcgattagacaaaaaaatatagcatatgcaaaacacaaacagtttaatcaatgaagtgtaatatacaagtacatatcaaattttgcaatctagaacatattctaaaaataaaaagcatacaaagaagttgtaagcttctcttgatgtccacaagctaagcaaaaacaactccagtgaaacaagcctagatttgttttttggtatagcacaggagtctgcatcccagaataaactataggatgtctcaagaagatgtaaggaatggcttgtcataaggtttagctctatgctagataatctgaggaagagttcaaagaacaagagtttcctcaggattgaacactatcataaagcaggggcaattcagtgattggatagtttaatttttatttaggagtcaggagaaactaaatggagcttaattataattggtaaaaataagcagtcactcatgtgagataagagagggagacagtggatcatttttataatttgcactgttctgttttgttcgtttgtgttttgttttttagtgttccaacatgagtgtgtcttcatcctattttatcctgtttcattatggtcgcagaattactataatcgatgtcggtgttctatgaagttctgacaaatccaccatttagggtattctatgagaccttgatttcttcaaatagtcaacgtggagattttaaagacacaatcctaaattctttggtactcatctcctcaagtggaacttaattctctacccttctggctgtgggatgtgcttagtgactcagttctaatgaatagaatataacagaagtcatgggatgtcatttttgagattaagttatgaaaagaccacaactttcattacagtctcaggctctatctctgcccccctccctctgtctctgatcgtttgccctggaggagccagctgccacgttttgggaaaccctatgaagagctccatgtagtttacaacagaggactcctgtgaagtcagcatgctactaacaaccatgtgagtgaactcagaagagtagccttctgccccagtggtgtcaccagataaatacggtcctggtggacatctagactgaaaccttgtgagaggccctgagccagaatcacccagcgaagatgatcccgacttcctgacccactgaaactatgatgtaataatgtgtgttgtattaagccattaagtttgagggtactttgttacacaacaatagaaaactaatacagttaacgttatagaaagtaaaaagtttaggttgactgggactaaagaaatataataatatagcaatagctaacacagactagagaaatgtaaaaagcaattacaaaacgtaacttgttggcatagatacattttgaatatgcaatggaaaagagatgatattaagaactatttctcaattgtaatattgtttttgtagttatatattagaatgtgcatgttttttaatgcaagctgaagcattcaggaactaagtaccgtgaagtttctgcaactagctttcagatggttctgccataaaaattgtatacatgtacacagagtaaatatggcaatatttttaaaattacttaagctatgttaatgagtaaatgagggttcattcttttatgcctgagaaattcaaacatttctctaggtttaaattttttcataataaacaggtggaggaaaattacataaacgtatcctggaaaaaaagttgacaaaatgaaaaaaagtcttacagcttgtcaaatcctttcacctagtaattcctttccttgaaatgtaacctaagaaaacaatgagatgtggcataggtttgtatatcagaaaatttttttcagtgctgttatcattgcaaaaatttggaaacaatgtaaattcccaaagtagagagtgagtaaagaaatcatgatgtagtcatgatggtatattttattgtgattaaaaataatgttttaaacatgtctaataacctacacagggaattgttcaacattaatattgaatggaaaaggaaagataaatatgcaggaagattttaaagttatacaatattatataaattatatatgaatgtttgatttttatctgcttctgaaaggaaatacaccacaaaatgttaatatctatggttaataggatcatactcggtatacatggatctttgtgtttttcaactttttttctaaaaggagtacagattactttgataatcagaaaatattggtaattaaactttaaccatatttatataattatattaaaattttaacataacgtgtgttgtaaagacttttattctttataatgaaaacactttgaggaagacttatgctatagcaaccaggtatattgtgaacagctaaaatacaaatccacccttttacttttttcttttttgtatagcacttagcataccacaattcagtatttattggcgttgaaaatttaatttcattttcattggagtgacttttctgttttgtattgccatcgtacagctaaatttgtaagtggtactttcaccctttgtaactggctttagctcctccttgcttcattcaggaggaacctgctacctttgcatggttcctcagtctaagacgttacagctaaaatcccctaaatacttcagtctattgcctgtcatataaatgggagttttgaacatattttaggcaaaaatttatgtttcttgttcacttttttgccttgctatgatggatcaaatgtatttaacatgaactttgagtgacttttgtaaacccgtttacttaatctcttatcggttctctgtgtttgaacaaaatgcttcaggatgatagaagcagcctaacttattaaatcgccaaaatcactggtctagttcaagtacaccttgcttgattacagatgttcaagtcagtctcttgtcctctagggcaaaagaaaaagaaaatgtatttatgagctgtagtgaattggtacaaaagttggatccagatggattgaagtcagctcctacttgtaagttctcaattcttcagaatatatttgagaaaatctatttaatgtgttgaacaaatatatgttgacattttagcagcaaaaggttgttgacctgtttttccttccatcactgttatagcatttcgcactttcctgtgtatccatctctgtgttgcatgttgcaggtacaaagatgactaagacatagttctggccttcaaggagtcatgtactaatgaggaatatggacacatagacctatattggtgatttcataagtactatgaaaagagatatatgcacaggatatatgagaaaagagaggggcaaataaaatttaaacctaggggttcacatatattttagaactataaacatagcctttttaagattatattttatgctcatcttcaataacaataggaccagatttattcatctagacacggttatgcattgaattccattttaactgcaataacattattttcaaaaccatcactactaacaaactaggttcaaaaatgtgggaagtgaagtctgcattagtaaaagtttggaaaaggtttaatttccattaacataattacgattgaactcttctgcttctcgctgcctacttttttatttatggcagattttgtatatgcatttcaaaccaaacaattttctctttttttgggcttttgattctttcattacttcagtctgcagctggcacttacttaaacttttattgagaatttgcaatgatttggggaatggcacaggcaatacttccaccagactcgggcaacacattatgtactaactttttcccgtgaaaaagtaaatcatttggctctgataattatattgcatttaaaatcctaaggacaattttgcatgttaaaaaatcacattgaatttctaaattattctgatttagtaatgatagttatagaataacaacatagtaagtcatatgttgacatatgtttgaaactgctattgaattttcctagtttaggaagcacacatgcctctacagatagaggtgatgatcagcaattctttgaagatggcagtgatatttttatacgaatcttttatttgttattaaattactaatccaaccaatgtgggattggcaggttttgccagatttttgacacgtttctctttttggagttagatttagatgctctatttgctatttcaagctgttccattttcatgatttcactatagtaatgtagttctatacattccaagtgtcttacccttgttatgtttccttctatagtgatccaaactccagcatctcatgctaattaatatacttttgcaacttcaactataatgtctttattccttttggagcataattatcacttctgacccactacctatgagaacctagaatattcaacacaataacaaggtacttagaaaatttttctttaattgtgactttatgacaaagagaaatatttgacatatttattatgtctttaaataataaaatatatgaaatcacttggcacataatggttactaagacatattagtctcttccatccttaattataaaagaaattaagagtcagtggccttcaaagtggagtatgaatgcctttaggggaagtgaaaagagttaccactgggttagaaaaaaatcacaatttcacatgctactttgtattattacattatattaagttgtctattttatatgtcttatattacaattatatagatagatacagatttataatactttgattttcgtcattggcacatgctcaaaaagtttggaattcattggattaaatgaggttgctcaaatttcagtcctcacatactattttggaagttttgctgtatttgactattgccaaagataattttaatgtactgctaaaaaggacacagttaaggcttgaaaattcagaaagtgaaagcccatattagacagaagatatacaggaatgtgataaatatatgattgatgatagattagatagatgatagatagatagatagatagatagatagatagatagatagatagacagacagacagacagacagacaaatagagctagataaccatcattctcagaagactttaggctgaacttaacaaatgcttgaaacgttcgtggtcatctccagtcccacaccagtaattcatgtgttctatgtaactggatggcaatgcccccatcttactttttactttgtcctaaaaaataatatagctgcatacaacattatagtatgctaacaacgtctgtgtaatacatataaatacataattattaaaaatacaataaataaattgcaacaataccacttaaaatatcatcctcactcatgtcagtccagatatcccattacactctctgggtaattagcacaaaatgaccatttggcttgatgatcagaaaggcaggtggttgtacaatgaacatgagatgcttcagacagatctctcacttaactctgtcatatagtagctctaagcctgagcaactcatactgtctgaacctcagatttttctgcagtgtgaggatgacagtatcctgagggagagtcgtgagaatttgacactatgttggggactatctcaatgttcagcgcatggtaagcactcaataaattagagctactagcctttgtaactattagtgtccttgtgtttgtagttccatttggtcagaggaactttcagttaatattgatgccatgagtccagcctttgttagccttcatacgctgtcctatctttgctctgtgttggaagctcggatttatgactgtgacaaaccaggaaattaatttcagatccaattttgcaatctccagtattcctttctacaggtatctaaatgttgattttctacattgaggttcatacaccacatatgaggaaatgatctggtatctatctccaaaactgtcgctagatctcagtgctcacagctaatattaagagtcctcacagactcatttctccaagtttctgaattccttgaacttcatctaaggtggatgcacacataagcctttctcattctcctttcaaaatgaaatttcctttcagccttcttccctgcccaaagcaggaaacaactctcctgctccccagcagctctctctatgttttcacaatattaggaggcactgtctgctatttggaatcattttggcttattataagggctcacactgtacttcattagcagggctgctgtgaaattatgaaacattttggtgaaaattacaagctatttagactcatttcttgctgaaaatatgcaaagcccttcggggaaaatgcagacagatggtgtttgagacatttattgtttttcctatgtatttgtaaacaaatactataaattaagcatttcagaatgatctttagaaaatctagttgcatattaatatatcaattgatatcaaattaaagaaattgtgatacccgtttccatcttaccagtgcattttttcctgtctgtactctgttttgaaaaggtttcagaattgatccaaaattgattgttgaaaagctccagaaaaagcaaaagcaggagtctctgttctttttttctccaggtatattttttataactcatgtaagtgcaataattaaccctacaaaaatattatatttttcctcatatataacaatattatttgtatctacctagaaaaccttatgtagcacaaattcacagtcatctacaaatgaaatgaattattcacttcttatcatttgagagtctacaaaatgtaatttatattctttgtgggttatctctagggaagagctgtgatgtttggaagcttacatgtgctactctgaagactactggagcaagtggtagcacatgagtaactgtgtttaaaggaaagtgtccttagtttctagctattttagtgctaaggcaaaaaattattactagtggtaataagcaaagttcaaacatggttctcatgcaaatcaaggaggtaggtatttttgaaagtataaatcatccgtatctctccattagttgatttaaattttttcttttattttgcttaatgttccttccccttgttccaataataattttactccagtttctatttttcattttccagtgttgcctacagaaaagcagagaaaaagtccaaataatgtatttgatcaccagaaaaatgtttctaagaaatatgtaatagaaataaaataccttttagagcacacctttgtagatatgttatcaataagcaatgctatttttgtgtaagacatttactgtattttgacatacagattaattttctctggttgaagatgtgcataaatacagagaaaatcttctattttagtgaaaaagattaagccaatgaatcatagtttttctgacttttacaaataggcatagtcatttctcccaatagtctcataagaactggagttagaaattgaattgcctgttctttttctttctcactctcctttactgcatttcccttattctctcattgttataggcagattaatatatagacacattttagaaatttctaaggatttatgaaggggtatattgaatatgaagataatcctgtcatggacaatagctaggtatcatccctcttaaaatgatgtcacatggaggatgagctatgacaagaccagctccacattcctcacagactgtccatacagatagtttacaaaaaatcattcatatcaagtacttggcattccaatgtgagaaagaaatagttatttctatttgaacaactctccatctagtgggtaggtaattactgtgtaggtcgttattcacagtttcaattacaaaaataaagttaaataaaataagtttaagaaacataataacgggcttcatctaggatgaccataatcctttcatttgtttgtattgtttttgaatttgagtgaattaatttattcaaaagcatgctttggatgaaaatttcttaacttgcacaagagctcctaactgccttaatccccagtctacacttttctcttttgtccataagtaaccaatacaatgtttttaagacatcctccacaaatcatgattcatcatgccactggatcgagcaggatgaataatctttctctaggtccagaagatctagactataattcactttcctctgttcttcacaaagaacataaaagcacttggagatatcaccacaaccatcatccttctttgcctctcatatacagaaaagaattataagcagattaaacatgttttgtagaaaacagttcctctattacttctctccctttttgttcctttccctgaagcaaacacagctgtttaaagttcaaccctgttaagtagaatgacagaagggatttccagacaggatccaaaatgggctgaaaattaaaacttgatatcttcagaggatagatttgttaagaaagcctagaagtgatgcatgatatgattacctataatacctgcagaccaaaaagtgacatatttgctctcagtggatgtgtctctaaaaacatggcatcctaatcgtgtacacttaatggagtatgccagctcagattgcgagattcagaagcctagaagcaccccagtactttcagttggtgaatttgtcacctgacaatgaaaatcctacttctaaaagtaaaattataaccatgaggtgaaagacctctggaaggaaaactaaaatattctgatgaaagaaactgaagagaacacaaacgaatggaaccatatcccatgtgcttggagaggaagaattaatattgttaaaatgaccatattgcccaaagcaataagcagattcagtgtgatccttatcaaaaccaatgtcagtttcacagacatagaaaaaggaatcctaaaatttatatagaaccaaaaaagattccagatagccaaagtaatactgagcaaagagagcaaaactagatacatcatgctacctgacttcaaaatatattacaagactatagtaacaaaaacagcatagtagtgatataaaaacagacacatagattaatggaacacaatagagaacccagaaataaactcacaaatttacagacaactgatttttgaaaaaggcactaagaacatatattagggaaaggacagtctcttcaacaaatggtgcttggaaaagtggatattcatatgcagaagagtgaaattggacccctatctttcactataatacaaaaaacaacccaagatgaattaaagacttaaatgtaagactcaaaactataaaactactagaagaaaacataggagaacacttcaggtcaccagtccaggcaaagattttatggctgaggcctcaaaagcataggtaacaaaaacaaatgcagataggactatattaaactaaaaaggcctgcacagcaaaggaaacaatcaacaatcaacaaagaaatgaagcaaagtaatctattaaaaagtaggcaaaggacgtgaatagacatttctcaaaataacatatactaatggccaagaggtatatgaaaaagtgcgtagcatcactcatcaccaagaaatacaaatcaaaaccacaatgatatatcatctcagtccagtaggaatggctattattaaaaaaaagatcaaaaataacagatgctggtgagaatgtggagaaaagggaactctgaaacactgttagtaggaatgtaaattagtgcaactattatgaaaaacagtatggatatttctcaaaaaaattaaaaatagaactacaatatgatccagcaatcccactactgggtatttatccaaaggaaaagaaatccgtatttcaaaggggtacctgcactcacatgtttattgcagcactattcacaatagcaactatatggcatcaacctaagtgtccatcagtggatgaatgaagaaaaaatgtggtatatttccacaatggaatagtatttggtcacaaaaagaaatgatatcatgtaatttgcagtaatatggatggaaccggaggttattatgttaagtgaaataagtcaggcacagaaagacaaatatctcatattctcaatcatatgtgggagctaaaaaagttaatctcatgtaagtaaaagtagaataataaatatcgaaggccaggaaggatgtatgtcagggcgagggaaagaaaagaggttggttactgcgtacaaatatatagttagattcaggaataagatataatgtttaatagcagagaaaggtgactattgttaacaacaatgtattgtgtatttcaaaagagctaaaagaaagaactggaaatgttcccaacatatagaaatgatagatgcttgaggtaatgaataccccaaataccttgacttacattacacgttatatgcatgtatcaaaatatcataggtgccctataaatatgtacaaatagtatgtgtaaactaacaaaataaaattttactgtacaaatatatttgtgaacaaataacaaacaatctctgaagacgaatgacacctccagcttcaaagaattgagctgaactaaactgtgctaaaagaaaaagaactgagcaactgtggcaggagacagctcttcctattgtatgaaatgattcacggtggactcggggccaacaagggtgcatcagatcacatccaggcatcttgatgtctttaggagatccaaatttagccttcagattctaggattttactgaaatagaatacaacttctcattcccaaaatataatgaacgggtgtgggtgggggaagagggggtggaggattttagaaccatgaatataggagggaagaagcttaaaaataatcttgaatatctcccttattttatagatagtgaaaaatagacctccaatcaataggtgatatgagctgggctacatcattagtcagggctaattagaatctagttcattcatttgaggttttaaagaatgcatttatgtatctgtgtattctttttccacgtatttttatgcttcaacaacaaatttgagctctgtgaatagattgcctgggtttgaaacactgactctggcacttagctaagtgattttatggaatttacttaacctttagttcccctttcttcatctgtaatataggcacattacaatatctacattctggggatgtagtgtaggttaaataagttaattcatacaaagagtttaggacaatgcctggcatataagatgtgttcaatgtgtgttagccattgtgattagcccttcatgtcaccttttgtagattaaaaaaattcaaattaacatctcaagctttcaattctctttcaagatttatctgaaaatttcctcatttacgttgagaaggtcttcctagttcaaaacctagtacctcaaattaccatgtcccaaatttcagaataatgaataatttcatttttctgcaccatgtcattccccttttgtgtttgctgtcccatcgcaccattcttttgtgttacactattccccaggtgtagagaaacagtctatgtcagtacaggcttaaaaagaaaactctcctaaatgggacttttttttcccaggattgtcttaatttcatttttaagaaagttaaaaacctaatacataaaaataattattagtatattctacatttcaataatattttaaaattcaatctataagcaggacaggacagatgaaatattgaatcttagggcaagaaaggaaaagccagacattactttcattttgcttttttgccttctcctctgctctgtatttctgctttatgccattcagttatggatgttatagtaaacatctttgtttctgtaaataaatactcataaatctatatatgtatgtgtattcatctataaaaggaagaataattttatttaccaagaaatctccccaagaatttttagcaatagcaatattcagaatgaaaaaaaaaaaatagcacgcttcctagtacaggtgctgtgaagttgctgggcacccaaccatcaccatccaatctgcatgacttgtgaggggttgcagatatcctggaaaccacctcatccaggaggcacataagaaattggaggaagccaaaagaagtgagaagaaagacagatttttttgtaatggttgcactatgaaatataaaaacctgttatatctttgaagaacccaattttatgccctgcaaaacacctggactagccactttaagaatacctataacaatattagcatgctttagggtttaagtgagatttctgatttcttcaaaagtaactctatgaaaaaaaaaactgaattatatgtatcatacacatagagaatgtgtaagaaggtaaccctttagagatatcttattgtctactcttttgggttgagatgaaaccatcctaactagtaactgacacgcctgtaaataatgtttacaaaaatccatagtctagacataagtatctgagcacatatatgaaaatataagctatctgacatacacgtctcatagttctgaatctgatatactctaaccagacctaaccttcaaaatcagtgccagtgactataaggagagatatgtttaccagatgctacaggtaagcttcaaaattatactgctattgaatgtcaagtggatgaagcacggtcagcaaaatgactaacattaacctgattcccatttccgtttttcttttcaacttttgcaatctcggagaacctgctaatggatcagtttcttattttgctgagactgtccattataaataatatttctatgcttattatcaataatgccactgctgcaaagcaaattcaggccagttacaatgcacggtacaaagctatctaaaatataagtgtgggtgtttcagcttgggtcttatctcatttgaaattgaaatatgtttgcaatgcttgaatgtgggaagattaattatcacctctgtttcaaaataagcagcagtagaaacccatcacatgaaaatgtggaagtgacattgtcgacagctaacaagagaggttttcagctggaaaagggtgcaaacagaaacaaatgcattcatatttctaatccgcagccaagaaaaattgtatttgatactggctgaatttgcctcagaaaatcaaagccccattttggctaggatactaaatgcagcaagatgaaccacagaattctgcctcgcagttacatcaatgctttcatgtttccaaggtcaggctagctctggctttttttttttttctcagtaagagagaaaagcataaacagtcccgccattgacacgcaatgtggccttaggcaaagaagttaatctctctaaacttcagtttccccatctatgaaatggacaaaataagcacatgcttagctcatggaatggatgcaagtctgttatgtattagtataaacaacacgcgtctagcatgcagtaagagctcagcagtagttagctattgctgttgcaaaaccatgccattctgttctaaaaccactaaaacaaaaactcgtccttcctgtctgaatgcagctctatctcaagtagtgagggtaatagaaggttcagttccccccacttcttaaacttcagtgattaagagagatcattttgatgcttcattcctgaaagatacttctttttttattgttgttttaaatgccatgtcagaacatccatagttaacatcaggtttttaagaaaggtctcttgagtcatttgaacactggcattgtgcagctcaggtctcattacagatcccttttgttaacaggaaggttttaagtcagtaagtccgctggctgtaccatacattaagataatgagatgaaatgatataaattcaaatcatttggctcccttctccatctctatttctctctcaatttatgttacacaatgacataaagcaccaccttgggaggtgagcctgccctgtggttaatcattccaatacatgctaaaataccccacactataatttaacatgaagaacagctaggggttgtattggaactgtcatgactcacaggaatctactaattttgtcctgttcaccttcattttataactttgcaagagtttctgccaacattggcagaggtggcaaacgtaaaaaaaaaaaaaaaaaaaaaaaaaaaaagataaaaagaagctctttgtgaaatggcatcttgagtctatgccattgatagcgtctttctgattccccaggcaagctctttctgagccactctaagccctccagagacaatttcttttatgaaagtcaagcttccttctaccaggctctcacatcttcagcaacggtaatcattcttgaagctggaagtgttgtctgctatcttgatgttgctggtactgaaagaggcaaacaaagtcagcctgattgttttaggtttggattagtctggagtgcatagagaaacattttaaaaggcttattttgactatcaaagtgagttgatatgacagcagtcgtcaggggaaaaatgtgcaccatgcaaacacacaaacatccctcagcaaccagctgcagctactttgcagtagcaggtttgagggaaaattgctttcttgactatcactggaaaagagggcagcactccaagttactttggaaaaggtacaaccacaaagtggtatccaggatggcatggaggtcaaaggggtttgaaagtcaacttttatagcacataatcttgtagaattgtgtctgtgatttcatacatgcgtgtttctgtgtaatatgtaactattcattaatcagacacagattggcaggttctagtcagttacgtccaaacataatgataatcaacagaaaggaaagtgatttgaattaggaaatggggaaaaagagaaacaactaacatgcaacaaaataaaaacaacagcaaaataagctagtaattgctgaaagcagttttagaattcagctcaaccacctaaaattctgagtttatgaatggaaagctacctggactattctgatcatatcatgaggtgcctttttagcttggttattcaaatgacaaaactctcagtcatatggcagggaactgcatgactcttcacaaaaatatatgaaattaaaaacaaattttcggtctaacttcctagtcaagtttatatttaatgagtttgagatgccatgtgattgccagtttccaagagaaattcaatctcccagcatttattccacttaaatattgatgtctacctcacagtagttcacaatttacaattaccagctctatttttaagcaaaatataactactcactttgacacaaacaagtattatttggaaataagaatcctcaacatgtttcccaaaagtagacacagattattgcatgatgtgtgttccacatttttagacaccaaaacaaagcagggtaatttcttagaaaaataaaacttcattagaaaaaaaagttgcacaaaatattctttcatattatctgcagacaatgtataaaatcatattttaaatacttctcaaagcaaatattcagcatactttcttctacataattacatccttcaaattctttacctcttagtagttggatttctatactaagcaataaacaaattcaatttttattatagatataaatagttaaaagagaacataaaagtaatataagaagagtgcaaaggaagcattcatctagtttgagggacaggcgcatgatgtgtaagacatatgttcagaagctcctgtcaaggatgtacttctcttggcaaagtctgggcctcatatccacctcaaggtaagagctggtctgagactggcttctgcctgatcctctcctcagcaccaggaaaacgatttcagaactgccttgaagttcttgatctagtctttgaaacaaaaggaaatggatcctgacgtggtttagagtgggcctgctcctgtgctcttatagatttgtgttcattctctttatctcaaatcagtttgggacttaagtttgtaaaagaaacattattatttattcttcattatcatataaaatttgactcaatatttattcccagaagaacttttctatcacctcactgagatagccttaacccaaggttttattttcttctccccaggaatgccttttgagtataatggccctgtccagtggtcagagccactgtgatttgtagtggcagaaattcaacttgaactagctcattatcgttaagaaatgctcccaattatgggaaaggcgggcagaaccgagaccggtaacaatatgctatctgctgtccctgtttttctctaccagttgtctttcttctcccctgatgtaaaacagcttctagtacaacatacttccaccttttctccagagaggaaatggctttttctaactcactccgtttccaggtaattatggggggatggaaatagattctgactggcttagcttgtgtaaaactcaattctatgccaaggaggtgatatcttacaattatcagagtctctcagaacctgtacaatatgggaagaatgagctccccaaaagaacctggctgtggaaaaaggataatgagggtgtgtggccatcagaagaaagctaggggagctgagatggcaaaaacgagtgattcctcctacatcttcctgtactatggacagtttgtggcagctagggagaaaacttatcagattaaagacattcatatgtgtttgcattgctctgctctttaccaaatgtacccattccatgaagaaatatacaactacctgcaatggttgattttatacgttaacttgtctggggtagctggaacccagatatttgatcaaacatcattctgggtgttttggtgagaatgtttttgaatgagtttaacatttaaatctgtagaccgagtaaaccagattgtctccctaatgtgggagggccccatcaaatcagctgaaggcctgaatagaacaagtctgacccactcctgagtaagaaaaaacttctcttgccagactgccttcgaactaggacactggctttttcctgccttcaggaatggacataaacatcagctcttcctgggtcttgagccttccggcctttgcactggaactataccatcagctctcccaggtctctagctggccaacacaccctgcagatctttggacttgtctgcaaccataatcatgtgagccaactgtgtatatacacaactgtgtgtgtatacacacacccacacacgtcccattggttctttttttctttttctctggagacccctgactaatttgctaccctcctcgtgtgtttacattctctgtgagaagtcttaaagtaaagaaagaatacagaaagtttagataccccacttagggtgtgggtaccctctttactggatggagacagtgcagaaaccaacttttacttctcgaaaaaaagttgacatgttccaatgcagtctacaggagcaaacaaaaccccaaatctccaggttctggagtccactgggtaggaatgagtgacaattctattttgtcattaccatttgtattagtccgttttcacactgctataaagaatactacctgagactgggtcattataaaggaaagaggtttaattgactcacagttccacaggattaccaggaagcatgactaggagacctcaggaaacttaccatcatggctgaaagcaaagggaaagcaggcacattcttcacaaggcagcacgaggaagtgtgcaagtaggggaaatgccagatgcttataaaaccatcagatctcctgagaacttactcactatcatgagaacagcatgagagaaacctcctccatgatccaatcacctccttccctcaacacgtggggattacagttcccttctgtgacacgtggggattacaattcaagatgggattcgggtggacacaatttgccaaaccatattactgttgtatataaaatggcatcttaaggcaatcctcagtcttaagggctgagacaaaggcttcttattacatctcttcaaccctcagctccagctcttctgctattataactcatagagattttatgaaaattaaatgggctgtatgtaaaaatgcctacaaaacatttaaatacagaagcatccaatacatttaattttcttattttgcttctgtgcagaaaagaaataacaaagcaggcctgagactgctatccttaagtctgcctgcaaggttggtccttgcctggcatctgggtgcttggaattcaaaagtttataccattcattaatttattagattggctccctgtgcctaaattgtgcaaataatatggtttatgctatacatctggtctccacctgtgactctcaaatgtttgttaccaaagtgtgcctatctaaaaagccccccataaaaatatcaggtattgactctctagtgagcttccatgatagacaacatttcacacatgttgtcacagttcaatgctggagaaataaaccatgtcctgtgtgactccacagggagggaattcttagaagcttgtacctggtttccttcagacgtttccccatgtaccttttccctttgctcattttgctttcattgtaataaatcttagccatgagtacaagtgtacattgagttctacgggtcctagtgaattaccaagatattgttggggacacaacctgaccactatctttttggccacttcactcaaattcagctcaaccttccaaaatctgtcatatagcagcctatgccttatttctatagattctagacagatcacctttgcctaagtactgtaaacctgaatatatacccaaagtaattttgggtttagaatagcaggctttctttttatgataatgtgctattgggcctagttacctagctaaagaaaatataactctatgttatatgtataaattaagtctacatccttacttaagtcaacacatttggttatttttacatatgcaattaggcccaaaggtttctgtcataaccatagttactacatttttagtcaagagaagtgttaaggaaagtataaccaagatgcctgccgaaaccatgtaaaaacaaaaaataacaaacaaaaatcaataaaaacccatagaaagcctggctttgagtaattctcttttatgttgaaatctccaagataaatgaattataaaatctacatcaaagtgactagatgtagtaacttagtgaatgagattataatttttgctttgggccctttatacctatagctcattattttcctccactgataaccttaaatcctttattctcgttttttttattagaaaagtaaaatgaattcctgtattgcagaaaaagtttctttttgtttcaatctgtcagtaaaatctttttagttcaccaggttttaccacgaacagataatgttcttagagggtaatattcttagatggtagaaatgcaagcattttctctttccagaataaacaggttttaccagcataggaagtaaaatgccatcactcataaatagaaattaatatactaatttatgtggcttcagggagtcttgaggctgtggaagactgcaaagttaaataagctgcatccacatatacaacctctgtttttcttctgccaagggcataacataatatgcacttcccatgtctctaagagtccccccatcttcccaaatttccaacatgtatttgctaaagaatgaaacacaggaaaacgtcaaaacaggcaggaatgagacgctgtactgaaaacaggggaatttagtgaaatcctacccatttaccgatgaaacctgatgttgtcatttcacctcctctccctggttcatccactatgggcagacaggcctctgccctttttatagggagacaggagagtgtagttttctcctcttgagaaaacttgagaaaaaagaaaaaaaaaagacccaggcatttgtgactagcctaaacatagagccatattcctgcttggttatccaattatgaagctcatcattcaccctgtgccacccatatattcagggctgccaattcatgttttatgcttttttgataaatagcctttttattatttttattcataagcagcattttatttatgctttactgataaaatagtgacaagattatcaataaacagccaaacatcattagacatttaaaaactcccaataaatgaaagttagaggccattcccccaaccccacaaaaggaactcagattaaatagaaacataaaaccacaaatatgtagaaacctttaataggctcaaaaatagagaaaaagaaaccttcagggaacaaaaaataggtttcagattttaaaaatacaacaggaacaaagtaccgtttacagaacggttgaaaagtcaagttgaagaaatctcacaaaatatggaacaaaaattcagagaggaaaaatatggaaaaaaataaaggaacaagctaggaagtcatagacaaagtggcaaatatgtcaaatgaacaagcctagagatccagtgtacaacatgaggactataagtagtaaatatactgtatgtgagattcatactatgtgagtagattctagctgctctttgccaccagaacaaaacaaatgggtaattatgtgagctgacagatacgttaatttactttactacagtaaccattttactaactgtatgtattccataacatcatgttacataccttaaatgtacagaatatgatttatttttaaaaaagagatgatgcagagaaaatgggtaggagaaaactaattgaagaaattaaatgagattttctttcataactgaaagtcatgcacctccagatttaaagggcctgtcaaatgccagcatgatgaatggagaaagacccacaagacacatcaatgtaaattttcatcacagcatggataaagtagagattctaaaatatctagcttgggtcaggtgtggtaatcctagcactttggaaggctgaggcaggaggattccttgaccccaggagttggagaccaacctgggcaacatggcaaaaccccatttctacacaaaatacaaaaattagccagacggaatagtgtgagcacaggaggcagaagttgcagtaagcggagatcacgccactgcactccagcctgtgtgtgacagagcaagaacttgtctcaaaaataaataaataaaataaaagtcaacaaaatatccagcttggcagaaacaacagatgaaatacaaagattagcaaattgcatctcacttctcaaagtcagtactagatgccagaaaatactggggtataagactccaaaatcatttcagaaaatattttcaacatagaattctgtatattaacagatagtcaaccaagggttgaataaacatattattagtaattcaaggaatcaaaacacttacatttgtttatcctgcattaactactggagaatgtgctcaataaagtgaaagagtaaatcctgaaacagaaataaaaaacagcatccacaagaacagggatatcaacaggaaaaaggcaaaggacattcctaaaataatgacaaagagaaaacataggataaatgcacaagacctaccaaactaccagtccagtcggagcagaaatatggaacgctctggaggggatatctttcagaagaatatgaacctgtagtttacagatgtgtttgaacccagtgagaaaagtttgttctgtcaaagagcttgaagactatcttataacatatccatagaaaaactccatatgtcaaaaaagtaagatcatttttaacatttagtaaaaaaagttttggaagaaagggatatagtcataatttattatgtagattagctttgaattatatttatatatgcataatgactgtaataaatattgatttaaccaaaattttagatattactattttgagagaattggaggaaggaatgtttgtgtgtctccgtgtgtgtgtgtgtgtgtgtgtgtgtgtgtgtgtgtacctgtagaaagagagagggttgcatcataagtgaatcaatcctaatgtttcataataagatttcaataaattatgtcactatctctaagattggaaaatcaaaatataacagtttatattgcttggaattggtcaagtaaatgcaagaagaaatatctaaaagtgataagatcgatattggtatcagagtgatgggggtaggaagggatgagaaagagaataagaagactgccattatttacaatatcatatatatatatatatatatatatatatatatatatatatataaaataaccatatatagcaccaaggcttattatgtatatatttatatttgtagcaactgtggctactaatacatatatatttcatatattactttttatataaatatatgctagttaaatatttattaaatatatgcatatataactttatatatacacatatatgtacatgtatacatataaatatgttagttaaatatttaatatattatatataactttatatatacacacacgtgtgcacatgtagataacatgtatatataaatatgcatgtatatactatacataattttaaaataaatgtttaattataaaaagcaaaaagaaaaaactttaaaagttatgtaactagtttaatatagaaaacagatcatgagaaaaatcctaaggaaaatagaatttaaaagattaaactgtatgtaaaatggaaaaaaggaaaaactatagagaagaatctttaggaggaatatattttcaaaacctctgactaaattttagcataattcataataaatttgaatgcctgaagcaatatgacattcaaaaggaatttttttctcatgtctcttaaagcaaataaagggatccaaagtcacagtcttttgcaacctttattaaaatctccttcctgccatacatgtagcctctgaaatactagattacttgatgctcacagctactactcagatctattactcagaataatttattctaaggtcattgtctgcttcagtataaatgacataaagtgactcaaaattaacttagatgacgaaaactagtagataatagctttttatatatgttttatccaaatattgaaatttaaaataagccagctttctcacttgagtaactttaggcacaatggcgaattagcagcagaccacaatagctcattgcaagtctctgtctcacctgcctgccacaattgtagcaaataagacaggtgactatcatgaggcagaaatacatgacttggaattaaatggaaaggaagtaatttggattaaatgattattatgaacactgcagatttagaatgaaaagtcaagaattctatgttttacgtcaactaaaattttactttacttctaattaccacttcggatttgaagccactgcatatttcccattaattggtagagatagtagatagaataagaaatggattttagtagccagagttgaagttagggttaatctaaatgatctcataagcaattactagcattgtaccattatacagtctccactgtgccattgtaaggactgttattcacatctaagtttcagtgaatggcactggaggagtggagagtacagcttgaatggacatacatgtgacattgtttacaaatttccacatttcttttgcagaagttgtattgggctgttcttgtgttgctataaagaaatacctgagtctgggtactttgtaaagaataaaggtttaattggctcatggtccttccggctttataggaagcatgatactgctgtctgctcagcttctggggaggcctcaggaagcttactattgtggcaaaaggcgagggagagcaggcatgtcacatggccagaggaggagcaaagggatgcgggcagtgctaaacactttcaacaaccagatctcctgactcactgtcgcaaggacagcaccgagccatgagggatcctccatgatcgaattacctcctgccaggccccacctccaacactggggattacaattcaacatgagatttgggcagggacaaatgtccaaagtatatcagaagtctaggtgtatttcttcctttaaaaaatgggttttgtaaacctggaagaacaaattcttatttacagtagtgtgtccaaatgcactgaaaaagcttgatttcaaatatatcttgatttggagttgctaactcctattgctctgatactattgtgatctcagattttgggagtttcctctggggtttattattgtggctccagcctgtgatgttttgtctgttggtcaatgcagaatattcaaatttggaggaaaatttttctctacagtctcaagactttgccttatttctcttcacttaagactttatgaacaatggtttcatgatgacctctacagcccctgccctcaatagcttttgcagttggcatcttacctcacaaatatttaacattttcatattctttaaaattttttggcatgtttaagtaatagctcttccaggtttacaaaacccctttttcaaaggaagaaatacatcatatgcaatttccctaagttggttctcagtcactgaagcctgcaaaagctctaaaattagattccgtctaattttccaattatgatataccattcctcagtgagtgaccagggaaatctgcgtatggttgcttctaactattaaagtaacacattcattctttcagcaaataggtatgaagcatattctatgtcccaacctctgaactataagcttgggatacatccatgaacaaacagaaatatctgctaacacggagcttacattctaatgcaggggttaaaggggtaaacaagtgttgtcaaacaacagaaaaaataatagatatattaaataagtaaattatagagcatattagaatgcaaaaaacgtaacggaataaatggagccaggcaagggtgaccaagaatgctggcgactatagatcgactagggtaatcagggtaagtctcattaagaaggtgatttttgagcaaagatgtgtaagaaataagggagttttccaggcaaacatttgtaggaggagcatttgaggctgagaaaatatccagtgcaaaaaaccgcactgtgggagcactcctagtatgttaagtaagaaggaagaaaggcattttgcttcaagggtcttttttagctagagtgcccactcttacatttctttttctggtttaccctcaggctccagtgcatatattttgtctctgatcctctgagtaattagccagcattttaatgataatctgcattttcaattatgttagcttcttttgtttttgaacctctgaggaaaggtggacataaatacttccattgcaaagataaagaatctgataatcagaaagtttcattcctttaaagagctcaattccaaagtcaaaccccaaatctttcactctgagcccagtggtatttctgtcattgcctatgatatcacagacaaatcttgtccagattttctatcactaaagaaaatctagtcaagtctctacattgggagggtgagaaaaaaaaaaaagcaggcaatgatagaattcaaggaaagacaggaggcaggtcaacacacacacacacacacacacacacacgctttgagtgaaaagcaacacccactgtgccatcatcctggtatgaagaatacttgcactagaaaaaatctaactgcaatcctttctgacacacacacatacacaattaggaaacactcaaacactccttccacacttcattctgctctctgcctttggaggggcaaacagaagtaatctagcccaatgtacaatatataaatgtatagcaccatcttggctgaaagtccccatgcattctgtagcatgcacattgtatacacccaattgagtgtttcataaagttgtatgtatgtgtaaaggggaagggagtggttggattatttttttctttgtccataccaagggcaatcttgtcctctctcctcctgccttcattaacaattctctttctgtgtgtcttcaggtcccacttttaactagctctggaatatgacagtatcaattttgattccctataccctgatcattttcagtggtcccttttttaaacctgccttgaattattctaatttgagtatgccatctgtttcctgctggaaccgtgactgataaaagtgccatcttccgttcttctaagaccatagaaatgataaagtatgaaatgataaatgtaaaatgaaatatgttcatattgatattcatttggaaagatagcatctatatcgctcatactaaaagagggacacaaagggtaatctatcctgaaaagcagatctatagaatctcaagcttgcagtagggagttctacttctatagaataagggaggttaaaaagtgcttcatatgaggggggtaaagaggagtgggcctagactcactacgtgaactgtgtggctgagacttcccttctctatctgctagaagagaaagaaagctgtcttctaaaccttgccctgaattgtggctatttatagctgagacccagtgggaggaagtagtggacatatcctggcaaataaagatttgaggcaagctactaattctcagtgacctaaacgttctaagttactacgtcctaaagatctctgagttaccagtgtttgacatggatctggatagggacccctgggaagacaggtggaagcatttacagaactgttagtgattgtggtatttgagcaaagagagaggaagaataagaagaggaaagagaagaaggaggtttccttttctgttgagcaactgaaaatatatgaggaaaactaataatagtactaagtgagctagtagaatcaatcagaatatgagttctctccagaaaaaaaagaaaataatagagtaatcaaaaatggtttttcaaatggtacatattaaacagtgttatattaaaactatgataatcatatagagcaaatgcataggtttgaaagtagaccgattaaagttacagaagaagagaatagaaaaaatagtgaggaaaaaagttattgaagagatgttagctaagaaagttcttgagttgaagagagacatgcatacatcctcctattaaaagggtacgccaaatcctgagcaggataaatagaagtctatatatattcatattttttaaaaaaccttcaatgatttaaaaaaactcaaaattttacccaagataagtggtagacaacctataaaatactgacagaagaatttttcatcatcattagtagctagagaagagaatggactacgtaatatttttctacatgtatagtcagtatctttattatgtttattacttgaattggacaaagttggtgttaattttctacaaaccactgttgaatagagtttatgaatattgtctttgaatttagataatcctgacttctaatactagttccaattttactgatggtgagatcattatcaagtggcataattcctctgagactttgtttccttagaattaaagtggaggcactaacaattactttaagagactgttataaatattaaacttaagacaatctctggtgtgtggtaaatatttactttcttgtggccattataaccaattgactagattttcataatttttaataaaacaagtcagttaagaatgaaacttatttgtatatatatgcagaataaggacaccaaaaaaagtgagacattttagaatgtctaggtatttaccaaggaccattcccttaaagctgttttcattctataactacatttttccttcactcactcctcttttcattttaagatctcaccttacttaggttactttctccccatctataactttaacaatcatctatacactggtgctattcaaatatgttatcctagtcttacatctcttctgaactcgaggtctgtattcacaactgattattctatatatcaccatgggtaattcaaattcaacataacaaaaattaaactcagtatctctccttcccactgtccaaaactaccccttctcatatttccctttttgagcaaaatccacccaattgctcaaaaacgtgtgaaaaacattaccttctattttttcctcagttcctgcaaaaatgtgttaaccccacaagaacaatattaagaatattttacaacctggttggcaggcaccaatgtattaacacagatggcagctgtagtgctagggcaggatcaagaatgccctttgctaaagattccttgacccctacagctttgccataggtaaatctagagctttcagggaatggactgtttataagagtgggaatcttgagaaaataatgattcagcaaagactatggaaagatttcaatacttttactattagtatgagcctgctgatatatggcagtatcatcttcttttcttaatacaactgctgtttctctgtttcttatcatcatttgcctgtgcagttgcaatagtctacgaattgtaatccagagatccaattccttttctcctaagtctcctctagtgatgactcaaatactgccagttagtgtttttacttgctatgtttgataataccactgtaagtaaggcattataaacatagttaatacttgctttatctgtatttctttcccctttgacagtttgttgtcttttttctgtatcagatagtgtaagcctttgttaaaagctttgggcaacttttaaaaaataagttacaattttatattctttctttttaatatagaaatgatgtacttttactgggtgggtagtgggaaatagcattaaaagcaacactgcaagcagcaaaatccctgagccagctgcacaacattaagaaaacacctttaaaaacacatttttctttagcctgaagatttgaggaagaaagcatcacttatcttttactataaacaatggatttgtgcaatctcacatatgagactagatcttaattgatgactgcacagaaagtagtaaaaactcaatatttatgataatcccattctgtcattttagtttatagcattgcagatttttacatgacaatgggtcatatttagtgtttccatcacttctaggaggatttgaagatgtttttggctcaagcataaattcaacttgcatattattgaatcaacagttaaaccaaataaatgatcaaatagtaaaaccaaatgaatgatctgtactacctaaatgatggggatcattttatatgttttcaatgtgcacctagcttctatcatacattgatatcaacttcctacaaatttatgcagtttaatacccatttgaaagtgaaaatgatccttttacacacatctcaatgtaatacatggtggtcagccgatggtgggggtgaggaacaaatattttttgcaaaacttctgagcattctcctttccagtccaggtctctatacaaccattatatgcttttcttttaaaaaatatttttactattaatccatttattacagaagtacataaagccaatttccctgtaactgatagtctaaaacaatataataaattgcatgatttcattaaagctttgcacctgttcaacatcttagaccttacttttttaagcatccattttaaactattaatatttgtaattgccaaagtagccacttaatgatttctgtttagaagttattagtattataaataatactttaattttgtttaactgacacttaataattgtacatatttatggagttcatagtgatgttacaatacatataatgcatagtgaacaggtcagagtaattggcataaccatcatctcaattatttattatttatttgtgttgggaacattcaatatcctcctagctaattgaaactatgtaatcctaatattttatacctaaattttttttataattctgaatgtaattttggaaacaatgtaataggagattaaaagtcagaaccatccaaggatatacctaacgcgtatatttaatagaaacctaaagatgcctttctaatttcatttcttgaatttttagattaagcaagccaagcatttttacaagaaatgttacttcatcctatgttgtagttctgtcagtgttaactactgtaagtttcaattatattcagaattattaaatattaattataaaatggaatagcatgtatatatggcaatgcatagtaatatttattattgtcaccataacaattatgtaataatatttttatactaataactaaacctatttaatgtgtattttcaaaacaggaagcactatttcactcaaagaatgaactcccaacacttaaatttaaggcactagttgtaagcaattgaaaaatattaagcacttcaatcacatatgttatgatttaggtataaactaaatagaaataagacaaacattaaccaaagtggaagattttttcttatctatttttaaaattatatatgacaaattcattcttatgcaagattttctgagaaaataaaaattttaatattcctattagaattctatctcgatgggaatggcacctatttcctgacttattctcttctgtatcaccagcaccaagtaaacaatcaataaatatttgttgtgtggcacagaataggtattcaataaatatttatttaataaataatattcagtagaaatatgagtcttagaactacagaatgctgatccaacatattagacttcattttaaaaacatttatgaggccaggtgcagtggtttacacctgtaatcccagaacttttggaggccaaggcaggaggatcacttgattctgggaggtggaggttgcagtgagcccagatcacaccactgcacttcagcctgggcaacagagagagactctgtctcgaaaaaaaaaaaaaaaaaaaaaacccaaaaaaacaaaaatttatgagacacaaatggtgctatttttacatgaagaaagaattaagtaaacaaagagtatgaacaggccattaacaaaagaatataaacaattgataaaccccaacaaaatatttaatcttgcaagcagaaaaagaaatattagtaaaaacaatacaaataccttatttctttcttataaagttaggatttctggaagaaagacaatgactagtttgcatatgagcaaggaatataaaatcagtaccaattctaaataaatactcattcaacaattcctctttgaatatttaaataaataccaaaaataaaaaataattgtgcacagcaacagcagaccacagttatggtctctaaacaacattcaccattaaaaggaagcagggcaactcttagggcagaagtggctgatgtgaggtccaggcagggcagaagatcttgtcatatgagaaaacaagtaagttggattattaaaaactactgggtaatacccaaaggacacaagagccagctcagaaattcccactgaccaaagttgggacaattatggaatcaatagaaagaataaactacaacagattaagacacaataaatacatttaaatctgtttatcatcttttataatgaagattcagtatttaccaccccaaatttgaagcatatggttcaaaataataaccactgtttcaaaaattttaagtcagctttcatttaacattggaggaatttttaaaggaactactacctctaataagaaaacaagtatccttgatcaatttccaatttctattttatgtgttaaattcaattataattaatagttttattgaaaagatcatgtcttttttgaccccaattttgtctccttatctcttttttccttttatataaacatatataatttgagtttttcctcacttacattgcttacaattatattaacactgtggtttatttttaaaattgtatactttttaaatgagaaagagaaaagtaaactttttgaattgcaaaatatagctgaaaatacgtcaatgaattttctcaaaactgaaaagtagttttctattaatacaaacttttttgtttgtttctttttttgagacagagtttggctctgtcaaccaggctggagtacagtggtgcaatcgtgtctcactgcagacttgacctcctggatttaagcgatcctcccactttgcccttttgagtagctggagccacaggcacgcatcaccatgacaggctaatttttttttttaattagttttttgtagcgattgggtccctatgttgcccaggctggttttgaactcctgggatcaagaaattcttctgcctccacctctcaaagtgctggtattacaggcttgaaccaccatgtcaggcctataaattattttttaatgtgtagggtgatgacagaacaggtttatttccttcattggtgcacatcatttatatttacttatagtaagacagtgctattagtaatacagcattctttaaaaaaataaaatgttgatgaaattgttacattgcttcagttatatgattagatctaaaccagctttcattatatttcatgcaaaatatattatataccatgcatggtattttttcacatagtatttatgttgcatgaaaaataccatgcatgatctctggaacctgggagactgcagtaaccctctatgtttctaaaatatttttaaatgatttattaataactcaagatatttctgcctaccaagctctttttttcctctgtttatattccatttttaataatctcacatttctaggaaaattaggtgatattacatttgtatatcttatgatgagaatgattgacaatattttaaggttgtattccaaagaaaaatctaataatctaaataattataattacagccactaattcagatttattagagatcaaatgtgtaaccaaatttgcagagaaatagaaaatattagtacgtgactgtatttgtttagcttttaaatttgaaatcaattacccatagtattttattacaagtgaattaatgatatttatgaatgcatacattcattaatttagcacttaaacgctaaacattcacatctcccaaattatttattttggttacattttctttttaaaataaataattactcctatatctttttattcaaacttagatcctcattaaaaacaaactttgaaactcttgtttttgttatactcttgtttttatcagtaaatatatagaaatatttctatctgtttgcatgttacatgctcacatgccatattagcccttaatgggctatcattgacctaacaaatcacccaatactgtctacctggattaagaccagcatctatagaagccttgataaaatgaccctctcttctcagtccttttatatatcaaaaccacatagacttcccagaaatgttacagataaataaagaggccataacactgttttagagaaactgatattcaattagtcagggcttcttccaatatataatgttaaatttgacagcaatgtatttatatctgttaataatttaaccaatcttagaactccactgaaattactttttttaaaaaaaatttacctttattgaggcataattgacaaacattattcaatgtgcataaagtgatgttttgatatatgtatacattgtaaaatgatttccacagtcaagctaattaacatatccatatacttaagactagccgggcatggtggcaagcgcctgtaatcccagctacttgggaggctgaggcaggagaatcgcttgaacctgggaggtggaggttacagtgaaccaagattgcgccactgcactccagcctgggcaacagagcaagactccatctcaaaaataaataaataaatataaataaaaagatttactgttagcaaatttcaagtatacattattattaactatagtcaccatactatacattaggtctccagaacttatgcatcttataactgcaattttgtactcttaggccaacatcttctcccatttcccccacccctcgattccctggtatcgacccttctattcactcttctgtatgttcaacttatttagattccacatgagaatgagataattcagcatttgtttttctgcgacttgcttattttctttagcgcaatgtcctccaagtttatatatgtctcaaatataacaaaacttccttctttttttaaagactgaatgacagtctcttgtatgtgtgtatgtgtgtatcgcagttattttaaaggacgtgcataactcagaaatgcacattccatagtgcttctcaaactgagcaagtataagaatcacctgggaatcttattaaaacacagattcctggggccagcctacaaagattctgattacgactgagttcacagccagggtgaggacccccataatttgtattcctaacaaggtgctgggtggtgttgatggtcatttggagcaactagaagtctgcattctcagtttaatttgtcttgttccttaaattaatttggcactaatctttgttaatcagtcttttcccttcccacacctctccgttactttaaagagcatctcctttgactttagattttattttaaaatgtcctgggagctactgttcacatgttattcctgtacccaggagatgaccttaaatatttgtgcttatcatttcatttcaagaaacactaacattcaggcaagtttaaatgatgtatgtcttggtttattgtcccctacgtcctattgtccaaggccctgttggagttataaacaattttatttcagcaccacaagaaaaacttgctgttttaggttttaatgtttatgtgccacagtccaagagaaattattttttctgataatgcctttgaacttcaaaagccctgttcctttaataaactttttagaatgaaattatgcaatattcatcttctagtcattaagttctatgagatcatgttccataaatttaacatttcatagtattaaggttggttcccagcctatctctaaatatcttttccttgtttattgcagtattttagcacttgatagcagataataatagcagacgtcaacattctacaaatcatttctaggatgaaaacatttttaataatataaaaccagtattccctgagcatctggcaccagaatttctcttagaaagcaaaaggtgtttttctggaaacaatcgtggtaagtcattggagattgaaagtgacacactgatagagtccaagaaacaacaataaaaggcattttttttttttgcttactctatacaaagcaagtgcttatccatattaacaaagttaattatcataactactttatgtggcatgaattctataatccttcattttctagatcataaaactgaagtatagggaggttaagtgacttaaccaaagtactgcaggtgtaagtggcaaagctgggatttgaaccaactcctcagtccaaatattcatcagcatacaatgctcctttatctgataacataagaacagttttgcaggtgtttgctgtcggtggttggttggttggctggttgactgaaaaagaaaatgtgggagtgggtgaagtgagaagagaaaaagggaaccagagatgccaaaaagctggaggatgatgaggtaaggtctctatttttagtggcagaatgactgtagaaaagtgtttaatatgaaatagatgcaggacttttcttggcccctttgccagattcacagcaggggcaacccttctactccgcctgctcaaccccattgcgggaaggagaactcccttgcaggaattgactgcaggatccagccagaagctcccggcgccaactcaggagccagttccaggcagggccatggcaaggctaggtgtgtcacctcgaggggaatgcggcggcacccaggtgaatgtacctatgaccctgaagtctcggaggggatgtgacagtgctcctttagatccaccgtctgcagacagcagtgtgtaagcagctcagttggccccttgcctcgttgcatggggtggctgccctccactggcgagggcaaagggctgatgtgatggcctttctgggtacccacactcggtgggtcccgagctctagtcagtgtccaagaagagtgaggtcacatagatggagaaggcagagaactttattgagtaatgaaaatggctctcagtggagaggggagctggggaggggatgggaagggctggttgtctcctcctctgccagctaagtctaggcacaggatggggagtgactgctgattgctttgtgagtatacaaaaagtgttaaagcaaagacaccactcaaaggtgggcacaacattgtagaaaaccaattaggaaagggtaggtataagtaaaacaggtgaagggtggggatcaatcacagggaagcgtgcctaacaggaagacaagttctcaacccggtctgaggattatttaacctgtagcttggatttcaggctttaaactctcttccccttggaggtgggatttcactgggtacctgcctctatctgcctaagcatttggctgcttcctgtcattatcaaaatgagacattattttgctgagcagtgcacattgtggcctctcctgatgactccccaaatcagcaatcttgtaaaaatcagtgacagggcagagtttcacatctgggttaatgttgaatgttgtacagaacagagatttcatggggtggggctgtgggagcagaaatagaggtgatcagcagatcagaagcccaggtaggctcaagaaatcttgggtcaggttttggactttcaagctatagaacagtggttaaaataatgttttctaaatattgagaggaagggagctcccagctaatatgtgtatttcattttatgattaaattattgtgttttctctactgtaaactaagggggaactcttattatctaattttaacgatagagcaccatgcccagcttgaggaataccataggtacttattttaattataataaagtatatgaatacttttatagttaaggtaagaataataaacaagaatattttcaaagatcttcctttatctgtgggcaattaagttttacttgggtagatcattcctgttttagtttactttcaatctttaggatatcttgaataattgtaaagatatcttttcatgacatgtaacataaacaaatcttttttcttcatatgtaaagccaagattttcctttcttactcatacatgtggcaccacagcccaaatcaggacaggctggttgaacaacggacattcccaggctgatgacctgatttactctgtgcattggctgttattgtgcatctgaggccatctgggctcctgagggttcccaggcagaaatttagcaggtggggcctcctggtagagtcgatgagagcactaataagcttgtctcagctggatgatactctttgcatatctttgcatttccttgttcttacagggaactgccttcaggagaaaattcacccaggtcaccaattaccgtgctccccagttggtttgtgaatgcttcagcagacttatttgttgcacacaactaactttttttgttacatacccttagttttcacacattaaaaaatacactaagaaacttaactctttgaaagaggacattttcattcatttcttagtttgttaattcaacaatcaataaacttttattgaagattcaatatgctcatcatcttatgctaggcattttagagtggaagatataatagcatattaaagatcttctatgtgacagccaatgtcctaagtgtttaaatccacaataatgtttaacttttatcacaaccatataagataaatacctgacacgcaagttgggaagttgaggctcagagaagttcagaattttgctccagtttatacagcatctaagttgcaaaactcagtatcacctctggttcaggcgactccaaggcccatttttaaaaaaatttgtgccagttataaatggttctggctctcaaaaagcccatggtttagtgatatatggaactcaacataagaaaaatcagtatatattatgtgttataataacggcatgatcaaggtccgtgaacaaaacaaatataaataattccatattgtgcgcttttcactggggatgctagaaattgctcccggtttttcagccaagataaaatcagcattccaagcagagtgaacactaaacaaacagacaaaaatcagaagcaagaaagtgcaatggtagctttggggcagcctctagagctcgctaatggaaaagaataaagggttgagtatgacacctggaaataagacttgaggtaaaatcaagaaatgccttgactttcacagttatgatcagaaaacatcaatgtatagtggttaccagacatgagcactaaggaaaactcaacctttaatgcagtttcttacctcagtgtacaaattatctattgacagagaccacccaggttccaaggatttcttctatcttgtgcaacttctccagttaacatagactagatttcactacatcacttggacatgaccatattattctagatcatgaggtataacaagccacaacaatacacttgtactcccctcagtttcaaaatttatgttaccttagtggtggttgagataatgttcaatttcctttgagaaatatgtagaaaagcaacactcctaaaacagagcctttttcagccttctgattctattctcacatattgcagggtaaagaggaaagaaaaagaaggatggtcagatagatgagtgagttctctggtacatgtaaatattcaggtgactgtgtgtgagacagagaggcagagacatagagagtgagtgcaggtgtggtttcccttctcaacctgtattttgtaagtatgctaagtacatccattatagaataatcagtattttactcttttagtgaagcctttaagttaatctttatgtccaaatacataattatatggtgagagtggaggtaagaaaaattatagttttaaaactaaacacgtattatataggtaacaaaaattagaattttaaaactaaacatgtattatataggtcttgaaataactcattaaagtttttgattgttctttcttcagatacattccatgttcctggttgttttgaaatgttctgactttttaaaattatactttaagttctgggttacatctacagaacgtgcaggtttgtcacataggtatacacgtgccatggtggtttgctgtacccatcaacccgtcacctacattaggtatttctcctaatgttatccctcccctagcccccaccacctactccaggccctggagtgtgatgttcccctccctgtgtccatgtgttctcgtttttcagctcccacttatgagtgagaatatgtggtgtttggttttctgatcttgtgataatttgctgacaacgatggtttccagcttcacccatgtccctgaaaaggacatgaactcacccttttttatggctgcatagtattccatggagtatatgtgccacattttctgcatccagtctatcattgatggacaattgcgttggttccaagtctttgctattgtgaatagtgttgcaataaacatacgtctgcatgtgtctttatcgtagaacgatttgtaatcctttgggtatatgcccagtaatgggattgctgggtcaaacggtagttctagttctagatcctcgagaaatcaccacactgccttccacaatggttgaactaatttacactcccaacagtgtaaaagcattcctatttttccacaacctctccagcatctgttgtttcctgactctttaatgatcaccattctaactggcgtgagatggtatctcattgtggttttgatttgcatttctctaatgaccagtgatgatgagcattttttcatgtctgttggctgcacaaatgtcttcatttgagaagtgtctgttcatttcctttgcccatattttgatggggttgtttacttttttcttgtaaatttaagttctttgtagattctggatattagccctttgtcagatggatagattgcaaaaatgttctcccattctgtaggttccctgttcactgtgatgatagtttcttttactgtgcacttctttagtttaattacatcccatttgtcaattttggcttttgttgccgttgcttttggtgttttagtcatgaagtctttgcccatggctatgtcctgtatggtattgcccaggttttcttctaggatttttatggtccttggtcttatgattaagtctttgatccatcttgagttgatttttgtataaggtgtaagcaacgggtccaatttcagttttctgcatatggctagccaattttcccaacaccatttattaaatagggaatcttttccccattgcttgtatgtgtcatgtttgccaaagatcagatggtggaagatgtgtggtgttatttctgaggcctccattctgttccattggtctatatatctgttttggtaccagtaccatgctgttttggttactgtagccttgtagtaaagaaatgaaggcagaggctgggcgcggtggctcactcctgcaatcccagcactttgggaggctgaggcaggcggataacgaggtcaggagatcgagaccatcctggctaacacagtgaaaccccgtctctactaaaaatacaaaaatttagccgggcatggtggcgggtgcctgtagtcccagccactcaggaggctgaggcaggagaatggtgtgaacctgggaggcggagcttgcagtgagcagagattgcaccattgcactccaacctgggtaacagggcaagattccatctcaaaaaaaaaaaaaagaaaagaaaagaaaaaaaagaaatgaaggcagaaataaagatattctctgaaaccagtgagaacaaagacacaacataccagaatctctgggacacattcaaagcagtgtgtagtgggaaatttatagcactaaatgcccgcaggagaaagcaggaaagatctaaaatagacaccctaacatcacaattaaaagagctagagaagcaagagcaaacaaattcaaaagctaacagcaggcaagaaataactaagatcagagcagatctgaaggacacagagacacaaaaaaccttcaaaaaaatccatgaattcagcagctgtttttttgaaaagatcaacaaaattgacagaccgctagcaagactaataaagaagaaaagagagaagaatcaaatagacgcaataaaaaatgataaaggggatatcaccaccgatcccacagaaatacaaactactatcaaagaatactataaacacctctacgcaaataaactagaaatctaaaagaaatggataaattcctggacacatataccctcccaagactaaaccaggaggaagttgagtctctttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccgaagttgagtctcttaatagaccaataacatgttctgaaattcaggcaataattaatagcctaccaatcaaaaaaaaagtccaggaccagaaggattcacagccgaattctaccacaggtacaaagaggagctggtaccactccttctgaaactaaagagggaatcctccctaactcattttataaggccagcatcatcctgataccaaagactggcagagacacaacaaaaaaagagaattttaggccaatatccctgatgaacatggatgcgaaaatcctcaataaactactggtcaaccaaatccagcagcacatcaaaaagcttatccaccacgatcaagatggctttatccctgggatgcaaggctggttcaacatacgcaaatcaataaatgtaatccatctcttaaacagaaccaatgacaaaaaccacatgattatctcaacagatgcagaaaagtcttcgacaaaattcaacagcctttcatggtaaaaactcttaacaaactaggtatcgatggaacatatctcaaaataataacagctatttatgacaaacccacagccaatatcatactgaataggctgtatatttccagtggaatatgggtaagaaaatggtttttacacgtgctatctcttcattttggaattttaagattttgtcttccaaaatcaatgtctttctgtcttgttgaatcctaccatttggcacagactgagtggtcttttttcttcaggggcaggggccaagataggagatgggtaatctgaagtttcctgtgttttcctgtgtgcaaaactcataaacagccaaaataattgtatactgttattgtatgatctgtctttagccctctcctgaggaaaggctatttcaaatgcagccatcttgaagattgtgagttctatttttccccagcaaagagaagttaatcatagtaaatgcgatgctttcctttctaagcatttgtggaccatacactgataggtattttgctgaatttgctatgacaatagcaatgtattacatctagacccttgtgcacagataatatcagaagctttgtgccaataggataaaccacatcaggatggagagctaagttgatatcggtttccacattttgttttaacgtcctgctgaaatgtctctgaagcttcacaagagagtttgctttgatcaacattcctcaaccttcaaaggaatcttggaagtgtttgtgagacagctgtttgctgaaataaccttaattgcttgtactaagaattatcactgcatgcctcatagatttgtgagaagtctgtaaaaaaactgctgacattggcaccaaagttcatctaccttcaatctacaaagtacccccctcactatttttaatgagtggtacctcatctcattgtgcacacatatgtgcccaaatataagtcattggtgatactattttcttatttttaatttttatacaatgtttctagtacaaaagtaatgcatgctcgattatagaaaatttgaaaattcaaaaatatgagaagaaaaaatatcctctctgaaaccaccattaaaataaaaaaaaagtctttctagtaatttgtaatatgaacagggttttggtttttatattgttaaatatagtcataataaaaactatccagaatagagtgtcctggtttatttttaagtaatcacataatgtatgccttttaacagcaaagaaaaaaaaatccatcccattggctttctgactaaagttccccttattccattaacagacttatatagtcatgttgagttccccaaacattaccattaccccctgtagtggaaaaggaaaaaagccaagttaaacagttggacacttgaggaattgttggtttggaacacataaaaatcaacttctgaattgcagtttctttattatttgacaaaagaacacgctggcctttaaagtattctgaacattgcactgcgtacagagaaagtgagttttacagtcaccattggactgctcatagaggccagatttttgaggtgctgggggaaataattagcaccctccagggatggactatgggatagtaatagagaaatcaaaagccatacaaaggaattggaagatataaaagtcagacagttttaagaagatttttaaacataacagtgaatgaaaaagacaataacaggaggaagacagaaatctaatatttttatttgatacttgggccagacatcgtggtaggcactttccaaatgtcaccttatttaattttcacaaccatgtgatgacatggagcaatacattgaagcaaaggatattaactaacataaccatttcttatagtcagtgatgacagaaagctatctagtagacttttgaagcaaatcaaatcagaaaaagattttggagagattttgcacagataatcaattgcccaatgggttattcttgcccactccccaaagagagctcatttatcaaggcaggggaattacaattgtgaaagagttttacacaaatagggccagctaaatgggagattggagttttattattattcaaattagcctccccaagaacttggaggctagggtttttcaaacaaagtttaggagatgagaggaggggtggctaggcaaggggtgcttgctgctgactggtagacggtacaatcacaggggtgtgggaaaaggtcctcttgcaagctaagtcacttctgggtggggccacaggagtggttggtgggtccaagtgtggctattagacttttagtataagaagtaacattagaggctgagtgtggtagctcacacgtgtaatcccagcacttagggaggcagatgtgggtggatcacaaagtcaggagttcgaaaccagcctggccaatatggtgaaaccccgtctctagtaaaaatacaaaaatgagccaggagtggtggtgcaagcctgtagtcccagctactcaggaggctgaggcaggagaatcgcttgaacctaggaggtggaggttgcagtgagcggagatcatgccactgcactccagcctgggtgacagagcgagactccatctcaggaaaaaaaaaaaaagaagaagaagaagtaacgtgagaaataaaaccagaagtcagaattcaaacttattcacactgtcaatacagtgttacagacaaaatgcttacaaatagaatctggtatgatttcattatctaagataacatatggaagttatgtgttttttaaagtgttgatttgaaggtataatctaaaacattccaaacatcaagtcatgaaagcagtttttatctgttttgtaaaaaaaaaatatatatatatatatatagtctatacaccaaaaattataatatattcatttaaatttctttgacatcaataatactttttcttatatatttatttaacatactttaacaaattgaagacattttttgttataagtatgactgcatattacatttaattaactttattgcattaaatactatcctgatatgaaataaaatacttggtttataatgtcttcttatagcccaaactgaaagcttgaaattaattagaaatttctataactgttcattagattttatatcactatggaagaatttagcaagttaaaaaaaatacacagacaaaacaaaaacaacaaaaacagagggtgagaaatgctggattggaggctctccaaggccttcctattctgaaatgccatcatgtgcagattctcatctttcctacacccactaactgaaggcattgacagaaagaaatgaaaaagggaagatatgtaattaccctggtggatcgattcactcataaggtataaatcaaaaggaaatgcctggattatttttaagaaaatctgtgtactccaaactgcagatgaaccttcttgaacaaaacaatataatacaacaaaatgctaagctcattagttatgcataaatactagttcttaaaacaattttaactatcagaactttaaatttgccagagatcaacatgttctgccaatgttggctagttaacaaagttaatatgtttagcatctagtaaatccgaaatggcataaaatgactgatgtatgaattgagtatgacccctggtcttcctctggattgaaattcctcttgcattttcgagaaattagtaaagtgtgctaggtaagtaattaatgcactttggtgtgagaatttggaaaattattgaaaaatatattaaagggttgaattctgcattatctcaaattagctaatctagttttttggcacaaaataagcagcctgctttgtacacatttggaaggttttaaaaacaaatcaatatagccatacactcaggactatgctaaacagagctgctgatacccgcagtgctcctccacagtgggcccattgtggagagctgccacattcaaaacaccttccagctgttggaggaaaccacaagaggggtgaggacagacgcagacaccctccatcagataattaccttgattaagattctctgaattaaacggagtttaatcaaggaccctgtgaaattgtgaaaacgccagctttctgtgcttgccctccttttctacagatggtgagttgccaaacaaaatcaaaggagtcttaattacaaggatgagaggcaaagtcaaagggaatgaatctgtgctttgtgatggagatggaccagcaccaatcagcagcaaactcagctctcgtctgcatggagagtgcgacaatgcatcaaagctgaacacactatcaacatccttgacaattcaaaggactgaattaatagccatgacaatgtatctaaggtagtagttaacattgactcttcatatgatataataatatatgtgaccttttatggcaacatttggactgacattagaaaaaacaaccatgccacttcagctgttactaagaaagcatggcccagtttgaatctaaactaaaccattactgaaagtaaactcccttttaaatgaaaaaattaaaagagcaatgacacagggaggtcaatttttttttcagtttttctgcttcctcttattttgaatttggactataaatagaagtaattataaaaatcatccattccatgacatgagttgataccacctagcatctactcactgcaacactaatatcctttacatgcatactatcagactttctccactgtattatatgtctgatctttttgacatccaacaccttttacttctttcttaagtttttatttatttaagttcatatttatttctattagttttttaaataaaacttggtccattattacaagtaacgtcaatgaattatcacctagtagtgctaattaattgggtggaaccaccacttcaaaaggagtggaatattataaaaatcattgtatcccctcccctaatcatacttacaatcatatatcttctaacataaatgtcatgtattttgtaatgttttctaaattaaacatatatctagcttctctgatattacaagtcacaaatgcaagtggttcatggaaaatctgtttccctgtaagttttcctcttttcaaaggaaatctacaatttctatttctaggagcttgcatttttaaattattttgtttagcccttcaaagatttcctttcaactattatttatatatccccttccctttgagatctaaaagtttattttgtctttttctcaggttctgtaccatcgcccttctgtattctgaaatcttatgagtgatagattcttatatcttgggcatcttattcttgtgatttatttttacatgcatatatcttgtttttcctgcaagcccatctctacacagcatttttgcaattcttacttattcttagtttgctttccttcaatcttttcttcttatataatttgctatcatattttcccaaaattccttttgaagtaacttcttacagtattttcttaatattagcaagaaagagaccttcctctaatcatacaaacatgttacatgtttgactgggtcttttccacaccttgaaagatgcaccaattgagtgatttgtttcctcttctgcatactgaataccataagcacttttcatcacactttaaacaagagctatgtatccttttattacacactcaaattttcccaactgcatattaaatccagcacaatgcatacaatatatcaacatatgagaagtagcatgacatcagtttagaagtaaagaaacatacattttagcactaattcaatcactaattttctttggacaatttaattgtccagactttggacaatttaataagttactatgaatcagtttttgttttggtttggtttggcttggtttcatattcactaaggaacacagttactataatttggatacggtttgtttgtcctttccaaatctcatgttcatatttgatccctgatgttggaggtggggtctaacgggaggtgtttgggttttgacatgatgttatccgaaaccagtcaagtaaaacgattgatttgttataacacttggattttaagtgaatatgtcatccaatgtagccttcaaaattactttcaaaaaaataagccttctaactttccctctacaattagctccaaagaaaagggatattaataaattttaaaactgtttaaaaatttgcacatatctttttaaatgttgctctctgtttaattttttacaacttgaattttatgaaaatctattagggattaatttttaaaaccttccttttatttacttttaaactggatgggaaaccataggaaatacaactgcactcttattaaaaactaaagctgaccatatcaagtattaccaaacatgtgaggaactgaaattctcattcactgctggtgggaatgtaaaatggtaaccactttggaaaacagtttgacagtttcttacagaattaaacatgtgcctgacatatgatccagccacctactcctacatattaactcaagacaaagcctatgtccacttaaagacttgtcattaatgttcataatagtttcatttgtaatagcccaaaacggaaaacccaaatgtccatcaagaggttaactcataacagatgaatgctaaaaacactgatatatatcatacaatggaacacaactcagcaatacaaagaaatgaactactcatacatgtggcaacattctgaatctcaaaataattatgctgagtaaaaaacccagacaaaacccagacaacaaaatccatactgtataacgtcgtttaaattgttatagaaaatacaaactattctatcataagagagagtagaacgctggttgcctgggaagggccatgtggtggtgttccaggtagttatacaggcatgagcagagcaggagagggctctcccacccactaggaatgtcaggtgatggcttggcaattatcacaatgcctcactaaaagtgataagttggcagccagcaccagggataggccatttcctgatggttcacacctgttgcactgaagtgttaattgaatgcaggcaacagggagaaacaacttcctgggcatgcccattaagagacaacatggcagagtatgactttctgggggaactccacaggaaaaaggaagaaagcctccgatgggaatgcatacaacttcctaaacacactgcatgtgctcacttcccaggggtagcaggggcactgcacacgtgggcagcccaccctaaggaaagaatcgtgggaaaggggccagcctataaaagtcttaggatcgctgttaaacagcacacttggccttcaggtgcctacttgagtctcttccaagtgaactttcctttctttcctgttctaaagcctttctaaataaacttttactcctactctgaaacttgccttggtctctttttctgccttatgcccatgagttgaattatttcttctgaggaggcaagaactgacgctgctacagacccttacagatttgccaccataaacactgatatttgccactggtaacagaggtttaggaagttgtatgcattcccatctgaggctttcttccctttttcctgtggagttcccccagaaagtcatttgcccctggtaacagaggtacaaaagtgagcaagggaaaccttgtgggtggtgagctatgttcatcattatcttgattgtgttaatggtgctcatacgtcaaaatatgtcacactgtacactttaaatatatgcactttactgtatatcagttacatattaataaaactgttaaagaactggaagtgaagaaacgttattccacttaacagttggaaaataaaatttaacttatgtatggatgtcatagtctgagatagaaaaggcaattttgtcttcatgacttttattggattttgcaaaatattctaaggtgaataaaattagaatcatgatatctgcttcaataatcacattaatttttttttttttcagagagatacagggtttcactctgttgccctggctacctggagtacagtgttgcaatcactcctccctgccgtctcaacctccaggacttaagtcaccctcctgcctcagcctcctgagaagctgagactacaggtacgcaccacaccaccatgtctcagctaattttgtgtgtgtgtgtgtgtgtgtgtgtgtgtgtgtggacatggggtctcaaactcctggtctcaagctatcctcctgcctcacttctcagtgttgggattacaggtgtgagccaccctacccagccctaatcaccatttttttgaaggtaaacaaacattcctttctgaccaaagtggtcatgggcacaacacaagctgagaacactcaaaccagtcagtatagaacgggtccccacagaggtcagcactgggagtccattatcaggaaataaggaggaaacaagaatcagtaaagcaaagtggctgggagcattatgtctccagcagcatggtgtgttcagcaagatatcctaggtttcaattctagcactgtcactcacttgcactataacttggcagattaggaaactacttcaatattcagttagcttatctgtaaagcggggatgataagagtacctagcacacagagccgtaatgaggaataaacaaactaacatgtgtaaaacacttaggtatttagcactataaaatgctagctattattggtagttcagggaacctgattagcaggctatgaaactatcagttaactctacactagatttgaaatctaaaattttaggaattgttaaatgtaaatattgaactctccttcagatttgtatgctaattagttaaaaattatttttggctgggcgtggtggctcacacctataattccagcactttgggaggctgaggtgggtggatcatttgagctcaggagttcaagaccagcctgagcaatacgatgagacctcgtctcttcaaaaaattaaaaaagaaaaaatagccctgcatgaaggcgtgcgcctgcagtcccagctactagggaggctgaggtaggagtatctcctgagcccagggaggtcaaagctacagtgagctgtgatcacaccactgtactccaacctgtgacagagcaagacccagtctaaaaaaaaaaaaaaaactttactcttatctaaaaaaaatactgttttgaaagatgttgcacttaatatttatttgaggtacttcttcttttgaatttatacatctgtgttatatccatctctattgccatcttctcccaacctctgagtgttggagtttctggggccaatttaatattactgagagtttaggtagttttgcagagcatatgaaccatatcccaaaggcaagctttcgaaagcaccatagaacaaaatcatgaacaacatactaagccaatcataattctgattaattggtactttggacaaggaaagaaacatatcttgagtttaaattataaaagtaattactaaaacagacaagtttagttggcctaagtatgtgtgctgataaaccttaataaatcagactccttcaattctttctctacttcttgattttcaattaaataattctaggagctctgtttcttgattttatactctcatggaaccatgacataaagtaattcagtgcagataagaaactaggtttaaagtaacttatatataaaactgttcacaaaaccaacaactatataaaataaggtttgtatttttccccaaactcttaaatttactcagttaacacctagtgataaatgtacttataaatgtactgttacaaaaagttactataagattatcatttccctagtatatatattaggatctgttgacttttagtggaaaaaaaatctcaataaaaggaaagttagtatatgtgtgtacttggaatgaaactgcaaatgaaacagggaagttatcagtttcatttccatgatccctaaaacagtttctggaacattaaatagagcccttgaaaatatttgcataaaaaataaatagtcaagaatcaaagaaactttggggaccatcaactccctattttctctcctgatcttatactgtctttatatttctctttccccaaattggtctatccccacaacactttccaattcaagattccagaaagtaatcatctggctgctttagcatcactcttcactcttactaaactccacagctactagtcaacctactaacggggtctactcttaaattaagtatctactccttgttcaaattacaagcagttctagtgaaagaacagcctagtggtactatccggagtggagcattgtaagtggagcaatacattcttagaattaatagccacacttgagcttagtgcaccagtacctgaaaagagaagacagacctatctggcaagttgcagggagtttatgacattgagtccctgatataatcaatgtacctttgaacaccaagagaaaacatggtatgatacttgctaaagaaaactgcaagaatgagagtgggaaggaagagtgtaacaataactatctaaatgacatcaaccaaaaaaatcataatgtatgcaagtcagattgtcaaatgattttaaccactcactttaactttgtcaaattttggctactgacagagtagctaatatttttaccataattttttgactttttcatataaacactttgaacaaatgatctgttctttaaaatatttttacatggaattattcaaggtattcactattactatgttcgaaaatgtgatgttgatcgtatcctggatcttttcttgagatgacatctctagaagtacaaggggagaataggtttatgttgtcagtttacaaaatttttatttttccctgggacaaattataccatagcaaagttacataatcttctaaaaatgcttaacaaactagggagagtatataatcacagagaaaaaaaaatgacccttaaacatacacaaatgttaaatcatgtaattctaaaactttcaactcaaaaatgactagtgaccttatgtgttatgtagcccaatcctttaatcacataataggaaggagcttcaaaaatattaatgagtgctctttcagcaactgataaaataaatagagaaaaatattatagaaaacatcatcaacaatcttgacctaatttttatctatagaaagctacatataacatgtatagaatatacattacttttcaaggatatgtggtaatattcaccataataaacagtgtgctaagcaattaaaacacttacacataaatttaaaagacagaaataacacagtgcgtgttcactgatcacagtgaaattaaattagctaaaacaataatatagctatggaaattcaagatatttgaaaattaatacatttttaaataattcacaaggttaagaaagaaatcttaagataaattgaataatatttccaaatataatgatgatgaatccataacatataaaaatttggtggttgcagctaaagcagtacttacagaaaaattaaaaaggtttaaagtcaagagaaaagtagtctaaagtcaaatgcctatgaatatacttaaagatgtaaaaatatgtgcaaagaaaataatagaaaaaatttgtaaaagatgaataagaggaaaaaataataaatataaaattttgttatttaaaaagtaaacaaaattcatacagtacattctaaattgattaatatgagaactggctcacccaacctactgccactactactaaggcccgagcctacaattcaggatcctagggattgatctgccttgccgatcacagctgggtgcccacatgcaccatcagggagtatcaggacagactcacccaactgtagcctctgctgtcagtacccagtttactatctgggggcctgggaattgaaccaccctaatcactggtaccagcactcacacacaccatttagggtcctgaggacaggcctacctctcccaccactgctactgcgagggctcatttatgtcatctggcggcatatggatcaacctgccccatctgccactgccaacacctgcacttgccttctaacggcctaaggaggggcatgcttcactctccactgttgttcttgtgcactatctgtaggcctgggaataagcccactctgcctactggcagcacaagcacacaattcctggagtcccaggaactggcccacctagcttgtctccactgccaccactgacattggggagcctgagaactgacccacaaagtttaccaccaccaccatcacacttgtgtgtgtcacttggggtcctgagaattggcccactgccactactatcactgcaaatgccatgcacactgctgagggactgcaggacttactcacttaccccactcaccactactactgccggtaccagagcaagccacctggaggcacaaaaaccaccccactaggacccactaccaccagctgctgttactagacgactgaggaactggcaaggttgacctctgatggccataactattctacatgtcatcttcatccccagcaaagccttatcacagccaccaccaacaactgcagtctaagccactgaagagctcacagacaccaatggcactaattacagctgaagaaataggaagactacactactgctcccacccagaatcaaatccaaagtaccatactcacccaatactatagataaaatctatagataaatgtctttccctatgaaagccagtccttaaaatgggaagaagcgactgtacacaagctgcatacatatcaatctaaggacataaacatgaaaaatcaattaaattgacaattccaagggaacacaataattctccagtgaaaagtcttaatgaaaagaaaatctatgaaatgcatgaaaaagaattcaaaataatcttaaagaaactcagtgagatacaagaaaacagataaaaatataaagaaattagaaaaacaattcatgatttgaatgagaaagttcaacaaagaaatatatctaataaaatagaaccacatcctggaaatgattaatttaattaatggaatttaaaaatacaatcaatagcttcaacaatataatagatcaagcagatgaaacatttctgaacttgaagacaagttgtttttaaataaccccattagaacaaaagaaaaaaaaagaacaagtaaagtctacatgacatataggacaccacaaagtgacaaaatattctaatttggggagtgccaggataaaaagagatgggcaaaggcatataaaacctatttaacaaaataatagcaaatgtaataccaagtgttgcaagagaaacagacatcagacacagaaaactcaagtatccccaaatagattctacccaagaagatcttctccaaggtacaccatagtcaaaatatcaaatttcaaagacaaagaggtaattctaaaaacaacatgagaaaagcatcaaattacatataaggaaacctccatcagacgaatggaggatttctcagcaaaaacattacagagcaggagagaatgggatgatatattcaaagtgctgaaagaaaaacaaacaaaaaaactattagccaagaatactaaacccagcaaagctatttttccaaaatgaagaagaaatgaaggattttccagacaagcaaaaattgaagaaatctatcactgctagactgaccccacaagaaattcttaagtgagccctacatctagaagcaagcagatgatgtccgccatcatgaaaacacacaaaagtaaaatactcattggtagaacaaaaacaagtgagaaagagaaaggactcaaatgttactattacagaaaactaccagctgcaatgaaaacaataagaagggaagaaagaaacaaaaggtacacacaacagccagaaaacaattaacaaaatgagaagaataaatcctcacctataataagcttgagtgtaaaaacattgtttctcacttaaaagatttaaaattgttgaatggataaacacaacatgacacaactatatgctacctacaagatattcacttcacctgtaaagacacatagagactaaaagtgaagagatggaaagatactccacacaaatggaaacctaaagagaacaaaggtagctatacttatatcagataaaacacaattttagtcaaaaaatcttagaagagaaataatgttattatataataataaagggataaacttagcaaaggtataacaattctaattatatatgcacccaacactgaagcactcagatatggaagttgggtactattaaatttaaagggagagacagacttccaataaaatagcagatgggactttaatatcacactatcagcactgaatagatcatatagacagaaaactaataaagtaacactggatttaagctaaacttttgactaaatggacctaatagatatttacagaacatttcatccaacagctgcagaatacacattcttctcattggcaaatgaaacattctccaggacagaacatatgtcaggacacaaaagaagtctcgacaaattttgaaaaatttaaattacatcaagtatcttcttagattacaatggaataaaatttaaatcaataacaagagaaactttgaaaaccatacgagtacacagaaattaaacagtatgctcctgaacaaacactgagtcaatgaagaaatcaagaagggaatacaaaaattcctgaggcaaatgaaaatggaaatgtaacacagcaaacatgtggatacagcaaaagcagtactaagagggaagtttatagcaataactgtctacattaaaaaattagaaagattttaagtaaacaacctaatgatgacttcaaggaactacaaaagcaagaacaaaccaaactcaccattagtagaaggaaagaaataacaaagttgagagcagaactaaacagatagagactaagtaacaatacagaggataaacaaaacaaaagacagaagatctaaataaataaaattagaaatgaagaagagacattacaaatgataccacagaaatacaaagaataactagagactgtgataaataattacacactaacaaattggaaaacccagaggaaatggaaaatttggggcacaaacaacataccagggaataaatagaaaacctgaacaaaccaataatgagaaattagattgaatcagtaataaaaatctctcaacaaagaaaagcccatgactagatgactttaccacaaaattctaccaaacttacaaaatactaacattaattcttctcaaactattgcaaaaaaatgaagatgagggaatgcttcctcactccttctacaataccagcattaccctgatacccaaccagagcaatgacacaagaaagaaaaccacaatccaatatccttgatgaacataaatgcaaaaatcctcaacaaaatactggcaaaccaaatttaacaacacatcaaaaggataacacaacatgatcaaatgggatttatcccagggatgcaaggatggcttaacatttgcaagtcactaaacatgatatatcacatcaacagaatgaaggagaaaacccacatgatcatctaaacagacagaaaaagcatttgataaaattcagtaactcgtcatgataaaaactctcaaaaacttaggcatagaaagaacatacttcaacatagtcaaggccgtgtatgacaaacccacaactaccatcacaaggaaatggggagaagttgaaagactttcctctaagaactagaacaaagcaaaaatgcccacttccagccctctagaattgaacttagtactgaaagtcttaaccagagcaatcaggcaagagaaagaaatagaaggcatcaaaatttgaaaaaaggaagtcagatgttctctgtatacaacattaccctaaatatagaaaaacctacactcaaccaaaaatttcttagaactgataaatgaattcagtaaagttgcagaatgtaattaaaaagtgggcaaaagatctgaattgacatttcttaagagaagacacaaatggctaccaagtatataaaaaatgtgcaacataactaatcatcagggaaatcaaatcaaaaccacaatgagatatcatctcatcctagttagaatggctattgtcagaaagtcaaaaaaaaaataacaactgctggcaagaatgaggagaaaaaaataactcctacatactgttgatggaaatgtaaattaggagagctattagggacaacaatttggagatttctcaaaaaactaaaaataggactaccacacaatccagcaattccactactagatgtatatcaagaggaaaggaaatctgtttatcagtaagatacctactctcccatgtttattgtagcactattcacaagagccaaaatattgaatcaacctgtgtccatcaaaggacaaatggataaagaaattgtggtacatataattaagagaatatcattcagccacaaaaaagaatgaaatcttgtcatgcgcagcaacattatgttaaatgaaatcagccaggcacagaaagacaaatattgcacattcctatttatatgtgaaagctataaaatttatttcaaggaggtagagaacataatcattgttaccagaggcttgaggcagtagggccaggagggagaaggggtgtgaagagtggctgattaatgggtacaaacatacagttagatagaagaaataagttccagtgttcgatagcacagtagggtgactatagttaacaataatttgttgtatatttcaaaatatttagaagagaaaattggaatgttccaaacacaaagaaatgataaatgtttgaggtgatggatatcctaaatagctttatttaaccattacatgttataggcatgtgttaaaatatcacatgtatcccataaatatgtgtaattattctgtatcaataacaaatataaaaaattaattaacaggctgggtgcagtggctcatgcctgtaatcccagcactttgggaggcagtggtgggcagaacacttgatgtcaggagttcgagaccagcctggccaatatggtgaaaccccatctctactgaaaatacaagaattatccaggcatgatgacaggtgcctgtaatcccagctactcagggagctgaggcagaactgcttaaaccccagaggtggaggctgcagtgagcccagattgcaccactgcactccagcctaggtaatagagcgagacctcgactccaagaaaattgattaataaaagagaagctaaattattgatattaatacaagagggactgtcattaaagatcttatagatattaaatggatactaacagagtattgctaacaattcttatgacaaaaaaatctaacaacttagatgaattggacatatttacttaaaaatacagcataccagaagacaaaacacaaaatctgaacaccagtatcaatgaaagaaattaaatctgtgatttaaaaaccttcccataaagaaaactccagacacagatggtttctctaaataacaccaatcctacataaatttcttcagaaaagaaagaattatttttttccctctcagttaaagtgaattgttgtgtcatagggtaggcatatgtttagtttcataacaaaatgccagaacatttcccagagtggttgtactgttttacagcatgtatgtatgagaaaatgctgatttccccaagtctttacttgaagcatggaaagctgtgagaaactcacgctatgcaatgagtgtccaagatctcaggcttcatttgagtattatcattcattcatgtgcctatccataaacccatctatcccttcaacaaacataaagaattttctggtgagaacacaattctaagaataaagtgacaagtagatacagtgttggccttcagaagcttacagtactagtaaagaaaggacacatctataaacaaatgaaacttagaatttcaggtgctattttaaaagttctgtcttcagtggatgtcatgcttttggaatgctaaaggaataacttcacttacaattattagaatttaagagtcagaacaacgttaaaaagtcagcaggaattacagcaaagtcagtaccacagtattttacagaacctctggaaacacctgcatttaccacaccattcacgtagtgatctcggcaccccaaaacacaattaggtgacctgaccatattttcttgtactcacaaggtttgaatgaccttgaaaaccatagagacttcaacattattttaggcaaaggtgtcaatatgagtaaaaggttataaatatgattgatcatcattcatttaaaaacataactaatggcttagaatgagtagatcacaatttgtaaggtgtggtgagaaatggggatggggaagggatgaattcaggaagatattagtgtacttttcttggaggcatggaatttaccatgtgaacaactaagaaccattgaatgtggtggtaaattgaagaagaatattaaaatatttgcattttagaaagattattatttgcattgtggagaacagtttgaagaggtatacaactggcagtaaaatgtatttgattattacaagaatagagaactgatatgtgcatgaacttaaatatctcagtcacagagggctacaggagacagataagagaaaaattaagaatgtataatggaaaagaccggtaataataatattatggtatacagtaataataatagtaatatttctatagaaaagacttatgtaatgctaattgatgctatatgcttatattataaaacaaaatatttattaattacaacataatttaaagtactaagttaacaagctatattgagaaatattaacaaagttatgtgattttgttacatgagtacaataacttatataaaatttattatgtaccagataacttacattattttttctagctgtggagaccagtgtagactggtaccaccaatgagtgagaaaaggtaataactacccaagttccatatttttgtagaattcttactgtgtgccaagtagtgttttgttctatacagttcacaatcattattatttatatttttcacacctacccttagatatgagagaattgggactcaaagacattacataattataccttcaatagattatgcaactagcaaatgaaaaagacagaattctgacccatgattccaaagtcctgtacatgaaggaaagatagtgattgcaagttaaaatatgtgggatagctacatgttatccagagtaaaggccttctattttggacctcagaaagcattacagtatttgggaatatcagcatctgtgtagtcactaaagccatatcaatttgtgacttgctcctcactgtatagacagaatcaatgtcattctattcttaggaaataaaaacaatcattaataaataacaataaataaaaataatcaatctcatgagaggcatatgaaagctctccagagtcagcatgccaatgattcaagttcacctctaacctctccagtagtagaattcagctgagagtcaagaatttcatggtacacaagtttggttttgttgcagagggaagaaaaagggatgatgtcagaagagaaggaagattctgagtatgccatggggtaatatcatttgaaatattttgtgaattctgctctgaaattgatatcaaagctcaaaacaaatgagaatttgttttgaaaattctcatttgttttgagctttattatttcttcctattttaatgggaacactgagaaatccagctgctacctccctggtataggtgctggcaggagatgacagctggtgcagcaaccctggccagaaccagatcccacagtgtactgactgacaatggatccatgcatccattcagtgaggaccggagcatcaaaagagggaacgtggacactgctctgtgactaaaggaccattgattgctgtgggtaggcaagtgtccatgacatcttccaacaggctcagaggaaaatgaggcttagagtctgtatgaacatggcatgaagaacaggagattacttcttcttctcattatcccatgcacctgactgaattcccctgtctgctgtggcatgagaaaacacactactaattgttcattttttctgttaccaagcaatttttctgagctctgcctctccaattctattcagtcattctaaaattcgctccaggaatcttaagcatctagtttaaaatcaggattcctttttatagaggatgtacagtaagttctagatttatagggcaatgttttactagtgtaagccacaagttaatattttcaaaattacattttttgttatattttaatgctcaggatggtctattatctcgctatcctctttgtatttaaaaaataataaaggtaaacatataaatgattagatgttatatatgctcggagaagtatataataaaaagttaaagcctctgcaatccctacctatgagtcgcttaccacaaagggaaccactattaacagttgtttgtgtctaagcccaggaacagcttccatgcctacagctgcattcatatatccattttaaagcatataaataataattctataatcactcttatatatcatacttttcatttaatcatgcatctgaaatgtttaattcaagccaacatatacatatctgtatggttttagcagtgtctgtatcatgtagatgtatgtaatgcacttagtaagtgcctagattatagcaacttaccacaattatatttgatcttacaaagacagctataatcacaacagtgtacttatatcttggtgcattttataatatatttcaactttggtaagtgatacggtttggttccgtatccccacccaaatctcatgttgagttgtaatccccagtgttgggggagggacttgatgggaggtaactggatcatgggggtggatgcccccttgcattctcataatagtcagtgagttctcacaagatctggttatttgaagcagctcttccctcattcactgtctctcctgctgatcatgtgaagatgtgcttgcttcccctttgccttctgtcacgattgtaagtttcctaaggcctccccagccatgctttctatacagcctgcagaaccatgagccaattaaaccattttctttataagttactaagtctcaggtagttctttatagcaatgtgagaatgaactaatagagtaagtattgcagaatttcatcctagaatagatttcaagttccactttcaccaacaatgcatgaaaggcttttgttcttctacagaactgatgttattaacctataaaacttttgtttaaaagtggttggcaagatggccaaataggactccagtctgtagctcccagtgagataaatgcagaaggtgggtgatttctgcatttccaactgaggtacccagttcatctcactgggactggttagacagtgggagcagcccacaaagggtgagccgaagcagggtggggtgtcacctcacccgggaagtgcaaggggtcagggaaatccctcctctagccaagggaagccatgatggactgtgccatgaggaatgatgcattccggcccaaatactaagcttttcccacactctttgcaacctgcagaccaggagattccctcgggtgcctacaccaaaagggccctgggtttcaagcacaaaactgggcagccatttaggcagacactgatctagctgcaggagttttttttcataccccggtggtgcctggaatgccagcaagacagaccattccctcccctggaaagggggctgaagccagggagccaagtggtctagttcagcatatcacaccccagtggagcccagcaagctaagatccactggcttaaagctctcactgccagcacagcagtctgaagtcaacctgggatactcgagtttggtggggggatggggggcatctgccattactgaggcttgagtaggtgggttttcccgtcacagtgtaaacaaagaccctgggaagttcaaactgggcagagcccaccacagctcagcaaagccactgaagctagactgcctctctagattcctcctctctgggcaaggcatctctgaaagaaaggcagcagctgcagtcaggggcttatagctaaaactctcatctccctgggacagagcacctgggggaaggggtggctatgggggcggcttcagcagacttaaacgttcctgcctgccagctctgaagagagcagcagatctcccagcacagcactcgagctctgctaagggaaagactgcctcctcaagtggatctctgaccccagtgcctcctgactgggagacacctcccagcagaagtcaacagacacttcatacagaagagctctggctggtatctggcaggtgcacctctgggacaaagattccagaggaaggaacaagcatcagtctttgctgttctgcagcctctgctggtgatacccaggcaaacagggtctggagtggacccccagcaaactccaacagacctgcagcagagggtcctgactattagaaggaaaactaacaaacagaaaggaacagcatcaacatcaccaaaaaggacatccacacaataaacccatccaaaggtcaccaccatcaaagaccaaaggtagataaatccacaaagatggggaaaaagcagcacaaaaacgctgaaaattccaaaacccagaatgcttcttctcctccaaaggatcacaactcctcgccagcaagggaataaaactggatggagaatgagtttgaggaattgacagaagtaggcttcagaaggtggataataacaaactcctccaagctaaagaagaatgttctaacccaatgcaagatatctaagaaccttgatagaagggtagaggaatggctaattagaataaccagtttagagaagaacataaatgacctgatggagctgaaaaacacagcatgagaacttcgggaagcatacacaagtatgaatagccaaatcaatcaagcagaagaaattatatcagagattgaagatcaacttaatgaaataaagcatgaagataagattagagaaaaaagaatgaaaaggaatgaacagagcctccaagaaacatgggaatgtgtgaaaagaccaaacctacgtttgattggcgtacctgaaagtgacggggagtatggaaccaagatggaaaacactcttcaggatattatccaggagaacttccccaacctagcaagaaaggccaacactcaaattcaggaaatacagagaccaccaccaagatactcctagagaagagcaaccccaatacacataatcgtcagattcaccaatgttgaaatgaaggaaaaaatgttaagggcagcaccacgtcacacttattctaaaatcgaccacataattggaagtaaaacactcctcagcaaatgcaaaagaatggaatttataacaaactccctctcagacaacagtgcaatcaaattagtactcagtattaagaaactcacttaaaaccacacaaccacatggcaactgaacaacctgctcctgaatgactactgggtaaatagcaaaattaaagcagaaataaataagttctttgaaaccaatgaaaacaaagacacaacgtatcagaatctctgggacacaggtaacacagtgtttagagggaaatttatagcactaaatgcccacaggagaaagcaggaaagatctaaaatcgacaccctaacatcgcaatttaaagaactagagaagcaagagcaaacaaattcaaaagctagcagaaggcaagaaataacttagagcagaactgaaggagatagacacatgaaaatcccttcaaaacatcaatgaatccaggagatggtttttcgagaagatcaacaaaatagaccgctggtcagacaaataaagaagaaagtgagaagaatcaaatagacacaacaaaaaatgataaaggggatatcaccagtgatcccacagaaatacaaactgccatcagggaatattataaacacctctactcaaataaagtagaaaatctagaaaaaatggataaattcctggacacatacaccctcccaagactaaaccagtaagaagtcgaatccctgaatagaccaataacaagttgtgaaactgaggcagtaattaacagcataccaaccaaaaaaaggtcaggaccagagggatgcaaagctgaattctacctgaggtacaaaaaggagctagtaccattccttctgaaacaattccaaacaataggaacagagggacttctctgtaattaatttgatgaggccagcattatcctgataccagaacctggcagatacacaacaacaaaagaaaatttcaggccaatacctctaatgaacattgaagcgaaaatcctcaataaaatactggcaaaccaaatccagctgcacatcaaaaagcttgtccaccacgatcaagatggcttcatccgtaggatgcaaggctgattcaacatatacaaatcaacaaacgtaatccatcacataaacagaaccagtgccaaaaaccatatgattatctcaatagatgcacaaaaggccttataaaattcaacaccccttcatgctaaaatctctcaacatactaggtattgatggaacgtatctcaaaataataacagttatttgtgacaaacccacagccaatatcatactgaatggacaaaagctggaagcattcccttggaaaactggcacaagacaaggatgccctctctcaccactcctgttcaacatgttattggaagttctggccagggcaatcaggcaagaaaaagaaataaagggtattcaaataggaagagaagaaatcaaattgtctctgtttgcagatgacatgattgtgtatttagaaaaccccatcatctcagtgcaaaatctccttaagctgataagcaacttcagcaaagtctcaggacacaaaatcaatgtgtaaaaatcacaagcatttctatacagcaataatagacaaacagagagccaaatcatgagtgaactcccattcacaattgctacaaagataataaaataccgagaaatacaacttacaagagatgtgaaggacctcttcaaagagaactacaaaccactgcccacggaaataagaaaggacacaaagaaatggaaaaacattccatgctcatggataggaaaaatcagtatgtgaaaatggccataatgccagaagtaatttatagattcaatgctatccccatcaagctaccaatgactttcatcatggaattagaagaaaagctactttaaatttcacatggaaccaaaaaagagcccatatagccaagacaatcctaagcaaaaagaacaaagctggaggcatcacgctatctgacttcaaactatactacaaggctatagtaaccaaaacagcatcgtactggtaccaaaacagatatatagaccaatggaacagaacagaggcctcagaaataatgccatacatctacaaccatctgatcttcgacaaaccagacaaaaacaagcaaaggggaaaagacaccctatttaataaatggtgttgggaaaactggctagccatatgcagaaaactgaaactgcacccctttcttacaccttacacaaaaatcaactcaagatggatcaaaaacttaaatctaagacctaaaaccgtaaaaaccctagaagaaaacctaggcaataccattcaggacataggcatggacaaacacttcatgactaaaacaccaaaagcaatggcaacaaaagccaaaattgacaaattggatctaattaaactaaagagcttctgcacagcaaagggaactatcatcagagtgaacaggcaacctagataatgggagaaaatttttgccatctatccatctggcaaagggctaatatccagaatctatgaaaacgtcaacaaatttagaagaaaaaaacaaacaaccccatcaaaaattgagcgaaggatatgaacagacacttctcaaaagaagacatttatgcagccaacaaacatatgaaaaaaaacttcatcatcactggtcattagagaaatgcaaatcaaaaccacaatgagataccatctcacaccagctagaatggcaatcattaggacatcaggaaacaacagattctggagattatgtggagaaataggaatgcttttacactgttggtgggagtgtaaattggttcaaccattgtggaagacagtgcggctattcctcaagcatctagaaccagaaataccatttgacccagcaatcccattactggatacatacccaaaggattataaatcattctactataaagaaacatgcacatgtatatttattgcagcactgttcacaatagcaaagacttggaaccaaccaaaatgcccatcagtgatagactggataaagaaaatgtggcacatatacaccatggaatactatgcagccataaaaaaggatgagttcatatcctttgcggggaagtgaatgaagctggaaactatcattctcagcaaactaacaccggaacagaaaaccaaacaccactttcatgtcctttgcagggacacggatgaagctggaaaccattattctcagcaaattaacacaggaacagaaaaccaaacactgcatgttctcactcataagtaggagctgaacaatgagaacacatggacacagggaggggaacatcacacaacagggcctgtcagtgggtggggggttaggggagggatagcattaggagaaatacctaatgtattaggagaaatacctaatgtagatggtgggttgatgggtgcactaaaccaccatggcatgtgtatgcctatgtaacaaacctgcccattctgcaaatgtatcataaattaaagtataacaaaataaaatttaaaaaaggaacaagatcatgtaattagcaggaacatggatggagctggaagccattatcctcagcaaactaatgcaggaacacaaaaacaataccacaagttctcacttataagtgggagctgaatgataagaacatatgggggcaacaacacccactggggcttgctgggtcagtggggagggagagcatcaggaagaatatataatggacactgggcttaatacctaggtgatggattgatatgtgcagccaaccaccaggacacacctatgtaacaaacctgcacattctgcacatgtaccctggaacttaaaataaaagttaagaaaataaataaacaaacaaacaaataaaacgtttgtttacctgattcaaacattgctatgtggtaataaatggcagaaatgtgaggttttcaacattacaaaaattatactacaagacgagtgcatcacatttgttaatttcaaattatgattttgtattttagagattgtgttttccccagtaagatactggggcattttttaaatgagagacaaaaaaatcacttgagatcccttcacaattaaatgaaagaagacaagatttgctcctatcacaaattgtttattttctacatctctcttaacaaataagcatgaaattatataagacccccaactattgaattttctggaaaatcatatatttgtcttggaaaagaaaagtgacatggtcactaaggaaagctcaatgaatttacaaataagtaacacattttattacaccaatgaaaagcttcattgacacaaagcttttatattgattttaggaaataatttgtattgtacattttgacttttcctccagcatattcactggagaaaggaaagtcaaggagagagaagggttgtgggaatgagaagaacagggaaagatctaagagtgaggagaagggagacagagaaagagagaaactcactggtttgaaaatggcctattttcatttccttgtgggattccctctacttattaaaagaagtttctttctgacatagaagcttcatggtgaataatatcagtgtataacatttcttctgaattttgggttgattttgatgaagctgatcccagagtagactgggtccacatttgggggattatcagacgttggtcaacagaaaggaaaacattaaggtaggaatggatgataacagaatatactttaaacagctcagcttcaaagaattctcttccaacatgatcacatataacattaacaaagatttaatcaccactagctttgttttaaactctgaaggatattctagtgttgtgcagagggagcacagacacacatgctacctggtgtctatattaaataatgtttattgggtaaaaacttataagcagagaaatatcagaagacaactaatcccttaaatcacttattattccaaaaagagatgtgctaagttgagcaaagctaggtggtatgctttcccattgagggcgctcctgccctctaaaagcttcacatatttataagaaacaataggaaggaataaagtatgcaactagaaaacaatggaaaccctctagtcagtagcagatatggcgaaggttgcgggaagcttctagggaagggcctccagtactaagcttctagtgtcagcccagctcattctttacaaaactagcccaaagcagctaagcaaggtcttcactaagctctcacaggcagatgggggaatgagcttctggagtcatccaggtttgtctctactctgtgattttgcatattcttacactgaatgaaggccctaacgatataaattttactgctgtttcataatataaacgtgtgccttggatttggatatagtataagtacaactcaactttttgtttatccatttatttcaccgaatatttatttagtattttgaaatctgaactctgctacttttttgtatttatgaccttgagcaaattattgaacttcgctgaacctcagcttgctcattggtaaacgagagataacaattcctatctatttcctgtcaattcctatctataccattatacaatagtattgtttaatgaagaaataaaataagtcatttaaagtacccggtgaagtagctctttctttgttttgtaaggtagaagagaacaggaatttcctaagttggttatcttggatgaggaaggctatttaatactaaaagccttgcttaataaaattcttagttacaaaaggcatcttaaataaacacctctagtatcactttaagttattacttcctagtttttatttccctgtgcacaacctcgttaaaattcataaatcttacagtaggaggttgtttctgaatcacagccccatctcagagacaatgtgaaacaaatggtacaaagcacacttccaaaacaaacccaaatattttgtgtagccaaataaatacaaagcaattaattcttgttgaaggaaacagacccaagctgtacagaaaaagctgcatttgttgtgggtatttaagtactaagtgacagaaagttcataccatgtcagaactggatagtttaaatcattattttattgtggaaagcaagatcattttaaaagtctcaaaataactctttcttttactttcctaaaactaaactcaagcccaaatcaccccgggactttaatttatttgcttgtcgttcttggtaatttttaaaataataaggttaatgttcaagttcagaattagttcagcccatttcaattcatggacacatgttctaagcagaatgtaatgtgtacttagtattggttttagggaaacatgacatcaaattcctctttggatattctacaaagagcttttatttgaaagatagtgttttaagaatgtgtttgacctgaggcatgtctgaaatggaataatagtgacatgtgtcaaaatggtatattctgttacctaaaacatttccccatatctcccactggtaaaataatgatattttggctctgaaaagtaggtccactctggtgggaaaaggcagagtcataagatcatcacttctatattttctaaaatcttaaggtaccagaaaaaaatgccacatttttcccatttgagaactcaagttaaactgtcttgaaagataaaaaataagtgaaaactatatattttttaagatttggggcaaacatttaaaaactttgtattatagacttcaggaaagcacaacagtcaaacccttttatctttgtctctataggacaaaatgattatattttgattagccttccaccacccacgagcataatgggaatgtctgaattttgagctgctcttagaccatttgtcatcgttaggcaagctagtaagcctcagtttctccatctttacaccacagatttgaaatgaggatttaagatatgatcataaataatatgaccgtgacatagaagaacctcagcaaatgctttcactttgtaaaaaaaaattccaaagatggcatttgccctgagccaaacagattattttaaaaagggcaaataactgtgattctcttccccaattcaaatcgtaggttcctgaaatgcactgcaagatccattcagtttagacagttacggtcatctgttcaaatagctggtaattgcccccctttcctcactagttagcctaattggagtaacataatgttaacagattgacctttaaagtccaacactcatgagttcaaattatgactccaccactgaactgtcactcatttataagttacctatgctctctaaggcctagttttctcatctataaaatgagttaagcacctagcacaatgccttgtgtgctgtaagtactcaataaatgttatgttttctccaaagaaataattctttccaaagaaaaagtatcagctaatgtgtggagttaaaaaattcaaaccaaacaccgcatattctcactcataggtgggaactgaacaatgagaacacatggacacaggaaggggaacatcacactctggggactgttgtggggtcgggggaggggggagggatggcactgggagatatacctaatgctagatgacgagttagtaggtgcagcgcaccagcatggcacatgtatacatatgtaactaacctgcacattgtgcacatgtaccctaaaacttaaagtataataataattaaaaaaattcctgcatacagaataaaaaagtatttattacataaaaatcgattaacaaatttgaaaagaaccctcaaaccccctagtttcaaagaaaatatgttttcctctattatcgccgatgttacaacaaaatctaatttcatccttatgacacctagaaatatcagagtaggctactgtatttgtcacagtgaggttctcaagtttgatttctagctgtccgtcaaaatgccacctttaatcttattagttcatgtcactgaaatttgagatgaaccccataagttttattaaaaacagagtagagttgccatccaaagctaatgaataattgaatatatttttcatattagttcataagagtcataaataatgacatataacatctaattagtacatttttagacataaatgtttataagaatgatgtgatgaagtacattgatgaagtacattaaattataattattctttggttaaaagatttgcaatttaacccatatgacatctgtatcttgtaccttttagcttattctctaggtagctatctgtctgccaccaaaataacatatggtagaattaaacagacgtcattacttgtagaagagtcttcacattttgcaaaagtaaagcaactgtctaactcacagaaagttaaaataattctaagcctctctcccccaaaataaggtatgtgccaagtagaatataattctctcagaaaacaatcacctccaggaaatctcaagggaataagtttaataccttgttccaatctctgtacattgcttcagcataagatagcaagaaaattaaaagattggttttgtttacagaagacaccgcctttctttcaatacttttacatgaactcatctcattcttattcatggaagaacacccacacttctatgaatccaaagtaccaaagtcaatagaaatatccacatatccaaaataaggattttttttgtcaaagaggaaagagatgtgctaacagtattccaaacatcaaataactacatttttttaatttaacaatctttctttttctaaaataagtgaaaattcagtctccaaattaaaaaactaaaagcactacttttttcagaacctgctcaaactatccagaaatttagggaatctacacctcttcagatatcaagtgatatccgaatttacccaattaattataattggttaaataaaaagtaaaacaatattacaaaaacatttccaaggacaagtttttggcacatacaattttgacaagtgtttggaaaaactggtgctttcatataccgttggtcagtacataaattggtgtaggtgccttggaggacattttgacagtgtccatccaattagtaacttacaaacctttcaagtctgaatcttttctgtatttattccacaagtgtacatgttcatgtatgccaaaaatgtcagttgccatgtttctttgtaatagcaaaccaccggaagctctaggatgggctgctgccttgtgaaaaatgcatgagtgtaaatttggtggcttaagcagaggtaaatctggttaagctctcagtcaccaaaaggatctcagatgatgatgccccctgatttgggctagaaggcagtgagtcatacttctaacatctggtggaaggaaaaatgaaagtacaaaatgctaaaaataaataagttggtaagtgaattagcatttctttagcactaaaatggttaacaactctgtaaaatgcaagataacaggctaccatgaaaggatatttctatctttccttctcaagcttttatttttacaaatggtgattctaagcacccttcttcctatagatttatagggttttccctcagaaccaagatcatggaaattatcttaacaattaattgcaattaaatttaagagcaatttatctagttcacactaggctggtgcccacttgaatgcaagttcgtcaataaagtgtaacttccatgaaagccagattagctttcattttatattgcatccccagtacccagcacctaaaagacagagcaagtgacatataataggtagtcaaaatatatatttgcagaaaaatcagcagagtatatctaatggagttctccaattgtaaatatttcttaagtgaactccactgctcttcaaaataattttgtgtagcatgaacactggcctgtgttcacattcatatatttgctttaagaactttaaataatttatatagtccactgatttaaagaagtcctagaactactaaaaactgaaagaaccgccgtgaaactggaagtcagttttacatgacaatagtagtatgtgctgtccttctatagactaagtgtattagtctgttcttctgctgctttaaggacatactcgagactaggtaatttataaagcaaagaggtttaattgattcacatttctgcatggttggggaggcctcaggaaacttacaatcatgacagaagacacctcttcacaggatggtacaaaaaagaatgagagccaagcgaaggggaaagcctcttataaaaccatcagctctcatgagaactcactatcagggacaacagcatggggtaaaccaccctaatgattccatcatctccacgagtttccacccttgacacgtggggattattacaattcaaggtgagatttgcatagggacacagagccaaaccatatcactaagatggtggtgtttatggaaaaagcccaagaatattagtaaagaggattttgttatagaaatggctctactgttgattaattttgtaaacttaactttgccctttaatcctaggttttcatatttttatcagtaaaatcatgggagttgggttggggaatctctaaattctagttccacttgctttaaattatttgattctatgatttttgcatatagcaatgtctcaaatcttactaacaatagtggggttgctttacagaaaatatatgcccaggccgggcgtggtggctcacgcctgtaatcccagcactttgggaggccgaggcgggtggatcatgaggtcaggagatcgagaccatcctggctaacacagtgaaaccccgtctctactaaaaatacaaaaaattagccgggagcggtggcgggctcctgtagtcccagctacttgagaggctgaggcaggagaatggcgtgaacccaggaggcggagcttgcagtgagccaagatcgcgccactgcactccagcctgggtgacagagccagacgctgtctcaaaaaaaaaaaaaaaaaagaaaatatatgcccagatagaaactcaccaaaaaggataaatcaatctattgttattctcactcttgttctcttgtgtgagtacttccaaagataactggaaaaaaaaaattggcatatatgttcctctaaatgcaatatctcttccctctccccttatctctcactatttacattttcacagcctttcatttccaattcagaacttgttgctgaatacagcaaagagtaaaaatctcttttttacatggattattcatagatcacttgttaattgagcaatgaaacagatattcacatactgttataccatttattggcataaaaagacaatataaaaagaggttttcaaaatgtgacatttgacccaataattccactgattcacatatacatttatattattttgagattatttcagtattatagaagagttgcataaatatttcaaagaattcctgtatactcttcacctgctatccaaatgctaacattttacggcattgtcattctctcttttttactgtgtctgtttccatagatatgaaagcttttcattggagcataatttaagttagagaaaactggaagaaacctaaataacaagcatcaaggaaatggctccttcaattatggcatatacactgtatggaatattgaagaggaattaaaatgttttcagtgattattgtaaaattgaaggcaagatgcttattaggtaatactaattcaaacagttattaaaattttaaagtgattatgacaaagattatggtataatgtctattaaatattgccaagtgaaaactcagaataacatcagtgacacatataaacagattgatggcaaaaaaaaaaagatgagaagggaacatgcaaaaataaatgtagttatataagtgtgattgactggggttatggataaatattctgttttctaaataatataactttttatggactatcctttaagattttgtggatggcaacctgaagtataaacaaggggaaaatattgagtttgagaaattaatcacaaggctataaagtagaaggcataaattgaaccatatactgtaaacactcatagttcatgggagaaagaagcaaagtggtcatttttcccaaggagaaaataaatagaactcaaaacagagaagagattatttggactgagatttccaaaggaataaagctgacacaggtttatgatgaaagtgcaacaaacagaatgctgaattctgctagatatcagtttaattttttactgtgctacacgatgcaattggattgcttctaacctgatatttcacagagatgtattattccgtgggtattactaacagatatgtgcaatctgactgccagactgaacacagacctgtaaaccaataaaacagatattttcaaagagaatttctgataaccaaaatttaaaggaggagatgaagataataatctcttagcaaagaatgtttcacacatgtgacttttaaaagtttaattacatgttcaacacaaagggaaacatttctgaaagccaggaattctgttgtaaggtgttttggggtataaagaatcgtaatttaacgaataaccctcagaatatcaggtggtatttaaaaatgctttgttttagtatattttctcattaatttttatctgaatatttggctctaaggcttacaaacctatgcataggcaattttgccaggggaaataggcaggaagtattttcatctatctgctgaagatacaactttttaccataaagcagtcataattttgtcttggaacgaaacacaaagaacagtataatgttaatcgtgattaaaaaataatgctatggtgttagaatatattatcaaaaagtaagctggccaatgttcaatgttttgtttctgttttctcataagtgggaaagaaaagagaaatgagggaagagtaggtttggagaaaataaaagcagaaaaagtctgcaatatctcccagtgtccacaccaagctgttctccacttagattagtctaattcattctgtataggtaagatagaaaagcagaaaagaaagtatgtatctttaatctatgattaaaataaattataattgcatgttttcatcttcgccctatcactaattcacctcctctattactagccaaaggctcaagtattttgcaatagtagcacaattataagagcattggtagaaggtccagcgacaagaggttagatttttatatattttattttacatatttatatattttattcattgtttgtagtaaagaaatggaggaataaaaaatgactctcagaatttgggcttaggcatcttgataaacggtgacatgatttactgtgaagtacaaaacatagagagacaggtttggggaaaaacaagtcatctgtcttgaagaattcaggtatgagatgtttattagtcacccaagagaaaataatttagtatcaagtgggcagtattagcaataatacatgatggatttctgatttaaaaaatctttatcagaaaatctagtatacatgtagtagcagaaatcggtctctcagtaaaatttctaggtagatacaaatggaattctttcctaacatgagaccacccaagcaggtttaacacataagaaactggtacttgaaccccagactctactaaatacaatatctttattgtatctaaggtatacttcatggtatattaaatctttgcaaaacgaacattgaaaatctaaagctaatcacaactccagaaagaaactagattattttctttttctaaaagaaaaggatgcttttactctgctcatagctgagtttgtcatctattgttatttcacagatgacataattcacaagttattaaaggtttcactgcagtctgaacttgtattcttacacattccaaaacactttcaattttctttaactaccctctaaagtaatttcagtaccaaagaatagaggaggaaaaaatatacattgaatgtgtaaagcaggggcagagagttgatctattacgacatacatctttatgaaagaaaagataggatgacttgctcatggctacatactttataagttatttcttctcactcataaagatagttcttttttaaaaaggttaggatttctttatattttatacaagttatctctcttcagtcttcacagtttttgtagttgtcaagtttcaaacactaaaggacaacttactttttcacagttatcgtattgccttctcaacatatatgctgctgtttagaatttatccccgagtcatggtaaaatcatagtttaatctttgtgtatacaaaatcatatctgaataaaaataaagtctgtaaaattcaaaatcatatccagatctgatgatagtaaccaatacaaatgggattataattggattgtcaatctcatcaatatcataattattcttttaagttatagagtactaaaattgtagtcatacaaaatgaatgaattctagagttctgctgtgtaacattgtgcctatagttaaaattaatgtattgcatacataaaattttgttgctgggcctggcgactcatgcctataatcccagcactttgggaggccgaggtgggcagattgcttgagctcaggtgtccgagaccagcctgggcaacacggcaaaacctcctctctacaaaaaatacaaaaattagctgggtgtggttgcacatacctgtggtttcagctacttgggaggccgaggtgggaggatggcttgagtccaggaggtcaaggctgtaatgagctgagattgtgccaatgaactccagcctgggttagagacctgtgtcaaaaaaaaaattgttaagaagacagagttcatgttaaatgttcttacaacaataataaataaataaataaataataaatcatatagtactaatttcataaaggtatacatacctatgtaaaaatataaaataatatcaaaagtatatgcttctatgtgtctagaaagaaatcatataaactaagtatataaataagcatatatactaagtggttaactactccttttgtagagtaggaataagagcaatgtttactttttatttaatgcatttctatattgtttgtcttttatagcaggaatgcattgtttaaaaaattggagaaatggcaagttatagaaaggagataactacgtgtagtaaaataacaacaataaataaaatcactaaacatcagagcaaaatcacatttgtcaatttgattcagaaggtttccaaaatgtccaatacaattataagaagataatatggcatatgaagataaaaattaaatgtagttattataataaaacttttgtaaaaataggacagtagtatgccaaacagattactctcaaatttttctatttaatttataaaatagtattaagcctgtaatgtataaaaggattcatggaaaaatcacaattttaaaaataatctggctttcaaagtgtatcttaattaataataaatatcacatcatgtactataacaacctaagtgaacaatactgggattaaggccacaaatttgaccacatcatgactttaaggatgttacagtataactatgttaaaagaaaaacattttactaaattggactattaaatttcctaagaaaaatgttaccttgcctcttaagaaattaaaaagcaacctctgggtcattttcagtaactaagttctaaactgcttctttcattcattcagtaaaaaacatgttgattgactctcatgtatcaaagataaagaagtgaataaagcaaacaaagaaaaactgtcctggtgatgctcacattctagaggatggagaaagaataaacaaaattaataaacaaaattaattttaaaatatttagaatgttagtgataaaggtaagggagaaaaattaagtagagaaagaaatagggattgggggtaattttgagtttaacagacaaactgaggagatattggagtcaagatcagaaagagggctgggcatggtgactcacacctgtaatcccagaactttgggaggccaaggcgggcggatcactcgaggtcagaagtttgagaccagcttggccaacatggtgaaacccatctttactaaaaatacaaaaaaattagctgggcgtggtgcaagcctgtaatcctagctacttgggagggtgaggagggtggattgcttgaacccaagcggtgaaggctgcaatgagcccagattgagccattgcactctagcctgggtgacagagcaagactccacctcagaggaaaaaaaaaaaaaaaaaaaagaggaaaaaaaaaaaaacagagagaggtggaaaaagtcatgtcactgtctgggggaagggatttctaggcataagggcagaaggggcaatgatgcaaaggcctaaggtattgcctgcttttttatgtttaaaaattaaacaggcccattcattggatcaaaatggtagggaagagaagtggtagaagaggaagttagagagattgaggcagatcttataagacctgcaatctcattacaaggactttgcttttatcttgtgcaatatgggaagccaacagagggttttgagcacggaaaaggcacaatttgtcttatgttttaccagcattcctctgactgttgtgttgagagcactctaaagggatgtaaaagtggaaatttagacaacagataggagacaactgcaagaatctagagagagattatggcagcccagagccatgttggcattaaagggtacagaagataacagcagtgccttgcccatatttcctggatcttatagttcagttcatgccatttaacttctaactgccagcatcaacatatctttgcttgaaggctatctgggactggagctaacttgtcccatgcatgcagaagcccaacaatatccactttctccccttggacaagcacccacaccaataacagaccggagttggtatataaataccacagtgttgttatttctgaagtggaatgaagctgacacatgtattttacaagagctccagatttccccagggcaatttaccaccagttgcctattgtggaaacttccttgattatgtacctcttactagctgccttccctttcttgtctcatttccccacttcctactatagtttcctggaatcacatccaaaacagctactggcactcaaatcattcccaggatttgggtctggtagaaattcaacctaagttagaagtgatcttagaaggtattaactgatataatgaaaactacaatggaaacattttggaagccatgaaggtaagaagtttaattctggacatgtaaagttagaggtcctggtagatacccaagtggagatttgattatgcaattagataagtgagtctgtacttcaaggagaagtcttggcttccaacataaattatggtgccaccagtatataaatgtaattcaaaaccacgacactgggtgaggtctccaaggtaatgtctgtagataaaaagacagagttcaagaactgtgctttggctgctccagggttaaaagtctagtgcaagagtcagcaaatcatggcctgtgggccaaagccaaccaatggcctctgtttgtatggtccttaagagtttttgtttgtttgttgttgttttggtcttttttttttttaacttttaaagtgttgtgaaaacaaaaagaagaagaggaagagtaggaggcagcagtggtagcataagcagcaaaggaagaaaactaggggacagaaactctatgaaatccacaatgcctaaaatacttagtattggccctttacaggaagtttgctgacctgtggtatagaggaagaatggaaatcagtgagagagagtgagaaggagtgaacagagtggtaggaggtaaaaaagaaggagaacgtggtacaccagaaaccaaatgaagaaagatgtccaaggagaatatcaactgtatcaaaatatgtagatagcagtattataataaattaattgaataagaaacacggatgtcattaaaaaccttgaaaaacatcatttcattggttgtaaggaaaaaagtaagattacagtgggcttgatgtagaaagcacatttttccagttccagccatgatgggataggttttttcagaccagatcgcctactggaaagatctttaaaaatagaataatagaaatatcatctatttgagaacattggtgatctattaaagcagtagactagcgtatacaagatcctagaaagaagggaaggccagagttgtgatccagatatttggtatctactttctttcaaaatatttgctattatttgaatgtaagaagctgagaaaccgagatgataagaaactgagaaagtagacacagagggtaagaagttcagcaaaattttaggatgcaaagaattagagttctgagctcatcaaaaagaaagtttcctagtaaacatccaaggtttcagttagctttcaaacgtctacatcttagaagctggataatcaaaaaacaaaaccagttctcataaagatttaagccaagcttttaatcagacttatcattgattgaacagaagtgatttggcttcattctaaatgactaccagaagtaaactaaattctttttgaaagcaaaaaaaaaaaaaaaaaaaaaaaaaaaaaacctgaaaacaacttagaattctatttcctgttgaaatatgcttcagaaaatgaaggttaaatatagcattattaggcaaccaaaagctgaaagaattcaaattcagaagaaatgctctaaagaaagctctgcggacagaaaaaaagattctgcttggatgctcagaaatgcagtaacaaaaaggatttaaataataaaaattatgggtaactataagaaaaatttacctataaaacaataataatactatcttgaaacatttgaatatataaatatgtgtgttagtgttattttattaaggatatgtaattataatatgtgcaaaagacaagaagacagtataaaagcagttaaagtgttctatggtggttgcattttctaggaagtagaataagttataatttacattttatttaataacacaaaggtacatgccataatcttcagggcaactactaaaatactaacaaaaattgcaaaggtcaaaatagggaatggaattattaaaacacatactaggtggtacataagatagtaagatggcagacttaaaccctaattaaagaaattatattaagtataatttctttattatagtattaagtagaataaatcataataaaaatttagagactatgtgttttctagcctccaagatgacccccagtgattcacattcttcccacttgcaaactgtacttatccccttccaaggcttctaaaggtctcatctcattacatcatcagctcagagtacagaatcttttcacctaaattgggtcccaatgcagatgaagtagccaaagtacaggttctcttgatatatggacctgtgaaactaaaaagacaagctatctgccctgacacactcaacatataatcgcaggacaggaacagtataactaatgtgttagctttctgttactttataaaaaattaccaaaactttgcttcctaaagtaactgtcttagtcaatgtgtgctgctacaataaaatattatagactgggtggcttataaacaacggaaatttatttcttatagtttaggaggctgagacatccaagatcaaggtgctagcaggtctggtgtttggcgagggcccattttcttatctaaacatggccatctcattgtatcctcacatggtggagagcacagagcaaactctctggagtctcttttataagggcactaattctgtttataagggtttcactcattacctaattatcttccaaagtcctcaccttttaatatcattatattgggacttaagattccaacatatggataaggggggaacagaggcacaaggaatcagtccataacaattacacacacatttattgtttcactttctataggtcagcaattcaggtatgacttaactggtcctctacaaggctgcaatcaagatgttgaccaggcatgaattctcatctggagctcaagtggggaattatccactaccaagctgactaaaatattggcagaattcattttctcacagctatatgacgttgggacttacttgttgctggctagcagcacgaggtcactcttggctcctagaggcttcccacagtccctaccacatggccctttacttaggcagcatataatagcttacatctttaaagccagctagaaaacaagaaagaaccttctagcaatacaaaaatttttaaaggaaatataatcgcagggtaacatcacatacatttgtcatggtctactggatggaagctactcacaggtcctactcacactctaggtgtagaggttacataaggtatgaacatccaggaggtagagatcatgggaccaccttagagtgtttttgctatatatgctatagacatttttgttcaaaaaagagaaaaacggtaggccaagcaagtcactggttcatagcaattccaaatccagctgggaaaatcttggcagttcacttattagggctcatggcctgggaataattccattactttcagctccaccctatgcatattcggttctgcaatcaattgtcatttctttgtcatgagacatgcatacagctgagtggttttcttttccttcttcctgacagtagaattttggactcaaatggaatcatttttatattgtctatttcatactgtctaagtgcctttcagtccaagccagcagcatttatgctgatataattttctcaaaaacctcacaggcatcctactcatgagtgttcacagcattacaaaagagccatgtccacacatctccaagtctgaaacaatattttaaatataaagccaagaaatttcatagacctcattttcatattagacatgggtccatgttctgagttaactggataatcagatgttggattacatggatgtatccatgtgttcacccatagtgctgaactactaccctaaagggtaactggccagaaggattataaaaaaacaagcacttccagttattatatacaagtatggagaaatatcaatagaaatattggacaatgtcttgcatactggcacaatgcaaatttgttcagtttgatttgtagaatcatctattcctagtcatgttcaattgtttatgattggaacgaggccaatcttggtcacaggaggaaagagataactgcataaacagtgctttacaaggtttattatcaatgactttggcatgataatatggtgatgagatttggatcaagatttgaaactgccttagaaaatctagaaggaaaaggtaatcaaaaatgtattgaaatttatcaggtatgaacaagatgatagaataattcacttgagggagcaaagccaattgggaatgaaaattaggtttgcttctgtcaggaatgatctaatatgatcctacctgaggcaggaattctattaatcttttccagttctttgattctaagttctaaaagaaagagaaaccttgggggaaaaaaaaactgtgtatgacttgagatctttcctgctgtctcctgggggcatttagtgctataaatttccctctaaacactgcttcagctgtgtcccagagattctgatacattgtgtctttgttcttattggtttcaaagaacttatttatttccaccttaatttcgttatttacccagtaatcattcaggaacagattgttcagtttccacatagttgtgcagttttgagtgagtttcttaattctgagttctaatttgattgcactgtggtctgagatactgtttgttatgatttctgttcttttgcatttgctaaggagtgttttacttccaattatctggtcaattttagaataagtgtgatgtggtgctgagaagaacgtatattctgttgattcggggtggagagttctgtagatgtctattatgtccacttagtccagaactgagttcaagtcctgaatgtccttaattttctgtctcgttgatgtgtctaatattgacagtggggtgttaaaatcgcccactattattgtatgggagtctaagtgtctttgtaggtctctaagaacttgctttatgaatctgggtgctcctgtattgggtgaatatatatttaagacagttagctcttcttgttgcattgatcccttaaccattacataattcccttctttgtcttttttgatctttgttggtttaaagtctgttttatcagagactaggattgcaacccctgctttttttgcattccatttgcttggtaagtattcctccatccctttattttgagcctatgtgtgtctttgtacatgggtctcctgaatacagcacactgatgggttttgatgctttatccaatttgcctgtgtcttttaattggggcatttagcctgtttacatttaaggttaatattgttatgtgtaaatttgatcctgtcattatgatgctcactggttattctgcccattagttgatgcagtttcttcatagtgccgatggtctttacagtttggtatgtttttgcagtggctggtaccagttgttcctttccatttttagtgcttccttcaggagctattgtaaggccggcctggtggtgacaaaatccctcagcatttgcttgtctgtaaaggattttatttctcctttgcttatgaagcttagtttgactagatatgaaatttggggttgaaaattcttttctttaagaatgttgaatattggcccccactctcttctggcttgtagggtttctgcagagagatccactgttagtctgatgggcttccctttgtgggtaaccagacctttctctttagctggtctcaacattttttcatgcatttcaactttggtgaatctaacgattacatgtcttggggctgctgttctcgaggagcatctttgcggtgttctctatatttcctgaatttgaatgctgatcttgaatgactttacatttgtactgatattaaattttatcaacctgtttcaaatgcacaagtgtttaaaatgtattagtaataattgtgtataactactcaattccttgaaaaacaatgtcttgatacaatagattaacatgatatatataagttaacaatttctaatgaacctatacaaactgctagcctatgaaacctatatctgttcatacatttctaatgtcacaaacttatcagagatggaggaagtgaggaaccatgacctgccaaacatgatcagtgttcagtggtctattttaaatttctgtaaacattttacagtccgtagaaacatttctcttttccaatttattttgtatcaagagggctatcatccagatcagttcagtccagtccagttcaacatgagtattttgagtactctctaatccttggccaggctgtggtgaagactgtaaggagaagagaatggaagctccctgtcctgtcctcaggaaaattccacaccctcagggagcttaaaggaaaaaatgctcaaagcagtatttcccgaaatatgtttttttttaaaaaatctcttttgcttccacttgttgctctccaggaagagtttacttcaaagaagtttggggaacatgatattatttcccatacttggatattcacagttcatattagcatttcaaacactctgagaagtctagtactaaagaaacatgttcaattttgcttaagtcaacatttattaaccagggcacactgttttggtgtgatacttattgatgtactttaaaatactctctgctgctttaaaaaatactttgaaaatgtccaagtttaaatgaaaatacattcagacttttactcaaaacaagcataatttcatgacttatttcatgcttagcatttgaaacacaatttaaaataattaaaatcataaagaaatctaatcataaccttgaataacactattattgtggtgtctcagtctgatacttttgtattcacattaaattgactgctatacttcagaatatcattttatttttattatatccgaatccatacaataacaagttatattgtaatgagactctaatatgtcaaggaatgggacaaggttcacagtatatatacttcaatgtttaagtaaatttgtcatatatgatactataagatcctctaacatctatattaaagtaaaattaattttatgacaactacatattgaccaaaagaaatatgaaacaagataacaatgcataatcaaatgattgctatctttcattttgcttttggatattaactcttagttggaaatataaagatatattgatatctttcatatgtcaatcaaatacccagttacacatgagtataacatcacatccatgtgtaaaaacttgccttgtcaatcaaatatcttgttatacacaggtctgacatcaaatttaagtataataagatataagattgacaactaatgagtcaaatgtgagaaaaatacactgtcctttgtttttccctgtttaaattagacagttcttagtttttcattcactcatcactagtccaatttgtaacgtttcactcttactgcaatgcctgtcataattccattcaattttttgtgccattgtgcttttattgacatgtaaaggcatgtgatctacatatattgatgattatatggtactaattaaaaggtcaaatatcagaggatatatagccatatcaagacaatttctaaaattagaaagtgcttcacagattatcctgaataataacaaaaacaaaaatagaatccccaaagaatatacaaattttgtatttttgacatctatcaataaaacctatagcagttacttatgccaaccaatgccacaaaagttttagatttactctccttatctcccaggatctaaggcactcctgggcctagcaggatgtatccagtggtatttagtgcctcatggcttaaaactgccctagaagtaagacctagcaaaagcaacacctgagtagtcacaccagttaaaacattgtgtcattatgagctactagtgataggtctttcggactatatatttttggacaaagttaagtcagctgggaagagacaaaaactgccccattactttggtcataatacatcaaaatatgtaggtatgtctatacactttcctagggcttgagggcagcccccaaacgtttatctgaagccagaggtattaagttatatcaatccaatgtcatggatatagagctaaatcagggcagtttaattcaaataaaatatattgagctccttcctaaagtaaagcattatgctaggttaaaaaaggtgaaaacaacagttggcaatataacgtccttgactttaaaatgtttattgtagtaggaggtttgggcaagagatgaagtaattcctaaacaaagcaaaaaccttacatttgttttaaagtgggccggcaaatatcatgaaggattaaaggagggaagagtccatatttatggcatatcatgaattaaaacataatttagatacagaaaaaagagaagatcaaagatcacggagtagatcaaatatactgaaatttggagaaacagggagatgttcaacttagagagaagagaagttgaagaagtgagaaagttgcttggcccttttaaagaagctgaatgaagtccgaaagtcatgtaccaagttgattagatattcaataataaagattttttaattggtcagttttagtttgtgttgtttaaggcaaagagaagaatcagaaagaccacctggtaaactattgcactattctcagcaaatcataataaaaatatgttagaacagccaaaagaaactcaagaatagaggtaagaggcattaaagagatgcactgtaatagactcagcaaataactggacatgggcaatggaagaaggagataccagagaccatcccaagtgaattcagtgaataatagaggatggaggtgaaacagaaagctggaaaagccatgtggagagttaagactagaagaaaatggagtgcagaaaacatgactgtacatatgatgaaaggctcacaaaggttaagagacagactggagacagaaaagttggaaagaaagaaaccaaactagaatataagatgggaatagtatcaataaaaaatggaatgaaaaaaaatctcacaatcaactagcatttctctccatctcttgctaaagcaccacaagccataaactaaatagttggcagcagataaaggtagctcccagccccatcaatgggaatcatactcagtcatccgcatcctttcttccctctctctttacattctgaatgcaagcccacagtacgtgaatggcagaaccaatccctcaattcagccatattcattttcctgtggcaagatttttaaacggaaaatggaagttttcaatggaagcacagaataaaaagctaatctctacagcatctgagcatgacacccagactgtattatggtcatgaaagatcttttcacaactgaacaaagatgtgttttctcagcccagccactgtttttgtgacatcttgaggctgcatgtcacaagaatattccttggtaaattctaatcattttctaacagctgtgtgctctaaaaatttttttcaaaggttagtaactaaagaagttttcacttaggtttgatcaacattacattttagcaaagatatatttaaatgtacatattacttattgtggttcatcctgtataaatctttcttcaaactaaattatacttattaggcttcagataaatgcatgacacagtcatgtaggattattctagggctataaatactggaaggggaaaaagagcgagatgtagaaccgaaacttggcagaaagcaacaatctattctgacagatgtgaccttatcaagtttataagtgtcatcattgtcatttatatgttctgtgaaagggatggtctgttattataggatgcttctatttattaattggaaaagcttttgatagatgactagaaaagatactttgtagaaattgggaattaatacacacttgctcacatacatgcacatgcatgcacgcacacacacacacacacacacacacacacacacatccgcaagagtacacatcgaatcttgaaatccaagtgcttaattgccatttggtctacttgagggcatgcaattatcagaatataattctaacttcaagaaactgtttatacaaatgttaaacacatatttttatattttttgcacatgcttttttacactagcttttttatttgaatcaaataatattagtagaaagataaatatatatttgttcttctgatcaaaagcagcaatcttactttttctaaattacttactttaagtaatattaaatgcagatgcatggaagctattttcccaaggctttacaatacattttgtatatccaatgataaagttaatccaatatatgcattttctcaaaaatataattattacatagaatttataagtctggtgaaaaagtacccaaaatcactcccactatttcttattatttttatcttaaaagtgtttcactgttgcaaatcaacgttactcagataaatattttcatttgctgggtagcagaagttctgataatgtccgtaattataacagtatatctgttttgtttgcattagataaaaatcattagcatgtatctatctagcaaaggtatttggggatattatgggatatgcatcaagtggtcttgtcccagatttaattatgggacacttgttatttaacagatactcttctgggtaatgtgggatacatttgtgaacaaaataattaaaaaattttgtcttcatttgaatatgataaaatgccaaggcagaggtggaggatagacatgcattagggattaaacatggttggagaggagcttgggggttccattttaaagacagtggtcagatctgaggccaactttgagattattattgggcaatgacttgaaggtaatgaaggagatagaagaaactgccagtgcataatttctacaatagaaacatgcctggcatagtcaggagacagtagagagtgattaaaggagaatgagggaatgagaaaagagtgagagagaagacagagactgcagtaccagatcctatgggattttgtaggtcactggcttctaactggaaacagaaccattgcagagttttagaataaggtagcaagattttgacttacattttaaaagggtcactccagattgctgtctggagaactgtgctgaagcaagaaggatcattagaaggcagtaactcctggcatgaagtggtggctcttgcctataattccaacaccttgggaggctgaggagggtggatcacctgaggtcaggatatcaagaccagcccggccaacatggtgaaaccccatctctaccaaaaaatacaagaattagctggacgtggtggcagttgcctgtagtcccagctactcagaggctgaggtgggagaatagcttgagcctgggtgtagtgagccaagattgccagcctgggcaacaggagtaagaaaaggcagttaatccagttaaaagaggctagaattagcagaggtgataatcgtgagtttgtggatatattttgatggaaattgctgatgaattgatgggaaatgttgaggaaaagaatgttttaaggatgatgtaaggcttttgtccttgcaccttggaaagatgtcgttgctatttatttccattggggaaatttgctttaagtaattacatgacagaaactagtttaatacataggaaaatgattcttattggaggctattcattgaaataactattgattcaggttcaactaattgagaatatttgatgacccaccagagtaagacaggctgaagacttcctttgtatcatcaataaaactaagatttgcaaagaatattaatactgcttataaatttcaggaagagtggaacataaaactaacttggaaaaaaaccttttttctgttttttagaagtattccttttaacaggaagattttgtatgaatagagagccttaaaggaaggctctgtgaaacctgagcttggcaacacatatttttatgtagctgtgaacagctgctttgcctgagtcagccatgaagctaagctgcctctcacaaagtataacacatacatggcctgactaaattattaaaaaaattcagcctctccagtaatcaaagtcatgtaaatttaataaactgtaagattccatctgacatccatcagattagtaaaaggttgaattgtttaaaacaatgtctgattttcaggttcaagaaaaaccaagtgcatacatttgtcttccctttcagccaaaatcccactgaaattatagttgagatgtatacacagaatatataatggtaataacaagggaagtgagtaccataagcagatagatcttacaaacttccagaagatggattgcaaatgggatcatttttaaaggcatgaccaaacagagatagcagaagctcagaattagtacagagaagtcttcatcaaaggtgaaagccactatttccctcaatgccctcgagaggagtcaccaatgtagtcagcagatttgtagagcaatcatgagctgtagaactaaaatcagtataattggtaacaaggctgtccacagaacagctagaagatacctttgtccacaccatcaccttgcacacatacaaaatgctagcctgatagcatttggcttctcacagaaactagagaactctcgtccaaaaaaatgtgacaatactgggcagacagaggggaagacagaatgtgaataaatttataataaagtcatattatttatttagaaatagtacccatttcatggcatcatctaacctaatgattatcaaattgtattattcacttaaaaagtaggaatcaaaaggactcaaatttaaatgttcataagagtaccagggatctaatttaaaagatatgtctagactcctgaaggtctgatttagaaagtttgcagtgggacctaggaatatgcattttgagctaattcccggtaatgactatagcgtaggtggtggggaacagagtaaaagggaaataaatattagtcaccttttgtgggctctctggtattagcacttgcatcttcatcattctttctttatagaagcccttccttgttcctatatatatattcatctcctacttacacatcaaaatccaactaaaagctgtcacctgcctccattgaaatctctctcctctaaatggctatgcttttttttgttctacttatatacaataacaacagcacactcctttaacatacctacattatatcatgatatatatatatattatatcatgatataatgtaggtatgttatattccatatctccctctcgtgtcttactaatgtgtaacttagccaagtgattggaatatattagtttgaccaatatttatgcataggtaatgggtttattatttttattgaaaaaattaagttaatactttactctttctgtgctttccattgtatcactccactcaggtaaaaagggaaggaaaaggaaataaaacataaaaagtaaattctggaactatgtcacaatttaaaaagacatcattttttaacatctccatgtaccattattttattaatttcaagttaatgagtagagatgttaaaaggtaaatctttggcactcatgaacttgtatcagtccacatgtttttccaaattatctattatgggtagttatgcaggatacatattaactgttctgaaaagtaaattattgtctaagaaagaaaataaacagcaaaagataaatccagcattaagctcactaattagagtttagaaatctatggaaagagcattggtgtcttcaagtacgtataatctgaaaaggcctaaattattagatattttccataatcataataatctcaggtttgaaaaataatgtgttacttttagtcttaaaataaatttactgtttaagttgcaaaagcaaaacacactcatgttaacagagacattaaagactaataaatagaagtgttcatcaatttctccatcctcttccacttactacaattctcttcccaggccacactaccattaataaattatgtgagttacctcagagtaggtttctatacattcacaaaataataatagttatgacatttatgaagtgttagctctatgcagaacacttgactatttgcttcaaatggattatctcattgatgttcttaactaccttgtgagatacagatcatgaatatctctgtttttccagggaaagaaccgatacttagagaagctcactaatttgttcaagggcacgaagctaataactggtgaaacaaatatttaaatcaaagcagaatggctccaactttacatctccatgccataatataactgcaaaacatatatatttaattatatataggaaatacattaagatgttacttttaaacatatatgacttttgtaacatagatgagatccattatatgtatttttctctgagttgtaaggattaaacgagatgtgctatgaaagtacaaagcatggcacatgacatgcagttgccattagtgtcccttttaactaaacacaatcaggcatttgacctgaagttatttctgttcatcacagcacctgtcacatactaggtgctcaatatatatttttttcagctttgttttaatttttagagtcatcaatttacattttaaaagaaacttttcttcttctcacatctatggcaaatagctactgactgtttgtacacatttcctttaaaaaaataaaatccaggatctcaggttctgagatttatccttgaagccaacttaccacagaaaaactatatgatagagaacttaatgataacattaggaaataagaatggatggtaccatggtaatagaattttgatacactttttttagcaaaaaaaaaaataatgaaagcaggaaattgaatgtctatatgttctgtcaggctttattttttttaaaagaagtagatgaagaaaagctgaaaaaattggaaatgaatcaaattgttacttaaaatacagagatggtttccattttttaatacacaaaaatgtgaatttttattttgagacaaagtcttgcttactcacccaggctgcagttcagtggggtaaccttggctcactgcaacctccacctcccgggttcaaatgattctcccacctcagcctcctgagtagctggaactacaagggcgtgccaccatgaccgactaatttttgtattcttagtagagatggggtttagctacgtcagccatggttggtctcaaactcctgacctcggatgacccactcacctcggcctcccaaagtgctgggattacaggtgtgagccaccacaaccagcctcaaaaaaatgtgaaattttgaacaaaataaaataaatattagtttttgagcgtgctttatatttcatccttttccaaacaaattttggtgaaaatactgttttacataggataatttatttaaaatatattaacgtaaaagctgatctgatcaaagctacagcagatggctgatgaaatttataataagaacctacttgccctcttgattcatttctaatggaacccaaagaagtttttggaatacagcacttctattttcaggaggttaaatactttaaatagtaaccactagtataacttgtgggccattatatatttaataaagaatgttttcaagtcactttccagtgattttaaatttatttgcatatattagggggaattcagtttgtcgcaaaatgtggtccatggacaacctacaacaacctataggagaatcacctgcagtggttgtttaaaagtgtcatttcctgggcagatgtagaatatgtcaagtgtgatatgagaatgtgcatttttaataagcattccacttgaagcttatgttcctgaaatttttagaaccattgactcagattttacagtggaattatgttgctagaagcatcaaaatgcattggaaaaaatatgtttaaaaattcagccaaaatttttctaatttttaatgcaaaaataatataaatatggtttttgccagaaatcttcctttgtgaatgaatgacttcagttggacgcctttgtgtatggatagaaaagggcgttaatatacattttgatgcaacatgtcacaactcctcatgtctggataactttgccagcaataacaagtatggccttcctttaagaaattaaatgttagatttttcacacttagttttggtttccataacaggcatcttccttgcacggggcaaattatcaagtattcactggtttgtgtttttctctatgatgagaaattgcagttttgcctttcttactacagaatgtgttaaatcaagtccgatttttttttaagaaacagtatacaaaatgaatttggactgagtctataagcaggaaaggagcccaaattgaatcagaactgaaattatactttgatttagttatatacttctccccagaaaaagtgttccacaaatgggaggaaacaatgcttccaacttaaataggaaataacaaagttttagtattttgatatgtggttcctctgcaggtttcatagaagggcatgtgtactacattaaattactgtattaattgagcacacaccaaacaatatgctagatgatacaaaccatatctcgtagacaaggcgttgtctccattctctaggaattaacagtctgtaagtggagggaaggcatgacacagcttagaatgtaagaaatgctataaaggagacatgtataaaattttgaggatctcagggaaaataaagattatttttaatcaaaaaaaaatttgaaagttttcaaatgaagttgacatttactttcagtcattcgaaaacagagacagagcttcaagcatagggttttaacaacctattgtatcttcttcaacatttttgattgtgttgtagcctccttggtagaacaaaagtgccaggaaacagaaaattgttagatttttaaccaaacctaatagcaaaaatccccatatcaggaaaataaattctactattgtattacccaatcctggggcctcttttcatgtagcaattaccagtaagtagaagaggtgaggtaaagtgatgtatcaacatctagatttttaccctgtctgtgggagatcctataaggtctacagaaaatacacaagctcatatggtcagtaaaatcagtatcatagacaaatacaaccattctcctactacagaatcttctccagaaagccatccagagctcacccaaaggcatggctagttagattatttgctgctcctttctgattactgtttatatacatatagtttaactatatgtatacaatatgaattgctaaaatattatatatataaacctataaacatatatacatatatgttcacatgtgtgtgaacatatacaaacatatatttgtaaacatacaggtttacaaatatatacaggtataggtgtatatatatatatatatatatctgtaaagagacctatgaccagagagtgtttgtgaaactcagcttaaattgtattatctccattatttggtcaaattctagcagcattcctggaacatcaaattcccttgttaatatgaaggtaagcattctgtagtcccctcctacttatcttgtcttcttttctacagtgtctttctgacatacacaccatctccttaattcatcaatttttttcagtcacctattgatataataaagctaagtaacaaatagccataaaatttagtggcatataataatatgcatttatttagctcatgcatttgtgggtcaaatgggtgttggctgatatgggctgggctcagctgagtacctctgctgattttggctaaacttgctcatgcatcttttatccttctcttggaaccaacaggctaaccaggacatgcattgttcatcaaacggcagaagtacatggaagcaagcagaaacttgctaggcttcctaaggctgagccttaaaactgccatagtggcattcttatctcattctgttacaaaatgcaaatcacaaggccaaacacacattcaagaggtgaggccatatacactaccactttagtgagaagagctgtaaaatcagattgcaaagtgcacagatataccccacacatgaattaagcatttaacttgtatacatccttaacaccagtgcttactgctaacctaatagttgtcacaacagcatgtagtgatccaattgcttgtttccccacaaaagacgacgactttcttcggggcaagaaccctgccatattcatcatcacggtaactccagaacctcaaatcaagtatgacatgtagacactaacattttatgatagacagataggagagagggaggcagaggaaggagcaaagaaaaaagatagaccatctcaagtgcaagatgtaactgctgttaagctattaccctacagatataataggattctattttccaacattttaaagtcaggtatcactttttcttcccactttctgacaatataagaaaatccgttattaataatataagaagtgatcagaaatgaacaaatatatacttaaggtattttttcttaatttcctttttgaaaacatagattaaaatactccatcactttgaaaatctatttccaatggtggaaggagctataacagtagtcattgtcagtgttattaggtatgtggtctgccaaagaagagacattttatcacttggcaggtataagaaattacatattgttaagggtcactgatacaattgactttggtgtattcgaaggtcaagatttattgaaagagtaggacacttaggattaagaaatgtggatttctttccaggtcagaccatttgggtaagcttcttaaaattaaacctccttaagcctccaccaaacttcagctgattctatatgggcagattttattactaataatggtaaattgtttgtatttgtagggttttttaaaccaaagaagtcaaattatataatagcagtagcaatcactagataattaatacctaagttttgagcactaacagtgtgcttggcaaagtgctaggagattgacatacattatttttaatccttaaaataacccattgaggaaacatcttttgtccatcctttacagaaaaggaagcagaggcttagagaaattataacatacttaaaccaaataaattccagagccagaatttaaatacagatcactatgattttaaagtttttgggtttcataacttggctattgggaataatgctacaattagtgaacatgggaaagcagatatctctttgagatcctgatttcaattcaattaatatacacccagtagtgagataactggaccatatgatagttctagttttaactctgtgagggatttccatactgtttttccatagtggctgcaccatttacatttcccaacagtgtacaagagtgccctttcctctgcatccttgccaaaatttgttgtcctttgactttttgatagtagctatcctaatgagtgtgaggtgatatctcctgtggctttgagttgcatatccctgatgactagtgatgttaaacacctttcagatatctgttgacgctttttttggcttttttggagaaacatctattcagagtctttattttttaatatgatcatttttgctattgaattggagttccttatacattttgatattaatcctttatccaatgtatggttttcaaatattttctcccatttcataagttgcattttcattttgtggttgattcttttgctgtgcagaagcttttgagtttgatataatcctacatacctatttttacttttgttgcctgtttttctgtttttgttttttttacttttgcttttgacatcatatccaagaatcattgcaaggtcaatgtcaagaagctttttacctattttttttctagaatttttatagtttcaggttttatgcttcagccattaatccattttgagtttatttttgtgtacagtgaaggtccaatttcattcttttgcatatggatattcagtcttaccaaaaacattaccggaaaaaactgttttttccccattgtgtactcttggccccctactaaatcagttaactatatgtgtctgagtttatttctgtgctctctacttacttgcattggtctatgtgtctttttatgccaatatcatactcttgtgatgctttgttatatattttaaaatcagtaagtgtgatacttccagctttgttcttttttctcagaattgctttggctgttcagggtcttctgcagttccatatgcattttagatttgttttttctatttcttttaaaaaatgccactaagaaaatgcccactaatgaatgaatggataaagaaaatgttgtatacacatataacgaaatattattcagactttaaaaaggaaattgtcctatttgtgaaaacatgaatgaattcagaggacgatatgttaagccagacacagaagaacaaaaatactatatgataccactttatgataactctaaaatagagttctagagccaggcatggtagaccatctctctaattctagttactcaagaggctgaggcaggagtattacttgagctcataagctcaaggctgcagttagctatgatcacaccactacaccccagcctaagcaatagagtgggactccatccctaaaaacaaaaaacaaacaaacaaaaaaaaaagagttaaacaatcacagaagagaaagtggactgatggttgctaggagctggggagagtggaaatatgtaggcattagtcaaagggtacaaagtttttgttataccagatgagtaagtactagagagctactatacagcatactgcctatgattaatagtgtattatataattaaagttttgctacgagggtagatcctgtgttcttatcagaaaaaaaaatgatagtaaataaagagggctgcaggaaacttttatagctggtagactgtggtaatagtttcagggatatatacttatctccaaccttatcaggttgtatacattaaatacgtacagctttttgtatgtcactcacacctcaataaagtgatttgaagaataattataaagtttgtgaattttcttgataaaacctgattatattctgcattttaaagcattattacttatttagaaaataaccacctctttaaaaccagtagaacgaagccttgaagtttcatgcaatatgaaagtttccaacttctttcctgctccacaatctgtggatattaagctcacatgtagcttatgatattcaaacaaattaataactgcttcaatgcccaggatttaaagtgagatgtaatagaaaggcaaagtgcactgacaatccaaaattacatattagactacatgtacttcagataatatctaggatctcacattttccatgcatttatttttaaagctctagttatgtttattaggaaaacaagaaaagaacaattacaataaagcagatctggagcatatgatttcattttaaattgcagataaagtaaaccaatggttcatgactgtcatttgtatccaattctgagttcccagatataaaagactgctttttcattctctttcacaatctgttgccttccctccttctttcctgttttatttcctttgggagagtaaataagagcaattatttgatttttattcatttattagccagacaacattttaacgacatttatgaagttttaaataaatgctaaaaataatcacacacaatccattttccccatccctattagagatgaggagaaaatgagataacacaggtagactgaaataaacactaaataattatctctgtaatgaatttttaaagtgcaccgaaaggacagtgtaactgaatgaatatgtcttatcaacacattcaaaaggcatttaaaagtgaactgtgatctttagccactattgcttcagaattgcaaatagcgagattagaaacctagggcagtgaatagcattaaattaggataaagagaaagattggcactacgtttttgtttgtttttagttgaatcagggctgccctagcaagcatttaatttgtgtaaataaacacgttggatgaaaaataggattaattaccatgtaatcaatggtattacaaataccttagcccaatattcaggaatctacacatgaaatccaagttgaaaaggacccagatggtgactaaacaagggtcactttcctacatagtgacagagccctcattagacactattaagacacacaaagaagaaatctaagaagtggcaacaagtacatgacttttttatatgtgttaacttcaatcctaaatacaactttcaattgcacaaattattaggcaaaaattatttctatttagcccacaaagataaagtgtgtatgccgcaaaacaggactttatgtctgtctgacaagttgacatatctcttgaatatcattactctcttggaactttattctatcttccattgtattagcaccccacccccaaaagtggttatcttctgcaaatttgatggtggaaatatttcttcctttatccaagatcctattgaggatattgcatacaatgaatctctgatctaagtatgtagtattgctgcttgtcatgctattgcaccttgttgcttcatctattaatacttcctataattgctacctttatgctggctattaaagaggaacatagtaagcattattcttcttgaatatgagattagaaaatagagtggggctaggcgcagtggctcacgcctgtaatcccagaactttgtgaggccgaagcaggcggatcacgaggtcaggagatcgagaccatcctgactaacacggtgaaactccttctctactaaaaatacaaaaaattagctgggcatggtggcgggcacctgcagtcccagctactcaggaggctgaggcaggagaatggcatgaacccgggaggcagagctggcagtgagctgagatcacgccacttcactccagcctgggtgactgagcaagactccgtctcaaaaaaaaaaaaaaaaaaaaaaaatagagtggaacctggatacaaaaaccattcttaactgggtatgttatggaaataagaatgaacacaataaaagatgaagaaggataagatttgaatgcagaacatgggctatgtaggtatcactcacctgacacaaagaataactttttccttcataaacagaaagtaacgtgatggcagaaactccccaaaacatgaaaatgttctcttaagagattcatttattctccacaactatctgtagaagctgatattatcctcactgaatagatgaggaacataagttaagtgagattagtaaaagttgcccaaggccatgaaactaatgagaagacagaatggggatgcctaaaactaaagcctgtgatctcaacaatgcaaactgcctctcaacctaccacttacattgcccagtaacaagttccttttgatcatatattgtatggctgtattcacatatgaaaatttaaattcaatatagccacactaaattgggaggattgtttcttacactcagattggaaatcacagaagcaaaatggacatcagcattatcacatcctttgagatgtctttaatctccaaattgtattattgtacccctccttcatttattctttatcacagtatatatcacttcatatcaagattatcttctattttgcctttttcatcttaccagactttaggaagctagatatgaatgaagatggtttctagtatatgaacatcactgtataaatgattcttgactgaactagttgaatttgcattattctggcctgcaattttgccagcctttttggacttttcaacatttttagtctgtgacaagctgcaaagtgcatgacgcaccattcagctagcagtgtggtagacacgtactcattggtagcagtggtgagggtagtcatctcttcgttgacactctcaaaaaaaaaaaaaaaaaagaaaaagaaacagctctttctctgtcttcccacagctctcctctcatcccatctcccaccccaaaaaggcaagagaagttagggaacagaagttattccacatactaaggcccccttcaccacacacaaaagggtctttctgtactacgtgaacaagggagaatgggtgtcctgtgcctgcagtcatcaaagaatatctcacataatctctgcaaagtctcttcgaaaaccaggaaagatacagatcctcaaggctcaccgtcacatcacagacagatgtgagatataactaccagcctcctgaaataagttcatcagctcagaaaagaacaaacgagacttgacaacattcttgtcaagagaattgataggaaaggccagggctttgccacatgagtacacactgattgttgctcagggcttagagaatgatgagcaagtagaggctatttgctgggaatgttagccacgaacattcagacaaagaaaaggatgattagaggagaacagttgtgcactcttggatgccactgtacctgagaacaaacttaatcttttctctctgattttttgcagctgatctaaaaggaagaaaaagaaaaaaaaaataaagaaaataaagaggagaaaactgtacattttttttctttaatttgtgataatgtttcaatgccaaagataaatgtgatgaaaatgccaaagaaaagaactgtggaatctacagcattcattgtgtttatatagagattatgcttctggttgttaacagcctccagaaggtaagcaagtgctatatctatgcatttaaaatagaggagagcaggcacagttcccattttttagtatagcaaaatgatttgggggctgaatataacttccttttccatataatacaaactttacaagaagttactctgtaactcagagttcatttttttttctctttcctttcaaaaaatcttcataacaaaaagccacaggcgagcggtttttctatttcactgtaatatttcaacctgacactgtgatgcaattaggatcttagaaaggattagcagagatatattctgctcttgcctttatatgctttaattatggtcacaagttacccccaacttttatgccttctccaccccttactgcacacaccgaaacacgcacatacacattatttcaggcttgagtgtgagtttaggctcgatgcattcagaacaaaatataatatgctctatttctcagggctgaaaatacatcaagtaaagaaacacagaggaaatgcatatatgaataaattattttaaatgactgcatttacaatatttccaatattattacatcaataatgcaccaactgtattcgttaaatgaattatggcacagtcatgcaatgggctactattgaggccattaataatgatgtcttagaagaatatataatgactttcaaagatgttcatgatatattgttggcaaaataaagcagactacaaaacagcacttacagtttattcccaattgtgaaactataaaatacaatcattttactgctagtctcatatgcatctaatagcaaagagaaatatctaacctgaagttctagaaggtatgtgtttttgaaaaatgatcgaaagaaaggatatccacaaaagtgttgtttttttctttcggtagtggaacttttttctagtaaatttagcttagtaaactgcataagtaggtcaacaatgataaactataaattcaggttggctaaatttttccaaaatcagagtttgaagatttttttaaataactttgcaacagataagctattattgaacatttttcgaactaagctgtgttttcattaacagaaatttcttacttgttatatctgccttcaatagtaaagtgataaaatacaaaatctagccaaagtcctattagtcaccatcaatataattgttaaaatagacactcaaaatgcagaacatgtcttaatttggagcaataaaaacagaaaaagaaaatatgaggcaaatgaaaattggtaaaaaatttatctccttttgatcgatttttcaagtttctccttccctgtatatattttaagtgaaactaatttcaaaattacatgaaatacaacatgtaaaggtaaatcatttatggttcataacctatctgtcttcatcttcttttacaggcaggttgaattatcattcactgtgctttccaatgaagataattgtgtaccctggaaaaactagaaataattaacatagctgcagaggaaaattatctgactccaagttttctatttttttttcctttggtaaacttgattctggatttaagttagtactgacgcttatttgccattcagtgggcactagaagccaatgatttaatgatgacaagccatcaaaactgcaaaaatagttaaggctgccatatattgagcctttactctggggtctttattatgcatacatgtatatacacatatatgtatctatgtatatgtgtgtatgcataattttcataataattctgaggtatttttatcccagagtaaagatttaaaggaataaaaacatgaaactgaggcttatcccaatttacccaagatacatcaacaacctatcagcagaagctggatcaagtacaggtttgtcacagaatctgtacactaaatgttgattttatacttcatttctgactagtgttttaaaaacagagaccttgtcagtctgtttatttctccaaagtgtccttcaagtttaattaatgtgtctcccttaatgtgaagatgaagttatatagaaagtgtgattggatatacattcaaattacaataaatacacctaaaactgcaaataagcttgagggtgaccataatgatcattaactaattttgctactaatccatcataactaggttcaaagtaagcacaacagtcccgtcttggaaacggaatatgtgttataaaacaaagtaccaaatgaagacttataattaactgtttaaattgtgtatctttgggaacacatacatttaaggttgatgaaatattattggatctgtttatacttcagaaggaagtgacagagaaaaaaggaaagaagatgagatatagggaacaaacagaaaataggcagaccccatatattattgttttcccgagctcacagtatccacttcattaattttaagtttctgagacatgaccactttgggtttttttaaaattcacgttgtcaaaagtgaaaaataaatcaatgtcgctgtaacaaaacaagtcagaaaatgagaaaaaaaaaatgacatctttcaagatcaactgttccacagagtacagaacaagctggcagtctgcagaagatcatacattaactggcataagcactaagaaaaagaaaaagaaaccaaacctgacattcaatgtatatccaagttaggaggcaaaagaatccgttctccctggggactgatatgttgtgatatctctgtatgcagaaatttcctaaccacatccaaggtcttattttattgtgtctaccacagtaaacattttgtatctctcttgcaagagaacccacagccacaacaagtcacacagaagagtatgaataagaattggagatgtccagaaaagctgaaagtgcaattcactttcgtccatttctggacgctttgcaaaacaattcaatagtggtctttatgaacagggaaaaatgcttagaaactagataaaacttaaggaaaatgactacatataggatttcactcaaaagaccatcatttacttcatccctactacacatatcttgtttgcatttatttgaattttttttttgcttattcaacaaacctgtaccaatcatctacaatatattaaaaattttagtaggcattaaagcactacagatgcaatgataaactaaggttttacctaaagcactcagtcaagtaaaatgttgattcaaaatgttgattagtcttgaaatacaaatgtatctcagaaatctggggccaaaagctactgaatgagagttaaaaataaataaaaagcatgagataggaagcagagaactttggaactggaggtaaagataaaaaataagaagtgagaaacaaaactatttacaggaggatcctagaacagatggaattgattaagaaaaggagcaggtattggaaagtaaagcagggacagctgaacagacatcactgggagatagagaaaaaagatataagaatgagacaaaaaagagagaaggtaagtgaaagagacataatgatgcattaacagagacatgataaatatggtagaacaaatgaggtagaaagaatatgaaataaagaaaaagatgaagaaaaggaaatattgattgggcataagacattttgaaacaaaaaacatcctaccaaaatgttaaactagcaagattatcagctccaatccccaaggtaaactgcagagtattacagagggaaccccactttaggaagaaaataatgaagagctttctggggtacatgaggtaagttagaggaacgggggtagttgtttaattggtttatctgaaatagtggctctaggttggaacaaaggcagaccagcatagctatgggaagataaaatagaggttgttgacattctttcttgcttctactctaccattgtctagggataagtaatacttgttcctacaacagcaattcagatctacactgcaaatatcagcaggagaaggaaaaggtggcttagggtagttcctatgccattctgtctcttcaaatctcagggctggaaattccaatccaaaaaatgtttccttctaattctgctcctatttgatgggctagggattgagccctcccctgagaaatagttctactggataaggcatgcggaaggtggttttccaaggccaggttctcttgtatggctcatttgacacccctcctccaaagttcatctggcccccagtttgacacattgcctaccatagtggacaatgagcccaggagaaaacgggatcacagatctaaaagctaagccatttgagaaaaaaactattttgaaataaaaaatatgaaccgtattaaagcttccatcaaaggctgaaattagaacaggtacatcagaattcaaaacaatctcactaagtgtactcaaactgataaaagattatattaaattaggaaagaaaaaagaacaatgaaatatagttttaaaagaaccaagtggaagcacttggtatgaacaaaattgttaaaatgagaactacaacagataggaaaaatattaatagtaaattaccacagatgagaaacaaattagcaatttgaaaataaaattgtagaactgtccaagaaggaaaaggaaacatgacataaaaaataaagttaaaatataaggaagacagaacaaaagtacaggtttccagaagacaggagttccagagagggaatatataaaagtcaagagaagaaaatatttgaaaaaaataaattctctgtgattaagaaaaagatgaaaaggagatgtaatgggcccatagagtaccagagtttaaaataaactcataactataataaaaagcattgactattaatgacaaaaaatttgcagttaccttaataatttcaagaatgaaagagcagagcatatacataggaatcagaacactgaataagagaaaacaatgggggtaatattttcttgaaaataaataattttgaaccaagaattttatatctggccaaactattactcaaataggagatacagatttaaaaatattctcagccatacaaagcttcaaaattttgccacataaaggcccacaagtaaacagtcttggatatttaagaaaaaagaaaaataaatataaatactgcaggaaatacatgaagtaaaagtgaataaacacctaggtaatgtttgttgtaatttttttttaattgctaataccaagggaaagaaaaacagaaaagatagtgataaaatccccagagtaggtaattatcagcataatgggacagaaaaaaaactaagaaatgtgagagctttctaaaattcttgtctcactagtgggaagttataaatcttaacttttatttaaaagaaaaagatttaaaagaaataaagcgggctaattcctctaaaagttgactagataaggtaaatagatgctcccattgagagccaccagagaacttggagaaaatatgtattttaaatgtcttaaaagatattacagagctcaaaaggcagttagcaaatacagggccaagactcagcagaagaagaaaacacaaaaaggtgaactgggcatttgacaccatttttagcctgggaagcctctgctaacttgggaagagtgtgggtctggaaggctgcgaggcccagcagagccttcaataatttggggcccagatgaccagagactatccagtccagggcccaccaagaaaagtggggtggctaatccatcccatgatttggatttgcaaccaagagaatttaagaaagttctaagagaacctagaaaagtctaagaatgaacccaaatggactggaccacggaaagaccaaagcccagataagtcatttcaactcttacttgaaataaggtaatccctactttcaaacaggactcattgctagtccttcttgtctttagccaaaagcaaactttaaatcatctgatgaaagacaaaattaacctaggcttcaaaacgtctttgcaattttttacatacactatccagcaaacaatacaaataatcgaatgtgtagttagagctcaacatgatcataaaatgagaagaacaaacaaaaatagaaaaacacccagacgggatgctatagagttattagacacagaatcattgaaagaataaatataaaaaaatatagtcagtataaggcaatgttaatgataatctaataataattttgtgattaaagatacagataaccaaaatggacaatcccagaagaagagaaacctgcgcaacaggacaaagttgtgacattctcaagtcctaatatttctgggaaaacagaaaagtaaaaatttatattaagctctaataaagtaagtatgcaggctctaaggtcattgttgaaaaagtaaaatgagtattaatgacaaagaaaattaagaacaattgaaaaaacaaaaataatcagcccaaaagaaaataggaagagagaaaagacagcaaaacagacttgaaacaaataggaaggtaacaagatgacagatataaacacatcatctgtctctctatttcactgggaatcacattatttgtaaacagactaaaaactgcaaacaaaaggataggacaggattctctgacaggatttaagtttttaaaagaaaaggagtgcaacaatttctgcttacaggagaaatgtttaaaatttaaaaatacagaaactctgaaaggaaacctctatataccacacaactatcagtcaatagaaagttcgtagagttacatattacatataatcatatatataaatatatattacatataatagtgtatagtacatatactatatataagtagtctttaaggtaaaatttattactggagatatggagataaagtagaaaacttcacagcatataaaaattctaaacttatttgcacttaataatgtagtcttgcaatacattaagcaaaaattaatataccatgtataaatgtgaaatctaatccagagatacataaaatgagaaatgggaaatgtgtaagtacaaaatcacagtgagagattttaaaacacatttgtcagtaattacatttataagaagaaaaaatcagtagatacaaaatatttgagcaatataacaaacaaaattaacctcattgatgtaaatagaacactgaacgtaacaactacagaatacattttcttttcaagcaagcgcaagtgtaccatttaccaaaattaaccatctgctgggccataaagcacgtctcaacaatattaaaaaaggaaatcatgcatattgtcttctctccacagtgaaagcaaacctagaaatcagcatcaaaagttaactgacaaactctcagctgttcagaagttaagacttgtatttttaaataacctacaggtcaaacaagaaaccacattggaaattagaaaaaaattaactgaataaaaacagaaatgtgatgcatgaaaatttttgagatggaattatagccatagccatgcttaaagaaaaatgtgtaactgtagatgtatatattagtttctggaaaatatcgctaagcaacttaagaaagtttgctgtcattagtttgctaacagattttttaatggcagtattgtcaaatgtcaaaattttccagcctctatatacataatcatatttttttaccattaatctactgatgataataacaggttgcttgatgctgaccatttcctgtattcctggataaacacttgagtggtcaagatgtaacaatttttaatacattgttgtatttgatttgtcaatgccatatttagaatttctcataaatgagactggcttacaatattgctttccctttgtgtattttatttattttaaactttcctttccccagtttgtgattaagttaataatgatctcttaaaatgactttttctgtgctctggaatagttctggagtatttcaatcttttcttttaaaggctgttgtatctttcaggtcatctgagtttggtaacagagatggatgataaatatcaagtgtcattatgtacctaagtctgtttctggattcgctatactgttctattggtctgtttgtatgttcttgggcaggtatttcattgtcttaatatacttacataacaactgtgcattacatctaattaatgcacagttttccaatccatgaatataatataaacatatctttccatttatttacagacttctttgtttttgtataataatgtggagtctcatacatcttttaaaaaacctattcctaagtgttagctatttgtgataatagtagatgataatatctactattttatttctgattctatgtaccagatgtataaaaaaagatttttgaccttatatatagcagtattactaaatttacttgatatttctttctttctttttttttttttttttaattgaaagagagtatcactcttgttgcccaggctgcagtgcaatggcgtaatctcagctcactgcaacctccgcctcccgggttcaagcgattctcctgcctcagcctcccaagtagctgggattacaggtgcctgccaccatgaccagctaattttttctatttttagtagattcagggtttcaccatgttggtcaggctgctctcgaactcctgacctcaggcgatctgcccacctcagccttccaaagttttgggattacaggcatgagtcaccatgcccagccaaattcacttaatatttctaatattttattggattttctatgtataaaaatcacatatcttacaaataaaaatagttttgattctcccatgggtaggcctttctttctcactatctacttacctaacttcctttcacagtctccctctctctacctcttcctctctccctctcaacccacttgctcaggtcttcaagatgctattgaccccttggagggttcataatggacattttatcttgttagtaacctcagaggggaaagtgctcaatattttatattgtgatgttagctgtctgttttttaaaagacttttatcaaattaaaattacttccttctattcctagtttactgagacttttagccatgaataaatattgaattttatccgatgccttttcagcctctattaaaatggccatgttgttttttctcctttattctgttaatgtggtgaattacattggttaattttgcacatcaaacttaacttgtgttcctgtataaaacacaatttgtcatcatgtagtcttctttttcatatctttggatttcattttctaatatttaatgtggaatgtttctacaatcatgggacacaatggacttcaattttttctttaaatttttggaagaattaattagtgaagtcactgagatctgatgatttccgtaagcagaagttttaaattgaaaactctcgattttttacaaatcatattttctttttcttatgtgagtcttaatacatttttttcaaaaattttacttactttgcctaagttgtgaaacttatttttatttacatgatctgaagaaattctaaaagttttaagtctttgaatttaagatttgctttgttgccccatgtaaaatctatttataaaatgttctcattgtaccaaaacaaaacctttcactttgtgatcatttggctagtgctttatatatacaactatgtaaattttgatcattattatttttaagatttccttatttaaatgttctgtaaaatttatttttattcatatgatctgaagaggcccatatttatgagtccttttaattcaatattttcattttaataaaacaactcaggatttatatccaaaggtttaaaaagcttgtttgaaaacttattagaaatgttgaacgtttatactgtatattcatgaatggaatattagatattaatattatgggttttaattaacataggaaacattttataatgggaagtgaatgcaataaatatgtgtgtgtgtatttgtaatgaagtgagaaatggaagtaaaacaaaaaatgtctacaattaccacgtctacaaagagcaccatttcttcctcatatttttctgtattttttgctctggaagtattaaattattatattatatatatataatatggttatatattaatgtactgtttattttctgtcatattaattgtgtatgcatgttactaatttatgttaatatataatttacacatattatataataaatgtgtaatattataatgcaataatataggtgagtgcatatatgttatatatgtatatctcccttactcaatataaagatttatttgtattcaagagctctaaatccatcaaatctttccaaattaacaacactgtcatttaaaaattttgcccttttcaccaacgagcatagaattaggttgtagagagtagccactgtattagtctgttctcgcactgctataaagaactacctgagactggtaatttatgaagaaaagatgtttaattgactcacagctcctcaggctatacaagaagcatcactggggaggcctcaggaaacttacaatcatgtcagagcaaagatgaagcaagaatcttcttcacatggcagagcaggaggaacaggcgaaggaggaagggctacacacttttaaacaaccagatctcatgagaactcactaccacaagaatagcaaggggaaaatcgcccccgtgatccaatcacctcctaccaggtccctccccaaacattggggattacgattcaatgtgcgatttgagtggaaacacagagccaaaccatatcagccacaattcacatacacttagaacattgcaaagacaacattgtatgctcatcgcagtccagcctgatatcctttccaataaaatgactcaagatttatatccagtggtttataaagatcaaaaacattgcttctcccagaaaaatatctcgtaaaagaaatcaggcatttactgcaaagccttcttcctcagaggcactgaagatgatgccttatgcaacaaagctcatctagcagcctcagcaaggagaagcagccttgaaaccacagtaagtagatctgagattctcatgagatttagtcacattccaaactcattagagaaatggaagcatatacagagttataagaaaaaaaattctgtacagaaggtacgaattctttctattctatagtagcatcagaataaattgttttggttcataacgactaaaatataaaataaccaaataattatttccacttaatcattcaaactatgttcagatacatattttcactcttggaagtataaagccatatccaaaggaatattcattattaattttacacctttcttgaaataaatctcagaaatctctatacagctcaaaatcaacatcacaaacttttgttctcttacagcctgtgcacatagcttgacagttcttcagcttccaaatttgcagaaccagcacttcaaaatgagaggtaataaatccaccagagaccctccaagaaaagcccattcctcacccaaagcaaagccaagaaaagtatcatggtgaccccaggagtacacactctagtcaagacagatgtttttctcatagtcctaattttaagagaacaagtatctatttacaataaaaaaaaaaaaataagacatgaagcaaccatccaaataagctcagcaaaaattaggcttgtgttttctttagcctgtactttccagatggccatttcattcattcacctattgtaatgatagggcttaatttaaaacccaatttagaaaggatacactaatatacaataaacagacataccaatgaaacataattatgaaaatatataaagcatatttacaaaggatatactattcaaacactagggaggagacaagtagttggaaaacaaatttgaattcctgcattatagaacatatcaaatggataaaaaatctaattttaaaacatatgaagtattaaagggaaatccagatcattcattttataaatctgaagtgaagaaagcctatctaagcatgacaccatttaatgatagaagaaaagataggtttgactacaccataaacagtctctagaacaaaatcttcatcctaaaaaataaatctaattagtaaattcgctaattaaatattttattagaaatatctttataccaaataatatttgacatgtttcaaaaatatatatcaatatttcaccgttaaaaatatctacataagaaaataatagaaataaaacaggttgaagatgaaatgaattgtgaatgaagtcacaaaaccataccaacagatactaacttaatatggactacatacattgctttgtcctaagctctcttctatttaaacactcccacctgaaatatatttcctactctaaattatctcaaatctctactatgatttaacaggacttaacacttgtaagaggtccaagatgacacacacctaaaaacttatgtctacatccttatgacaaattcaattttggtcaatatggtagcacccttttaaaacatgtttcatatgggttttgatctataatggattctttctaaactaatatctactgggggagagtgagagcatttataatatacttagagaaaaatatcaatattttcaactatatgaggtggaataagaaaaattgctaggatagatcagaataattttcaacgcatatttcaattgcgaataactggacaattctaaaatacttagaagtgccccaaacgttctgggcatttggtttttttctatgtgtatttttataatgaaataatacaaacaaattatataaaaatggggaaaataaggagaaattatatataattccaccacatatacgaaccaatgtcaaacattttatttattttcttccaacattgttctcatttgtatctgcctgggtctaagaattttaacatctactctgcaatcttgtttataatttcctctatgagaaaaaggattttctaagctagcaccagctctatcagagtaatcaccaattctaaatcagaaaaagtccaaggtaatgagattttaccatatcacagagaaaatcttgggcacccaaagtgtaatactcttgtatagtaaatgcctcagagaatgtgtttaacctatgacattggggttaaaatagttaacaaaaaaatgtaattaagacctcctattacatggccctttttttcttcttttgcttcttagcactatttctggctattttttaaagaaacatttcttatcaggcagcttcacagactagcaacttacccagggccaatccaaaaagtaactcttatgttttagattcagtttcttctttctgtttgcctatttttaggtagcatgatatatgaagaatgtaaacctttttaaaatttgtataggctgaaaaatcaaaggtaattatctacaagtcttctgaaacttgtgggcacttaaacagattcagtcatctgtgtacgagatctgcacataactagtagtgacattttacaaatgcaactggtccaaatgttataaaaactgatcgtaaggctgtgttagtaaaatattcaacttagtgtgagagaaatatcatgttttttcccacataaaatatagttatacttctccaatacatgaggaactctatgcaatttctgactgagtaggaaaacgcatatttcttataaaattgctactgttttctacccttccatcataatttcacatgcacacacacatggaaattgtttaaattgaattaatttgcatctatgttttctggaagtttgactccccccaattttactttatttaattaatgtcatagtgttatcaacaaattagatgaaaatttttttctcttaagaataaaataattctaaaacttgctgtcttatcttaaagacataaaccctgattgatttgaaaactcaatcaagtgaacacacaaaagctgaattagaacaccaaggcaggtatacttataccataaccagttatgcaaatcaaagatgtcctcacgaacatctcatattctttattctaatcactgtatatcagactacgcagagaagccctgacagatgctgtaattacatttcacaaggagttgccaggacaaagacatggtacagtatggcaacagcttcacagaagttaatagccctggttccaccactgactatctgtacaagtgatcttgaaatagtccttcaacttttgggctgtgagtctatgaaaagtactaacatgacacagatccagaaactattcaaacaaaatcaaaaaataaaaaaaaaaaaagtgcatcaagggttctgaaaaatgaaaagccctgtgacttcaaatgctttctggataagctttctcaagtagtagtagatggagcggaaattttctgatttgcaagcaacgctcaaaatgaaatggcttgccaatttttttcaggggatgggtggtgggggacatttatcgtcttccgattccaggcagacaagcagatgaaattccttccacagcacttcttatctcgacccaagtgcttctctttattttttctttctttctttatttttctaaaatcacttttacttcaagctttgttttctccaacttgtcctatgaagaaaacaaaggttgaagtaaaagtgattttagaaaaataaaagtggttgaggttccgattctgacctgtgcggaataacagggagaggaggggtgagcacagtacagacagggagtctttccatgatggtccccacctcaggtattttcctgatgtttcagagggttactcttaataagccatcctcacctcaaaaaaaagaaacaaaaaaacgacggtgtgaagtagtcagttcttcactgcagaattattcatgacaaaaatggaaaaaccaacaatccaattttctgttcttcattcactgagattcagtgggcagtagtgtttcgcagaaagtacttcagaaaatatgaagataatttcctcatattccataccatcaattagtttctatttcaaaatggattttcctgccctccaaaaaaagtcagttctcatttactttaatctctttatagttgtccttcctctttagctagaaagtatttccttgatgttaggtatctgccaacttggacagctaaagaccaaagctggcagagatacatcattgtcatctctatgtttcattttcccagaacccagcatggggaaaaaaataaaaaataaaaacctattttcacatgcaactgacactagctcagttgctgagattagctcgtgagtgtgggggaaacgtgtaccagttccctttcatatatgtatcctttttatcctcttccatctgcaactcaatggatagaaaatgtgatgggttggagaaatctgttcattctggtaaaactgtctggaggtgtcaaggctaagaatagtcataggctgacattaaatagtagggacacatgctgagctggctcacccaaagctggtgtctacagcagcacgctaaattagaattcagatgggagacattttttagaatattcttgggtctgattactcaaggacatttcaatttagagatgcaatgtggcccctgggggtatgaattcccatgagccaggctgattcaggtgctcttaagaattatctttaaaccagaacacagaatagacaactatcataataaccttcttcctatcattcagtaagggtattctctctgaacacagaggcaggatgcacacagggcaagcaggttaagcaataaagcaaatctaaaagaaactataatgctttctgaggttatggaacaattctgtcctttgaagatttccagcttgcagatttgtctctctgagagcttagctgattcaaatcttggcaacatccaaattcagcctagattgaatatatgtctaaatctgtgacaccataaatgtcacaattatggcaaaaatatccatttcctttggaaaccatgtttcacttccagtcattgctcctttaaatgaattgcacatgtttagacttagatgccccagtggttaaactgatagatataaaaaaggacaggtcactctttcagtcctatttgagaaacaatttgtagatataaccgttcttctactctgaagtttttttctgagttctctattaaaaagagatctttcctatgccttcactttttaccaaactgctatttaagtctgttttctttcacaaactaccaaacaagtttcttcaaagagatgtgttaattcacatacttgtggggcaaggagccttaggcttgagagctcatgtggcattcaagtacataaccctgcctccaggcaggaccctgccaaaaacctatcaaaagaatggaaagtgcaacccgccttctagagctggaggaaagaaattttcagtgattccaatgtttagacaccccatgttgctatctacatgcctaaaagggattcctcccatcttgttatttaaaactcttacttcacatttttttcaccatagagtggaaacacatttgctaataaacctctgatagtcacgctatttcatagatgtgacttcaaacaatccctattcctttagttccccccttataagctcgcatattattcagtcgacatcactgctttgtgcccttatattgctatggcaagaactagaaaaaatacattcttgtaagcaaataaacgacattctgggctcatccactcattcaacaaacattcactgaaagctcctaggagttggagtagttccaggaactgaaattaaagcagtacacaaaacagataaaatccctacccttttgaaatgcacagtcaatctagtgagggaagatagaccatcaacaaagtatgcagtaaaagaaaataaatacaaatatagatagatggatgtttttaaaattgaaggcaaagtcaatagaagtacacatttaggagacaaaattagtagtttgggtttagaaatatggtttgagaagccttttgggtatttccattagatttttcaagtaggcagttggatataagtttgcagacttgggaggagatatctgcctaagagatataaattttggagttaccagatgactcaattttcacttatgattaacttgttcataccatatattttgcaacaaggctccagtcatttgcatttcaacctatcttctttctccctacttctttaactttcagctgaagcacctgcttcattttctcaattgtttttcaaattttctaatacaacttgatacatatatacctgactatatttaatcactaagcttaaggggaaaatttaccttcttctcccagttcgtatttttaccaaaaactatcaagtgttgactttgtgccttgaattgtgttaagcatttcctatgtaacatgtcacttaattatccaaaacccttacaaaataggtattactatgatctacattctgttgatatataaatttaaaaacagagacattaagcaagttgtctcaggtgaaacagccactgtcgtaaacataatggtatatcagatgcacagcccggcaataagtgaacatgttacccaacaccaggcaatttcaatctttgagatatatatatgtgtgtgtgtatatatatatatatatatacacacacacatatatcataaattttatgtatataataaaatgaaaataaacattttattatatttatgtatatatgtatatatttacatacatatgtatttttgtatatatttacatacttattatatgtacataaatatgtatataatgtatgtatatacatgtataatgtatataaatatgtatataacgtatgtatatacatgcataatgtatatgaatatgtatataagtataagcatgtatataagtgtatacatatacatatatgtatataatatgtatatatttgtatacataaatttatataaatacatatatatatttttccagtctactaaaatccattgagagccctttgaatgtgatacaaacatctaaaaactgtgttcaagataagcaggcatattaaagatgagtgccatattctctccaccatgataagttgttatactataaaataactgtgggcctttttagtattctactggaagaatctaaaacttaagggcaaataactacaaagattaaaatgctttttcccaattctgtcataaacttgtaattagatagcatcacttctctaagaatgataaaaaatagttatcacatatttaaaaagtaagatatatagtcaactaaaaagaaatctaaaatgaagagcaattaagtgtttcacccaaggttgtacataaaattaagggagtttaaataaacacaggtgttttgcctgaaatcctttttttctatgctgctgtgtgtgtgtgtgtgtgtgtgtgtgtgtgctatttaacttagattgtgcaatgagacagaacactatgagaactaaattagccttaccctctcaaagtcaacattatcctttctgttccttgcctatttcagccctgaaagaagcctgaaaaacaaggtttttctaaaattgattaatttgtgaaacttctaccatataacaaaattatttggagcatgaagtaactgtttcttcttccattatatcttacatattttttcataaaataaatgcacatattatgcaattcccctaaattattataatgtttagaatttctcgatcactaggctcttcactgtgaggacaacttcctggaagatttacatataaggaggtcattttgaaatgtcagtagctaatccctttggatgatttctaagacataccagccttatgatgaattttgctctgtcatgaatagactctcagaatatagcaaggttgggtgtaatatatccccatttcaagatatggaaacagacgaactgagacttaactttcacatgataactaggaccaaaaaattcttcttcaagctgtgagaagtctgaaaggaaattgattgtgggaataaagtgtattctagagaaataatgttatgaatgtagcctacaataatttatgagtgatttataatttcaagtgtttttgttacatattctaatatttggtcctgagaataacctgatgatgtagggaagtgagatattattaggttcaaactacagatgaggagactgaagctaaaagagatctttcctatgccttcactttttaccaaactgctatttaagtctgttttctttcacaaactatcaaacaagtttcttcaaagagatgtgttaattcacatacttgtggggcaaggagccttaggcttgtgagctcatgggcattcaagtacataaccctgcctccaggcaggaccctgccaaaagaatactcttggtcccctaagaagcaggccacaagataggattaaaacttcaagagatttattggcagagggaaaaggagaagtggggagagacttcagaatgcaatacaagtatgacagttatggaaagagagaatgaaggaaagaggcttgagtaggtatttcttgcaatagtgactacagcacagttgcaagaaagtttcagccagatgatataatgtcctcaagctaaataacttcattggaagagcaagtccaccatctttctggaatgggtccaccttaatacccccaccatgcttagtcattggctgagagcagccaataggaagaataacctctaagtgaacacagtggtgaacccagagggcacacgcggggaatgtcaattacttcctcacatcaggagatcttgagcagcacattttcataactgccacagtctcttctgattaccaaaataataagtaaaaatggtaggcccaaaagttcactgacatctagcagaatattttataagcctttaatgtgaatgacacatgatacttaatattttttggcaactagatttgtgatcattgaatacagttatatgcaacaatttgttagattctacttttgaagccaaatctataatatttatgcatagaagcacaaagttgtagagtgaatctgctaatattattcagctgcatggaaactggtacaagaggggggaaaaatcaactcctgaaatgtttgaaaaactatcaatggattagttttgctactagatgcctctcagtacatactgtgatacaaatatttttaaggttcactaggtgaaattttgatagatgcgtaacattctacagcctatttactttcacctgtctgtctaagtgaacatacctaaataaattatttaaaatcaaaacctcattcctcacaagaaatagtagacatagttatcaagtattatctgtttaatgcattgcaagaaaactttcattttcccctaaaaccgactctagaaataaatcattccttcaaagcacatatgaaaaaactgaggtcaagagactttaacaacttgcttaagatctaacagagaatggtaatttctggatttgaatttggctccattgcctatcaagaaaaggtgcaacacatctaataaaaatagagattatactatggctttacacacacccatttgattgtttaaacaatagtccctagacttgattgatacaaagattcttttaaaagtggaccatcaagaagtgatatattagaagtgatacatttagaagtgatacattaccatattatctttgtaacaaagaagaatcatttttcctatttcttacctatccctgtttctgattaaatagcgtggtaagaatttctctgagaattacggatgaaaaagtatcctatcaattatatttttgtttggaccatttcttgggaaattccagaataaaaatcatataattttttaatctaatgaaataaaaaatttctctatgcacaaacatgtagaaagttcagccaaaaaaaaaaaaaatcaaacgtaatcatgcagttattctaccatgacacaatatccatatcattgtatgtacttgttttctgtgcctaaaacactcttttccatacctctgccatcgaaataagtccttaagactaggttcaaattttccatttttttccctgtgaagccttctgcactatcccccagcctacccttccttagcacatctcaaatgttgcttgaccctgtgcagtaccccagctccttgtatggtacccccaatgtagctgtcatcacactgcagtgcacatatttatttgactgccatcagcgattgccaaagaattcctctatgtttggtgcctgacaaatgtctgtggtataaaagcaaggcgacatggtggaaagcagatgacgcagtgaaatcaactactgatcttaaaaattctaataaagtgatgcctatttatatctaaacttcatatttcctcctccaagtgtaatcatatgatttgataaggaaaaagtgatgttgatgttttgttcagatttatgttgatgtaaccatcaaaagcaaacaatagagcataatatcacaattacattatattctcaggatgatattcaaaataaatagctggatggataaagtacgcaaaaagtgtattagtatatttataataattagcctaaagaattatgccaaataattaccaaaattttgaaaaatattgactgatattttatgtgaacagaaacatagcaaatgacatactgaacataacttcagtgttaaataagctttcctctttgcactaatcttaaaattctgttgtcttaatgtgtccaaacacagtatactatttcaatttcatctactaaacaaaattgaccaactgcattataactcttctgtaaattgtaatacagtgttattaattttatggacttgcaatagaacaatataatcttgtttcatctggtttagtattgtacagtttatgcatcagtatcttttatcagactataaacctcttgaccttagccctccttataatgtccccaaaaggtagcccaatatcttctacataacagacataaatacatacttatcaaattcaattataacataaaaattgaaacagaaaataaatatcttgaaagcaaatgaagaaaaatcaatttgctggttcctttatgacaactgtaatgctactattatgtcttaatatagtcatacaatggtttcatcatttctgtccatcaccaaaaagcattcatttatagagcattaagcttgtctgagtattatatgttatacaactagagacattgtagacaaaattgctgtgtcctgcattcgaataatatcctcgcagaagaacaaagcaacctggtcactaggaaaaatcaaatcacaaatatttctgggaatgaaaagagggaaaattatttatattaatacatgaaaaaacataactcaatgcagttgtaagtttatatattccaaatgtgtttgtatggagaacagattgtcatatggttaaaaaaaactagattgctacatattaggaaaaaaatgcagagatggataaggcaaatctacccatcgttatttatctatgtaaactcctacgtgccatttcatctctcagatccattccccttttccatggaggcctagagcacagactatttatatgaaataaatagaataatgtgtatgaaactcatgtgaactctaaacctgaatacacataagctattattatatcatgtttataaatcccacacaaatgcataaacatacagtatttatagagaattaaaacattcattgtaggactatgtgcattccacaagtagcaccatgtaccaacagattgctgtcacattgcatttgtatctgtaagcgttagtgccattttcgcatacctgttaagcaatcttccgttattactttgcaacacatcatttatgtttctctctttactaacataagaccattatcttgccattcagcaacgacaggtgattcatcctagattccaaatgacatcttcttgacacagggtgttaaaaaaaaaaaaaaaaaaaacttttttttttggacatattttacctgtgctttagattcctttccaaacaaaaactcacaaaatatatttggtagcacaaaccagcagggactcattaaatcctttcaaagggtaaaagacaataacatttcatcatcaattacttgtatattttaccactggagatttctacatgaaaagtccaaaatggtagaagcttggcataaaggagagaggagaggcaaggaatggaaaaacttcataaacttaatcaaacaaaataaacttctgacttgttttttcagttgtcatcaggaaggattagaatgtcaaaaaggcaaaaagtatttttatgcagtgtgacggttaatactgactgtcaacttgtttggattaaaggatgccaaggattgatccaggttgtgtctatgagggtgtcgccaaaggaggttaacatttgagtcagtgggctggagaagacagacccacccttaatctggtggtcacaatctaatcagctgccagcaaatataaagcaggcagaaaaatgtgaaaaggtgagactagccgagccacccagcctacacctttctcctgtgctggatgcttactgccctcaaacatcagactccaagttcttcagttttgagactcagaccagctctccttgctcttcagcttgctgtgggatgttatgattgtataagttaatacttaataaactcatatatatatatatatatcctgttatttctgtccctctgggaaaccctgactaatacatcagcaactgatattagtgctcttactttctgtctcatatcaagacttaagtgaattttttacttctaatttgacattaatattttattatcaattataactaactggtattgaatacttactatgtattaaccattatatcatctcatttaatcatgaaaacaaccttatacagcaagtagaagtaggtaagcaaatcttaggtcatatagagaattacaaaagactgtagatttgaatgtaaatgcatttgaatccaaagcatctgcttttcatagccacttcatttggtttgttaaaacaaaatgaaaacattaagtcaaacaaaggctggaaattaacacatagggaatcaattatcaaatctcctttattgaagcctttcttggggaaggggcacctgttaatgccattcctttgtaaaagtttacctaataaatattcttaaacttggtgtatgcaaagtcactaattataaggatatctatgtgtggagaaagacacaaatgtgaacaaatacgatacaagactgatttgagcacaaagatggctcaactgcctgatgaaactaaggagagatttgacttaaaaatataatacagaaaagagttttgaagggaaggtttccagagacatgaattaggaagggaagttttgacagagcagaagacatttaagggagaaggaacggttcacattaaaaggactggaggtgtgagaaatcagagtgcatgtaaagagcagaacatgaaggtcccacaaaaggaaatacatggacatgggatttaaaagacatatagagctaaatcatggtcctgtgtgtcatgcaaaatatttggaatttaggttttaggaagaaatggagctattgaaggattttcaatcaggcgatgaatgaaacagacttgcatttgagatacattatttagcccttagtctaaaagtagatttaatgggattaaagctgcagacagagaggcaaggaggccaaagttgcccaaagcagattagattttaaaaatggataaattattaaacgtctgagagatctaaaataaaggcttttattttgttttatattagcttcttagcctatgaaggataattttctaaccaattattgccttgccaccttgttattgaaattttatttctaatgccaaaatgacaatgatttcaggtacaaactcatactcatgttgttctttttaccaattaataagataaaaatcttctttgctattataacttacagctgaaaaacatgtttcatagaataaggctttaatttcctatgctatttaataaaagaatacttagatttgatatcctgagaatactgcaatagagagacactatgtactatttttactgttgagggcaaatacaataataaagattattatttttttctgagtcggtgtctcactctgttgcccagattggagtgcagtggcatgatttcggctcactgcaacctccacctcctgggttcaagtgattctcctgcctcagcctcctgagtagctgggattacaggagcctgccatcatgccctactaatttttgcatttttagtaaagacagggtttctccatgaatttttaaataatgagtttgtgcccactgaaaaccaattcagaaataggaatataaaaaattttacgggtgtttaaatgagaaagaatactaagaaaatttgactatcatgtagtagaaaatacaataagtgtaaaacctcaaaagaagtggtatggtagcaccaactgtacaattcctgtcatcatatgtactaagtagaaggttatcagtagatatacaattaaaaaactttttattacatcttgatagtaatggattttgtgatacacccatcaaattgatagatccctcaaaataattgtttgatgactaaaatatcattagtacttcaaatgataatgacaatacagaccattctgtaaatactggtttattacatttagagtcagaaggatttcgtggacaataaataaaacatgaaacttgattttttttaacgttaagttcttggatatatatgcaaaatgtgcaggtttgttacataggtatacacatgccatggtggcttgctgttcccatcaatccgtcatctacattaggtatttctcctaatgctatccctcccctagtcccctacccaccgacaggccccggtgtgtgatgttcccctccccgtgtccttgtgttctcattgttcaactcccatttatgagtgagaacatgtggtgtttggttttctgtttctgtgttagtttgctgagaatgatggtttccagcttcatccatgtccctgcaaaggacatgaactcatccttttctacggctgcatagtattccatggagtatatgtgccacattttctttatccaatctatcactgatgggcatttgggttggttccaagtctttgctattgtgaatagcacaataaacatacgtgtgcatgtgtctttatagtagaatgacttataatcctttcagtatataatgggattgctgggtcaaatggtatttctagttctagatccttgaggaatcaccacactgtcttccacaatggttgaactaatttacgctcccaccaatggtgtaaatctaacttgagttcctatgttccctatgcgggaaaaaagaaatcgttaacagtaaataatgttgtcttaaatgctattattttgctattttgtttgcatttaatttctaaatttattttggggcctaattagaaaatataagcactaggaatttatgcctaatgttatgtaatgtgatgataaaaataatattaaataaacactggggactttctggctattctttcctacaaaaggacacatatattgttgatgtttaagatacatggacttgcatgaggaatgatgagtgtttaaactaagatacttagggaagttttgggaatactcctgtattattacttagaatattggatagattcattcatttattctagcaaatatatctctcattggccacccatagttcatcagctaatattttcaagagtgatctcttgaaacagtgatcaagagtgatcacaaagtggatcttagccagtgttgctccagatttgtattcctaggttgcttttgaaaccccaagttattttaagctcaagggaatatttttatcattttcctctatatcagtgaaaaacttacctaccagtcactatctcctttaagatattaaaaatacaaaaggtagatggcctacaacagccttcaggtaagttgaaatatttaccaagcctaacactttctccaatcttgaatcatctaggaaggtatacaggtaggcaagcacagaaaatcacagttctttcttattcactgagcaaaaatgagaattctgcttagataaacaaatgcttgtctcaaaaattgatttagaagtgtatgagggaacttcaaatagttcatgaaaaatggaaataaaaaatataaactttatttctcaacataagcttcatgatagtcaagacacatttttgagtgatgatatcagccatttggtccatcctaaaataactaagagtttaaccattttaatgacattttgaatgttattatctgaaaaatgtctagtgccctctgtagattttttaagattaagaaaccaaaggaggcagaaatagccaaattaggactgtaaggtagctgtctaatgacttcccataaaaactctcacaaaatcgcccttaattaatgagaggactgaccaggagaattgtcctggtggagtctttggtgaagccttcccaggcatttttctactaaatctttggctaactttctcaaaacactctcataataagcagatgttatcattctttggccttccataaagtcaacaaccagaatgccttgagcatgccaataactagtatcatgacctttgctcttgactggtacacttttgctttgactagaccatgccatctcttagtagtcattgctttgatcatgttttgtcttcaggatcatactggtaaagccatattatatctcctattatgattatttgaagagatgcttcaggatcttgatcccacttgaaatctccattgagagctccactcttgtctgctgattttggagcaatggttttggcaccatagagtagaaaggttgctcaactttaatttttcagtcagaattgtataagctgaacccgttgagatgtctttggtgttggctatcactaatcattcatcctcttcaattagggcatgaacaagataaatttttccttgcaagtttatgtggatgatgtgctgctgcaagcttcatcttcaacttcgtttcaccctttctgaaattgagttattgtaaactgctgatttctctagggcattgtccctaaaaagcatcagtgatttcatcattcttctacccaagcttcaccaaaatttgatgtttgttcttgtgtcaattttagcagaattcatgttgttttgataggggctcttttcaaactgatgtcttatctttcttggtgccttaaactaagttctgttcagacatgtgacaacaaattcatactagtttttttttttggtgcaaaaaaaagttgtgaattccatgcataattttttcaggatatgcattttcaatgaaatttttaaaggcctctcatgtgctaatattgaacttatgtcatggttatattaaaaatgtattgccaaatagaatattaaattattcgggtacaaattatttgctttttcattttactaaataatgtgtgctttgataagcatttctaattgtaagaaaggaaaaaagaagagagtgaggaattaataaaaagaaaaaaggtagagaaaaaggaaaggaaacaggagaaagaaggaagaggaggagggagaagagagagaatgccacatatcaggaaggggggacattcttaaagctagacataaacatggtataaaactgtaataatataaaatccccatcttcatttttgaactggcagaagaaagataagggcagtgatgtgcttcaagttatcgacttgagacatttttttggagctcttagtcaaacttatcccagttacttcatttgttacttgctcttgacatctctgttttcagttttttaatgataaaaattggacattaaaaaaaatcgaactcacaggaagctgagaggattaagagagttaatgtacctaaaacaactcaaacaacacctgccctagatgtggtgagtactaaatttgtgcttatcattaccattatatgattcattgagcacccactgtgaacaagtacaccatcccggtgactgagctcagtttactagaaaactggcaatcaatgctgctaccctccagggacaagacacactgctttggaaccaacagtgtgatgaaacattttatagggtagctccagttgaactaattatcacccacacccatctgtgccatttggttccctgccaaaattgtatgtgttctggtgcaaatatgggcatatttgttcatagatttgctctcacgtggttgttcccaggggcttatctgaagagtaacagcatcagaatctcctgggaaacttctgaaaaatataaattcctaggttccatccccaatgaatatagatcttgagtctttgaagattgcacaaaaatgctatctgtatgtatatagctcatccttagacacagagaatgcagcataatggagaacattccaatctacttgctgaagaatacgcaaaacagacttgagcattattcagttagaaaagaaaagactctgtatcattgtatgattcgcagggcactgcctgacccaagtatcaagtgatagcaactgtttgtaaaagctctccagccagacagactgggttgacatttgcccctccactcagcagctgtgtggtactgggcaagttatgtaagctctctatgcctctgactcctcatatgtaagacagttattataatcacaggttatctcattggttgttgaaacaattaaggggaaaaatgtaaaatacttgaaacattatctggcatgcaggatataaccaataaatgttggttattcttgttaatatcaggtattatatagtctaaatccacaacatataatgaatgaatgcttgagtattaaggtatcccattctattctacttactttctcagtaattcattaaattagaagtccttttttgcagctgttccttaaagtaagtttttcaaaaaagttaatggaaaataacatttcagtagatcaggaagaaatctttttgatgccataaatattctttataaattggtacgttttagtatcacataagacataattatttagtaaataccgagcatttattacaggtgatttcaaaaagtacaaagaaaagcacaagagaaatatatctacaggggtgaagacagaagcaaaaatcagaggaaagtaaaaaattaatcagtaagtgactctttagcattaattccattttgcccatgtagatttgtattaaaaacaaaaaaagagagtaaataaattcatctgtttgctaaaagtatatacacataaagtcctattcatgcatgcctagtagttccaaaaaattcacagatacccattgctaatacagaaaattcataagttagtcgctgcctaagttaactaaagtgaatcagaaatctggagttacttctatgagattatatttattctgtatgaaatattcttcccaaatgccctctacacttcaggctcataaattattaatgagtgttatggttgttagaggacaatgtatggaaatttacccagattccaaaatcctaaacaaaaacaaatgattaaaaatgaaaggcagagaagaaagaaaacaattatattggtttggtgagagttgaaacatttattctactccatcagcactgattttaaagatctgaatgacaacaaaatgatgaataattcagatttcatttattagtccactgaccctacacatggcttcacaaaaatgaaaacaatgtttttctcctgcttcatcctccatagaatggatatgtgtatgtagctgggtggaatttttttgatgtcatatgctcccgtatattgtatacacatatatttgcatatcatatatttagaagaaatgttgagataaaaatatttttaaaacatgtataaaggagaacattttgccccctactggccaatgactttggtctgcataaaacaatgctgatgatcatgcaacgactgcttacctggcaactagaaaccagacactgtagcaatacggttctatgtcctcagtctgggattgacatacacacaaaaagaattgtcacggatgcatctgcagggctatattctagaagattatgagttttttcccatggcctcccatctccactataagaacataaagctaccacactaaatcttctagcttaggatttacaatagttggtgatgctattaaacaggacaaagattccaggaaaatgaacatatttctcgagggtaagataaattaaataaggtcattcttcgagcaggttgaatgtgacaaatctttgggttatcaatgagagtctactaggaaattggaaaaatttgctggtatgatttgggcagggagggaattattaacagtttatgttgttcttgtcattcatttgaaagtcacttatctccgataatattaggtaatctattattacctttgtttgtaggtactatctcaccatcttcttaactccacttagtcaaagttcaataaatgttttccaacaaattatataacagagtattcaaattaaagtttttgcttgtgatcctgtgaaaattgatactaaatgtcaaaggaatttgcaatatcgtcttactctgtaagactttcaaaaataggtatatgaaaaatatctataagactcttggtataagagacctctcaccttcattataggtataaaagggccaggagtgaaaatttatgaagaattatgcgtgatacttcttttgtttgttttttttggagatggtggaactctgggctccattagcccccactggatgaggtttggggggtggtactgccttaaaacttagggagagagcttaatatatgccttctacagtttttggatactaatgaactattaattaggaggctggcctaagatcttgtgatggtaaattagactagagagctgtggcttataaataactgcactctcagaatttgttaaaaccaaggatctgcaaatattttctgaggttcagacatggcctatatcgatagcagagagaaagctggtggtgggcttgccataccctaccaatagggcacgtaaagggtgaaaacacacatcaacagcaaaatgtttaaggcattccagattcccagaaactgagaaaggagtaagaaagaagctgaagatgactttgccatcctcaaaagtacaccccaagtgagagttctcacaagataaaagtgtatgcctatgggatatgcctaattcagaaagtgtcaaaactagatggccagaactctaccagataacaaagttccaactctctctagctcatcaccttcccagcttccacgccaaagaagtcatcatttttttattcacaagacaagaaagaataagtagaatggtgagctaaaggaaacatatctggcatctttccctagcagcagtcttcctatttacaataggcttacactaggagaaaaaaaagagaacacggtggagaaaactgtaattagagaattgggattttattctgcaacttaaggttactctacacctttatattataattcctggaagtgaatagacaagtcttgctgcctgcccaaattttcattcagggtcatgggcaaaagtagccccactaagcagaggtaaggagactagaagagaccaaagaaattgctttaagattgtgtcctatgagttgtgcttgtgcaatattccagttacaatgataacctcctaacatggtcggaagtcagaggatgcttgagtgatccagcctgtggtccgctcactcctatcttctgcactatctgtctgttgggattcaatcaggctggtgggaaaaacattagagataattatagaaataaacacaaagcttcttggaaggccaagaagttttgataacttctgtaatagatctgcaggtcccattacctttagttaagggaatatagagtagtttatctagctagcttgttcactcatgtggtcttaagattaacctttgatgtaccacgggtgcttaagtgccttttacttgggaagtccacaatgtcaattactctccaatggtgttgactcaagcttttgttagttaaacttactgaataaatgcaaatctccctagctcatggaggccaactgcagtgacaaacttctcttggtgtgtaggtggtcagacactcagcaggactggcaaaacagaacatctgtgtgtcagtgtacgttttattcatccatcgtttgggtcagggtctgcgggcagacgcccgcagctaatgccctcttgtgaggagcaatacctcatctatgttaattacacaacctttgcccacacacgtcaaagatgatacaagatgagtattttgtgagtgtgtctgttccactgttatcagttctaattttgaaaaattaaaaaatgctttagtgaatgtaagtatacttccctaaactttccatcatgttgccctaattctgccttttctagttacacagaataaattaagtgtctctttcctatgatagctcctagggttctcgaaaagaaccattattatagacttgttttctcagcctactcttctccacaccaaacaactccagtttctactgctcctgggagttcttttcaccacttcctgagacaaggtgtctgcatgttaggaagcattccacctctccttaagatttatgagcaacacgtgttcttcaactatgaactataatggacatcttcataattagatattggtgtactttccaaatataagctttttgataaagtggtgaatttttgaagttagtagtcagatatttgacttaattctgagagctagctgctattctcccatttctcagttgcccgtgtggaggggcttcctagagtagtgctccttgcctcttgcctatcccttgcttatgcatcctcaaaggatgtgagctaccaagttcatgagtaaccaccattgctccactgtttatagcaataaccttcttaaacattttgagcaattgggattaactctctccgctctcttcttgataccaagaagagacaataatttcaatagaccgtaattttatctagggtaacctgtcccaagaagcaatcagcaatgggagagagggcaggagaagagtaggcaggaagaaatgggagccaggaaatagcatttcatagtcatttttaagctatattctccaaacagtgttaccctcattaactaggatatttttattattgtcacaattagtggtgaagaaaaaaatgaatgcaatttatgccctcaaatttgaatacctggttctctgattaggtacccaggaaaaagaaaaagacaatgagttgtgtttgaagagcacttacagactttgacttcaataaacttggttacatggaactttgacattgactgtcacagctaattatggctagaatctgtaagcggagcgtatttttaatagggtggggtgtttggataattcaagttatgaaggcatcagtgtgtggtctccagcaactgatttggaaaaatagaggtgtggcttgtatctaagcaggcacagctgaggcaaagttttaattagagagaaaagaaagtttttatgtagacaggctttttaagcattgggaaagaataatttttattccttttttgtttctctgtgtgatttgcaaacaaggaagtcaggactgcaaaggcagttgagacctacctttactatagagcactaagactctagtttcaaactgttagttgcagactgagatgtaaagtaccatatcagctgtcccaaagtccctcttgctgagacaaaggagaataagatatgggcaagagtgaattttagactttaatttatttggtcttttaatgcaaaaattcaataaaatttgatttgggactttgaagacttggtctgcaatttctaagggcttaaacttgtaacatactctgtgaactttaatatctctttggaaaattcataataagaatgaatttatataacaattatgagtacctctaaattgtaggccttaaataattggtataacttaatgctgtcataaattcattacgtaaaacctatgttgagctattgtggactacatgtctggaaattttgcaacgataatcaaagagggagtgaactttcagccctgaatatagtgaggcattgataagatttaatcaatatgttgttctaacctatttctgagatttctggagacaaaatgtgcaccaataagcaacagttcaaagacaattcagagggggacaattgttagagacacttcactcaaatagaagccggacttgcccaggcttaatatttcagataactggattaagacaaccaaaagcaaaagaaattcgtggaaaatgactcagggaagaaacatttaacccccatttcttcagtctccatgtggagtcaccttgctgaagcaatatatttgaatactttccaacttccttcttgtccttttataccagaggagtacgatacctcgttggtgaaagatggccattggtcaacctttctcagttcctaggatctgatctactaaaaagcaaaaacatcaataatttggtctcttttatttcctctctgcctgtggccaaagaaaaagtgacactggataaatccatctactctgcagaaccaaaacgtccttcaggtgggctatttgtatagctagactgggagaagaaaaggagagaggattcgtaacataatctgatccttatatctgagccacattcttcaaaataaacaaacaaaaattaagaaaatgtgtcagcagacatacagtaaaagaaataataaaggaaattcttcgggcagaagataaatgacctccagagaaaaacatggaaatttaggaataaataacaaatattagaaatgtaaactgcatgggatacaataaatttaaaatgtataatcaaaatacataacaacacaaatggtgggcaataagtggtagatgaagttaaagtgtgtcaaggtcctagcattatcaaggaagtggtcaaagcaatcattttcatttgactacaataaacaaagatacaatgtgtaattgccagattaaccagcaaagcaacaggagaaaaacaaaacaagaccaagagtttctaataatttacagaggaaaatagactgataaaaaataccaaataaagaagacaagaaagaacaaaaaaaaaggcaacataaaacaggtgacctaaatagagacaaatatcataatgttaggaaaaataaacatgcctagaagtagataaaatactcaggcaaaaaatctcattgttagacaggatgtaaaaacaaaactcattacattatgcttctaagaaaactacctgaaatatacagatgtcaagaagttaaaaataaaaagataaaaaagaatataccatggaaacattaaccaataggcttctaaagctatagctcaaatagatttaagacaataaatgaggtggagggagacatttctcaatgataaagagatacggtagaccaggaagatattataatcctaaatatatgtgtatcaaacaatatattttaaattacatattaagctaaatttcatagaactaaaaagaatacacaaattttaataaaattatctcaatcactgatagaatgagttgccaaaaatcagtaagaaaatggaaaaacacaacatcaaaaatacaacaatataattgataaacacaacctatagaactttcacccaacaataatacccatttttcttcaggtgcaatatttactaaaattgatcctactctgtgtcataaagcaaatcccagaaaatgtcaaaggattaaaataattcagggtttgttttctaaacacagttgaagaaacctaaaaacaaataactggaaagtaactagaaattcccaaaagccattcactgaatcctaggccaagtaaaaaagacaacagaaattagaaaatcttttgaactgagtcataatgaaaacatgaacacatgaaagctagttggatgcatctaaagaatgattggggccgggcgcggtggctcacgcctgtaatcccagcactgtgggaggccgaggcgggtggatcatgaggtcaggagatcgagaccatcctggctaacaaggtgaaaccccgtctctactaaaaatacaaaaaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtcccacctgggcgacagagcgagactccgtctcaaaaaaaaaaaaaaaaaaaaaaaaaaaaaaaaaaaaaaaaaaaaaaagaatgattggatgaatttctttagccttaaatgaatacattagaaagtgaagaacaagtaaaagttaattaagcctctgatatctccaagcctccaaatctcatgttgaattgtaatcctagtgttgtaggtggggtctggaaggaggtggttagagtatgggggcagatttccccactggtgctgttcttgtgatagctagtgagttctcatgagatctggtagtttaaaagcatatgatgtcttcccctttcttctcttttcctcctgctccagctatatgaaatgccttcttcagctttgccttacaccatgattggaagtttcctaagacttccccagaagcagaagctgacatgcttcctgtacaggctgaagaaccatgagccgattaaacctcttttctttataaattacccagtcacaggtatgtctttatagcagtgtaagaatagactaatacaggaaattggtactgaggagtgaggcattgttatacaaatacctgaaaatgtagaagcagctttgggattgggtaacaggcagaagctacaagtgtgtggagggcacaaaagaagacaggaagatgagggacaatttggaacttcctagggacttgttaaattgttgtgaccaaaatgctgatagtgacatgaaaagggatggacaggctgatgaagtctcagatggagatgagaaaattattaagaagtagagcaaaggccacctttgttatgctttagcaaagagcctggctgcattatgcccctgctctagggatccgcagaactttgaacttgagagtgatgatttaggatatctggtagaagaaatttctaaatagcaaagtgttcaaaattttgcctggctgctttcaacagcctataatcctatgtgtgagcaaagaaatgacatgaaattggaactcatattttaaaaagaagcaaagtgtataagtttggcaaattcgcagcctggtcatggagtagaaaagaaaagcccattttcaggggaggaattcatatgggctgcagaaatgtgcataggtaaaaggaagacaagtactgatagccaaatcaatgggagagagctttgaaggcattttagagatcttcatggcagctcctcccatcataggcccaggggtctaggagggaagaatggtttcctgggccaggtccagggctccactgttctgcatagtcttgggacactgctgcttgcatcttggctgctcaaactccagccatggcccaaaggggcccaggtacaccttaggcctgtacctgcttcagagggtgcaagccataagtcttggcactttttacatggtattaagccagtgggtgcacagagttcaagagttgaggtatgggagcttccacatagatttcagaggatgtatggaaaagcctggatgtacaggcagaagccagattcagggatggagccctcagaaagaacctcttctagagtagtctggagggaaaatgtggtgttggagcccccacacagagtccctaccggggcactacctggaggagctgttaaagagggccaccatactccagaacccaaaatggtagatctaccggcagcttgtactctgtgcctggaaaagccgcaggcactcaacccagcctgtgagagcagccatggggcctgaaccctggaaagccatgggggcagaatggcccaagggtttgggagcccatcccttgcatcagtatgtcctggatgtgagagatggagtcaaaagagattattttggatctttaagatttaattactgtcctgctatgttttgggcccacgtgtggcctgcggctgctttcttttggatgatttctcccattttggatggaaatatttacccaatgcctgtacctccattgtatgtggaaagtaactgacttgttttttttactttatatgctcatagatgaaagggactagccttgtctcagatgagacattaaactttggacttttgagttaatgcaagaatgagttatgattttggggtaactattgggaagtcatgattgcattttgaaatgtaagaaggacatgagatctaggagaggccaggggtggagtgatttggtttggctgtgtgtccctgcgaaaatctcatgttgaattgtaatcaattcaaccaacaccagtgttggaggtgggcctggtgggaggtgatcgtataatggtggcagatttccccattggtgctgttttcatgtagtgagttcttgcaagatctggttgtttaaaagtgcgctgcacctcccccttccttctctcttcctacttttttgggcatgtgaaatgtcttctcctgctttaaattccaccaggattgtaagttccctgagaccttcccagaagcagaagtgacgatgcttcctgtgtagcctatggagctatgagccaattaaacctcttttttttttataaatcacgtagtctctggtatttctttatagcagtgcaagaacgaactaatataaattccatattgagtaactagaaaaagacatctgaacaaatccaaataaagtagaacaaataaaataagaaacagtaagaaatcatgaagtagtaaatgaaataaagaaaaatcaccaaagccaaaagttgtattttttaaaagattggtaaagttaatgaacaatgtagacagctgattaagaaaaaaaagaaataaaacattaatgtctaatatcaggaatgaaaacttaacctcactacagaagctagagaaatttaaaagatagtaagtgggtattttttttaaaaatctatatcaacaaatttgacagtaaaggtgaaataaatttgttggtaaactgataaaagagcaaatagaaaatctaaataatcctatcataaagagtctgaatattaataaaaacttttccaaaaagaaaaaattaccagtccagattgcttttatgttgaatttatatatgtatgtgtgtgtgtgtgtgtgtgtgtgtgtgtgtatttaatttagacagtcttcaagacgataaaactcattttatagtgctagaagaatgctgacaaaataacatgacgaaggcaacgaaagaaaggcaaaattaagaatgatgtctgtcataagtgtagaggcaaaaacaaaacattagcaattggaatttaatgacacagaaaaaaatgtaatacattatggccaagtgtggtttattgcagtaatgtcaaaatgttttagcactaaaaaaaatcaatacaattcaccacaataaagaaaaaatggaggaaatgatgattacctaggtagatgtagaaaagcacttaaaatttaacacaagatttttttcctaattctattaaacaaggaacagaagaaaatttactagatgtgatgaagagaatctaaaagtaacttacagtaacatcatatttaatgatgaatttttcaacactttacaggagcaaaaaaagaaagaaaaaggatgtctttatcatagtttctgattaactttacacttgaagtcctaaccagggcaaaacgttaagaaaatgagcattagatggaagagaataacacacatttttacaaattgcaagtttattttttaaaatccaaaagacacctcaaaccaatagaactaagtattgtctttggcaaggttgttggggattgaacttgtgatcaatatgtgaaatcaatgataattcctatggataagcaataaccaaaaactgaaattttgaaaaaatattaattaaatcaatgcaaataaattgatccaacaacagacacagaagacctcacctgcaaaaaatctaaaataaatctaaaattgacgagctgattcaaaaacatatatggaaaataaaagactaagaatagcaaagcgatgttgaaaaagaatatggctaaacatttacccaaatatgaaggcttgttataatgtgagcgcaagacagacagtgtactcttactgaaaggagagaaaaatagatcaatagaatacaatacaacaatgggaaacactcatacaagagacagaagaggtagtatagaaacattcacacatatgtgttgctcttatttctatcaagcatgttgctatagtgcagtaaggaaaaggtgaccttttgaacaaattgttctgggtcagttggctatctgtatgctagttattaaatcaatccttacattaaacctagctatcaattccggatggattgtgaaagatataatgacataaattttagaaaaaagtactatattttcacaaacttgcacaagctaagatttctcaatcaagacacatagagcattaattataaaaggaaaatgataaattagactaaatcaaaattttgaagttttatttactgacaccattaaaagaggcaaaatcatgccacaaagtaagattatttataagacgtaaactgacgaagactaatatataaaaatatataagtcagctaggaaaatggcagaaatgtggaaaagcctttacaaaagagtatacatgaatggtaataagcatatggaacagtgctaaatatcattattcgtaagagaaagttaaaataaaaccacaagcaaactttacatatttatggctaattaatttacaacaagggtgccaagacaattcaataggtaaagaatagtcttttcaataaacggtgctgtaacaactagatatttatatgcaaaagtataaaattggaatcctaccaaatactatataaagaaatcaattcaaaacggatcaaagacctaaaagtacaacaaaactcttaagacaaaaacacatacaaatcttcatgacctttgattagacacagtttttaagataccaactgcccaagtaatcatactaaaatttgataaattagactccatcaaaattaaaaacatttgtgcagcaaaggacaccatcaagaaagttaaaagacaacccagagaataggagaaaatatttgcaaatcatacatctgataaaggtttaggattcagaatatatacaaaacaattgtgattcaacaataacaggacaaataacccacttattaaatgggtaaaggatttgaacagacatttctccaaagaagatatacaaatgggaaataaacacatgaaaaaatactcaacatcaccagccattaggaaaatgcaaatcaaaaccacaatgagataccacttcatacccactatgataactataacaacaaaaaagcatcagtggggacagatttgagagactggaatgctcctacattgatgggaagaatgtaaaataccatagccactttggaaacagtccggcagttcctcgaaaaattcaatatcaactacatgactcagtaattccattctttgctatacagctaagacagctgaaaacaaacatccacacaagaacttatacatgaatgttcacagcaacattattcataataaccaaaaatggaaacaaaccaaatgtctattaatggatgaatggataaataacatatgatttaaccatgtaatgaaatattattcatccataaaaaggaatgaaatactgattaatgatagatacaacagggaagaacctggaaaacattatgctaagtgaaagaagcgaaacacaaaaggccacaaattgtatgattccacttatacaaaatgcctaacataggcaagttcataaagacagaaagttctttattattttctaagttctgggagtaaagggaaatggggagtaactgctaatgggtacaagtttctttttggagtgatgaaaatgttctggaattagatcatgataatggctgcacaatactgtgagtatactaaaaaaaaaaccctgaataactcattttaaaggcttaatttcatgatatttaaattatatctcactttttaaaatagaaaataagatcaccatcatgctgtcatatgaccatcatcagaatgaatgaaattaaaaagacaacaaattgttgctacaattttggaccaacagaacttctcacacacttttggtgggcatgtaaattgaagaaatcgcattgaaaactcttttctatttccactaaagctgaaaatatgcaaaacctatgattttgcagttatctccttggcgtatacactatagaaatatgtatgtatgttcacataattcatataatgtatgttacaagtatgtttacatcagtgctacttgtaaaatccccaaactataaacaacccaaatgtccacctatagtagaatggattaaaactactgtggcagtgttcatacaatgaagtgctatgcaacagtgaggatgaacaaattattgctacatgcaacaacatggatgaatctcacaaacgtaatgctgagtaagataagtcatacccaaaagaatacaaactatggccgagcacggtggcttacgcctgtaatccaagcactttgggaagctgaggcaggcagaccatgaggtcaggggttcaagaccagcctgaccaacatagtgaaacctcctatctatcctaaaaatacagaaattaaccaggtgtgctggcacacacctgtagtcccagctactcaggaagctgaggcaggagaatcgcttgaacccaggaggcggaggtggcagtgagccaagatcgcgccactgcactggagacttgagcctgggtgacagagacagactccgtctcaaaaaaaaaaaaaatatatatatatatatgtgtatatatatatgtgtatatatatatgtgtgtgtgtatatatatatatatatatatatatatatatacacacacacacgcatatatgatcccattaatataaacttcagaaacaaaagacttctctaaagcattagaagccaggatacttttggggcaaatggcagtggaaaaagcacagcataagagaccttctgaggctctggtaatgttctattttgatctgggtgctggttacaagagtgggttcactttatgaaaatttttgagttatatatgaaaatcattgagccatctgaaggtgtattatacttcaatttacaaagtttatgctaaaagtaaagagtcaagagagaaaaatcatcataatgtataaatacttaatgtatgttaaaactagcatttcaaatcacttgataaaatttttagagtgcaaaaaacaataatacagctttatgtggaaatccattaatgacttctctccaaattcaagaacaattgatgattagcttcaaatattcataagaatattttccatatttttcctatgtcctgtttgactctttcattgctatggtcaatacattccatatcaatggccttctccagatacaaactttgcaagcctccaaacagaaaatgagaattagaaatttttcttagtgaatctatgatggttcctgagaattaccacagtcttttctagattttctcaatagtttaaaatatctaggaaaactgagatcaagttttacttacctatagtcttaagaatctatattagtactcatctgacaaagggctaatatccagaatctacaatgaactcaaacaaatttacaagaaaaaaacaaacaaccccatcaaaaagtgggcgaaggacacaaacagacacttctcaaaagaagacatttatgcagccaaaagacacatgaaaaaatgctcatcatcactggccatcagggaaatgcaaatcaaaaccacaatgagataccatctcacaccagttagaatggcagtcattaaaaagtcaggaaacaacaggtgctggagaggatgtggagaaataggaacacttttacactgttggtggcactgtaaactagttcaaccattgtggaagtcagtgtggcgattcctcagggatctagaactagaaataccatttgacccagccatcccattactgggtatatacccaaaggactataaatcatgctgctctaaagacacatgcacacgtctgtttattgcggcattattcacaatagcaaagacttggaaccaagccaaatgtccaacaatgatagactggattaagaaaatgtggcacatatacaccatggaatactatgcagccataaaaaaggatgagttcatgtcctttgtagggacatggatgaagctggaaaccatcattctcagcaaactatcgcaaggacaaaaaaccaaacaccgcaagttctcactcacaggtgggaattggacaatgagaacacatggacacaggaaggggaacaacacactctggggactgttgtggggtggggggatgggggagggatagcattaggagagatacctaatgctaaatgatgagttaatgggtacagcacaccagcatgacacatgtatacatatgtaactaacctgcacattgtgcacatgtaccctaaaacttaaagtataataataataaaataaaaaaaaaattttaaattaacaaaaagaatctatgttatactgtttaaaaaattggaaaagggttaattgatctccagtttcaggagatgtcttagtccattttctgttgcttataacagaatatctgaaactgggtaatttacttaaaaaagaattttttcttataggtatggaggctgtgaagtctaagatcagggtactgcctctggtgagtgtcttcttgctattgaagactctctgctgagtcccaaggtgacaaagggcatcacatagttagagggctgagtgtgctagttcaggtttcccttcttcttataaagtcatcagttcctctctcatgataacccagtaatccattaacccattaattaatgatgtattaattcctgaatggattaatccatttgtgagggcaaaaccctcatggcccaatcacctctcaaaggcctcattctcaatactgctacattggagattaaattgcaacataagttttggagaagacaaacattcaaaccatatcaggggatattcccatgatttctcaaatagttcagcattattccatgtcaatgtatatatttgcaaaagaatttaaaatttcatttaatcccagtttttattatcaactacttctgatcattgatgcttacaataaaataaataattttgatatttgtaatattacaaactgtgtatctccttacggggagaaaaaaattcgttttattagctactaaatcttttacgtttgttaagagtccacaagatttttcgaggctgaattcaattccaattccctgccttcacattaaagtctacataaactgctccatatgaatagttatttaatattttattacagcttttaattttactatcccctcagtaacttatttccctgcttacaaaccttatggtcaagaaattcttcccaacagcaaatataaattttccattctggtttcctagcattaaaagacttattaaattttccttacctccaccctgacccattcttctctaacaaaaccacaatcttttacattctcccttccatttctaatgccatcttttgtcatgcattagctagtaccatataagctgctgcaataaaagaacatagagtatttgctaaaataatcaattaggatcagaaagctgggttcagactaacctttactgcaactgtaatcataattaaatttcataacctctatcagcctcactttcctgatctgaaaaatagaaataacaacagtatccacttcataaatttattgtgaagattatatgatatggaatatgaagtaagccaatgccttcttacactaagagctcaataaatagtgttgttataattgttatcgtagtagtagtttctgcttacaaataaatgaaacagctaggttaacccaaaaaatgggagaatagggcagagaatatgcatgatgcttggtggaagaactcaagaaataatcctttgtagttacaataataaataatgcttagcagactgcttatagttataataataaataatgcttagcagacacacagcagttagggtcactgaggggccacagcagctggggctccgcactgttcagcataaagggcacacaaccccaaagctgctctaactctccactccaaatttcaaattcctaggagagaatgccgaattactccaactagattcaggatatgtattactcttgggtcaataagcaaagaacagaaggccacaggtatcaccaatagagatacactcctgtgtatgaaaccaacatcaagaaagagggtattggatcaacatttttagatttcacataagagtgagatcatgcagtattttctctttctttccctgaaatagctattaagtgttctctccacaaaaatgataattatgtgaggtgatgcatatgttaatattgcgtaggtttagccattccactatgtatgtatgtatgtatgtatgtatgtgtgtatgtatgtatgtaaatcatgttgtacatgataaacacatacaattttatctgtcaattcacaaaataatgtttttgaaaagaaaaaaacaaaagaaagtgggtattgggcggccataccccttggtgttgttttctatcactgatagcgctactatagcagcagctactactgctcctgtaatttctcctactgctgttactgctacacctccttttattattattagcaagccactttagtccttcatctagaattgatgagaagacagtaaacaaaataaaaatccttgccctgcaaatcacagaggtttggaaattgtgactgctgcccactatgataccacaaggaaagaaaaaagtcacgttgaaagatatttatttagaggaattttaacttcatcaatttaaagatataatcctattcccagacatataataagaataacttccagaatccctcagcaaacttgaaacaagaaaatataacaataacagctttcaaatacttttactatgccctgtaatttgtacattattttttactttaccaaacacactctaaaaaatattaaatttacacatcatttctgcctcaacttggcaaagtattgcaaagtacatatttataaagcaagattcaattaaaatagatttaaattatctaattttgactaaattccttatttaaataattattgatttagccaagtaaactgccatggatactgtattttgttagttattaccaaacatattcaggctttcaaaagtaaacaacacaccttataattaggcaatatgaaattaatatgaatggtctagcattatcgttactatttcccctaattgaaaggcagctagctagtatactaaggaaaaaggaatgaagtttttaaaagtattggaaaaagaaggagtctatgactgaatagaattatttttatggattaatctaatttgctaagcacagtagcaaaataaagagcaggtgaataagaaatgcacaatccatgcaatgttttgaatgtttttgtcctctctaaaactcatgtgttggaaacttaagccccaatgcaacagtgaggtgaggcctaatgggaggtgggcaggtcaggagggttctgtccttatgaaaggattcatgaacctattttctactgcagaagcggcttccaggagtgggttctctctctctctctctcttgctcttctgtcatgtgaggacacaaagttcctccccttgggaggatgcagtattcaaggcaccagcttggaagcagagacaaggtcctaaattgtgcaacaaaaataacaaagattttctttacatctaattagacataaaggctagaacaatgttcttgtgaaaggatgcttttaagatgcttttttggaattgaaatagtaacaacatttgtttttttgtgataaacacataccaaacctgatggtgacttgatcttgaagttctcagcctccagaaccaaaagaaatacatttctattctttataaattacccagcctatggtattttgttatagaagcaccaaatggactagaaaaactgagtgtgtgttagagtaataggaaaaagcattgactttgcagccaaataaccctgagcacaatcctaactctgccacttatttgtcaattcaagaaccagtttcaaaatttatttgatccccagtttcttcacctgggaataggcacgttagaatctaacttaattatttctctgagaagacaatatacagaaataaaaaataagggtctagcatggagcacagcacacaataaatcattagttcacttatttcttaaattacccttacagatgcacaaaatttaagttccattcaaatattacttaaattttttcttcaaatagatcaagcttagcatccatttgattccaataaaaggaatgccaattacataaagataaagacttaacaacacagattagtcaagggttttattcaaggctgaatggaagccttcggtcaagtcagaaaaaaagcctaggtctcttgacttttagctatgtgctaaaatgtactctgccttacctctaggtgacatctgttccagagtttttggatgcttgccatatagtagccatactacccacacttgaatatcagagcagcaacaaatacaactaggtagaaagtcaaagatattcaccacgtttggaaaagaatatgttgcttgtgtcaaaaactaaattaaaacggtaagcaaagagaacaaacagcacactgagaaaaggaatctcaataggggatttttatcttggtggggtgaggagggtggtggaggtggagattgcacacatgaaaaagaaaaaaaaatccactggtgtaatttaccttgcaaatacagtataagtcagtcacctctccattctgatgtctttacttactatccccatcccatccagactcaacagaatagtttagttacaactaaagaagccaatagattcatggcatgttctagtagaaaacatacaaaatgagaaatggagagaaacctaggctgttttcccaaaaatatttatggaaaccacactacaatgttcctgaagaaacaaaaagaagaagaaaaggaagattactgtgaggtgaaaggaatcaggacaaagatgaaagaaaaataagcatagaaaagaaaggcctttcacaggatttgtactgcacatgtgcacttattttattcagaagaatgttgctacagaacccagcaggggtaaactattatttatctctggttattagccaagtctaaattgtgtaacaaaaataacaaaagattttctttatatctaattagacataaaggctagaacaatgttcttgtgaaaggatgcttttaagatgcttttttggaattgaaatagtaacaacatttgttttgtgtggtaaacagaagccttttggcagtgcagttgctttcattttgaaactgccaagaattatttgcttatctgtggaatttcaactactttccctgcctgtgagtcatattgatgctgatctagaataaacaggactgcacagaacactgggtcttactgtggtctttgggcaatttcctcccacccttgcccaacacacaggggcaggcattcacagtacgccactaggagagggtaaaagaagtggaaaagagagaagataatgcaaagggagagaaagaagagacacacaaaagcatgataaaaaaagaaaattcaacaagggagggaaggacatgagagaaaaggaagagaaatgtcagagaggatgacagaagtcctagagacataaagaagcagaaaagaaaagtgtcaaaaaaccaaaataataaaaagaaaaaagaaggtggaaaagggagaaatgtgagagggttaggtagatagagcaagaattcagaaagtacagggaataacagtgaaaaagtgggaagaagcttggaaagacttcatggagcaggaatagcctaatataatttggaagggactgcagagttgtctaaataataatgctatttgacagtttgatatgtatttatagctgattccagctttctctgaatattatataggattatccagattttctggggtttatcaccacaggcatgtaggattaacagcctgatgaagtgaacaattatttttcaatctgatccttaggcttgtagagcacttttcccaagttccctgaacatagtacataaaatgcaataaccaatggaaaactgtgtgcatgtgtgtacatgtgatgagtgtgtacacatttatctatcaacatctaaaattcttcgatctgggcttaaaatctacaaaagtactaggttcagaaaaatgccttaaagtagcaagtgttattgttcacctatgatgtgtcagacaaagggaattaagtgggaaaaaaaataggagacagagtccctgtctcatagtgctcagagtccagaatgtagggtatgtggtaagtggtatgtcagagatagtgcagagctacaggaagcatgtaaccagagacccagcttagtacaagtgggaatatctgtttgaaaacttaaaaatgattgaaaactaaccaggtaaaaatggaaaggggttagggatgttgcaaggaaacaggaggatgttcaaggcagaacagagcaaaggaatgatctctttgctttacagtacgtctttttctatgtctgtgatcacaaaatataatgacagtgttgagacagaatgttgtgctggaaggagagacacatcatgaaaagacttgcagatctgctatggatctagggttttataatcagggcaattcaaacattgtctgggagagggcaggcttgagaaaggaaaaagaaaaaaaaagaaagaaaagttgttcagtaagggattaccaatacaacattttatcttctaaatactactctttgaaaagtagatgagaagtggaaaagactggtgtcaagaaatccagttaaggagctcttataataacacatacagtagaagaaccaaggtagtggcagtgaggtgagagcgaggaatttggattcctgaaatactaatttgcagaatcaatgggatttggtgattgctacatttggagaagtaaggaatcaaaaagtgaatagcaagtcaagaagttataggaatttcaaattctttgacatcaagaaacatgaattcttagcaacagttttggttgattgaactgtactgtgtactcctgtgtcttctgagtttctctttatgtagatatacgttcattaaacaaattcaacaaagacttattgaacgaatagttaaactcatgagtgattgcaagggaatgaataaatgaataaatacaggcacaaatgaaagaacaaatgaatgagaggaaaatcaaggaaacaaagagtcaatgaacatatgaaagatttcctcatcagcaaggatggtaaatcatatactcaaaatagagcctcctagttttaggaaatctagaactcaagatgctaaatggggtgcaaaaataaaatgcacaacaaaaacagcctaatgaagcttcattctcaatagatgcagaaaaagttttcaataaaattcaatatcttttcatgaataaaaaaagaccttcaacagactaaatatcaaaagaatatgcctcaaaacaataagggccatctatgacaaacccacagccaacatcacactgaaaacgcaagagttggaaccattccccttgagaactggaataagacaaggaggcccactctcaccattcctattcaacatcacactggaaatgctagccagagcaatcaggcaagagaaagaaacagaagacatccaaacagaaaaagaagatgtcaagctatcactcttcactgacaatcttattctatacctaaaaaaccctaaagattccacccaaaaggatcttagaactgatgagtgactttagtaatgttgtaagatacaaaatcaatgtacaaaaatcagtagaattgatataccaataatattcaagctgagagtcaaatcaagagcacagccccatttacaatagccatgaaaaagtgaaatatctaggaatacagctaaccaaggaggtaaaagatctctacaagaacaactgtaaaacactgctgaaagaacttagacacaacacaaataaattgaaaaacattccatgctcacggactggaagaatcaacattgttaaaatgtctatactgcccaaagtgatttacagattcagtgctaatcctatcaaacaaacaaagtcattttttacaaaattagaaaaatctattctaaaattcatatggaaccaaaaaagagcccaaatagccaaagcaactctaagcaaaaagaagaaacacaaagaacaaagccaggggcattacactacctaacttcaaactatactacaaggctacagtaaccaacacagcatggtactggtagaagagacacatagaccaatggaacagaatagagaacccagatataaagccacaaacctacaaccatctgatctttgacaaagtcaacaaaacaagccatgaggaaaggactccctattcaataaatggtgctgggataactggctaactctatacaaaagaatgaaactggacccttacccttcaccatacacaaaaattaactcaagatagattaaggacttaaacataagttctcaaattataaaaattctagaagaaaacctaggaaataatctttctcaacatcgaccttggcaaagaatttttggctaagtcttcaaaagcaattgcaacaaaaattacaaatgagacctaattgaaccaaagagcttctgcacagcaacggaaactgtcaatagagtaaatagacaccctacagaaggggacaaaatattcacaaactatgcatccaacaaagttccaatatccagaatttgtaacttaaatgcaaaagcaaaaaacaaacaacctcatttaaaaatgcgcaaaggacatgaacagatacttctaaaaagaagatgtggccaacagaaatatgaaaaatgctcatcatcactaatcatcagagaaattcaaatcaaaaccacaatgacataccatctcacgccaatcggaatggctgttattaaaaagtcaaaaaataacatatgctagcgaggttgtagagaaaagggaacacttatattccactgttggtggaatgtaaattagttcagccactgtggaaaacagtttggatatttctgaaatctcccagtggttacccagcagttacccagagttacccagcagagttgacccagcaatccaatcactgcctatatacccagcagaaaataaatcaggccgggcacggtggctcatgctcgtaatcccagcactttgggaggctgaggcgggcggatcatgaggtcaggagatggagaccatcctggctaacattgtgaaaccccgtctctactaaaaatacaaaaaatcagctaggcgtggtggcgggcgcctgtagttccagctactcgagaggctgaggcaggagaatggcgtgaacccggcaggcggagcttgcagtgagccgaggtcacgccactgcactctagcctgggcgacagagggagattccgtctaaaaaaaaaaaaaaaaaaagaaaagaaaaagaaaaagaaagcaaatcaatttacccaaaagatacattcactctatattcatggcagcactattcacaatagcaaagatatcgaatcaacataggtgcccatcaccgtggtacaaatacaccgtggaatactacacgaccttaagaaagagcaaaactatatcctctgcagcaacatagatgcagctggaggcctaagtgaaataatgcatgaacagaaaaccaaataccgcatattctcacttataagtgactaaccattgagtacatatggacataaagatgaggataatagacactgggaactactggggagtgggggagagaaaaggaggagagatgggttacaaaaaactaccagttgggtactatgcttaccacctggatgataggatccatactccaaacctcagcatcacataatatacccatgcaacaaaccttcacatatacctcctgtatctagaagttcaaattatagaataataataacaacaaagcaaacaccatataccgtctttaaaaaaaaataaatgcagaggatttttgaaactttaaatgtaatagaaaaaaaataaggaaaaagctcattgacattggtttgagcaacgattttttgagtatgatcccaaaagcttaggccagcaaagcaacagtagacaaatgggattacatcaaagtaaaaagcttctgcacagcaaggatacaatcaacagagtgagagacaacctatgaaatgagagaatatatttgcaaaccatatacctgataaggagttaatatctatcatatatgaggaattcaaacagctcaatagtaagaaaacaaataacctgatttaaaaaatgggtaaaggaccttaatagacagttctcaaaagaagacctgcaaatggcgaacaggtatataaaaatgttcagcatcactaattatcaagaaaatgcaaattaaaaccacaatgagatatgacctcacacctgttaggatggctattaccaaaaagaagaaaaatatcaagtgttcgtgaggattttgagaacagggaacccctgtatcctgttggtgggaatataaattagtatagccactatggagaaagagtatggatgttgttcaaaaaattaaaaaagaacaaccatatgatccagcaatcccactactgggtatatattcaaaggaactgaggtcaatatgtcaaagagatatctgcagtcccatgttcactgtagcattattcacaatatccaaggtacggaatgtcctaacctaaatgtccaccaacaagtaagtagataaaacatgtggtgtatacacgcaatggaatactagacagcttaaaaagaaggaaatcttgttatttgcaataaccaacataaatgaacctagaggacattatgattggtgaactatgccaggcacagaaagatacgtatcatataatatcacttacgtgtggagcacaaaaacgtcaaactcatagaaatagagtaaaatggtggttactagaggctggggagtataggattaggaagatattggtcaaaaggcacagaattttcatgaaacaggaggcataagttcaaaaggtctattgtatatcatgttgaacacaattaataacactatattgcatattttgaaaaatgctgggaattgattttaagtgttcttgccacaaaagaataagtgaggtaatgtatgtgctaaaaagcttgatttagccattccacaatgtatacatatatcagatcatcatattgtacaccataagtatgtacaattttactagccaattaaataagagaaaaatgaatgcataagttttcatcatatataggtattgatttttccagagagatgatcagtcacaaataatggtatcctcattcatgcttttttaaaaaagccaaatgtagacttgaggctctagcaaatgagtgctgacttctatcttactgcatccttgaatgcatatacgcttactcagtgatcgtttgtaaaagacaaagcagggtgcagaatggtttcatttcacacctggaatcagctctctggggaaattttaagatcaaaacagtaaaacaaacagcaaggtccagtagaaattagttcttaacttgctgcattttaacacctctctggccatacaaatatgcccacacaggtaactagggtagagaagtggacaccacctagtgtatgctaagtaattggatcatcacctgaatgaattcttccacccttatatggtactttcaatataacttgggaaaacttctctctcattcaactcattgtcactagatttaataattcataatgtagttatctctaatgctaaaggataggatgttttggctgataacagtatcagtgtataaatccgtcagaaaagggcaaaatcttaggagctcactatggatcacaaggttatgggtccaaggtagaacaagcatgattgctctaatgcttaaactatcatgctaatttctatatataaaataatttttattaatatttctaaaatttcattatctattgctcataactcccagaaagtaatataaattttagttcctgaagaatcattagctatttaagaaaacattcaaaacacaagaacatagaaagaattttccacttatgttatgagttatttaacttctaaaaatctttttctcctcctctttaaataagaaaaattattatctctgaggctattgaaaagactgacttagcgcatgtaaatatttaacataccaacccatattatgagtgtaacaaaagctaacataatttattttttaacaatcctaactctatgggaaacaaaacagaaacactttttccaaccagttccttctaacaggccctgctggatctcctttctcatccttgatgacatctggaatgattctttcaggtttttggctgaaatgaaaatcagattttgtaactaagaattcactttcaaataatacagtctagaccaaaactgcaatttcctacccatttcaaacagtctaccctcacatcaatttatacatgatccagtcttagatacctctgcaggggaaagaaaggtccttactcttccttttctttcacttcttctgctctctttctttcatttgctccttctttccctctgttgctgcttggtcctcttcctcgtccatcatattggtactcaagagaggggattaataaaagtgctgctgtaatctgaccacttgttccctcagcatggcagatgcccgaatgccagctagctcacttaggagaacatttgtagctcttccatggagattacagtgaccttcccattgtacactttcctcaggcaagcaaaacaatatccacctgacctcttgcaacctcccactgttcattttctgctatcagcagatgctcctataacttcacgccaccagggacgctttgccctaggcaagctatcctcataggcatggctccatccaaatatcttcatcccgcttatcttatgaggtgctcagtgagcccataggaaactcatgcattcttgtcaaaccaaaagttgaatgtttcctctgcttcttatggccttcctctcttgtcctgctgtcagacatcactccacaaagattgccaactttcacattctcagagcaggagtcaaaaaatagtctctttatttaagtacactctaaaaccctcagaatgcacatcaggcacttccaagaatttcctcccttcatcctactcctgtctcaaaataaaatacacgaacaagtctctgcagctcaacacacttccagctagggtatgagatgtcatcacctcatcttgtaaccacctcaaatctctgagggattatcttggagtctccctcacttgacttgaaggtaaagaagagaagaaaaaaatactttacccttaagcctatgactccttattcacacattttttcttcattttttttatcttctgactatataggttgagtagcaggtgaatgaataattcaaaagactgtattattaagtcctagaagaggatttctcaatcacactttggacaagaactctttgttggtttgaggaggctgatctgcacactgtaagatgtttagcagtgtccctaccttctacccattagatgacagtagcatttcctccctctcaggtgtgacaaccagaaatgtctctagacattgccaaatgttctaggtggggcaatattaccccagctgagaatccctaccctagaagaatgttaactagctacagttgagcattctctttagattatggaggtattctttgtactcctcagcttccgggttttaactaaaattttaagagcaaaggtcatgtacttatattagttccccattccttatatctgtttgtctgttgattaagtggacattcattttattcactaaataaatattcatgttctgctttgtaaaagacactgcccaaggactgagtaaacagaccctgtcccatgggagattacaaggctgacgatacttgagatatcatagagacttcaacagatacacaatataataaaagtggtgactgaagatgacctgggcatcattttgcataatgaaaagaaagggaaattttgaagctacagagaaaaattagaaaacagtggccatttttaaagtaacaatgatctaagtttgacccctggcaataaagaggaacgaataaaacagaggaaatttttgaagacaacagataaaattttgtacgaggctgatagatgaaaataagaggggaaaaaaagagttcttcagtttcagtttaacgaaggggagatttatcacagttgtgctaccacttgaagatacagaattgttgggattttttacaaaactgctaggcagatgattataacaaagcaataactagttgggtttttggaatattgatagttggttagtttgaccagaggatgggctattcaaggcaattccgtatacagaaatccaggatatgggcttctccagaaaagatgcattgttcttcatctcatttttcaaggacactcttaagatatacacaaatggattggtttattcctcaattatgttttgagaaaaatagcatattaccaactcatattctcaaactagaattcaggctattccacaataaaacacaaaatttaaactgcctctctgatgactttacctaagcagaatcagcctaaagacaaaaagaaaatattttatcttcacagatcagagatataaatcttcacagaaccttaagatgacaggtattttaaaaataaagtctaattagaaatataagaagcttttctttaaaataacagggcaattggacagcacttgttaaaataatcagattctaaagatagtataaaaatataagtggccataaaattgcttagcaaaaaaatgttttatgggaatagaataagaaataagaactatttcttattcctcctatttgccccttattccactgcattttctctaactttaaatcaagagggttaaatttagaaaactatcgttctatgaaaatgaacctattatgtcatgatcccctcaaacctctgccaaccatctgcagctcccacactggttccttcattcatctccagcttttgctgacatccacaagaacacattttaggagtcctagagtcctgagttcagttctcaagtgtaccctgataagattactctgtaaactcaggtgagtacttctctacaaattaatttctttatttaaaaagtaaagatattactttccccacatggttgttatgataattaaatgagttaattaaagagtcacataatataacaaatacagagttcattttagttgttcttccccttcctttttctttctgccaagtgatttagaaataggagatatgaaagacatgctatacctactgtgtatttgccattacatatgttgaagcaatacagataaaaaagatacagaataatttgtgcaatacaatctgaacaatgtcaaatcaatttttttaaaaccatacataattatgaatattaaaaaagaatgcaaaaacatatatttattaacagtgattattttggatggtagaaaatgaatcgatatttatccctttcactgttctgtttcccaatctttatataatatttaatttcctaatgaaaaatataaataaacttcatagaaaggaaaaactacttaaaggaaactccaatgttctcattaatgaatacaaaggctactgaattcactagtgactcagaaaactaattctcacacaaaataagataatattttttcacaaactgttattttgcctacaagtggaccaaactccagtggtacccatggaatatatcatagccctcaaacactgtgtacaacaatgactttggtcttctcttaaaaataataataatatagtatttttaaaatgactcgtcattattatgataataacattaatctaatcggcttttaaataaaccagtcatctttatacagattaatgcttaataatgtaattcatatgacttagacttttttcttgcaaaagtggtttgcaaatcttaatagttaggaatatatattcactgctctccaggtcagttttccctttttttttttttttttttggctgactttttgcaggtactcaaagtgtttcttaaatactgttaaatactgcaacagtggaagcctaatccacataccacattgccatttcaattcagaatcacatagaacctatttattgtctccctcccccaccatccctagcagtgacctgtaaggggaaaacaaaagatcttagtcaagaactttttcactatattgtaatttgttatctacatatctattttcctctaataatgtgttctcctttaagacggagggggagatttgatcttttttgtgtcccttgatcagttgctggaccacaggatatgttcaatcataaacacttgatgaatgaatgaatgaatgaatgaatggtttgaaatggaaggaatcttaaaagatcatacagcccagtttccactgacttttaaaacactttacctagcattaccaacaaatggtcagctatactccttttggcctcattatcctatagcagaacactcagggaccataattctcttcacctggtttcagaacttaggttcattagaaaccttttataactgaaatgtatatttcattgattatctttcactggggtctcttacatgcctgccttctgtttttcttaaattgaacacatcatactagcataggtctttctaaattaaaattcaaagagcactaccttcaacacatttcatccccatttacactggttttcactgcccgcagtgattgctctggctaagactatcagcactatgctgaatagaaatggtgaaagtgggcagccttgtcttgttccagttttcagaggaaatgctttcaacttttccccattcagtataatgttggctgtgggtgtgtcatagaaggtttttattgccttaaggtatgttccttctatgctgattttgctgctgattttaatcataaagaatgctggattttgtcaaatgctttttctgcatctactgagatgatcacatgatttttgtttttagttctgtttatgtggtgtatcacatttattgacttgtgaatgttaaaccatccctgcatcactggtatgaaacccacttgatcataatggagtatctttttgacatgctgttgattctgttcgctagtattctgttgaaaatttttgcatctatgttcattggggatattggtccatagttttctttttctgttaggtcctttcctgattttggtgttagggtgataatggattcataaagttatttggggaggattcaccctttctctgtcttttggaatagtgtcaataagattggtaccaagtcttctttgaatgtctgattgaattcagctgtgaatctgcctaatcctagactttttttgttggtaactttttaattacaatttcaatcttcctgcttgttatcggtctgttcggagtttctatctcctcctggtttaattgagaagggttatatatttccaggaatgtatccatcaccttcatgatttctagtttatgcacgtaaaggtgttcaaagtagcctggaatgatattttgtatttatgtggtatcggttataatatcttctattacatttctatttgaatcttctctcttcttttcttgtaatctcactaatggtctatcaattttatttatcttttcaaagaaccagttttttgtttcattaattttttgtattttttgtttcaatttcatttagttctgctctgatttggttatttcttttcttctgctgggtttgggtttggtttgttcttgtttctccatgttcttgaggtgtaaccttagattgtctatttgtattctttcagactttttgatataggcatttaatgctatgaactttcctctttgcactgcttttgctgtatctcagaggttgtgataggctgggtagctattatagatcagttcaaacaattttttaatttccatcttgatttcattgttggcccagtgataattcaggagcaggttatttaatttccatgtatttgcatggttttggagttgattcccaattttattccactccagtctgggagagtagtggatattttattttggtaaatttgtcaagacttgttttgtggtctatcacatggtctatctcggagactgttccatgtactgatgaatagaatgtatattctacaggtgttgggtagaatgttctgtaaatatcttttaagtcaatttgttccagggtatagtttaaacccattgtttctttgttgactttctctcttggtgacctgtctagtgctgtcagtgtagtattgaagtcctctactattattgtgttgctgtctatctcatttcttaggtctagtagtaattgttttataaatttgggagctccagtgttaggtgcatatatatttaggactgtcatattttcctgttagactagtccttgtatcattatataatatcactctttgtcttttttaacagctgttcctttaaagtttgtttgcctgatatgagaatagtgagccctgcttccttttggtgtccattttcatgaactatctttttccacccctttaccttaagtttatgtgagtccttatgtgtcaggtgagtttcttgaagacagtagatacttagttggtgagtttttatccattctgccattctgtatcttttaagtggagcatttagaccatttacattcaatgttagtattgagatgtgaggtactattctattcatcatgctattttttgcctgaatgatgtgttttttcttcatcgtgttattgtttttgtaggtcctgtgagatttatgctttaaggagattctattttggtgtattttgaggatttgtttcaagatttggagctccttttagcagttcttttagttctggcttgataatggcaaattctctcacatttgtttttctgaaaaagactgcatctttcctgcatttatcaagcttagctttgctggatacaaaattgttggctgataattgttttgtttaaggaggctaaagataggaccccaatcccttctagcttgtaaagtttggctgagaaatttgctgttaatctgataggttttcctttataggttatctgatgctttttcctcacaactcttaagattctttccttcatcttgactttagataacctcatgactatgtgcctaggtgatgatctttttgcaatgaatttcccaggtgttctttgagcttcttatatttgaatgtctagatctctaaaaaggccagggaagtttgccttgattattccctcaactatgttttccaaacttttagatttctcttcttcctcgggatcaccaattattcttaggtttggtcacttaacataatcccagacttggaggctttgttcattttttcttttcctttgtcggattgggttaatttgaaagccttgtcttcgagtcctaaagttctttcttatacttgttcagttctattgctgagactttctagtgcattttgcatttctctgagtccttgatttccagaagttatgatttttttatttatgctatctatttcactggagatttttccattcatatcccatgtctttttttttttcaaattcatctaagttgggcatcacctttctcagatgcctccttgactggcttaatagtagatcttctaaattctttctctggcagtccagagattttgccttggttgggatccattgctggtgagctagtgtgatctttcaggggtgttaaagaacgttgttttgtcatattaccagaattgtttttctggttccttcccatttgagtagactatgtcagagggaagatctatgactcaaaggctgaagttcaaattcttttgtcccacagggtggtcccttgatgtactgctcttccctttcccctagggatggggccttctgagagctgaactgcagtgattggtatttttcttcagaatcttgccacccagaagagctaccaggcccttggctggtactagagatagtatgcaaagagtcctgtgatgtgatccatcttctgatctgtcagccatggattccagcacctactccagtggaggtagcaggggagtgaagtggactctgtgaggatcctttggttgtatttttgtttagtgtgctgattttgtgttggttggcctccagcgaggaagtgccactttcaagagcacatcagctctggttgtatagggaggatcaggcgctgggtggggccatagagctcccaagagattatgtcctttgtcttcagctaccagggcaggtagggaaaaaaacatcaggtgaggtcagggttaggcatgtctgaactcaagactctccttggatggggattgttgtggctgctgtggggcagagggtatggttccccagcccctccataagccaatggagttatgttccctggggaattatggctgtctctgctgtgtcacactggtcaccagggaagtggggtaaagccagcagccacaggcttcactcagctcccacgcagcccacaaccccaaaggctggtcttggtctcattcccaccagcactgagtttatttgcaggcagctggtgagctgggctgagaacttgccccaggctacaagcctcccagctgagaaagcaagttgactcacagttcctcaaatgacctatggggcctgcagcagcagaccacctcgttcaaagggtctgtggattctctcagcttttctggtatattcttgtggtagttcttggagcaaaagttcatgatgtcagtctccacatgctactctgtccatccaagtgggagctgcaagttagtcctgcctgctatcctccattttcctgggctatcaaaatgactgtttttgataaatttaaggtggctggataaaacacaagatgctgagataagttttaatttcagacagttttagtataagtgtgttccttgaaatctttgaaacatactgatactgtatttttatctgccaactttaacaatcctacatacattggacaatagtcacaagacagtggatattgaaagaagaaaaggcaatgaggtgaggccaatgataatcccagttttaaggttagaggcaactatggactatggtttcaaggtcagggaacccaaacagagtccagaagtctaaaacagaagaaagcctgcagacaaaaattagagttcagagaggctaactttagaggacagaataccacagagcagaaagatacatggaaacagagttctgcaaatttgcatagggatcaccttgagtccttggttgtaattgcttaggataaaaattcataaggcaggaaaaacaaaaaatgctggaaaaagaacaataatcaagggactataagtcaaataattccaagagttcacacagggccagagtttccactagtcagagtggaaaggtctcaattagtacataggacttccagtaaagaccccagaaagatgaagatttaaaagtagagataaagtaacactagactaaattctactccatatgtacccaaaaaagatacacagcaagccatgaaagaatcaaatttataaaggagtaacttaactgctggccagaacaaagacccacactgaacaccaaaatatttattattcctcaacaatgtaacattcataatgtcaaaaatccaattaaaaattcttagacatccaaagcaggaaaatatgatattttaccaaaagaaaaaacagtccatagaaacagactgaaaaatgacagagatgatggaattagcaggcaaagacttttaaaaagctattgtaaatatgctcaatgtccacaaagttgtaacattaaaatgaaaaagtgagaaattaaaaatatttttaaaaagaagcacttccaaagctgagatatactgtttgaaaaattatgaatatacttaaaaacaaatataaatataacaacagaattaaaaatattagtgcattcaaaaacttgtcaataaaactatctaaacatatccacagagagaaaaaaagagtagaaaaaaagagattcagtgacatgtaggacaatatcaaacaactaatatacaaccaactgaatacccagaaggagagaagttgtgggggtacagaaaaaaatcatttgaataaattatcactaaacttttccaaacttgataaaaatgtaaatatgtggatccaagaagatcagcaaaccctaaggagatacaaacagacaaaaagacatacagccatctcataattaaattgctaaaaatcagtcataaatagaaagtattaaaatcagccagagcaaaaaggaacacagcacatagggaaaaacagctaggaatgtcccctgatttcttgtcagcaaaatgaaaaccataagacaatgaaggaacaactttaacatgattaaaagtaacaactctcaactttgaatactgtactcatcaacaacaaaaatattcttacaaataaaggtgtattagtcaattttcacactgctgataaagacatatccaagacggggaagaaaaagaggtttaatggactcacagttccacatgcctggggatgcctcacaatcatggtggaaggcaaggaggagcaagttatgtttcacatggatggtggcaggcaacgagagagaacttgtgcggggctactctcattttaaaaccatcagatctcaggagacccattcactatcacaagaacagcaagggaaagacctgtccccataattcaattgtctcccaccgggttcctcccacaacatgtgggaattagaggagctacaagataagatttgggtggggacacagagccaaaccatatcattccacccccagcccctcccattggttgatttcaaaacgaatcatgccttccccacagtccctcaaagtctcaactcacatcagcattaactcaaaagtccacagtctgaagtctcatctgagacaaggcaagccccttccatctatgagcctgtaaaatcaaaagcaagttagtactgtcctagatacaatgtgtatacagacattgggtaaatatagccactccaaatgggagaaattggcccatttgggccaattggcccaaaacaaaggggctacaggccccatgcaagccctaaatccagtggggcagtcaaatcttaaagctccaaaatgatctgtgactctgactcacatctaggtcacgctgatgcaaaaggtaggttcccattctcttgggcagatccacctctgtggctttgcagggtatagccccctcctggctgctttcatgggctggcattgagtgtctgcagctttttcaggtgcacagtgcaagatgtcaatggttctaccattctggggtctggaggatggtggccctcttttcacagctccactaggcagtgcctctgtagggattctgtgtgggagcgctgatcccacatttctcttttgtactgccctagcagaggttctcaatcagagccctgcccctgcagcaaatttttgccttggcatccagatattttctgttttttttttttttttttttttttttgagatggagtttcgctcttgttgcccaggctggagtgcaatggcgcaatctcggctgaccacaacctctgcctcctgggttcaagtgattctcttcctgcctcggcctccccagtatttgggattacaggcatgcgccactatgcccagctaattttttgtatttttagtagagatggggtttctccatgttggtcaggctggtctcgaagacccgatctcaggtgatctgcccacctcagcctcccaaagtgctaggattatagacgtgagccacagagcctggccacatccaggtatcttcatacctgttctgaaatctcaacagaggttcccaaacctcaattcgtgacttctgtccaccctcaggctcaacaccatgtgaaagctgccaaggcttggggcttcaaccctctgaatcaacagcctgagctgtaccttggctgtttttagtcacagctggagtggccatgacacagggtaccaagtctctaggctacacacagcacagggacccagggcccagtccacaaaatcactttttcctcctaggcccctgggcctgtgatgggaagggctaacatgaagacctctgacatgccctggagacattttccccattgtcttggggattgacattcagctcctggttacttatgcaaatttctgcagcagcttgactttctcctaagaaaatgggattttcttttctattgcattgtcaggctgcaaattttccaaatgtttttgctctgcttcccttataaaactgaatgcctttaaaagcacccaagtcacatcttgaattctttgctgcttagaaatttcttcccccagataccctaaatcatctctctcaagttcaaagttccagaaatctctaaggcaggggcaaaatgttgccagtctcttcgctaaaacattacaagagtcacctttgttccagatcccaacaagttcctcatgtccatttgtccatatagttgtccacattctgggaaaagccattcaacaaatctttagaaggttccaaactttcccacatttttctgtcttcttctgagccctccaaactgttccaactcctgcctgttacccagctccaaagttgcttccacattttcaggtatcttttcagcagtgccttactctactcgtaccagtttactgtattagtccatttttatgccactgataaagacatacccaagactgggaaaaaaaagaggtttaatagactcacagttccacatggctggggatgcctcacaatcaaggcagaaggcaagaaggatcaagtcatgtctcatatggatgatggcagacagagagagagcttgtgcaggacaactcccatttttaaaattataagctctcatgagacccattcactatcacaagaacaccatgggaaagacccacccccataattcaatcctctcccactgggagctacaggatgagatttgggtggggacacagagccaaaccgcatcaaaaaggtaactaaagactctcaaaaaaataaaatctgaatttatcacaaccaaactaatactataaaaaatgctagagttcttcaggtagaaagaaccttttaccagatataaactcagatccacacaagaaataaagaataataaaactgtaaatacatgggtaaatatagacaatgtcttctcatattttaatttcctcaaaagattaattgggaggtagtacttccagaatgtcagaatacccaactgtttcccaaaaaccaataatactggataaatgtgtcaaaaacagtaattccagggctctggaaaccaacaacatgcatacaacaaactgagcagtgtttattcaagaaaagctactgaaacttgaataagaaaaataggagtttgtggtgttttagcctgggaatgctaccatacacccctcccctagctccatcaaaattggaattctaccagaggaagataacatcggaaaaacagatgctttactgctaaagaaagctgatttgattttaagcagactgtgggaaaacgacatgccattggaaaatagtttacaaccaaattggaaaatcatatcatagctaatctaaaattgcaatctaattgtggcaagcaacagaccagcagagaagcaagaactttaaaagtaatacccaggtaattagaaagtcatagtgagccttgagaaactcctacatgctcttttggcctgaaaagctgtgttcatttacaaggttatgcacatgattgggagacaacagggaggcaactagccagccacacatccctgaatgtacataagacctgcatatgaacgaaagagacatgagagaacataaaataaaagatgggtcaaattcataaactgcctaaactttatatgcattccccaatccaaacacagattcataggcgaggtatacaatccttacttatgttataaattgagtacaaccactgactaattaatatctgacctttaaattatgctaaccccgtaagaaatcataattttttaaaatatctgagcacagatattagtgaccacataccacaagagataattagtacaggcatgtcacttaacaaaccaacaagtagcactaaaaacaactgcggcaagattaaaatacagagtggctagattatcttaaatgtccagtttttagcaaaaaaacaaattaaacatgcggagagaaaaaagaaatatgactatattcagggaaaaagagcaaccagtagaaactgtatttgaggccgggcgcggtggctcacgcctgtaatcccagcactttgggaggccgaggcgggtggatcacgaggtcaggagatcgagaccatcccggctaaaacggtgagaccccgtctctactaaaaatacaaaaaattagccgggcgtagtggcgggcacctgtagtcccagctacttgggaggctgaggcaggagaatggtgtgaacccgggaggcggagcttgcagtgagccgagatcccgccactgcactccagcctgggtgacagagcgagactccatctcaaaaaaaaaaaaaaaaaaaaaaaaagaaactgtatttgaggggcaaagatgttggatttagtagataaagctaaagcagctgttataaacatgttcaaagaactaaaagaaaccacatttcaaaaactaaagtatgacaatagtggtccatacataggctatcagtagatatataaattacttaaaaggggaaaatggaaattttgaagacaaaaaatataactgaaataaaaatttactgaggtgggaagggcttaatatcagttttgagataggagaagaaagaatgcacaaacttgaagaaaaacaagagtaaacaaaaaagaaaataacgaagaaaaagaaacagagcctcagagacctgtgggaagccataaatatatgcataatggcttcccaatagagaataaagagaaagtgaaagaaaaatacttagagataagaaagctaaaaaattcctaactttgatttaaaaagttaatttagacatccaagaagctcaacaaactcaaagtaggatagacaaaagacgtccgcacctagtaacattatattcaaacttttgaaagccaaagacaatgaaaacacattgaaaacagcaacagaataatttgtcacttatagggatcagaaataaaccatgatcaacagctaacttctcaacagaaacaataaatttcaaaaagtaatgtgataacattcaaaatgccaaaggaaaaaaaaagtaaaccgagacttaaatcagcaaaactatccttcaataatgaaaatgaaatttttagagaatatgactgggatatagagtatctcaaggaaccaaaaactcctcaaactaataaataattttagcaaggtcatggaataaaaggttaatgtacaaaagtcaaccatcaccccgtatactagcatttaaaagtctcagaatttgagactttttaaaaaatgccatttataaaaattccaaaaaataactcacttatgtataagcctaacaaagtatatatacaatctgcttgtggaaaactacaaaatactgaaaaaacaaatcaaggaagatctacataaacagaaaatatactatacatattgactagaagattcaatagtgttataattaggctgtgaaacacagtttgcctgcccttgatatagatgcaaaaaattctcaaaatattagcaatacaaagacaccagcaatatgaaaagaattacacagcatgaccatgtgagattaattccacaaaagcaaaattgactaaagataaagacaattaatttactatattaatagaataaaagtcaaaaatatagaatcatttcaatggacacaaaacattatttgaaaaaaatcaaatactcctttaggattaaaaactacataaactagaaatacaaaggatctttctcaacctgacaaagagcagctatgaaaaatctacagctaatgttaaacttaatggtaaaagactgaatgctttccactaaaattgtaaacagggcaacaatattcacttttatcacttctattaaatgttatactgaggtgctagctaatatgataagacaatataaatgaattgaattaatccatattggaagagaggaagtgaaactatattttcaatcaacatggtcctatatgtaggatatattaagaaatccacattaccataaaactagagctaataaattagttcggctaggtcacagcaaataggataaatatggaaatattaattaaatttctatatatcggcaatgacccactcacatatgaaattaagaaaacaattccattcacaaaagcctcaaaaagaaaaaaaaatgtaggattaaatttaataaaggaagtgcaagtcttgcataccacaaaacattgctgagagaaatgaaggtgtaaatggagaggcattctatgttcgtgttcaatattgttaagacggcaatttgcctaaaagtaatctataacatcaaaataatctctatcaaaataaaagcaagtgtttaaatggtatttgtgtgtgtgtgtgcttgcaggccattgcagaaattgatgaggttttttctaatgaaatgcaaaagatgcaaaatagcccaagtcattttgaaaaacaataacaaactttgagtacttatacttctaactcaaaacttactataattacacagtaatcaaagtactgtggcacttgcaaaagatacataaaccaaagatacagaattggaagtccagaagtaaatccttaacatttatggttcattgattttcaacaaaggtgctgagacaattcaatgggaggaaaaaaatagtctttttaacaaatggtgccaaaataattagatacccacatgtaaaaagatgaatttagacctctaccttataccatacacaaaattaagtcaaagtgaataacatacctaaatatacgagctgaaactgtcaaacttttagaagaatacctaggagaatgatccctatgacctttcgttaagaaaagagttctcagatacaatgccctgagcatgatctgtaaataataataacaataccagtatacatcatcaacatactatatcaaagagaagtagtgaaagtgggcattcttatcttgttctggttctcaaggggaacgcttctagcttttgcccattcagtatgatgttggctgtgggtttgtcacagatggcacttattattttgacatatgttctcctaatctttagttgtcatagatggctcttattatgttgaagcatgttccttggatgcctagaactcccactattattgtatggttatctaagtctctttgtagatttctaagaacttgttttatgagtctggctgatccagtgttgggaggatatatatttgagacagttaagtcttcttgttgaattgaaccctttatcattatgtaatgtccttctttgtcctttttgatcactgtttgtttgaagtctgttttctctgaaattggaatagcaacccctgctctttaagaatattttcttttttatgggaaacagggggtcagtcttgctctgtcacccaggctggagtgcagtaatgtgatcatggctcactgcaacccccgcctcctgggttgaagcaattctcatgcctcagccaccagaatggctgagattacaggtgtgtgccaccacacccaattaacatttatatttttagtagagatggggtttcgccatgttggtcaggctggtcttgcactcctgacctcaagtgatccacccaccacagcctcccaaagttctgggattacaggcgtgagccaccatgcccatacaactactggcgtcttttgttttttatttgcatggtagattttttctccatccctttactctaagtgtgtcatcgtatgtgagatggatctctagaagacagcatacatttgggtcttgcttctctatccaacttactactctgtgcctttttagtgggatttaaactgtttatgttcaaagttaatgttgacatgtgctggtttcatcctgtcatcatgatgttagctggttgttatgtagacttgattgtgtagttgctttttagtgtcagtgagctatgtaattaaatgtgtttttttggtggctggtaacagtctttcatttccttgtttagcactcccttaatgacctcttataaggcagttctgataataatgaaatctcttaacattgcttattggaaaaagattgtatttctccttaacttatgaagcttagtttggctggatatggagttcttgttggaatttattttctttaaggatgctgaatataggcccccaatgtattctgggttgtaggatttctgctaaaaggttcacatgtgtgtgcacattaccaaagcaggagggtatggcaaaagcaggcacgtgcacgctggcaaagcagttgggataaagcaatatagttctgggacagcatttaagccttggttctcactctaagcctttcacagaaaggtaaataatggcaaagcagcaatttagatctagactagcagttaaattccaatattcaatctgaatcttcctcagatcaagaaatgatgacagagcagtgagattgttccagtgttgtcttgagttctggtggtcactaaaagtcttctccagaatggaaagcaataataggccagcatttaggtttcaatccttataagtaaagatctcacactatcaaaaagcacctacaaaaggtgaaagaggtggctgtctcctcaaacttataggcatcaacataaagatacaagcattgtgaaacctcaggaaaatatgacactaccaaaagaaacctagaaaacttcagcaatagagtcagaaaaattgatgatctatgaaatatctgatacatgagtcaaaataacccacttaaagaagttcaggaagttgcagaaaaatatgaatagaaaattaaataaaaattgaaaaacaatttcggaaaaaaatatttaacagaaaaatagtaatagtttttataatgcaatagagttcttgaaaataaagaatataattatgaacagaaaaactcattataaagcttcaaaagcaaacttgttcaaaaaggaaagaattactgagctggaagacagcacatatgaaattacccaatcagagaagaaaaagaaaaaaaaaaactaacctctgcataattggaacccccaaaggaaaggagaaataaaagagcttagcaagcatgtttaagggccaggtgcagtggctcacacctgtaatcccagcactttgggaggccaaggtgggcggatcactagctcaggagttcaagaccagcatggccaatgtagtgaaaccctgtctgtactaaaaatacaaaaattagctgggcttggtggcacccgcctgtaatcccagctactcaggaggctgagccaggagaatcgcttgaacctgggaagcagaggttgcagtgagtgaagattgagccactgcactctagcctgggtgacagagtgagactccatctcaaaaaaaaaaaaaaaagcaagcaagcaagcaagcaagcaagcaagcatatttaagaaaataatgactgaaaatttcccagatctggagaaagagggcagcatccagatacaggaagctcagaggtcaccagtcaaattcagtcctatgaggaattccccaaggtacatcagaatcaacttagtaaatatcaaacacacacacacacacacacacacacacacacacacacacaaattgttcaaaacatcaagaaaaaagaaacatatcacattcaagcgttctctaatatggctttcagtgggcttttaggagaaaccctgcaggccaggaaaaaagtagaatgctaaattcaaagtgctgaaggtaaaaaacaacaacaacaacaacaaaaaaaaactcttagccaagaatactgtactcaacaaagctattcttaaaacacaaagaacagattaagacattacactaccagaccaacaaaagttgagagaattcatccacagcagacctgtcacaagaaatgctaaagaaatagatactaatatgtaacaataaaacatctgaagctataaaactcactggtaaatacaagaagccacatttgtaatactctaattctataattgtgcaagtaaaccatttatatgtcaagtataaagactagaagacaaaagtattaaagacaatgataactatagtaattggttaagagataggcaatataaaaataggtaaattgaaacatcaaaaaattaaaatgtggggggaaaataattttgttttcagtactttcctttgcaatcaatgttaagttgatatcagctttaaaaaatctgtaataactaaaagattttttttgtaatcttcatgtgaacctcaaggcaaaaacccacaatagatacactaagcaacatagaatgaaaacattctactaaagaaactcacttaactacaaaagaagacagcaagagatgaataaaagaaagggtctataaaataaccaaaaaccaagtaacaaaatggcaattgtaaacccttacctatcaataataaccttgaatgcaaatagattatattatccaattaaaagaaggagtaactacatgatttaaaaacaggatccaactatatgctgtctatctgaaactcaatttgcctataaagatatgtacagactgaaagcgaagggttggaaaaagatatcccatggaaaacaaacaaacaaaaaagcaggagacattatacttacgtcacataaaatagatgttaagtaagaaatgattttaaaaagataaggaagactattacataataatactcagaataataaaggtgtcaatatggcaagagaatataataattggaaatatatatgcacccaacaatgaaagactcaaatgtataaaacaaagactaatagactaaaagacagagattgattgtaatacagtaatagtaggaaacatcaacactctactttcagcaatagacagatcatccagacagaaaatcaacactgaaacattggagttaaactgcactccagaccaaatggaccaaacagacatctatggaacattccatccaacagcagaaggaaacacatttttctcaatagcacatagaacattattcagtgtagaccatatattaggtcataaaacaagtattttaaatttttaaaaataaaaattatatcaactatcttttctgaccacaatggaatagaattagaaatcaataactgaaggaatattggaaactggacaaatttatagaaattaaaccatgtgctcctgaacaagtgggtcaatgaaagaaattcaaaagaaaacttaaaaattccttaagacaaatgaaaatgaaaacacaacataccaaagcctatgggatacagcaaaagtagttctaagagtgatgtttatagcaataaacacatacatcaaaaaagcagaaaatcttaaataacctaatgatgcatctcaaggagccagaaatgcaagaacaaatcaaacccaaaattagtagaaggaaagaagtaataaacatcacagcagaaataaatgaaattgaacctaaagaaataaagaattaattaaacaagttggagtttttttttaaaaaagatgcatgaaattgacaaacctctagctatactaagaaaaagagaagacccaaataattcagagacaaaaaaggaaacattataactgatatcacagaaatacaaaggatcataagagactaatatgaaaaactatacaccaacaaaatgcaaaacctagaagaagtggatagaagcctaacggattgaactatgaagaaacggaaaacctaaaaagaccaaaaaagagctatgagatcgaagcagtaatgaaaaggttttatcaaagaaaagtgcaggacctgatgttactgcatcagcaacaatgctcaatgttaccaaacatttacaaaaaattaatatgaattctacttaatcttttaaaaataattgaagaggagagaatatttccacattcattctaagaggccagcattacactggtaacaaaaccagacaaagatagaacaacaagaacaacaacaacaacagaaaactacaggctaataacactgatgacggtaaatttaaaaaccttcaacaaaatactagtaaaccaaattcaacaatacagcaaaaaggtaatacagctatagcttctgtctacatgaggcttatattctattgggggatacaagaagtaaacaagtaataataaacacataatttcatagtgcaagtgctgtaaagaaaggtaaatgttatcaaatattattggcccaactaatttaagtctagaaatagtcaagagacttaaaatgccttataacatgtgactataaacaaaatttctttttcttctgttggaaaaacagcaaatatgatttagttcagaattttaagaacgatgtgagcagaaagaatagtgggagatatgttcatcaagtgaaagtaaaaggcagcacttctaatgatcctggcattgtctccggctctgtgaggaaaagaaaataaggtccctggggtcagataaggagctcagaataagctcctagctgagttctctggatatggttaattccataggatattttttaccatgtcacaagaattgtgggctttttcagacatgttagtatgtcttctatcaaatattttccagagaggcaaatatatttcctgcattatctacagttgtgttccacataattaagatgtgtgacaactgtctatatttatgtgttccaagaaggcagtctgccagttaatgcaagaaagaaaatgtcatttgttctacattctgcctaccgtaccacccaaatcagctgctcctggctctgctcaagacctagagatccatggggaagaatacatggtggttaggtggcctatactttctgccgtggctgagcaagtttacaaaatctttccagcgaataccaggaaaaagcatgttttccagcaacctcaagtcatgcaagcgcttttcttacaggacaaacctagtctttctgaaaccatctgtaccatagcagagtgcagggcatcagttattttagcgggcctgttctagactactacctgaaagcagctaaggtttgaagtcaaatctgtaccaattaaaattattcctgttttctttataattggacaattataaccttttccaccacctagcctcaagcagtttcaggtctttaattttcttcatccctcaaatagaactaactagtaatatttgtactcccttattatcttagatgatttttatctttctagagtagataactatgtttcagtaactttagtgttgattccagtctattattgtcacctataaggtagaatgcaaactatacaattgcaccaagatgtttagaaatacctagtccctctggacaagaactgaatattgggagatgccaacaggtcatatggagaacctggatgggaacttgctaagacaaacatgcttcaagtagacgtcaaagtcattgactgctttcatatctcttgtacatattttcctccacaccacaccctctcaagtaattatgttggctagaggcctgaattatttaagtgaggcatattttcagtgagagaagttatttctgtgacctatatatgtctagatccaacatacatagctttgaaacaatctgaagttatacaattgcctgtctcccatatgaagcttgtgggcttcacaaacataatacattttctcaagttctcttaaaacaagattggtcttgttcttcaagttatctcagcagctcaaatgaatgtgaacaataaactggaatcctggtgctagaaacctaaagctttttattttacccaagaccaaacctgtatgtcttcgaggggaggaatataaagaaagagaagtttgccattagagccttccctttttctatctgctcatagttgacagttctcagccagtttctttgaaactatgctgttattctatcccaactgtgaaaaaaagaaccataacctagaattattttttgtcccactcctgtagactctaaattaccaactggtaaatgtcatcaagtcagtcacaagccagtagaaaagaaagagaaaactgccactaagcaacagaagatatttctatttctactttgttttctagactactagtgaccaatagtgtgaaattcaagcaaggccaaagggatatcatctcaagcaaggtggaatacttatgcaccccttagaatccaaacaagtaatctaccttatgagatgcctaaccacctcaaagttggaaacaagtcctacatgccagctgtcacttactaagtcttcatttatgtcatctaaaaatcaactatttgaatcacctagtcttctgtaggggagtaatgttgaattagaaacagtttgatcaatatttgcggttatctagccgcatgtgtaagtccctacaatgaactacaaggttgggaattaaaggaaaaaaaaaccccactgccctaaacatctcttcttcacactgcctgagtatgccactttccctcttctcaggtgtgaaatgctaccaaatcaaggttcgtttgggttaacaagcctatttttataggtaaataactctaaaaggattcatttaacaattaagtcctttatggagagtacacaggctgccttagtcaaattacttctctcctaaactctagttgatatatccccagagtaatgagtactttaatagcagaaacatagaaaaaagaagagcaatttcagaatatgaggagagggctttaagtaaagacatgcttgggtaggacattaaaatggaggaaagatgtttagagcagccaaaagggatgggataagtgaagggaaaagaaaggtaaagatgacaaaagatagatacttcaaaaattgtttctggactctccatactcccagttttcagtgtaatactgcctcttgactatttagatatgctattatcttttgggccatatctttaaaataccataagctgggaggtttataaacaacagacatttctttctcacagatcacgaggctggaagtcagaggtcaggctgccaacatggtcagttgttaagggccctattccagatttcagatggacgacttctccctgtcctttcacctcgcagaaagagagcacaagaactttctggagccccttcaataaggacactaattccatttgtgaggtctatacccttataacctaattacttcccagaggcccaattcctaatactaccacgttagagactaggatttcaacatatgaatatgggggagacagaaacatttggtccattacgagtaggcatcagttaacagattacacaaaagataaaactcaaaagcagccttactctcttcatacaccatatcaacagatcatctcaaaatccatcaattatgtgatttaaaaatctccatatattggccaggtgtggtggttcaagcctgtaatcctagcactttgggaggctgaggcaggtggacagcttgagcgcaggagtttgagaccagcctgggcaacatgacaaaaaccccatctctacaaaaaatagaaaaattaactgggcacctgtagtcccagctactcaggaggctgaggtgggaggatcacctgaatccagaaggccaaggctgcagtgaatcatgattgcaccacagtactcctgcctggatgtcagagtaaggcactgtctcaaaacatttccatgtatctttatatttcaaattttggtaacagctaaaaggaataaaatccttttctgatgattttcaatggccttactgatttaaaaagagaaaaagtaagtctaaaggcatgagtttgtaaaggtgggttgtcagtatatgagtcaaatgtggggcattatcttaattcactgtctcacgcttatattactcagaccattattctagtcagccaaggccaaaaatgaacatattttcagactcaagtacaaaccatctttccttgaatattctagaggtttgacaggcctcgaaagaagtacctaagtgtatgggaggcctaagaaaatcagtttttaccagattcaagaatcaaatgaaggcattttaactctattacctactctgcagttcaaatacatttgccaagagattatttatagttgtggacaatgaaaatatgatctgtaaactgcctgtggtgagagttgctttaagaatcacaaacctgggtggagggagccgtatggtgacgctcagcagcacagtgacacagcaggctgagagagaactccagagacttctgttttcatagcagctctgcccccacagccttgccacataaccctgggcagtcttttaacctgttccagatgtactttcctccatagtttgtgagttaatcagcagctcttggaaagaaatactaatttaaataatttgtaaacaaaaggttttatagagtacagcaaacaataaatagcaaggctttaaactcttgatagcatgagtgaatcagctccaaatcacttatcctaccctatcaaaggtaatcattgggcagtttttaacaagatactcacatctactgtccagccaagccttcccagccactctcagttgtaaaacttaaagatcttaaaattggtatctgagtctgtatcccaaacccaccaaacaagtagagtctggaatttacaacttttcctagggcctgatgacgacggttgcttagtggcttccatgcacactagacctggagccaatgagacccagattcaacagctgactagaaacccatattcccgccaagggaagtagaaaactttcaaaaccagtttcaaacgggagggaactagtttcaaaacggatgtttcaggattggggcattaatttcctctttagtttctggagagaggccagaaaaaacattttaaagacaatataaccttcatcatgtatggccagtatagaagaatcacctttcaatctaccattttgacctaaaccctgatctatgtcagtccttcatctgcctttccatgtcctcaactttgaggctgggtcaattgctgcttcttgtatccctattttttctacaatttatagcactctgggaaaaaaatctgagtaaaaacaatattctgtaattgttacggcctacctggattttcccactgtgatccagcaccctgatttcaatcatcagtcaagtttcctcagtccaaattcccatctatgtcaacggccagagattctagtggtggttatttttaatcatgacttcgtgaaaatgatgaagaaattctctgaaaatgcctttatttgcattgatggaatgaaaactatgtttatgcaatttattgtatagctaacttgagcatactcacatgcaattattatagtgggaagtttggaatacacattcagctcctctacattaagaggttaatgaaaaccttttgccagcatgtcaaaagtggtattagttctaattcagcatggtgtttttctccgtgccacatgtaggccctgcttaccctcctttgtgggccccatgctgtgtttattcatagtagtctaggctgaacaaacatgttttctttttaatcacagtacttatttacagtctctttatgaaaactgcttagagttaaatttaaatactagctttaataattgtatttccagataggatttttttcccctcaacacactctggagaatatctgccactaattagtccttatattgtttacttgatgcagtagttcatctcccacacctgagtgccccatgcaattggtgccgggcatgagttctgcatatttctgtgatggaagccatgttcaactctgatccctttaaagaagaaaaaatagcttctggaatgaggttacaagctaacaatgtgctcactcactttgtgaaaaaatggacacaataacttcatctctataccacaattaatatccctctcatctatagcaactcagggaagctactacttaaccactgcctacccaaaatcataatggctaacatcaacccaggaacctctctttctcctactattctgttcctcgttaaacatccaagcttcattcattcattcaaaaaatatttgagcacttattatatgccagacactgggctaggcactagtttaattaaaaagtttaccactactttactccatctagatgtgacccaactatgcccttgaatatctgcaccagataatatcacctgtgaattgtctgcaaacttcagacttggtgttttagattgctggtcactctcaggaggttcaggcttcaactttccagtttcagaccaagcttgttccttccttgagggagttcaaggcatggtcttgattaaagacttccagaaagagtccatacaattgagaggtaagagcagctttaaccaaaaccttggggctgcttacctactcaaggtttcttcaagtgtgtcattctttctgactcaggttgttataacaccctctcatcttcctttaaccctccagctccccatctgttctccagaggaaaaactctttttctctctacatctatctccatggctttaggtcaaaccactgacatcacagctacctaccaccgggagcccatattgccctcagcaataagcaattctggcatccctgatgcttttccctcaagacttgatttatcattcttgcttcgggtcaaaactgctgaagttataacttctttacaatccttaagcttaacttagctctatccctaagtaactctcacctctttcctctctttagtttgcactatactcactaaaaatatcttagattttctatccttccttctaatgtttgctgaactacaaagagaaatggtttgcacagtgtccagaaagagaacacaaaaggggaacatttataaacacatacttagccccatccagggaagagcatgccctgaagagccaacaagcctggtttagtgtttatggtctgcttatattgttgaaaaccccaagctatagtgtctttaagatgccagccatctagataataccacttatgctagtggttcctattacaagcttaccaagcagtctcctagttttagcttgcctgtccacatatcttttcccacactgtacacatcacctgacacaagtctatcgatttgcttagaagctaaatttcttattataaatgtatacattattctggttagttcactctttaacaagttttattagtgtacctcatcttctagaacagatcacttctgaaaaatataaacactcaaatttctagacatgaatttttttgtccccaacttcagacttttggagactcataaaggtatatagttaactgggttaaatgcagaacttggctacatccctgggagtgccttaactcacacctgagttctttatgtcttattttcaacctctatttccacaaaattataaactcacagacatacatatatgcatatatatcaatgatttttctgttaatttcattggaacatattacttaaactgtctgagttcatcttttttaaaattccttgtaatgactaatattagcatctctaaatttaaatcctgagtcattttacttggccaatgtttgatacatttgtgaaagtactggtttcttcgcaaagtctgggatgtccccaaattttaagccaagaattcctctgaggaacccattaacattttattaaggaaaaatcaatgcaatgtttcctgctagcaagcataatatatttctaactacctcttctttattttcttaaatctcctgtctttccagattattgcttgaaaactatctttcttcaaggcatcatcaattgagttagattggcctacctcagcaggcatccttatattgggcttgtctttcttagctgttgatttttctctgaacctactatatttattgaattctttctacataatgtcttttggaaaccttttatccataaagattccagccctttgctgtcttttaggaattgccaaaattaaagatttttgtgcttgtataattcatgtttgactattccagtctttgctttacttttaaatacttctacttcctccctcccccttgttatctcactggtctaatctgtgcagtaagatgaaggcataaatgtctgaattatagatttaggtgtagatagaaatacctactgatatcacagcatgccttattcattgtttctgtggacacacacacaaacacacaaacacacacacacacacacacacacacacaatgaaaggtaaagagtatcaaagaagtccctgaaggtagctgcacctatgctggacttttaagaagattgtttttactgcatttgggtagactacatcaaagttctgtcagattacctcttagtaggccaggtgcagtggctcatgcctggaatcctaacagtttgggaggacaaggcaggaggaatgcttgaggctaggaattcgagaccagcctgggcaacacaatgagaccccatctctacaaaaaatacaaaaattagctggacatagtggcacgtgcacacagtctcagctgcttgggtggctgaggcaggaggattgcttcagcccaggggcggaggcggtaatgagccatgattaaaccactgcactctggcctgggtgacagagtgagagccaagctggaaatggcacaatcataactcatggctcattttttctaaaaaaaaaagaaaagaaaagaaaagaaaaaacaaacaaaaaacaattcttagtagatttctaatcagtctctgtaatgtacatagaattatttttaaaacacaactttggccttgaaatatgatggtgatttcaatccttcctgtctccctttcatgcagaaagtgaaactcttgagataagaacaaacatccagccttttcatatctctggaccccttactttctctgaagcttcttctcccagagcctgtttactccatatattccagctctaaaaagctactagctgctagtattcccaaatggccttgggcccctgcacatgttgttccctccaagtgtaattccctttcctcctatcttaccctgcaattttattcacttcttcaaagcatattttgtgtcccttcctctatttaagactttccagaatctacagtgactatagtccttattttgtgttcccattatactttatagacacttctaccaggacctttgtaactattttattcatttgcttacattatgcatctcattttaagtctctaagccccttgaagggtccatatgttcatgcaaatcacattttactcagaattcatgaaagtgtctttgaatatagatatacagtactccacaaaattgtatttgttaataccacaaggcaaacagtccactgattcacaagcatgaatttggaatttgttttggagcaatgtagaatttccctattctttaacaatctttgttcaattctttcagggcttaaaattactcattagtaaagttattagtagaaactatgaatgtgatcaagaagcaaggtatacccagctggtataggagactcatgatccaataataaccctgtgttctcaccagcagagcaggtaatgcagtacagtcaatatactaacagataacactcatgcacacacacacacatgctttctaggctccccattcagatttgtttataagatgacatcaaagtgcaaaaagttaagcatatcatatttatcaaagtagaatttctaaattttagcaaaaatcatctcatctagcaaagagatatttgactggaaatacatgttaaaattttccagcagtccgaatctctggagatctagtaataaagaggatcaagaataatgtattaatattataaaacattcttgaggtggtcagaaatcatgaaaactttgcccaacattactttttgcgtaatatggttgggttttctgcccccaccccaatctcgtcttaaattggaatccccataatacccatgtgacaaggaagaaaccaagtggaggtaattgaatcatgggggcattttcccccatgctgttctcattatagtgaatgagttatcatgagatctgttttttttttttggttttttttttttttttttgagacagagtctcgctctgtcgcccaggctggagtgcagtggcatgatcttcgctcattgcaagccacgcctcctggattcacaccattctcctgcctcagcctcccgagtagctgggaccacaggcacctgccaccaggcctggctaattttttgtatcttccctacttcactaggcacttctccttcctgccaccttctgaagaaggtggcttgcttgccctttggcttccaccataattgtgagtttcctgaggcctccccagccacacttaactgtgagtcaattgaacctctttcctttataaattactccatctcaggcagttctttatagcagtatgaaaatgggctaatagagcaaattggtaccacagagagttgagtgctgcaataaaaaaacctgaaaatctggaaccaactttggaactggataacaggcagagattggaacacgttggagggctcagaagaagacaggaagatgtggaaaagttgggaactttctaagagacttgttgaatggctttgaccaaaatgttgataatgatatggacaaagaaatcccggctgaagtggtctcagatggagatgagaaacttgttgggaactggaatgaaggtgactcttgctatgctgtagcaaatagactggtggcattttgtcccttccctagagatctgtgaaactttgaacttgagagagctaatttagcatccctggtagaagaaatttctaagcagcgaagtattcaagaggtaacttgagggctcttgaaagcattaagttttatgcattcacaaagatatggttcgcaactggaacttatatctaaaagggaagcagagcataagttccaaaacttcacagctaacaatgcaatagaaaagaaaaacccattttctgaggagaaattcaagctggctacagaaatttacgtaagtaaagaaaagccaaatgttcatcaccaagacaatgggataaatgtctccagggcatgccagaggtcttcacggcccctcccatcactggcctagagatctaagaggaaaaaaattgtttcatgggctgggcccagggccttgctgctttgcacattctcaggacttggtgccctgcatcccagccatggctaaaaggggccaatgtacagctcaagccattgcttcagagggtgtaagccctaagccttggtggcttacacatggtgttgggcttgcaggtgcacaaaagtcaagaattgaagtctgggaacctccatctagatttcagaggatatatggaaacacgtggttgtccaggcagaagtttgctgcaggggtggcgccctcatggagaatctctgctagagcaatgcaaatgggaaatgtaggatcagagcccacgcacagagtcaccaatgggacactgcctagtggagatgtaagaagagagccaccatcctccagacaccagagtagtagatccactgacagcttgcaccacgtgcctggaaaagacagagatgctggatgccagcctgtgaaagcagctgggagtgggactgtaccctacaaagccataggggaagagctgcccaagaccataggagcccacttcttgcatcagtgtgacctggatatgaaacatggaatcaaaggaaatcattttggagctttaagatttaatcactgccctgctgggtttcagacttgcatggggcctgtagcccctttgttttggccaatttctcccccttgaaatgggtatattttcccaatgcctgtactcctattttatctaggaagtagctaacttgcttttgattttacaggctcacaggcagaaggaacttgccatgtctcaggtgagactttggacttggacttttcggttaatgctggaataaagtaagacttgggggactgttaggaaggcatgattgatcttgaaatgtgaaaaggacatgagatttggcaggggccaggggcaaaatgatatggttaggctttacggccccatccaaatctcatcatgaaatgtaatccccataatccccttgtgtcaagggagagaccaggtggaggtaattgaatgggggcagttttccccatgctgttctcatgatagtgagtgagttctcatgagagctgtcggttttataagggcctcttcccctcttcactaggcacttctccttccggtcccctgtgaaaaaagtgccttgcttcccttttgccttccatgattgtaagtttcctgaggcctccccagccatgctgcactgtgagtccgttaaacctcttccctttataaattactgagtttggggcagttctttatagaagtatgaaaatgaactaatacactcattatctgttaaattcaagtttataactttttgtaaccagttcttattttctttgaaattacagtaataatgtgatttgggggagtaaggatagcgttatttctctctttgattcccccagaaatagaagtgtacttgtatattatattcaatatatatatatacttactaaatacataaaatatatcattatcactttctgtttcataaatatagatgaatatctttatagatattcatgattctaagtgtaatataaacagactctccaataaaaactcttaactggaaaagaacaccaaataagggacaaaataatctaaattaaaatatactattttttcaattttacatttctttttaaatatcagaattttatcagtattttgtatagtttattcagcttagatcagatcatatccttttctttttggggtttattaaattatttaggctttcctcatatttatggcttttgcctcccaaaatgggatatttccacaatgttctttctctctctttgctttcttccttattaaaaattatctcagactcagatttctcaaagaactaaaactagaactatcattcaatccaacaattccactactgggtatctacccaaagggaaataatttattatatcaaaaacacacttgcactcatacatttaccacagcactattcacaatagcaaagatacggaatcaacctaaatgtagccatcagtggaggggtaaatacacacacacacacacacacacacacacacacacacaccctgtaatactactcagccatgtaaaagaatggaatcacgtcttttgcagcaatgtgaacagaactggaagctgttatcctcagggaaataactcagaacccaaataccacatgttctgacttataagtgggagctaagcaaagcaatggatgcacatgaacatacagagtggaataacagctattggagactacatggtggaagggggataagagttgaataattatctattgagtacaacgtttccattcaggtgatggttgtactgaaagcccagacaataccataacacgatatatgcatgtgagaaacctaatttgtacctcatcaatatataaaaattgtaaaaattaaaaagtcaaaaacaattttcaaaatgtcaagaaattatctcagactcaaattaatcattgtattgccaaaaacaaatgttggaatgtttgtagagaaaaggcaacacttgcacattcttggtaggaatgtaaattagtatatccactgtggagaacagttcggaggtttcttaaaaaacaaaaagtagagctaccatatcattcagcaaatccactgctaggtatgtacccaaaagaaagataatcagtatatcaaagagatatctgcactcccatgtttgttgcagctctgttcacaatagccaagatttggaagcaactgaactgtccatcaacagacgaatggggccgggcacagtgactcacgcctgtagtcccagcacttcagggggccgaggcaggtggatcacttgaggtcatgagtttgagaccagcctggccaacatggtgaaaccccacctctactaaaaatagaaaaattagccaggcatagtggcacacgcttgtaatcccagcaactcaggaggctggggcaggagaatcccttgaacccagaaggtggagtttgcagtgagccaagatcacaccactgcactctagcctgggtgacagaacaacactctgactcaaaaaaaaaaaaaaaaaaaaaagatgaataaagaaaatgtggtaattatacacaatggagtactattcagccatagaaaactgagatccagtcatttgcaacaacatggatggaactgaaggtcactgtattaagtgaaatatgccaggcacagagagataaatgtcacatattctcacttatttgtgggatctaaaaatcaaagcaattgaactcatggagatagacagtagaaggatggttaccagaggctaggaagggtagcctctgggggactacagggaaggtggggatggttaacagttacaaaaaaaaaggttagaaagaatgaataagacataatatttcataacacatcagagggatatagtcaataataatttaattgtacatttgaaaataagtaaaagggtatatttggattgtttgtaacacaaaggataaatggttgaaaggatagataccccattttccatgatgtgattattacacattgcatgcctatatcaaaatatctcttatattccataagtatatatgcctagtgtataccaataaaaatataattaaatttaaaaagtaattttattgccaaaagtatattcctaacattttttttttgagcagagtcttgctctgtcactcaggctggagaacagtggcataatcttggctcactgaaacccccacctccctggcacctgcaatcctcccacctcagccttcctagtagctggaaccacaggtgtccaccaccatgcccagctaatataaattgaatacataaaattagctattactacatgataaagacaatgtttgtcagtccccaaagggaatatgtctattgggaccatataccttataaagaattccttaattcaatgtaaatataaatacaaaaatgaattttattagatagtttaaagacgcatttcaagtaagaatgaatttaatacaaggaattaatgcttacacaactaatggaagggctgtgggacaaaggtcaagggaaaagactgctgggtcttaggggattaagaaactatagacatctgaagaaattgccactaaggaactcagctgacggtagcactgaatcagagatttgccatctgcccaccattgccagaaaataaaatgatctcccttccatgttccaaatgccacactagtaccttttattgaaataacctaactttagaatcctactagtcaggacttattaccattaacaatcaaaggaccagaaaccaatgcaagacctttcctctgagctatctggaagagtattgcctaataaaatatttatattttaattgtagagatgaggtagtgctttttttaatggctacaaattctttgacacttctctcatcaacaggtggggtctatatcctctctttatcctagattcttggagtcctgtggctgctttgaaaatacactgccagaagtaaaggcatgtgagttgtgcaataaggccaaaaagacaacagagcttccatgtggctttcttggatcttttggtctcaagactccatcttagaatccagccacaatattgagagaagccctagttgacagtctcagctaagcccagttttgagtcatcttaccctgggcatcaaacatgcaagtaatgaagcctttatatatgtgcccccactgcttcattcaccctcactatatgaagcctgagacatcctggggcagagccaagccatcccttcagtaccgtgtctgagttcctgatccatggaattggtaagtattataaaatggttattttacactactaagtttggggtggtttataattcaacagtagttactgaaacaactcctgaaaaaatgagagaaaaaaaattgaggttgatggagacttagaagctatggaattcatcctgagtatgcctatttgaaagttatcccaatgacctgacagatgaggtgtatgtacgaagctatacaattaggcttacaattatctgttacaaatctgaagtattcgtcttcctccattttatcccttctttatataatcttaactctggaacctaaaacttcagagagagcagatttgggtcttctttacccattcccatatcttcacccaaattacacagatgaagggcaatttgaatctttaacaattacagtattcacagaaactgcacaactttatcacattaattaactctcatccacatactcccagaggagaaggagcaaaaattccaattacagaatccatttactgaacaaaactgaatttcttgtaagtggagcctatcatatttttctaaacccttcccttgagtttgacaattcacagttataacactttcttatgactaagtttctgttctgttacttcatctcactttatatacagatgttctctttgattttcatctctttgttccttttgctctgccatcaaaactgacagttataataagcttttatgtgacattgtatgttttgagcacctagggattatacccatttattattctgttcagcattcattagcaccatcactcttttctctatatatttgagtgtccagtgtgtataaactgtagcttggtcctaaagcaaaagataaaagtacagaaagacctagtctcttaattgtaaggtacttactttctgataaagataggaatgtcataaatataatagcattaatttttaaatagaaaaacacaagaaaagaaaaagctgatataattttgaaacaataaaaatagttttgtaacttaggctcacctgtaggacatagtaggacctctgtggcttcaattaatagtccaagaagaattgagcttgagttcccatttgctttcccacgactttattgagcaactaacttgtgtcaattagcatactcagaagtttacatttttatttaactgactcagtacttaagttgccactttcaattttgggaagtgatccaatagatcaaataaagacaataaatttgagagtttgttcaagataaaggaggagtatcaaggaacctgccccaatagtcacataggttcttttctattttccctaagtgtcagccggcttgagaaataaaggcacagagtacaaaagagaaaaattttaaagctgggtatccaggggagacatcacatgtcggtaggttccgtgatgccccacaagctgcaaaaaccagcaagattttattagggactttcaaaaggggagggagtgtgcgaataggtgtgggtcacagacatcaagtactttacaaggtaatagaatatcacaaggcaaatggaggcagggcaagatcacagatcacaggaccacaggaccggggcgaaattaaaattgccaatgaagtttcgggcaccattgtcactgataacatcttatcaggagacagggttttgagagcaaccagtctgaccaaaatttgttaggtgggaatttcctcttcctaataagcctgggagcactatgggagactagggtctatttcacccctacagcctcgaccatagaagatgggcacacctaggtggggcgtttatagacctatacccccaggcgcgtattctgtttcccagggatgttccttgctgagaaaaagaattcagcgatatttctcccatttgcttttgaaagaagagaaatatggctctgttccgcccggctcaccggcagtcagagtttaaggttatctctcttattccctgaacaactgctgttatcctgttcttttttcaaggtgcccagatttcatatttgttcaaacacacatgctctacaatttgtgcagttaatgcaattatcacgtggtcctgaggtgacatacatcttcctcagctgacaggattaagagattaaagtaaagacaggcatagaaaatcacaagggtattgattggggaagtgataagtgtccatgaaatcttcacaatttatgtttagagactgcagtaaagacaggcataagaaattataaaagtattaatttggggaactaataaatgtccatgaaatcttcacaatctatgttcttctcaaacggagagactgactgaagccatggcagaagaacatggattgacttcccgcaacagaggagggttggttcaaaggcaaacaatttcggagtgatagtggtacacttacaggcaataaatcaattaaaagcagaatcttagtccaatgtactgaccaccaactatgtagtagaaactgtgttaaacctggagataaaagatggttaggccgggagtggtggctcacgtctataatcctaacactttgggaggctgaggcgagtggatcacctgaggtcagcagttcgagaccagcctgaccaacatggcaaaaccctgtctctgttaaaaaatacaaaattagctaggcttggtcgcgcatgcctgtaatccaagctactccggtgcctgaagtaagagaatcgcttgaacccaggaggcggaggttgcagtgagtcaagatcgcaccattgcactccagcctgggcaataagagtgaaactccgtctcaaaaaaagaaaaaagagaaaaaaaaaaaaaaagatggttaatccatagcccctacctacaaagttatagataccacgagatagatataaatatatataaggtcaagtagatatgcaaaaacagaaaagtctagccccagaagacagataaataggacaggtacaaaatgtattcaatgacccaaagaactgtgaaatagtttaggatagtactgcattctctaaaagtaaactagctaatttaaaacccaaatggatactaataacatatgtgaatatcaaaaacattatgtttaacaaaataataaaggtataaattagtaaatgctatattatttcacttataagaagttcaagaatgggaaaactaatctttgttgaaggaagtcataacagtggttcttctgtagagtatcgactggaaagaagtacaaatgaattttctcgggtgatgaaatattttgtttgagtgttggttacaaagccgtatgtatttgtcaaaacacattaaattgttcatgcaaggtctcaatctattagtctctgctttatgcttggcttctcagcctctcagttctaggcgcattaccttagcaaattctgtaagggtaagtacagtagagaatattttattcatcacagtgtatttcccttctatccaataactgagtccctcaagtcttgaaggacatgatagctcagcaataccttcgaaatatccactttgtactactattatcattgtatcctactgtttctattttgttttatcaagatacaagctagtccatcccatctagaagtagaggtctaaaatagattttttaatgttttgccaactgaggagccatatggaaaaagataaaattgaatctgttcttcacactacacacctgtgtgaatatcaagtggatcagaataacaaatcacataagcagtaggaaaaaacatggatgaattcctttataaaccaagggtagatgaaactttcctttgactctctaaagtattataaaacaacttgataaatttgactacgtaaaaattaaaaacacaaaaagttacattataaaacaccatataaaagggaaaaagtaataatgaactgataaaaatgtttgtaatttatatgttttcatatccctaataaagcactcctaataattaaaaagaaaatgatcaagcctgtaatacaaaaaattgttgagtaatatgaagagagaccacaaaagaaaaaattaggaagacattaaatatatatacacacacatatgcatgtgtgtatgatgttcgctctcatttataagtaggaaaatggcgatcgtaaactgtattatgtagatttaattttaatactaatattagcatttttatttttaaactatgttatgtttctgtttttaaagtatgttgtaggataaagtgaataattatgttaatgccaataaaaacaagaatttttaatttgagaaaaaaataagtacaagaaaaataaaatttcacatcttaatattgaattggaaatattaaggtaaaaatattttatctctttcattttaaaaatacatattgcctgtttctgtctactagaaaggcctagaatctgtggcgactcaggagcaatgagcacccctagcataaaggttatggtctctaatactaatgctctacttaaaggaaaaataagtactcaagagagtttttcaatctgaaatgaaaggaagttaattagtaacataagagcatataaaagtataaaactcactggtaaaattaagtatgtagtcaaattcagaatactgtgatactctaatgatagtgtataaattacttgtggctccagtataaaggctagaggaaaaaaattaaaaatatagcaataataatatatttatggatacacaatataaaaagatgtaaattgtgacatcaaaagcatacaatgagggggaagggtaaagttttggtatgtaattactattcctatgaacttaaaatagttagatagtaagacattttatgtaagtcttttataaccacaaaacaaaaacctatagtagatatatgaaagataaagagaaaggaatcaaaggaaaccactacagaaaatcatcaaatcaaaaggaagaaaagcaagacagtaagaaaggaacaaaaaatccacaaaatagaaaataattaacgaacaataataaattcttacgtatcaataattaccttcaatgtatatggattaaattatccaatcaaaagatatggagtggccaaaccgattaaaaaaaacacacacacaaaaactacatgctgtctacaagagactcacttctgcttcaagaacacacacagactgaaagtttagagatggaaaacaacatcccttgcaaacagaaaaagagcagcggcagctatacttatatcagacaaaatatgctttaaggtaaaaagtgtaaaaacaataaaaaaggacatttaataatgataaaagcattgattctttaaggagatataacaattataaataatatgcaccaatcatagcacctaaatatataaagtacatattaatcgatctgaagggagaaattgacagtgatacaataatagtagtaggcttgaataccctacttctaataatgaatagatcatccagacagaaaatctgtaagaaaatactagacttgagaaacactttggaacaaatagacctaacagacatatacaaaacattccatccaacagcaacagaataaacattattctcaagcacacagaaaacattctccaggctaagtcatatgttagaccacaaaataagccttagccaatctaagaaaactcaaattatatcaagtaacttttctgaccaaaatagtatgaaatcagaagtcaataacaggaatattttgggaaagttcacaaatatatggaaattacataacacattcctgtataatcaacggggaagagaagaaattaagagaaaaatttaaaaataataccttgagacaaacaaaactaaaaacataacataccaaacttgtggattctgcaaacgcagttctaagagggaagtttatagcaataaacacctacatgaagaaaaagaaagatgtcaaataggctgggcacagtggctcatgcctgtaatcccagcactttgggaggccgaggcaggcggatcatgaagtcaggagatcgagaccatcctggctatcatggtgaaaccccatctctactaaaaatacaaaaaattagcccggcatagtgacaggtgcctgtagtcccagctactcaggaggctgaggcagacgaatggcgtgaacccaggaggcagagcttgcagtgagcccagattgggccactgcactccagcctgggcaacagagcgagactccacctcaaaaaaaaaaaaaaaaaaacaagatgtcaaataaacaacctaacattacacttcaagtaagtagtaaaagaagaataaactaagcttgaatttaatagaaagaaggaaataacaaagatcagaaaagaaaaaatgaaatagaaactagaaaaacattagaaaagatcaatgaaaccaacagttttttaaaaacataacctacactgacaaatcatcagctaaagactcaaataaataaaattagaaatgaaagatgacataaccactgatatcacaaaaatacaaaaatcatgagactactatgaacaagtatatgccaactaattagataacctagaagagatgaatgttctagaaacatacaaactaccaagattgactcatgaaaaaatagaaaatttaagtaaacctaaaattggtaagaatattaaattagtaaataagcactctcaacaaaaagaacctcgagatcagatggcttcaatgatccaccaaatatttaaagaattaatgtcaatacctctaaacttcgaaaacaattgtagaagaaggagcacttacaaacacattttatgagaccagcataacctgccactaataccagataaggacaatataagaaaagaaaattacaagccaatatccaaaattaaaagccagttaaggaaaacaataagaaaagaaaattacaagccagtatttctgatgaacatagttgcaaaatactacatcaaaccaagttcaacaatgcgttaaaaggatcatatgccacgatcaagtgatatttgttcctgggttacaaggatgtttcaacatacgcaaatcaataaatgtgttatgccacattaacagaataaaggacaaaaattatataatcacctcaaaagacacagaaaaagcatttgactaaatccaacaacatttcacgatcttaaaactttcacaaattagatatacaaggaatgttcctcaacacagtaaaggccatatactacaagcccaagagctaacatcatattcaatgaaaaaaaaaaggaatcttatcctctaagaataagaaaaagacgaagatgccaactcttgtcacttttactgaacatagtattggaagtcctggtcagatacattagtcaagaaacgaaaaaaatgggcatccaaattggacaggatgaaataaaattgtctgtttgcagataacataattttaaatatatatatatgaagaatttcaccaaaaacctgttagaataaagatattcagtaaagctgcaggatacaaaatcagcaaacaaaaatcaccatacaacaatgagctatctcacaattaaatttttaaaaatcccatttacagttgcattaaaaagaaaaaaatacctagaaataaatttaacccatccatgagttgaacactacaaaatattaatgaaagaaattgaagaagacacaaaaaattgaaggacatctcatgttcatggattagaagactcaatgttgtctaaatgtctatactacccacagtgatctatagattcaatgcaatccctatcaaaatttcaaaggcatattttacaaaaataaaaaataccttgctcgattggggaagttctcctggataatatcctgcagagtgttttccaacttggttccattctccctgtcattttcaggtacaacaatcagatgtagatttggtcttttcacatagtcccatatttcttggaggctttgctcgtttctttttattcttttttctctaaacttcccttctcacttcatttcattcatttcgtcttccatcactgataccctttcttccacttgatcacatcggctcctgaggcttctgcattcttcacgtagttctcgagccttggctttcagctcattcagctcctttaaggacttctctgtgttgtttattctggttatgcattcgtctaattttttttcaaagtttttaacttctttgccattggtttgaatttcctcctgtagctcggagtaatttcatcatctgaagccttcttctctcagctcgtcaaagtcattttccgtccagctttgttccgttgctggtgaggagctgtgttcctttggaggaggagaggtactctgctttttagagtttccagtttttctgctctgttttttccccatctttgagaacttccccaatctagcaaggcaggccaaaattcagattcaggaaatacagagtaagtcacaaagatactccttgagaagagtaactccaagacacataattgtcagattcaccaaagttgaaatgaaggaaaaaatgttaagggcagccagagagaaaggtcgggttacccacaaagggaagcccatcagactaacagctgatctctcagcaggaactctgcaagccagaagagagtgggggccaatactcaacattcttaaagaaaagaattttcaaaccagaatttcatatccagccaaactaagcttcataagtgaaggagaaataaaatcctttacagacaagcaaatgctgagagattttgtcaccaccaggcctgccctaaaagatctcctgaaggaagcactaaacatggaaaggaacaactggcaccagccactgcaaaaacatgccaaaatgtaaagaccatcaaggctaggaagaaactgcatcaactaacgagcaaaataaccagctaacatcataatgacaggaccaaatacacacaaaacaatattaactttaaatgtaaatgggctaaaggctccaattaaaagacacagactggcaaatcggataaagagtcaagaaccatcagtgggctgtattcaggaaacccatctcacatgcagagacacacataggctcaaaataaagggatagaggaagatctaccaagcaaatggaaaacaaaaaaaaggcaggggttgcaatcctagtctctgataaaacagactttaaaccaacaaagatcaaaagagacaaagatggccattacataatggtaaagggatcaattcaacaagaagagctaactatcctaaatatacatccacccaatacaggagcacccagattcataaagcaaatccttagtgacctacaaagagacttagattcccacacaataataatgggagactttaacaccccactgtcaacattagacagatcaatgagacagaaagttatcaaggatatccaggaattgaactcagctctgcaccaagcggacctaatagacatctacagaactctccaccccaaatcaacagaatatacatttttttcaccaccacaccacacctactccaaaattgaccacatagttggaagtaaagctctcctcagcaaatgtaaaagaacagaaattttaacaaactctctctcagaccacagtgcaatcaaactagaactcaggaataagaaactcactcaaaaccactcaattgcatggaaactgaacaacctgctcctgaatgactactgggtacataacgaaatgaaggcagaaataaagatgttctttgaaaccaacgagaacaaagacacaacataccagcatctctgggacacattcaaagcagtgtgtagagggaaatttatagcactaaatacccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaacccttcaaaaaattaatgaatccaggagctggttttttgaaaagatcaacaaaatcaataaactgctagcaagactaataaagaagaaaagagagaagaatcaaatagatgcaataaaaaatgataaaggggatatcaccaccgatcccacagaaatacaaactaccatcagagaatactacaaacacctccacgcaaataaactagaaaatctagaagaaatggataaattcctagacacatacaaccttcccaagactaaaccaggaagaagttgaagctctgaatagaccaataacaggttctgaaattgtggcaataatcaatagcttaccaaccaaaaaaagtccaggaccagatggattcacagccgaattcaaccagaggtacaaggaggagctggtaccattccttctgaaactattccaatccatagaaaaagagggaatcctccctaactcattttatgaggccagcatcatcctgataccaaagcctggtagacacacaacaaaaaagagaattttagaccaatatccttgatgaacattgatgcaaaaatcctcagtaaaacactggcaaaccaaatccagcagcacatcaaaaagcttatccaccatgatcaagtgggcttcatccctgggatgcaaggctggttcaacatatgcaaatcaataaatgtaatccagcatataaacagaaccaaagacaaaaaccacatgattatctcaatagatgtaggaaaggcctttgacaaaatcaaacccttcatgctaaaaactctcaataaattaggtactgatgggacgtatctcaaaataataagagctatctatgacaaacccacagccaatatcatactgaatgggcaaaaactggaagcattccctttgaaaacgggcacgagacagggatgccctctctcaccacacctattcaacatagtgttggaagttctggccagggcaattaggaagcagaaggaaataaagggcattcaattaggaaaataagtcaaattgtccctgtttgcagatgacatgattgtatatctggaaaaccccatagtctcagcccaaaatctccttaagatgctaagcaaattcagcaaagtctcaggatacaaaatcaatgtataaaaatcacaagcattcttatacactaataacacacaaacagccaaatcatgagtgaactcccattcacaattgcttcaaagagaataaaataactaggaatccaacttacaagggatgtgaaggacctcttcaaggagaactacaaaccactgctcaatgaaataaaagaggatacaaacaaatggaagaacatttcatgctcatgggtgggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagccggaggcatcgtgctacctgacttcaaactatactacaaggctacagtcaccaaaacagcatagtactggtatcaaaacagagatatagatcaatggaacagaatagaaccctcagaaataatgctgcatatctacaaccatctgatctttgacaaacctgacaaaaacgagcaatggagaaaggattccctagttaaaaatggtgctgggaaaactggctagccatatgtagaaagctgaaactggatccctcccttacactttatacaaaaattaattcaagatggattaaagacttacatgttacacctaaaaccataaaaaccctagaagaaaacctaggcactaccattcaggacataggcatgggcaaggacttcatgtctaaaacaccaaaagcaatggcaacaaaagccaaaattgacaaatgggatctaattaaactaaagaacttctgcacagcaaaagaaactaccatcagagtgaacaggcaacctacaaaatgggagaaaatttttgcaacctactcatctgacaaagggctaatatccagaatctacaatgaactcaaacaaatttacaagaagaaaacaaacaaccccatcaaaaagtgggcgaaggatatgaacagacacttctcaaaagaagacatttatgcagccaaaagacacatgaaaaaatgctcatcatcagtggccatcagagaaatgcaaatcaaaaccacaatgagataccatctcacagcagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatcttgaactagaaataccatttgacccagccatcccattactgggtatatacccaaaggattataaatcatgctgttataaagacacacgcaaatgtatgtttattgcggcactattcacaatagcaaagacttggaaccaaaccaaatttccaacaatgatagactgcattaagaaaatgtggcacgtatacaccagggaatactatgcagccataaaaaatgaagagttcatgttctttgtagggacatggatgaagctggaagccatcattctcagcaaactatcacaaggacaaaaaaccaaataccgcatgttctcactcacaggtgggaattgaacaatgagaacacatggacacaggaaggggaatatcacactccggggactgttgttgggtggggggacgggggagggatagcattaggagatatacctaatgctaaatgacgagttactgggtgcagcacaccaacatggcacatgtatacatatgtaactaacctgcacattgtgcacatgtaccctaaaacttaaagtataaaaataataaaataaaataaatatcatggtaaaattcatatggaatcacaaaagtctctgagtagctaaagcaatcttgagcaagaggaataaagctgggagcatcaaatttcctgatttcaaatcatatcacaaatatgtgataatcaaaacaatatagtattggcataaaaacagatacatacagcagtggaacagaataaaaagtgcagaaataaactcacacatatatggtcaacttatctttgacaaaggcatcaagaatatacaacagagagaacaccgtctcttcaatagacagtgtgtgttaaactgtttatccacatgcagaaaaatagtaattgaatccttaaattacaccatgcacagaaatcaactcaccaatgaattgaagatttaaatataatacctgaaactgtaaaactcctataagaaaatctgagagaaaagctccatcacattagattttttggatagaatataaaaaacacagggaacaaaagcaaaaattaacaagtgggactacatcaaaccaaaatatttctgcactcataacaaccaacaaaatgaaaatgccacccacagaatgagagaaaagatttggaaaccctatatgcaatgaaaggttactatctaaactatatgaagaactcatacaagtcaatagtacaaaaataaacaacatggtggaaaattagtcaaagtagacatttttccaaggacaagatacaaatggtcaataggtatatgaaaaagtgttcaacgtcactaattatcagggaaattcaaatcaaaatcacaagatatcaactcacacgttaggatcgctattatgaaaaagaaatcaaaaaataagtgttggtgaggatatggaaaaaagaaaacccttgtgcagtgttggtggaaatgtaaattggtacagccactatggaaaacagtataaagtttcctcaaataagtacaattaccatatgatccagaaatcccatttctgatgatacatttaagaaaataaatcattatctgaaagagaaatctgcactctcgtactcagtgaagaattatccacaatgtccaagatatggaaacaacctaagtccatggacagataaatggataaatacatacatacacacacacacacacacacacacacacgcacacggaacattattcagcctttaaaaagaagaaaattctgccatttgcaataacacggatgtacctgagaatactgtgctaaatgaaataaataaaccaacaaagaaagacaaatactgcattacttcacttatatgtggaatctaaaaacatcaatctcatagaaacaaagactagaaggatagttaacagggtataggggatggcaacaatagagagatgttgctcaaaggatgtagacttgcaatggtaagttctggatacctaagtacagcatggtgattagaattaatagtaatatattgtatacttaaaatttactaagagagtaaaccttaagtattctcgtcatgaaaagtaactacgtgaggtgacagatatgttaattagcttgattgtggtaatcatttcacaatgtatatgtatgtcaaaacatgtacaaaataatatgccttgaatgtatacaatttttacatgtcatttgtacctcagtgaagtttggggaaaaaagatagttaagaaacataacaaccatttgcaatgaggagaacttattaaagaaaatcaagtctgaaaagatatttttgaaatgactgaaggtatgttaacatgcatttgctattctacattactagggaattattgttaactttgttaggtgtaataatggctttgtaattatgtgagaaaatacttgtttagaaaatatatatatacatatatgtatattttttttgtaaacatacacaattttttgtatctctgtgtatatatatatgtgtgtgtatatagatacatatacatatatatatatacagaagtggatttaaatgacataatgtatttgtcagtgttaagtaatgcctttgtctcattacatcattttgaataaattgaaattttaaactgtcttaaattatgtattagtgactaatataattctttttgtgacttgtttatttatagaactcaatttctagctaatcttgaggtgcgatagttcatagttctgaataattcatttataggagacaggaaattggtttacaattaactcctgttaggatgtgtggcattatcattttctatattgcattcccattaaataatttatctccaataactgacttttatccatgaatcactgtataatggaaaccctttcgtcatccaagaaaaggggcagtgcagtacgctatgtttaaactaataaatcgacagttttcaatggatggaatcgaaactctgagataaatggaaatagtccccaaggacagtcaaatgtgactttctgcagatggctgcacagaatgacacttcataaaacatcatttctctgctaagctgcacagcatctatggtgcttcaaacatattgtttatctcatcaaagggagcaggttctaaaggtaagaactgaacaagtgccactgctgaggaaacagagcagatggcccatctatgatggtctgccttcacttgatgagagtctgctccaatctcaaacaggcccattgccaattaaaagaggtcttggctgagggatctttactttcctgtgacacataattcacttgtccattttctcagactcctgcccaccaacaagtttcatcactgccccctccagaaattaagaggttcgttatgaccagttgtgtgatacgtcccattgatacttgcttgtaaatgtctggatgtcacccaaacttctcactttagtgtccggctgcattttattttaagactctttctagcttaattgctaacaaggacatgtgtccatgctttgtaaaagaacttcaagttcatggattaaacgtaagaaaatttattggacttccttctaccacaaaatacactttattaactactcttttcaaacaactttagcattgaaacattttaagttagtcaaaatcatttaagttttcataaaaacagataaaaacattttatgattagaaggcatatgtgaactttcaaacttcaggatcctgaactccaatgttgtttaaggaagacgatcctaagtctgaagaagactatcccaatcaaatgtccagtaccaagaaccacgtatctatattgggatattttctgtttgcgagaggatcctaagaccaggttagtcagatcttgacagttactagacaacctgagttacctagagcaagttttgagctacatggcaaaggaatgggccaaaaccatgccacatctggagataaacctgagggaaatagtaaaccaggagagaacagtggtttggatacacagagtggagaagaagtgaggtatacatacagaattaaatcagctctaaaatttaatcaaaaggagattctgatcctgtgttgctttaaaattttggtatcttttttctcgaagttggggcactttcctaccacatcccaaattttttagattgtaaaccatctggaaacacaatccatgtgtgttttgttcaccattctatttctagtgcttagcacagtgctttatatctagtgcccaataaatttttttgaataggaatgtctgggacattgtaggaattgaatatttattctttcaaagaagaaatggacattgattaatattctaagcatgatgaagttggagcattgttatcttcctttgttcagaagaaacagtaggatttctctgtaaaattcagaaccctgaggctgggattaactcatcctgtaacccaggcattgaaaccatttcaatttattactgagcgcaaatctcaagaaaatcaagaggttttttttcttataagggtatctaaaatattctgatccggaatgttaaaatatttttgacttggtattaagaattagatcttaaaacttctttctcctgtattcataacagccctcaaaattttctccctgcctccaggcttgcttcactgcacttcatccttcacacgcctccagtgtaaccttgctaaaactcagatttgatcaggtcacttactcttccattccaaagttttctgtggtttataattcatgccttaccatggcagtaaacacccttcacccttctatttttttcagtctcatccagaccaggcctctttacccacagatgccatccatgtgcccacgctccagccattctacatattttaccaatcctgaacccctacataccttttccttgctcttctgttttacatgttcctttctttatttttggcttggcagtatccaactcttctgtcaaaatctagtttaaatgctaccttccctgggaagcttttcttgactcatccagatagaattaatcataccttctgtgttcctatacctttaatatagagtgtaacagatgggagtgaaagttttggagtcagaaagatgtactttccaattctggttttcctgcttaccatgacctgagcacaacacttaaggtccctgagcctcatatttttcacctataaaatgggtataatatcgacatattacaattgcaatgaagattaactgtgatcattataaagaatgtttagcatagtttggctagtcaaaactcaaagaaagatacttacattatttttatcatcttattattatttcatcatgtatgaccatctgatttttggataatgtcatacctgcataatctactagattttgagtcattaagataggtctatcatattcacattttatttatagtgcctaacacagtgtctgacttactgacagtgtcatctcagtgcttatcaagtccattagcctttgatacaagatttcctaggcttttttgtgaaaatgtaccaatatatatctgttgatttgtgtatgaaatcatgtgtattactttaacaatataaatacatgtgatgctatcaattgttctttgtaattttgccacaataatccttgaaaaagcagaaacagaagccaatttctttttacctcttcttcactcgaaagtataaaattaacatgacttcaaaaggcttacagaaaataatatattaagtctcatctaacctgtatttccagcaacatacctaccagaggtagcttgagctgaaattgcactgaaactcctaagtgattttgttcacccaattcaattgctatttaggtatctgctatccccagttcattgggaaagcagtatggaacaagataacacaaaaagctttctttctagttcaattaaaataaacagtgacatatgtcctgctgaaataacaactaaacaatagcattaaaagcacctaagatatctaaatgggacaagtatttgtgatgtcatttcataattctgactacatcatgtgggtgcctccagtccccaggaaattaacccccactttgccaccaatgtaatcattttggctttgtgactacccagctaaaactcttccatatttgcacatttctggcttaaagcatatagtccaaacttttagcgtggcacaaaaaaaccttgctgaaatcccaaccatacctatttttatagcctcgcttatcacatcttattcataccgcttatattccagccacatgaaaattgtctccttgaacttccagtatcaacttcacatgtaaaaagcttagaagtcttcactcctgttcttaaaacaagtaaaacctgcaaaaactgaaaatcaatgacttttcttggaaccctcagagaactgagattgcagagccaactgtaaccctgaaatctagagaaataagctcattcagggaaacacagctgagatcctcttatctgaagcagaaacccactggagccataaactgaaaggaacacttaaatggtaattttggtgaactgctgaaaggtgagggtgaaccatcattatagagggacaaacccctggaggctggaggcttggggcattaggggacgtattttcacaggttttactatccagaaacccagcaagatcttcactgttaactgtgatcattataaaaaatgtttagcatggggcttgactagtaaaaactcagagaaaggtatttacattacttttatcattttattattgcattatttatcacaatctgattgatattacagataaggtcatgcctgcataattcactaggtattgtaaagtctagaacaacaaacaaaatttataaagaattataattgagatgctgggaagagagaaaatgaaaatataaatagttaattaaaacaagaaaaacagaaaaagaggaagtaaaagaaacaagaaagggaatgaatagaaggcagatatgtgcacagtagatattaactcaactaaattaattatcactttaaatatgaatggtctaaatacaccaaccaattaaaaatggagactgtcggccaggcgcggtggctcacgcctgtaatcccagaactttgggaggctgaggcgggcagatcatgaggtcaggagatccagagcatcctggctaacacggtgaaacccagtctctactaaaaatacaaaaaattagcccggcgttgtggcgggcgcctgtagtcccagctacttgggaggctgaagcaggagaatggcgtgaacccgggaggcggagcatgcagtgccgagatcgcgccactgcactccagcctgggcgacagagcgagactccgtctcaaaaagaaaaaaaaaaaaaaaaaaaaaggagactgtcagagtggataaacaaaataaaatccaacctcgtaatgtttacaagaaaactacattaagtacaaagacacagataaattaaaaataaagagatggagaaagatataccttgctaacactaatcaaaaaaagctggaggtatattaatttctgaaaaagctagcttcagaaaaagtaagactactatggaaaagaaaagcattaaataatgataaagtgatcaattctttaaaacggcataataatcctaactgaagacaacagcaaaacacatgaggccagaactgatagaactgcaaggagaaatagaggaatccactgttatagtcagaaacttttaacatacctctgtaggtaatagatcaaacaggcagaatataacagtaaggatacagatgaccttaacaacgctatcaatcaacttgttcttttgacatttatagaatacttcatccaataacagcataatacacatttttcttcagctcatagtcaccaatatattctgggtcataaaacacatcttaacaaatatggaagaatagataccctacaaagtttgtttaaagaccacaatggaattaaacaagagataataataaaaagatagctggaaaatcccccaatatttgcaaatttaacagtagacttctaaataacacaagggttaaagtagcaagataaattttaaaaataattttaacatgaaaatgaaaattaaacttataccaatatctgtgggatttagcaaaaacagttcctaaaggtaaaataatagcattaaatatacttattagaagagaagaaaggtataaaatcagtaatttaatattttttccatgagaaactggggaaatggtaatttaagtataagcaagcaaattaaattaaaaacagaaaaataatagaaaaaaatcaatgaaaccaaaaactggttctttaaaaagatcaataaaatttataaccaaaaaaaggaaagacacaaatgaacaaggtcagaaaggaggattcatctctactgatcctatgatattaaaaggataataaaagaatactatgaacaacactatgcccacaagttggataacttagataaaattagaccaattcctcgaaagacagaaactactaaagctcatacaaggagaaacagataacttgaaaagttccatgtctattaaagaaattgtatcaataatcaataaaattcaaaaaggaaagcaccaagcccacatagtttactatgaattctgccaaacatttaatgacgaaataatatcaattcttcatttttttttctgaaaaatagcagagggaaggcttcctaatttatctcataaggccaacatggctctaatatcaaaaccagatttaaaaaatcacaagatagaaaactacagatcaataacttctataagctagacacaaaatcctcaataaaatattagcaaattgaatctaataatgtataatgataataattaaacaccacaaccaagtagagttcattccagttatgcaagcatgattcaacattcaaaaattagtgtaaccatcacatcaacaggctaaggaagaaaaatcatatgattatatcaactgacctcaaaaaaggcatgacaaaatccaacatccatttatgcttttaaaaaaagaacacagtgtgaaggttaatattaggtgttgacttgattggattaaggaatgcctagatggtgtgtgaatcagtaggttgggagaaaaaaatttcccctcaatgtgggtgttcaccatccaacccacactgcctactactgaggtgagaacaaagcaggccaaagagggggcatattcattgttgaacttctctctctctctttctggagggggatgctttttctccttctgcccttggacatcagactccaggttctttggcctttgtactctggaacttgcatcagtggcttcccagggactctcaagcctttggcctcagactgaggggctgcactgttggcttccctggttttgagggtttgaggctaggacaaacccatgttactggattttctcattccacagcttacagatggcctattgtgggacttcacctttgtaatcatgtgagccaattctcctcaataaactccctttcgtgtgtgtgtgtgtgtgtgtgtgtgtcctgcttgttctgtccttctgactgtggagccccaactattacactcacaacttaggaatatagaagagaacattctcagcttgataaagaacacctacacaaaacctacaaccaaacttatacttaatgatgacagatttgatgtttaccccaccaagatcaggaatgaggcaagggcatccgatcccaccactcctgttcaatatctttttttgtttgttttgaacaactagatttatttcaagccattttaaatgcttatcaaatcaactgtaaaatgttaaaacctgggagattttattcaccagctgaaggactcatcattactatcttaaaaaacagcaatgaataagcaaattagaaacaaacaaaaaccgaacacaacaaaacaaacagcaaattgctcaatatcttaatagaagccctagcttgtgcaatataatcagagaaaaatataaacagatacatattggaaggggagaaatgaaactgttattatttgacatgattatctatgtagaaaaacccccaaagaatctacaaggagagaaggctgaaatgatccatattgtaatagattagggtgggagacatcagtctgaactcatttttagctcagtattgacacaaatggttgcatacagagatgtttataaatatgtgtatttacatgagttagttttcagatgtatatttccttctttgtcagctgaaaagccttagaagcaataacattccagtagcaacaagcacacctatatccagatcttgatttctgatacaataaaaagaaccagaaattcttggagaaatggcctcaagcaggaaatagatgagataagcctggaccatccaatagtgccagaaagtaagtatgcaaaaaaccacaatgaggggtaggtcaaagtgatacagaaaccaacttaagagttcttattgaccaaagctggaacaatgtaagcaacaaaataaattattggatcataaaccaaagtataaaataagcacccatgggtcaatactggtttatataaatgactgaataaataaatggggataaacagacaaatctcccatgcaaaagaattcaaagttatttatagaataactatttcactctaaagaaggttgagcgtaactcctcactccttgagtaggactgtgcatgttgactttcttacaaagagtacagtaatggaagtaggggttggaggggaagaaactttacagtgaaaaaccctgacaaacactgcctcagctggatgattaaggttaatatcaagagtgatatatcatattggtaatatatacccttgatacgaagtgataataatagcgctctacctctgtgatcctcctctcaaaaggccgtaactccagtctattagagaaaaatattaggcaacccgcaactgagggacactgtacaaaatgcttgacaagtattcatcaaaaatgtaaaggtcatccaaaacaaggaaatctcagacactttcacagccaaaaggagcctaaggagatattatcactaaatgtcatatcatatcctagattggatcctggacccgataaaaagacactaggtaaaaattatggaaatcagagtaaagtattgactttagttagtaatagtcaatattttttcattaattataattgtattatgctaatgtaatattaatacaggaatctggatgtggggtatatgtgggaactctctgtactatcttcacaatatttatgtaaatctaaaactattctaaaataaaaagcctattttagaaaaaaaggtgacaatttaaaaatatttttaacacagcatattcttctcacctctcctcattgtgatatttccttggcgagacataagcctccttctccatttgacaaaatctgagacatggcttcttctacagagtcatcttcaacctctccagacagtgttcattttctctccttctcttgatgccaaggcaattatctcataacaatgtaatcatatgcttgcctttttccactgtaggctgagctctctgtggcctccacaatgtcttcgtgttctctctaatgctactccagcaaaatgctaaacgtaatagagtcactcaattcatgtttcttgcctaaacaaaagatcattgtttgtaatgctttggcattttttaagttcacatacatgattttcacacattcatcctagtcaccttgtgtgttgacagtcaactgcttttgccatttataaatgagtaaattaaaactcagagagtggaaaacattattcctaatttacacaacttcaagcgctggaaaaataaaagcatttatttcagttctaatgattctacatctactttccttcatcatgtataaatagaagggtagggcttttcacctggggtacaattttgggaccgtacactgctatctctgatcttgggcaagtcactaaatccaggtgaccctcaaagttctcatacattttaacaggaactaatgataacatatatgctttatatatatttgcacatatatatgcatatatacacacatatatatgcacacatatgtatacatacatatacacacacatatatatacacacacacacacacatatgccacagtcaatgtgctctatttgggccaaaacatgggctcttttttggagttatcctcctctttaaaatataagcccaatggcaagaaaccagtcatctattcaagatggccatttggactatatgacctctaagttcctttccacatattttcttttatagtctttattttctttgcagtccccaagtagtgcagcatacaacatcagagtttcaataaaggctggctgactgaagctttcaaactcccaacacaatcacgtttatgttgccaacttttattcagtttgtgatttatgggcatatggagtgttttgcatcccagagtttcctcttttgagtcatgatttgcaaatggatataataacccataaactgatatcagcatcaaaacagagccatccaactcgagtaatagatggccttcagaggaaaaagacactagcccattaggaagagcacaaacaacaagcaagcgagtgtgaacaacagccttcataaagtcagtttctcagttcattccacacattctgtccattctaagataatgtgtgtgacaagggcacaatctaatcagactctcactctcccttggcaaggcaggcttgcaacaatagactaaacctcagccctgccaaccccaaataggcatgccagtctgcctcattccagatttgtggcttgtctccacaaagtaatagtgattctcttgtctgtaccaattgcaggctgcagatgggtagcctaatgctgtaatttcggactaaattctccacagatgaactggaaaatttcctcactcattcagaaatatgccagccagctgtcagatctccaggactccctcacttgcccagatcaccaatgaacagacggcgttcaccacaatgattaggctgtgttttcagttcaaatctttttctcctaattatttaatctatttttctttcttcgaagagtctggagaatggtcattggaaatttcttaaccagaggaatctttaagaaagcaaccgagaaagctgcttttctcagttttttatcccttgggatcagggataaaaaagtgtatgtctatgagctgttcactggccatgaccccattccatgccaatcattcttccaaggtacccagtagaggacaccttttttgtgccaatagagacagggaatagggaagcagatgcctgctaactacttgactgccactacccataaaggatacaacataattttaggggactccaaaagccaatatacaacatttaagaacaagaaataagtgataaatgtatacaaaaagtatgaaagaagaagcaattttattttcatttataagatatgagaacattgctcagtctcaaatgtcttttttgacttcccatgtttaaatgaataaagagaactttaaaacatcacctacgcttaggttttattgttgttgcttggtagaattttttcttcctttagcatttgatctgtgtacaattcgttcacaaacatctgagagtgtccattcacatggtctttctctatggagtgaagattttgacaaatccaaaaattctttctgaatgtgtttctctcagggctcttccttgccaattattagtctaaatgattcactcacagataccttcccagggagcccaagtttgggggttaaatagactaaaatccaaaacctggctctgtcatttacagtgcgcaagacatttggaaacttatttaacttttcatagccttaatttcctcatcttacagagttattgtgaggcctctgcacatgctgtcaagcccctgccaaaaactccccaatgacttcccacagaaactatatagagtctaccaggcctgttaaatctggccgctgcctacatttttcaatcccatctcattctagtctcttcctaacacaacatgtcaaggactctggcttactttctgtttcttaaacatgccaaatacttgcctctctcacagccttctcacatcctgtcttctctacctgaatttcctcgctccctgtaccagggctagtttcttaacctccaggtttcatcgctagtatagtgatgccttgaataacaaagttcccatgaaggacagaccacatatgcaacagtggtcacatatgattataacagagctaaaattcttattgctagtatgccttatactatgctttttattgttttagagtatactccttctatggtgtatgtgtgtgtgtgtgtgtgtgtgtgtgtgtgtatacacatatatatgtgtatatatattttatatatatatatatatatatttatatatttagaattaaccataaaacagcctcacgtaggtccttcaggacatattccaaaagaaagtgttgttatcataggacatgacagctccatgtgtgttattgcccctgacgacctcccagtgagacaaggtatggagactgaaaacaatgatattgatgatcctggctctgtgtaggcatagactaatgtgtatgcttgtgtcttagtttttaacacaaaaagtttcaaatgtaaaaataattaaaaataaaaatgtttttaaacagagaaaagcttacagaataaacatataaaaaaagaaaatatttttgtacagctgtacaatatgtttgtgttttaagctaagtgctatcacaaaagagccaaaaaagttaacataaatttaaaagtttataaaggaaaaaagctacagaaatataaggttaatttaatattgaagaaatatttttttatacatttagtgtagcctagtagtacagtgtttataaagtctacagtggtatacagtaatgtcctaggccttcacatccactcaccatcactgactcacccagagcaacttccagtcctgcaagctctatttatggtacgtgctcttatatgtgtgtgccattttttatcttttatactgattttactgtacattttctatgtttaaatatatttagatacgtaaatacttaccattgtgttacagttgcctacagtatacacactcttttgaatctaatatcctaggaatgtgtctgaataagtaattttagattttcacacaatagttccaatgtgtaagagagtaatcaggtaaagaaagagaaaatgaagagactgtgcctgggtttaatctctatataaaggaggcagcaacatgaagactccagaggagtattaaggggctcatagcacttatattcatagtaaacagggacagataggagctaacatttattaggcataacagtaacatactgtaaaggtttgtaggctaggagcaataggccataccatatagcctaggtgtgtagtaggctacgtcatctaggtttgtgtaagttcactctatgatgctcacataatgacaaaattgcctaaggatgcatttctttgaatgtatacaacatatatctttattatacaggtcctcttctttgtcctgtcatggtgcctattggttttctttatagctattcacacaatttttgcttatgtatttgcttcttattagctccctccttcacggaggtagacactatgtttgcctggaagatttcctttctcacaactctgttgctttgagtacttgcttttccttagtgacaccacttagacttcctagactaggctaaattccctttgtatatatttccttagcaccttgtgctttccttctggaaccctcaaaatacttctaattccttgaccattgtttctctttcctaatatacttccatgagaagagggtcccagtctgtcttgtactatgtccacgctgctcaatatagtacccgacaactagaagaggctcagcaaatgttacctcctatctgtccccatgttactatgaattgtaagtcccatgagccccttaatattcctgtaaagtcttcatgttgctgccttctttacgtggggattaaacccatgtacagtctcttcattttcttttattctcttgcacttcaaaaccatcatgtgaaaatctagaattagttattcagacacattctttggatattagatgcaaaaagtgtgtaaacacagagcaagcagaatgtgtagaatgtgaagtaggatgctcacccatttgctttgatggtttagggtgggtaagcaattatacacgtacatactaagtaaacatgacctggtggtttctgagaagcttctgataaatgtatctctttcctaattttacagttacatcttgtcttctttagcatttacattttcctcctagctttccctcttagctctccatagcagcctggttttcactttttgtgtcttctagcagtgggcatttttcccaaacaccaaacctaaggtggctacactggtttgcctttctctatgggaaatcctgtcctcaaaataatccccagttggcgaaatgcatagctaaggaaattgttgtcacatgaccaaatccaaatcaagctgtcaaataaagaagaccactaaatgttctggataggccaaaaataaacaaaaagtatggactttcacagactactgataaaaatgttttattcctcttctagaggacttcccatgtttaaagtcaccctcatgctaaaactctgagctgtggcaattaaaaataaagctatattctttttgatcattttgttataataaaataataggtattttccttcacattcacaattatagctttctacccctcccaaaaaattcttcttctatttagtcccaagcaaaataaaattaaagtttgagaagctgtatgacaatcaacagaaatgctatccagagaacaatagcaatcctataatggtaaaaagttaattatatgaagacctgcagaattttaaaatgtcagaataatagagcaaatttattgaaacgaaactgagccttgaaatgcttaagctttcacaggagcacacaaatttatatttcaataaacttttaacataatgtcactttaagaatgaacaacatgtaaaatggccaaggaacaacattctcagttaaacagaaaagcatctctgagacgtttgttatagggaaaaatgcagaccctgctgatatggaaatggtagatattcactgctgactacagcgatgaaaaaacagttctctgaaatacaggtattgttcaagttacaaagaattaggcaatattacaaagctaacttaaggttttcttgtctaggagggttatattttctttccttcccttcatgtattccatatctatctcttacacatggcaaacaaccctatccttctggtcaaaaaagctagattttaatcctgatggcgtgaagctgagcaaggaacttcattttctgaacctcagctctttatcgaactatgccttatagatttctcataatacttacggactaagcaaagcaaggtgtgcaaagctcttggcataaagccttgcatatattgtatgcccaataaatgatggtgactgttaccattttcatcttttatttcaggaaaatagaaaatacacatctcttgttgtcttgtgactttaaatgtgtcctcttggtcaatcttcatggcactcagttttatagttctcaaattccattacagcaatttcaaaatgttttgcagcagttcacaaaactgataaatagacagtcaccatttaaaaaggaaaaaaagtatcatggatgacctaaaatatcactgcagtcacttgagcactgaagttaaaaaaattcaatactaaaagtaaaatgctgtcttttgatgatcactcacagcaatgcgattgcaaagacaattgcaaatttggtcataaatcaagcggaagtttttaaaactggccatctaaataggcaacaatatatttatactaattttaaaaatcattttgaaaattttaaaagttttctagtcctgaaagtccttgtgggttccctggggaaaaaaaaaaagtcatcattatatgccagtttgtaaaaccaaagttatagagcaaaagaattttgtgagtgttgttctagagagcagattcatctgcagaggctagaggtgagactgaactgtacccacattttacaataaatatatgtattcctatttaaaatgcatttaaaaatcaatgctttaaagaaaacagggtaaaaggaattacaggagggaaaaactcactcccatattttctttgtattttttactttgctttgcatattttttcaatcattctttgagaagtttgccataaccaatccaaggtcataatcaaacctatggagctaagtcaggtaatataaaaaaatttatctggtcatgtgtaagaaaacgtggaatggcaggaactctggtggactaaagagcaaatactccttataatgagggcgtaacttctatcgggttccaaatgatcattaccataaaaagacatgtgtcccagatcttgtaatttttaataaactaggaaactagaactttatataaaatcttatttttcagtgatgcagctgttttaactaaaaaaaaaaaaaaaaaaaaaaaaaaaaaaaaaaaaaaacaccactacgcaagctaaacgaaacatatctctgagccaaattcatccccagattccaatttgcaaccatcagcatttagggacaactgaggggcaaacagaaccaaactgctgggtggtctgtagaaacctttgtctcaccagatgggttgggagattaaagagtttgagacccactgccctaacatagtagcatgaacgaacatgatttcaagaatatctagttgttcattttgaccaagggttatttaaattagataaggattaaaattaattacagccttcttatagctgagtagctcagtaagcgctgcttggaattatcttacatcttgatgtctctctacacatagaaaccacccagcaagtcactaattggcatattctgcagaagtctctggagagaagctaagaaagtgagcacttgctagcttctgcatgctcctcaagcatgctttccctggagatgggagctgtcacaggatactttgatcactggaggcgctggggctcctcctcactttcaatatgtccggactttaacagaaacacaatattgtactaaatccaatcttttttttttatacttatgaggaagcaaaataaaatggacaattaaaaatctatgaaggtcgattgatttcctctactagcaattatgcctcataattgtttgctgaaggagaaattggcattttacaaagccaatgattggctgggattttgtgcttactaaacctctgtggatttagagtttgggtttggataaaaaccatgaattgagcagcacttgagaagcctctccaaaagcctttcatctagaagcaggctggtgagttcacgaggtttctgacatttctcctatcccaaccaggttggaaccccactgtaatcaaaattcacaatgttccagaacctagactttgtttctcattaaaaatccaacagacaaaaaaatccaggaggcctgctagccaaaccttttcacacggcagggaaggtttgcattcagttttattttaagttagcagactaggtcggaactcattttgaagcctgatgaaagactgagagcctgcgtttcatcttctgattaatccaaaattaaacaattcagagattttcatcacttggtcttttcttttaaacatatgtgacagataagaaatagccatctctagcacacatagcaggatacattgtgtttgcctgcaggctctttgtgggccattcttaagcttattctaagatcagatagtaaatcacaatttccttttaagggactgttacagttttcacctcttattgaaaccaaaatgtgtatttttcactacttgaacattacttacctgctgttcatagtctctataaaaaaattctcatcttatttaaaaaaaaattttgaagtgaatacatgatttatgcattcttgtaacacaagaaaggaaaaggaaattaggcatatatctcaaggctcattagttgcatttgagttaaacataaatttttggaaataaccaagtattttgcaattccaaggttttgtttcctaaatcaaaactttaaaattaaaagattttgtaaagaataaataagcaacacttcaggatagaatgtgaaatccaatataacaagtaacagtatggatattgcagggagacaaatgacagtccctctagataaagtgcttgtggccatcctattcacccatcttcaataagctcaccttttgtaaccacctcaatccccttccattctggtttccctgatttcctctacccttgtacttccaagcacagtaaggaatttcatcactcaagtccccatagaagtttatctctgtctttttttttttttttttttttgagacggagtcttgctctgttgcccaggctggagtacaatggcacgacctcggctcactgcaacctccacctcctgggttcaaaagattctcctgcctcagcctcctcagtagctgggattacaggaatgtgccaccacgcccagctaattcttgtatttttagtagagacagggtttcaccaggttggccaggctggtctcgaactcctgacctcgtgatccacctgcctcagcctcccaaagtgctgagattacaggcatgagccaccacgcctggcttctatctgtctttttctttttttttttttgagacggagtctcgctctgtcgccaggtggggtgcagcggcacgatctcagcccactgcaacctctgcctcctgggttcaagtgattctcccgtctcagcctcctgagtagctggattacaggcgcacaccaccatgcctggctaatatgtatttttagtacagacagggtctcatcacgttagccaggatagtctcgatctcttgaccttgtgatccgcctgcctcagcttcccgaagtgctagtattacaggcgtgagccaccacgcccagcttctatctctcttttctaattcaccacaatccattgtgattatttgtctctatggatgtcttcctcaaagactgtgatcttcccaaggactaaagcttaattgtctttttatcctcaccatagagcaaaacacctgatatttcttttgcatatgcacttgttcatttacacactgaacttgcaaatgagtattttgagatgctttataaaaaagaggttcttacaatttgctggaagaaaagacacagccataagtaaaatagaacagagtaaaagtaaaaggtgattagttggtgcccagacaattgctacacagtaccagtcagggtctcagcaggaatctgatggcacattcaaattgaatccattaagtagagtttaataaagagactatttgcaaaggtgtcagaaggatctaagaaatgaaaaataaaaagtggatagtagagtgcctccagaaaaataacagaggaaaactctggagtttttactactctcggcctgaagggcaagacgaggaagttgttagtggtagccagagaaagaactctgtagagagggccacctgataggaggtgtggacttaccaagagaagtaactaacctgcagagagctcagagaataagtacctagtctcactctctccgctcctttagatctctttccggaacctctcatgggccaaatttgatggaattccaagggcagagaaatcccttgatagagttgatatgaatcaggccccagagcagggagcagggtgtagaaagaggtggaaggagaagacatgtaacacatagtataatcttgcaaattcatttctgcccattttagcaaccagccagaacaaaatgagatgcctaattggtttcgaaaatctgtgcatttatcattaatagcatatcaatggtttgtgaaaagacacaaagacttgagataaaaatctcccatgggaagctctgagagtgactttcgtagagttccttcttgtagcatgcaccgaggcacactgaggcacggtatacagagcaattgagaagtaattctgcaagttcacaataatgggttataaacctaccggtctcatggcttgataatataaggctaaattttagagaacttggagaaactgtcaaactgagtatctttgatatggtttggctctgggcccccacccaaatctcatctcgaattgtaatccccatatgtcgagggagagacctggaggaggtgattagatcatgggggcagtttcctccatactgttctcatgatggtgagggagttctaatgagatctgatggtttaaaagtgttccttcccctttcactctctctctgtcctgctgccatgagagaaaggaccttgcttccccttcacctctgccatgattctaagtttcctgaggcctcctgagccatgcagaactgtgagtcaattaaaccttttttcggccgggtgcagtggctcacccctgtaatcccagcactttgggaggctgagacaggcggaccatgaagtcaggagatcgagaccatcctagctaacaaggtgaaaccctgtctctactaaaaacacaaaaaattagccaggcatggtggcgggcgcctgtagtcccagctactcgggaggctgaggcaggagaatggcatgaacctgggaggcagagcttgcagtgagccaagatagcgccactgcactccagcctgggcaacagagcaagactctatctcaaaaaaaaaaaaaaaaaaaaaaaagcaaccttttttctacataagttacccagtcccaagtaattctttctactttgtgaaaatggaccaatataatcctttatgtaattctccatgagtatcagccactttctttttaacaaagatttttaaaacagttgaacaactgacagttcatattctctgacaaaggcaaggatcacatacgaatgaaaataaagctgtagtcttacttatcaaatgaacgaaagatagggccagttctcgcgtgaaatgtaaggtgcctaattctaatatgtatctgaatgggtgttcaacacaagccaccccacgcccacagggtcaggatggtcctaaactctctgaaagactcaatcaacatttgttttaaaaagcagaaattatcattctactctatgtgattaacttttgttggtgggtacaaacatattgttggatagaagaactaagtgctaatgctcaatagcagagcagggtgactacagttaacaacaacgaactgcatatttcaaaccagctagaagagaggatttgaaatgttcccaacacgtagaaatgataaatgctcaaagtgatggatattctaaatactttgacttgattatgacacattctatgcatgtaacaaaatagctgatgcaccccataaatatgtataaatattatgtattgattttaaaaagcagaaattgaaacacacagtggggcacactcccagtttgtgctttctttatctttgctaccaaacagatgccacaggaaagcattttcttctcttcagtatatataatgaaagaaaccagttattttactacttgttacaattaaaaaaaaaaaaagctcatgtccccttctggtgttctaatcatcatcatcactcagagttttaaattgcttactaaagtgccagacattctactgagtactttatatgccttacctcatttaaattttatgtaaatatcaccatttccaatttacaggtgaggagactgaggaacagaaagcttaagtaatgtgctcaaagtcatccagcatgccagaggatttaaactttgaaagtctggtttcagagacccgcctctaaactgccacacaatttcaacaccgtagtctaacatgagacagggaaagtagattggaaagccttcctgggaaatgagaaacgacagaaccaagaattgttgcgcaaataatacttgtagctaaacacttcccaaactaggattttacaaaacatcttatcctgtaagatgcaaaaggaaaacaaggattccaaggatagtgaagctgaaaaacacagcatagtataattctattttatgagaaatacaatacgtatgataatattacaggctctgataaaatatttattaaaatattttttctctttcattatctagatgatcctaaagttatttcatcaatgaattcattcattgcttcattcaatgaaatgacctgtgtgttcctaaatccaaaggacttctaggcagctctagacacaatagaccttgccctccttttgaaacatgctctttgcatggctgtgtaggggccaagggaaaatttcgacttcagcctctgaaaagtttgccgaaaatcaaccgacaaaaggcagattaataggagaaaaggcatacaaatatactaacatgcatgggagtcatgcaagatataagagcgcaaaacaatggccgggtagttgataattttatgccatttcgagggtatagaaagaatgggggcttggagcatggcaaaacaggttatgggatggggagaaaagaagacctagctagcaaaggtagtgctgttccatagatgaaacatcacaggtagcagccctcagagaagatatatggcaaatgtttcttttaaacctttaaaggtgtcagactctcagtcaatctttcctagatctggacaagggagggcctcagagaaaacctggctgcgtcaatgaagattctctacagatacaaatctttcccacaaaagacagctttacgaggctacttctgtttgcaggtcctctgaacagccatctaaaaatatgtcaaagaagtatattttggcatgaaatattttggcttttatcagcttttgcaatataatgatcttggtttctttccttctatatatttttggttagtctttcactagctcatccactgcctgccagtcagcaatatttggagtcctcaggcctcaaccccaggtcctttccttctctcactcaagagtctctctctagattactgcattcatagctttaaaaatccacccatttgcagatgacacccacatttaaatcaatatcccagacttctttaagctccaaaaccatttttccaacctcccatttgaaatcatgtttatgatgtcccaatgtcctctcaagtgcaatatattcaaaggaaaccttgctattttcctcctaaaccttgtccccttcctgtagtgtgctctcaggcagtgatagaaggaaacatcaatttacttaccaatacctgggtatcatcttgtgactctctttcccttactgcccatattcaatcatcatatcttgttgactctgttgttaaatgtctctcaaaatctttcaattttttcatcttgacaattataagtatagtccaagttaccaaaatcattttcctcacctttttgcaacaacatagaaactgtcatatgtagttgtccctcagtatccacagaggattgtttctagggctcgcttacataggtcccttatataaaatggcatggtatttgcatataacctatgtgcattttcctgtactctttaaatgacctctagattacttataatacctaatacaatggaaatgctatgtaaatagttattgtactctattatttagggaataatgacaaggaaaaaagtatgtatgtgtgtagtacagacgaaatcatccctttttatttttccaagcatttttgatccatggttggttgaatccacagctgtggaatccatgaacaggaagagccaaccctgcatatctatcgtgcatcagccactctaatccaatctattcttcaccttacagacacacccaacaagcccaaaatgtgtgatatttttaagtgccaatataatttttctacttaaaatatatcaatggcttgtcatttatttgattataaataaaaccttcttaagatgtccatcagtgccttctatgcatggcccctgtctatctcttcagcttcatctaagatttctcttttgctcagtctccatttgaaagacctggaccttttgtaatgcaacacacacgctgaactcacacctagaatactggcacagcttatttgttctatgtgtttctttttcttcctcttctatttagtaactactcaatcttaagatgttagccatgcatcacttcttcagaaatacctactttaactcccagatgagacctaatgcccctattttaaactttcatgaaattacatggttatcctttatagaacttgtcttatttacaattttacattttctagataatcattagctcaatatttatcttcccccatgacttgaagctaaatgagagcaagcagtgtactttttgttcactactattatctctagtgcctagcatagtaccctgaacaatgtaggtggacctggagccaggcactatcttatcagccccatgctaggtgctgtcatagaacatgcaagaagataaagggcacctctttgctcatagaatttgtagtctagtgtaagaaaaaggtaatcaataagcaagtgcaatgcaatgtgtgatggggttaaaacatgtgcttctggggaaaactcagacgtggatggttaaagaagattttcgtgaaacgaaagacctaaataataatgatcactatgtgaacactgagtgcatagcaatttacactgctcttcatctaataagggaggtacataggaaaactagggggcaaaaaaggtgtgtgacttgccaaggtcacttggctaattaaaagaggatctcaattcaaacctagacagtctggctcccctagtgtgttcttaactccatattgtgtggaatctttttgggttacctagacaaaggagagtcaagagatagtcagggttccaaaggaagggtagagcaaaagcaaagactctgaggcaaaaacaaagaactctgagcttctgagaaactaattaatcatgttgcgttttttgggggtgggggggaaaccatgagcgacaatggagagattcaactggagaagggcaaaccaaaaacagctaactctttttaaaaatcctattaaacccttatcctttgggacgtgtgtttttggaggactgtaagagaatattgctcgaaacaaaccaaagactgttgttataggtccagtacctacatgagccaccactccttttcaggaccacaaataaaagactacatcaaattaaattactttacaaatatacattctctagtcacaaaaagggctcaaagggagaatttgacttcattcaaaacaaacctactccagcaggttcacatgaacctcagagttttagaacttgaaaattttttatcttaccaagtctatttgcaatgatgaggaaaaaatacaaagacaattctagaaatcacttcccctaaaaaatattcaaaaaggatatagttaaaaaatatagaaaatatagtgagctggtcctttcagcctcacatctttgaaggactatgcagggaaagagggtgtaatgctagatcaggcatttttgcacatattatccacagagaaatctaaatctataaccatcatcataaaataaagcaagaagaaaatcagaaagaaatgaatgaagggcaagtgatagccgaggggctcacaacaattaattattaaaatgccttaaaagagcaaagaaaatgcttatcagatcagcaaagcaccttttaataaataatatgatttgggtttaattaatggcctaattacagttttacccaataggcttaaatgctccaaaggagcagtttgagcctctttggtagataatctgtgtttttaaaaatgttctaattacatatttgcttgagtaaataatgtgcattttacaaaactgcctaatgatatatttatgtgactatatttacccaaatggcctctcattctgtactaatggagttgggattactgttcctgagagatacaggaaaatcggatggctccagctttcaccctaacacccctgttattctcacactgttctcgctctctcaccccaaaacataccactgaaagcatatgacccacttattcatcatcagtttaaacagaaagaaaattcttcctcagccttttgtgtaaacacattttgcagagaggatatatgcttgaaaaatgagtattaatactgtataatgctccattaaaaatagataatgagactgtgaccaaggcagaacatccaaggtttaagtagctgcataatttattctgttctttttatagtaagttacaatctttacaaagactcagactgcatgtattggaatcagattgcgatggcttaaagccacatgatggtctgcaataagtaacagacaagtcataaaaaactgagttggaacctcccagttttgtggtggcactctccattcataacttttaagtcattttttgtgtgtttttgagacataaatctagaaaaaatggatgcatattcataacattttatgaaaaggcactaaaagttccatttcatagttttcccataaaatctgactcagcagacatttactgtttgaaattaggtgatgcttcattcacaaattaatgaaaagattccttttaagcattgaaatatggtggctcctcaaaaaattaaaaatagaaattaccatatgatccagcaattccactcctgggtatatatctaaaggaattcaaagaaagatcttgaagagatacttgcacgctcatgttcacagcaccactatgcacaatagccaagaggtagaagcaacccaagtctctattgacagaagaatggataaacaaaatgtggcacatacatgaaatggaatattatttagccttagaaagagaggaaattctgacacatactgtaacaggaataaacctgataatgttatgctatgtgaaataagccagtcacaaaaaggcaaatactgtatgattctacttctgtggggtatctagagtagccaagctcattgatacagaaagtagagtagggatttccagggaccatggggatgcgagaatgggtagctgttatttaatgtgtattgagtttcagtttcacaaggtgaaaaagttctggacattggttacacaactatataaatataatcaacattattgaactgtacacttagaaatggctaaaatggtatattttatgttatgtggtttttgccacaataaaattttttaatgcattaaaatccttttaagatagtctatgtattggcaaaggcttactatttccttcatgcttattaagcatttactgtgtaatagtagccctacaagtaacacagaagtgtctttaattcaactctgggttggttaccacatcagccaaacttacattttttataggtttccgtaatcaccctcttagatacagttcactatccccattttacagagcaagaaattgaggcacagaagtgttaaaagacaaagcagaaatttcaagtcagatactaggtcacgagctcaactagaatatacactcattgttcaataatctatgtaataaagaccagagatagaagactaatcactgaaatggccccaaacctttttcaaaggcacattctttctggtgtccacacccaatagaaaataaagtttgactagaatcgactctcatttctcctttgttattaaaacaatttgtcactgtgacaacaaacatctattgaaaacttattctgtggcaaatactgcatctttcctatgccctgtaggaagatactattacctccccattttacaggtaaagaaactgaagcttagagaattgaagtaataggctcatgttctagtttataactacgagggctaggatgaggtttcaaacctagaccttccaacatttgagctgcactcaataattactaagtatgactttccacttggtagagggaataattatagctggctagttggaaaggcctgtggaaaggtagacaaaaaagtcttgactataaaactcccacacaatggagagaggactccattacagaaccatacagcaagatcctcccagggtatcaagccctcagcagatacgaattattttaacctgtggctttcttgttcacactgcccttgtttctgatggaatgcaataggagttacactcaagacatgtatagcactgtggtcaagctaacaaaaggaatatggatcacaattaccagcaaccaatagtaatagaggctaatacctctaccggatatgttttataaacaaaactaggaaaccccacaaaaacctgaggcaaataccgggcatgtgctaccagtcagacactacaattaaggtgtagatattcatgaaaagcaagatttctgctatctggcatggcccagagaaagaacataaaattcctattttttagtcattccatgaacaaggtaagtttgaaacacatacaaaaaaagataaaatagttcattgagagaagaaagaataagaaaaatatctaggtgacagaatagaattgaggaataaggttagtatgcaatcctatgcattcaataatagcctacagactctaagcttcctagagaccaaagcaaagcaggaaagtgacagttacgtaagtcagtcaaaatcaaataatcagaaaaacagatctcattgattttcagatctaaaaacggccactttttgcacataatattttcaacaacatcccaatacagggtacaatagtgagtttcatatgactgcaaattaccatttaagtcaagggcagagtctcatattttaaaggatagaatccataacaaatataacattaactgtactggtcacagtgacagccctcttggatgattcagaagacattccaataattgcagggactcagggccctcattatgggcactaattgtattttactgtaattgggtaaaattgctacttgagagttcaagttgatagagtgccagattaactaattttcaccttaataaatgtgcgattatttatcaaaattttgaatcccaatgctgacacacttataaattatttcttactctgggcactacttcacagagttcagatgatcccattgtgcagactgaaagactcgtgattccgaattgtaaagattatttacagcatagaccccaaagcactaaaatccattcatttctttcttctaatccaacagcctctgagatggcttgtctgcaggggtgcagcagcagcaccatctgtttactctggcctcatttgcccggatcaagtagaaaattgaaggcactaagctgaatttttcagaaactttgcagtaattgaaaaaagaagatgataaagaaaaagagaaaagctgtttggccacttaattatactggtcactctgtgggctacacaataaaactcacacatatttttgaaatagcaccaagctaagggcataccataactccaagcactatgtagaggagcccatctactcaagtagtcatttaaaattagtatatgaaactcaaccctgccgtcatttattattgaaattgccttaaggtgatctcaaaaaaaaaaaacttcatcttttgatttacctcctcctcccttttctaaaagtagcaaatgaaatttgtgggattagcctcttaggagcaaatcgacagagacaaaatgtaaccatgagctaattcttggcagggcccagaagggacgtgccaagaggacatgggtggatcatgggagaattgattggaaagattctgtgttcccagaagagagcaggcttcagtggtttctctcaagttttattgcacgttagcacagccatatgctctgctcatgtgagcagcacctggggggagtacattggcttcagactcaagtggagacttgggaagtttgtttagtaaatgagacctgcgataactgcagaagcggcccctgtcctccacttatacataatgtatttcttcacccagtctatgagagttaggtttttttttttttccattccatgtccaccaagagaagaaaaaaaaaacctttctgttactataaaatacacagaataaaaagtctatcttggtgtaagaggatagtgagtggctgaagggagaggaagaaatcaatatgtcttatcaaacccacatcatattgtatataccaaagtcattagacccagagcctacttcttaggaataaatattttgccctaggattaaatccctttatgccacagaagttgaatttctttcagccaaccagaaaaaccacaacaaacaaaactcaatatagcatcaatagagtggaaaatgcaggaagcaaagattctgtaggtttaaatgggaaaccctgtagtttgttgtatcccagctcagaaccatagcattttgggcagtcctggattgtaaaacttacagctggaataagccacatttgcaactggtactcatcctggtccccaccctcactccctgccctctactcagagtctccctacagctgccactgtgttgtcacaaagctcctcacaactcacccatttggaagcccatcctcttaaactgctcttcctggcatcctctcctactcatctttcctggctcctttctcaccatcaaaccttgctgtttggtttgctagtttctcagaaactaggtaacaaatgagagtttaattaaatatagagataaaatgcaaatgtgttacaccctctagaaagcagatttatagttaacagaggcctcagtactttaactcatgggagagccgattggtagaacttcgggaaacatggcagtatggaggggaaactatctgcaaactagtgtcttccagcctattccagcagatcacactttatcagttatgatggtttggccgcaagtcatgaaatctctaactcaaatagccacaattataaggatgtttatcatctcatgtaagaagtcccaagcactaacaaggtgtaaggctgacccatctctctaccctgcccctttcagcatgtgcccaagcttgtccccactaatccctctcatgttgccaagatgccccccatagctccaggcatttggcatagacacaaccaagcccagaataatagcaggtatctcatcttacatatctctatcagagagacaacattgatattacccactagcaatcttctcacatatcattggccagaataagttcatatacgccttcctaacccagtcattgccacaggtgatatagtaattatgcctgccttacactactcagactttttcttacagtcacttaagagaggacagaaattccaaacaaaattaagattcttttcttatggagcccaatagaacttaaatatcaatcttttctcatatcctaatgtactttggttcaaattcagttatcaaactgttccttctgctaaagcctttgccactttgagctttatggattgtagtataagagaaaaaaaggagaaagaacagaataattagaagatgagagaaacagaagagtcttaattttgtagagtctagaagattttattacatgattgtcagtttctcaaaaccactgacctcccacaataaccctaaactcagaagtaagtggttttcttaaaccagaagaatgaaattaggagcaggtgagtacaaacataaacaaggtccactctgttggtgatgtagaaattgaaagtgacattttagacagtgccaacacattaaaagcaccaataacaaacattgaagattatatttttctggaagttgagaaagccagcatttaccttaatccttcatttcattgatgcaaagtaaaaaaaaaatcagccatgcccactgctttaaatatcagcgccaccttcacgtggagtcaaatgattaaaaagcgaagggaaacctgaagctctttttgaaaagtaatttccatggacacacctggctggaggcaggatcgctggccttcatctctacatctgctaaagaacctcataacactgtgacttctatgacacagcttttcacagcctggcttatactatgaataatattatttaaaatagaaacaaggtcttctttacctttattgcacctcctagagcttgaaaatatgcaaattaggtgttaatctaaatttattggaaaataatagtttggtttacaaaactgtctgtagaaagtaactgaattattggctgggggctgtggctcatgcctgtaatcccagcactttgggaggctgaggtgggtggatcacaaggtcaggagatcgagaccatcctggctaacatggtgaaaccccgtctctactaaaaaatacaaaaaaaatagccgggcatggtggcgggcacctgtagtcccagctactcgggaggctgaggcaggagaatggcgtgaacccgggaggcggagcttgcagtgagctgagatcgagccactgcactccagcctgggcgacagagcgagactctgtctcaaaaaacaaaaacaaaaaaaagagaaagtaactggattgtttatagtgtgctctatttaacaatacagcataaggatgtctagaaagtttcttttaaatatgttaaagcaagacacttaaatcattaatgtttcaccattaaacattaatcattaatcattaaacatttattcttaactggctaaaaaaacgaagactgccagaacaaaggttatgaaatagttatgtttattgcagtgaaaaatcaagacacattagcatataaacaattttggatgaaagtttcactttcttaaaagaagtttctcgtacaaacatatcttaatacactagtatcagttaaacggggtcttccccaagagccaacactggagccttagcttaactactcttcccaacagtcaggaaccaaaaaagcaaagcgaaacacctgtgcttgtctcatagtttcactgcttgtccagggaacaccaaacaatagaaagcaaaacctgtggccagtagagcacattttactcagtggacttctgaacaaccatatcccatttgttgaataagtattcatcttttcctactcattttgacggccaattttgtctcctataaaatccaagtataatattgacttttaaggatattgctacaagtgcaccaccaccaaacacctaaaacttgacttcagctttccttgaggaactgccttaaccaatgtttgccctttctgcaagacccatgttttggcagccacctgtataaaaccatgtaaaatacctccccattgctttggcctaccgtagtgtctgaaactctaaccattaatatcattcaaacttttcaataaacaaccattaagtactatatgagggaaatgcattgattaattgttgggaaatgtaaaagttaattatatactatctctattttatagactatataatccactgaggaaaaggatgaaattacaaataactatactggaatgcaatatatgctaaaagaaagcaaacaatatccaacagaggatcaaactagaaaagatgtaatacaattaaggcaacagaggaattttttgtagacaaggaaatgtgcaaagcaccatgaaagtcagatttttttttttttttttttgagacagagtgttgctgcatcacccaggctggagtacagtggcacaatctcggcttactgcatcctcagcctcccagattcaagggattctcctgcctcagcctcccaagtagctgggattacaggcgtgcaccaccatgccagctaatttttttttttttttttagtagcgacgggtttcaccatgttggccagactggtctcgaactcctgacctcaggtgatccacccgcctcggcctcccaaagtgctgggattacaggcatgagccaccacgcctggccagaaagtcagatttttaacacatgaaacactgataccatacaagcagaagaagcaaatgagcaaaagtatagggatcttttttctttatacatttctttcaaaatgggcaatccaaaatggattaaaaaagtcactgaaagaccctgcattaaagagctagcagactacaggactcagagaaaataaagtaattgacaaggaggttctgatagtcaagggaagcctttgaaaggtccagaacatgtggttcatcaggaagctcttgaagcctctaggagcataatgggatcactagacaatgagatggagacgccaaaattagatttgccttctttaccgtatattctccggcagtctctaacctcaatgtgcattaatcaattctgacaaagcaaaaagaaaataaatccaaggatgcactctgctcaagaatatggaatctatattgaggtcaagcttaaggaaaacaggaaatcacagtgaaggttacggttctgatagggatttgggctggctgtgctttcattcctttctaggtcacactgacatgaagcccagagacagctttgaaatctgctgaggaagtcagcacatgccaaaatggaatggaattccacacctctttgctttaagcgtaaggagctcgcatcagaaaaagtctagtgttttaaacaaagcactgcttaatcattcttaatatcctaaaacaagccttttgatcaccacaaatggataagaaaacaataagacagacaacagaaagaaacaataagacaacagatgcgtgtgctaaagatataaatactaaattcataagaaaaaagtacaaatagcagacaaacaaaaaggttcactaactagtaatcaaaaaaagagcaaattagaaaacctgggtaccatttttcacttagtaaattagcaacttaaaaaattataatattctatttgacaaaagtataccaaagttctttctcatgaagctgaggtattagataatcacaatgaggctttgactcagtaattctatctcagggaatttattttaaggaaatatattccatctatttgacagatcatattcacatcataattatttctaataatgaaaattataaactttaatataaaccaaagagaatgatcaaatgttctgttttatatctaaaatagcgacttgaaaattctgtggaacagggaaaatgcttataaatcattatacaaaattagacgtatattatgatcacaacactgtatagcattcatagtgacagtgtctaaaagaaaatataaagtaacaaagcttgttttatttggatattggaattacaaattactttttctctctctttttcctacattttcactagaattgatgtgctgctctaataattaaaaactctgcttctcattcatgaatttctaaatgccattcgattttaatgaaattattttaccacaatgtttatttaaaatacctggacacttgtcgttggtcccattcagttttgccaataaaaaagaaactattacataaaaaatagcccttaggaatgcatcccatttttcaatactagctgagaaggatccagaagtcactcaccaggccaatcccactcccagcaacacaccttcaaatcccatatactggctgagtgcggtggctcacgcctgtaatcccaacattttggaaggctgagacagaggatctcttgaggtcaggagttcgagaccagcctgggaaacagggcaaaaccctgtctctgccaaaaatacaaaaattagctggacatagtggcgtgcacctgtagtcccagctactagggaggctgaggtgggaggatggcttgagcctaggaggtggaggttgcagtgaactgagatcccgccacaacactacagcctgggcgacagagtcagactgtattaaaaaacaacaacaacaacaaaaacaaaaccatgtactttctcttctagttacagtcatgtgctgcatatcggcatttcggtctgcaacaaaccacatacagcatatgatggtagtcccataagattacaatgtagctaataaattcctgtgtgcttgtgtcttagtttttaacgtagattttggctttagaggatcccttcaaacacctactattgattgaactattaaataaaaattaaaatggcaaagataaattagaaattagccgtttctattgcttttgttcttcctttttcctttttcttcttgtatttcttttcaagaatccttcactgctccgtgggagacgctgagtctcccaagctccaaacccactatcagttagaggaagataggagtcttagctatactactatttcttaatctataagcaaggagccaagatatgcaaggaagtatctgggacagtgagaagctgatgcgttgtgccatttcttgcatacatcttcagtggggttctactccaaccctaagattctaagattccccagtctctcccatgttctggattggaaggaaaagtttggagaagagagtctatcatctgtctctaattcatcagtcttgtgtcgaagacaaactgtgagaaaagactagatctccaggaacaaccaaaaggaaagattttgtgtgaggtccttcctgtaacaaccagctaaatctgtgaacttgtattcaggaatgaacaataacacagagcgccaaacgcggttactgctgatggaggatatgacagacaaatcttaaccttacctctatcccattctttttccacaatctctcctttgcctgtaagacagcaaatatctctaacagcagcatcaagcataataatcctctgagatctgctcccacagctactttttctccacctaaactttgacacaggttgccgtttgcaaacagtttgtactttacctatcacggtaatgattaacttcagcggtctcttgtgtctgagtaaagtatggtccgtggaacagcagtattgccttcacctgggaacgtactagaactgcagaaactcaggctgaattagaatttgaattttagcaagatctcagggtaatttttatgcacattaaagtttgcaaagtgctttaagaaaacctggagggtgacaccatttatcgccctacaaattgctatgagtgccaccacttcttgtggtatactgaagaaagcaggggttttggagtagcttttcctaggattgagaccactgctcatcacttagcagctgtaggtcattgggcaaattacctaacatctctagttttccatttccccatgtgttaagtaataaactctatatccactaaattgtgaagattatatgtaacaatgtatctaaaatatgcaattcagtgactgaaccagagtagatgaatatttgaaatcagaagcttaaagtatgagaagagactttgaaagctaattgtcaaatccctactttgcctcaatgtgctcagctttagccaatccctgaagatgataattacaaccttttctcatttgcattcctttactcaggagctcaccttcttttacataaaggaccaactaccccaaaacatctcctatcagacttccattgaacttaagatttatcactgttttgctattttatatagtgtcttgcttgtttttctgagctcattttgctttctttttagtcaagaatcctcaaaaacaaaatgactgtaacactggaacatggttgttgcaaactaatacaccactggatggtgacatatcatgttctcaagaccctataaaagaagtaaaccatatcatcagtttaacagcccttagttagagaaaagattaattcttttttttttttttttttttttttgagacagtcttgctctgtcactcaggctggagtgcagtggcgcaatctcggctcactgcaacctctgtctcccgggttcacaccattctcccgcctcagcctcctgagtagctgggactgactacaggcgcccaccaccacgcccggctaattttttttttttttagtagagatgtggtttcaccgtgttagccaggatggtctcgatctcttgatctcgtgatccgcccgccttggcctcccaaagtgctgggattacaggcgtgaaccaccacgcccagcggagaaaagattaattcgtaattcaaaaaatatacactgagcactgattgaaagaagataaacaaaaaataaaaagtctttgccctcaaaaaacttaatctgtgaaaatgtaatgcaataagtgctatgaaaaaggaaacatggaattttgggggagctcgtagaaagggggatctaaactatgtttttagggggtggagagagtgtttggggaagatgtcctagatgaagtgtcatttaatgtgagaaagtataagcaaattatttacatgcctatcagcacaactcacaaatcagaaaaagctggctgggttcaaatttgagctcggaggtcgagcaaatttattgacctttctatgcctccctttacacattagcataatagaagcaacgtttttatctacatcataggttaattgtaataatgaaaactttaaatatgtattgaaggctggcgctccacaaatgtttgctggcttaattccttctgtttgcatgaattgatgtaagaatagctatcctatctcataccagaatttctatgtgaagcaagtgggtcaagattatgagagattactgttctagtccccgaaaagatagctcaatgtgcatatggatctcaaattatatgtacatatatatatcaatctcaattttatatatactcgtgtgtatatatatatcaaattatatatatcttaagttatatgtatccacacacttacgaaaaatttttaaagtaaaataagaagaataaggtaagcaaaactctctgagaaaagcagacttcaaagatgcctcaaaatcaatctacccagcatcatactgtaagctccatcaaaccttccgcttcccacatgctttatctaaggatgaagacactctccagccataggcaagtcagaaacacaggagtcatccttgagatcttcttcctcatgcccatatctcactcaccctaagtcttgatgaccttgtctcctaagaatctcaaaaacaatcaccccaacttaaatcccttcttcacaatgaacacttggtcatgtggacctcagttctggacatatgtttggtatctagcataattacaataataaatgcaagctaaattaatgattttgtaactagatggagatcaataaagtgtagccataagaaaaaaaatttttaatttgtgatttagaaagtaccaatctacatttcattgactctctttggaaatgttttggtttgatggtaggaaaaatcttacaaataaatagatggtgatatctttaatagaggactgattaaaacataacatcaaaacctcatatgctgaaatagaaataacaaatgagacatagggatgtctttaggactgggatcagcaaattaaggccagcatgcctaatctagttttggtttttgttccactggaacacagccacacttactcatttgctattgattatagctcctttcctgttgcaaaggcagagttgaatagttgcaacagagactacagggcacataagcctaaaatatttactatctggctctttacggaactagcttggcaacccctgctttagaacatcagaaaaaaggcctctgtcaggagaatcgtttgaacctgggaggcggaggttgcggtgagccaagatggcgccattgcactccaccctgggtgacaaaagcgaaactctgtctcaaacaaaacaaaacaaaataaaacacaaattgtgacagaaaacaatgtactatggttttagagatttgtgaagagattaggaaaaaggggagatgaaggcagtgtttgagttaaggccttgtggtcggctacattatgaccccaaagataatcacatcagaatctctggaacctgtacatgttaccctatttgaaaaaagagtctttggaagatgtgattacattaaggatcttgaggaaaggtgattatcctaggttctttgggtggaccgtaaatgtcaccacaagtgtccatatgagagagaggcagaaggagactcaacacacacagaggagaatgcatgaagacaagagcagagatgggagtcacatcatggtacactgagaacgccaagcactgctggcggccaccagaggctgagagaggagagctaaggtttctttcccagagcttccagaatgagctcggcccaggtggtgcatgattttgaaactctgacctacagaactttgagataatatgttttaccattttatactcccaacgtcatggtaatttcttctatcagccacaggaaactaatgtagtcccactgaagaaaaatcgggctcatctctgctcaaagaagttgggaggaagaatgtgattgtatcacaatatttaaagtacctaaaattctatatttgatcccattaaattttgccaaaaaaaaaccactgttgcattaataaatagcatttaggaatgattcccatttttcagtgtccagaagtaattcaccatgcccattccactctcaacaatacagcttcaaatctcagtcactttctctttaattttatagtaacctgactgtggccccactattatgatttgcaaattttaggctttgtagagcaccagttctaacttttaaactgcatataaactcagaaagaggtttcagtgttaactctgccactaaccaattttatcaaattagttgacactttcaatttctggttcatcagaatgagaaagaaagaataaaggggaaaaaaaaggaaggaagggagggagggagagaggagggaaggaaggaaggaaggaaggatggaaggaaggaaggaaagggacggagagagggaggggaaagattatttcatattaattgacatgtaatgagattagaaaaaattattatagtacctcctgacatcagaagtcttctttttaaggaagctacctttgcttaagaaaaatatctcactgtgaaagaaagtgcaaccatgaagttttcagagataaagtgctctacataaaaaattataaaataaggttttacttttgatctggtaagtaggaagaaaggaaaaagaaagaggagagaaaagatagaaaggggagttggggaaggagatgtgagtaggttggagggaaaagatctgctggtccctcttccctgagagaaacaaacaccggtctcaaactgccctagtcctggttatctgccatgataacagaccccccaggcttactcctctgacctttcccttatcgcactaagaagatgaaattgggaatgttttacagcgccccccacccccaccctaccaccatacagcaactattgtgattcaaggagccaaacctaaaaaataagaaacaggcagggcacggtggctcacacctgtaatcccagcactttgggaggccaaggcgagaagatcacaaggtcaagagatcgagaccatcctggccaacatggtgaaaccccatctcttctaaaaatacaaaaattagctgggcgtggtgccgcatgcctgtaatcccagctactcgggaggctgagacaggagaatcgcttgaactcaggaagcagaggttgcagtgagccgagacggtgccactgcacctcagccaggtgatagagcgagactgtctcaaaaatcaatcaatcaatcagtaagaaacattagtcaataaaaccaggacagttggagtctaaggctctactcctcctttcatacacatgatggctaaaatggtttgaaaaggaaagagcatgcattttatattcaacaatttaggtagtaaaggctgaaaatataaattagattcaaaccataatccttcactaagtgctgtggtttgatacagaaagaggtacaaggggacatgacacaactagaagagaggaagggttttcctctggggagggtggagagtgccaggagaggagctgagaatggaaagcagagtgagggcttcactgtgtgtcgaaatgtagccctacctacacctcagcagggcaggaagcagctaccggacatgagtttaggaaacatttgcagaatctgaccacttctcaccacttccaccaccgtctctgtctaagccaccatcgtctctagcctggattcagctatggtgtcaccactggccattcttaattttcttaatgttgccaccataaggatatttacctatgtcagatcctgttattcctccattcaaaatcctgtaaaaatatctcacttcactcagagtaaaagctaaagtacttagagtgacttatgaggccctatcagagcccatctcctgctactttatacccctcccttctcattatcaaacacactggcctcctccttatttttcgagcctcctgccttagccccagtcatacccccagccatcaccactccctggaacttccccccaccccaactcacttcatcccaaccctgtccacaggctacctctcttaactctgagttctatgtttgaatatcacctagtcaatgaggcttctcctgaccacccaaatgaatgcctccgctcctccccaccttctgcacttccaaccaccttcacctactctagttttatattttatatattagcatttatccctttccaaattatataatgtatgtgttatatgtattatctccttctgcctccaacacctgggaatctaaagctctatgaggtcagggatctttgttttactcactgatgtaaacaatgcctggcaccttgtgagagctcgaaaaatatcaaatcatgaaagaaggtaaagtggaaaactactttccacaattggtaagttttttaacacagaataatgtaataatataataagtcaacatgtttttaaggcatcactgtgctgtgaaactagcttcaataaacatcacaattactcattcatttttttaataaatacttgaggagggcgtaccctatgccaggcactgttcccagttctgaagatataataattgagtgaaaatgtccttaaggaggttgaattatagtgggtaagagagacaattaataagtaaaatatttagaatgctacatgatggtaagtgccaagcagatgaagcaggcaaagaagctaaaactgattattatacttttaaaacaccaaatgagatagcttataataataaaagtgcttaaagaagtataaggcaaaggttgaaaattctatccaatttaagaagtatctttcttatgttttggttttactcaaagcaagttatagaagatgcgtcatacaaccctcacaaactcactgcctaagtggctgtgtattggcttcatattcaccacagactcctgcttcaaacccacagagagcactgtcattcctatgggcagatggtgcatgctcaccaggcagatgcagtgcacaggacctcaagtgcattcagtgattcccacaccctctggtaatccctcgatggcagcagaatgtgagaggcatggcagagtggccttactggctcagttctatcactctagttactcctgtggcatttcacactctcactaagaagtgagcccccaattcacttgactcacgtgagagcatcatttagttacagaatttatcgttattgatttgttttctttggttcccgtgaaagaaacaataaatgctatgagcagaaaatcaattgtggacattctaggcttatcatatatacctttaaacgcactcaaaattcttttcaaattatttgctgactatgccgccatcctctcacttccagaattcgccaagattaccggccctcttccctttgaagtcatgtgcagccacgtgacttactttggctgaagaaagtgaacagaggtgacttgtgtcactttctgatggatgtatttaagagttgtgttcacttcttcttttccactagcacagcaagccctgaacgttatggtgagatgatgacataagatgaagtctctatcaagtctgagcctcaaagtaactacaatgcaattattttggggaacataatatgaacaagaaataatcttcttttgttttaaggcactaagacgttttgttattgcaataacataaaatagtttatcctaactaacatcccaagtaaagccgtgacaatcctgcttatgagcacctggtagtctttcctccctaccttagggagaaaagtactaaggagcgcaatgtgcccaatgtgagatattaggtcatttttaaaagatgagtgaatttacagtgatatatgaaagaactgaagcacctggtctctatcctgagaccctaattactagagaagatgactttaagaagcaacataaaacacctctgaaatatcctttgatacattcctcgagaatctacttcaaatttctcaagaaagagggagcctgatttaaaagtttaatttttaaaaaaaaagttataacaatagaagacctctgggtaatggagcagaaaataaaaacaaaaattgtattggtgcaccctttgttgcctcaacagctcttaaagtgaccatggaagcaacagcaatgactgagaaaacacaggtccatcactcacagcaacaggaagagcagtgattctcccgtacatggcagcaacatccttatgaaaccagccccaaaggcttgcagccacaaacactctctatggctgagcagagattaacactagtacatatagcaagatgttatttgttccaagaaaaactgataaactatgccaggatgctgctaggtgtgcaaggtgggggcggtgggaaattgggacccagaaattttaccatggaagcccagacccatttcagtgtcacagtgattgctacccagatttttggcagtcctcctctagactagactgagaaagcaggaattcatattaaaaaggatgtttatggaaccatccaacaggatctagaatcagctgcaatcatcagacacagaattaatacattccttggatctttacatcatagcctttaatgacaactacttggaagctaaacccttatttccccaaatgggagaatcaacagcaataaaatggcataaaaattgaacttatgggatgccacaccaaaaacactttatacttttaaggacatctttatttatattttcacagtattttctttgaagtttatcatccaaataccatgcatatactacaaacagctctagacttctcaaccccctcagtctgtaagttgcttcaggggtagaaatgggtgcaacatctagaacagtcattccaggaattatctctgaggtatggctcccaccacagctcataggcagcagcctgaatctgcttcactttaatcaggaaagatagatggaatggagcccacttagttcgtggctgccagccctcttcgtctccctcccacagacatgcatacaggaaacctggcagctcccttccctcttcctgtcattctcactaggctaaggagtaggcagatgcaggagggagggggaatgcaaaggctgccagagcacttgccacattctgtgttgccatcacaagcctccccagtgcccagcatttctcaggtgctcttgctaggttcaagacagagaaatagatataagcaattgagcaaagcgccccacaagaaaggcacaccccaacatccaaggctttatttgaagtaacaaatacataggatgactatgccctgattaaatcctcttatttttacaagagagaattgagaaattacacagcattttgcactaaactcagaaaatcttcctgaaagagttcagagaagagcaaggaagagttaggcaaacaatgggtgaaagaggaaaaggaaaaaagtaatttaacgttgatggatttttttccactgtccccagtaggaagaatcccattgggggatagtgacatgtgcccaagcaggcaagtttaatgggcaagacagcagacaaacttgggatcatggtctacttcctttactaataaatgtcccaaatgctcccagcacaagctgtcaaaacaaatctagctttcctctgacttttgttgataggtgataacactcagctcaaccaaacaaattataaggctgctatatcaatgtaacctccactctcccgacaatcaaaaatgtcagggaaaatctacagcattatcttcactccgaaagacacactcttaagagtgagggatatagccctcagttaagtgatgcaaggcaaactgcacgagcagttcaaagtcctcacctagagctatagaactgccttccttaatttattcattcatacattccctgcaggatatattgcatttgatataatgaccaacaagacaaatacacctcttgtgcttacagagcttacagaacctcaagagaaaaagacaaaatagtaggtaattacaataaaacgtgttatgtcctaggtgctcctcgtgcagtctaaaaccacaaagacataaaattatttgaaatagtcaaaatgtggaaacaacccaaatgtccatcaacaataatcaatttgtttattgaggcaataaacaaatatgtggtatacccatacaagggaatattatttagccacagaaaaaaaatgaagtactgatacatgctacaatatggatggaccttgaaaacatcataattaggaaaaacgtcagacacaaaaggccacatattgtatgatttaagttatataacatgccccaaataggcaaatccacagagacagaaagcaagttagtggcttccaggagctgggggatgaaagagaatggggaatgactgctaacaggtatgaggtttcttttgggggcaataatgttcttaaattagatagtggtaatggttacacaatcttgtcaatataccaaacgccactcaactatacactttaaaaaggtgaatgctatgatatgtgagtcatatctcaaaaaagtagttacttaaaggagaaaaaatccacaaaccctttaatacggtaaagaaggacccacctgagccgtatagaatcaactttccttgtcagaatacatgtggtataagagaagcatgactttagaatcagacagactactacctagcttttcaccgccatggtttcttaatctgcaaattaagatttgtgcaatgttgttacgagtttaaaaataacatatcaaagcatctgttgtaaagtagcttctcaataaacaatcacccaacgatgttatggaatatcaatattaggaatttcacaactagggtgagacttctccaactctttaggccagcagaatagtttccaagtggatggtatccagcagggtgattactagattgccctgccgccaaaatcaaaagcagaaccatgatggcacgaggatgtgaagtggaacctatcaagcgatcgatgctgcctcttctccaccacgggtcagcattaaaagatcatctcttcctaatttatgagcatctcagtccatcttggagactccataaaatgtgtacctttggagatttttaaatctcctgtctttcctcctgtactttggagactctatacgctgactaactgaaaagcagaactacaagaactaaatgcttcatacctgcatcatattggaaagaccctgatcaatttcaataaaaaccccttgatgtatttcaattgatagacagatttttctttaaaatatgcaacatgtgatagggggaattatgtttacactgcatcaaaaaaaatcaggtaataacttcatttgagacctccttatagaaaatatattcctcacagagcgtggcataattgcaggcacacagttaaagctcagtaaatattaatactttctgcaatgaaaagacattacataacaaaccagcaactggtcaagaaacagaaatgcctgttatatggattgttctttcctactaaggatgagacatccaaagacctctgtgatgtggctcctgcctgtctctgccacattgtgtctactctcatcacaacgtactagtctgtcaacacactgaacctcatggagttctctaactgcacctagaagttcttgcttctaggcccttgttgacgctcttcccttgcctagatctccctttccccatttctctaccagcttaactcttacaagtcacctaggattcagctcccgtgtcatctacttaggaagcctccctgatcttgccgagtcctgccccttggtgtggatgagagttccctcacacacacttatctagtacctgtcatattgttataacaactctctgtttagttatttgtttcccatcctaaactgttggtttctagaaggtggaatcatggctttcaccgctgtattgttatctcctaaaacagtgccaggcattgaataagtgctcactgagtgagtgaatgaatgactttagtcatagttgtattcagcattttattgaaataattttaactattaccaacttctcaaatttcctcaacattttaaacttaaagaaacatgatcatatttgataagaaacatcactaattacatttaaataaaacccagcacaattatcacatgtaatttacaacagttaatccaattcatacttaatgatatgaataattactatagtgtcaaaagttcattgggcataaaagtcagacagtcaacataaacaaatattaaaatgttccttttatttaagccaagcaaatcattcttggaattcactgagggaagagagaaaaggaactgagcagggaaggaaacaactctgccagtttccttaattagaaactgaagttgcttctgaggcaggtcattctatatcctgcactttcaggggctaagggttacaaagtgtccttattcttacccgcttccttgtttactcactaaccctaccacttgcccaaggaaagaatggggagaagttggtcagtgctttaaacctcccctcaatccttctcccagtcactctaatgggttttctttttaaagccctaagtctgagagttctcaggtgacattcaattgttcaagtgacaggggagtccattccagcattaagagtgatatacaggccgggcgtagtggctcttgcctataaatcccagcacttcgagaggctgaggaaagcagattgcttgagctcaggagttcaagactagcttgggaaatatggtgaaaactgtctctaccaaaactacaaaaaattagctgggtatggtggcacacgtctgtggtctcaggtgtctaagaggctgaggcgggaggatcacttgagcctgggagacaaaggtggcattgagccaagatcccaccattccactctagcctgggtgacagagcgagactccatctcaaaaaaagtgatataaggcagggtacagtggctcacatctgtaatcccagcactttgggaagctggggaaggtggatcacttgaggtcaggagtttgagaccagcttgggcaacatagccagacccctagctctacaaaaatataaaaattagcagggtgtggtggtgtgtacctgtaatcccagctacttgggaggcggaggtgaaacagtcacttcagcccaggagttggaggctgcagtaagctatgatcacaccgctggactccagcctggtaatagagtgagaccttgtctcaaaaaaacaaaacaacaaaaaaagtggaataggtagctggatgctttaacatactcagaagtggatcaacttctcaactagagaatgccagagcaattcatctataaaaatcctgtacataaagaaggtcgaacatctgaccaccagagcaacaaacccaggaatcatgagggaaaacaaagcattctttggctttgtcctgatttttcctctttccctctcagataaacatcaaaatcacatactggcttcaattccatgtgtcattcacttaatataatcccaaaagtcatctattactgagaggtgacaccatgctggcagccctcacagccctcgctcgctcttagtgcctcctcggcctcggtgcccactctggcggcacttgaggagcccttcagcccaccgctgcactgtgggagcccctttctgggctggccaaggctggagagggctccctcagcttgcggtgaggtgtggagggagagccctgggcgggaaccagagctgcacgaggtgcttgcgggccagcgtgagttctgggtgggctgggcttggcgggccggcactcggagcgcccggccagtgccgctggccccgggcactgagggtcttagcacccaggccagcagctgcggagggtgtgccaggttccccagcagtgtcggcccgcccgcactgcgctcaaattctcccggggcctcagctgcctccccgtggggcagggctcaggacctgcagcccaccatgcctgagcctccctggtgggctcctgcgccgccggagcctcctggacgagcatctgtccctgctccatggggcacggtcccatcgaatgcccaagggctgaggaacacaggcgcaaggcagcctgggactggcaggcagttccacctgtgcccccatgcaggactgggctcagaagccaactgggctcctgagtctattggggacttggagaacctttatgtctagctaagggattgtaaatacaccaatcggcaccctgtatcgagctcaaggtttgcaaatgcaccaatcagtgctctgtgtctagctcagggcttgtgaatgcaccaatcagtgctctgtgtctagctaatctagtggggacttggagaacttttgtgtctagctcagggattgtaaacgcaccaatcagcaccctgtcaaaacggaccaatcagctctctgtaaaacagaccaatcagctgtctgttaaatggaccaatcagcaggatgtgggtggggccagataagggaataaaagcaggctgcggagccagcagtggcaattctctctggttgttttccacactgtgggagctttgttctttcttgctccttgggtccgcactgcctttatgagctgttaactctcaccgcaaacatctgtagtttcactcctgaggccacggagaccatgaacccactgggaggaataaacaactgcagacgccctgctttaagagctgtaacactcactgtgaaggtctgcagcttcactcatgaagtcagggagaccacgaacccaccaggaggaagaaactccgaacatatccctacatcagaaggaacaaattctagacacattacctttaggaactgtgacacacaccgcgagggtccgtggctttattcttgaagtcagtgagaccaagaacccaccaattcctgacacgttactgtggagaatttgcagtgcacagaaacttgttcaagactgtgctctttagtactagctgcctcccaagaaaggagcaaacagtaacattgtattacagatgctttaaagagagagaagagggcagacccagtggctcacatctgtaattccagcactttggtcaggcaaggagggtagatcacttgagatcaggagttcggaccagcctggccagcagggtgaaaccccatctttacgaaacacaaaaatcagctgggcgtcgtggcacacacctgtagtgctagccactcaggaggctgaggcaggagaattgcttgaacccaggaggtggaggttgcagtgagctgagactgggccgctgccttcccgcctgggtgacaaagtgggaatctgtctcagaaaaaaaaaaaaaaaagagagaaaaataatggttctctgagctcttaaaggtcgtaagggagaccttcaaatttagggaaagaagcagagaaaggaaaggagaaatcaaaaagaggactggaccttctccctctgcattcaggtttttacaaagagaaggtaacaggtaattctgcagattctctagaggccattttatgtgtacacacccattggttggcaaaaacaagtgtcaccttcagaaatatgttggtcattaaaatgaaccgacccaacagatttactctgtgttcactaatacctataccgtatttcaaattaggcatagatatctgtctttttaatactttgaatagatttcaaatttgcctaccttattgaactcacggtttaatgattgtggtttgatatgaataaggttattttcagcatatttttgtgatttttttgcattctttttattagcatgagacaggcattctattttgttcatttaaattatttttaaattagccttatgcaggcttggtatttggggtataatttggactcccacacatcttaattcatctgggatccaattaaattattttgatattccaaaatacttagcttctactccctcacttttcccttcccaacagttaatctcttatttatatctaccgtgtaagaaaggaagttaggtcaattaaatacagtgctggaagtgtagtcaaatgaatctgttctgttcccaactgacattccaatttgcatgaacttggactcatcaccaattcatctgtgtctgtttcctcatttgctaaagcgaaatactgctattagtggtcttacaccctagaatcaagaggaagacacttggcacatgtctcggtagaatgaaaattccttgagagtcactcattttttaacactataaaaactagtcctttatcctctccacctaatccaatgctctagagggcagaacaaaattgactaattttttggcttacttggtttgttttctaagacaagtaaatataaaactccctacagagagctattcatacaagtttttattacataagtatttctgaagtaaactgtgctcaagtagacacacataacactgacttttgttttgttttacaaacagcaacaacgtgaaaagtccactgaataatgaagaagaatgacacactggttacaagatgctactgaaaaatatgccacattctgttttctcctgttggagcttcactcttcacatttgtatattaaagatttcaaggaatcttggattaaagaaatcatgtttaacttcgctttactccacatttattagatgacaaaattttttacaaagaataataaataacatcctgaggaacaaacttagggaaagcttatcataaaacaaatagttaaagatggactataccattgagaattgggccttttctggtagcttaggatgaataatacacattttacatacttttcttttatccaaaatagcattttattttacaaaagtaatgttcttccaaaacctttttaaatgcaaataaagaaaaataactaaaaacaaccataatcccacctcttagaataaaattatacttagcattttgatctacattgtatgcgcgtatccatatatatatgtgtgtatgtccattttcttaaccgagttaagaatagagaatattcactggaaatctacagcaaaagttttatgtaagggtaagcctttgaggcatttctttaaaatcaagcacagtacatgttttctactattgtagatactattgaaagctacactgaagtttctagtcaattaagaaaaaagtagaagatataaaacgaagttttgtaaactatcattgctaatggatgacatgatcgtccattcataaaaatcaataaagctacctcctgaaattttttttttttgagatggaatcttgctctgtcacctagactggagtgcagtggtgcaatttccactcactgcaacctccgcctcctgggttcaagtaattctcctgcctcagcctcctgagtagctgggattataggcatgcgccgccatgcctggctaatttttgtatttttagtagagatgggatttcaccatgttggtgagtctggtctccaactcctgatccgcccacctctgcctcccagagtgctgggattataggcatgagccaccacacccagccgaaatatttttaaaatcaggtaattaagcatgtaggcaatattaagatcaacatacaaaaaatcaaagacctccatagtggtcataacaattacaaaatgcagtagaagaaagaagctattcacagtagaaacaaaaattaaaaatacaaaagtgtttaaatcactcatggacaaaattacaaaattttgttgaatgatataaaataaaacttgaatactggaatagttcgtattcctgggtaggaagactcaaaactgttgcgttgtcaacttttcacaaattaatctataaattcatctaaattacaatcaacatttcaacagaatttttcagtagtcatacactcaattctaaattcatatgagaggttaaatttgcaagagtagtcaagaaatttaaaagaaaaagggactcaaaaggatggttgctttcttgccaaatatcaagacatagtatataactatggtaattggtatattgctattttggttacaaagaacaactaagtaaagaacccaaaacccaactcataaatatatatatataaatacattcgaaatatattcaaaaacctttaatatgatagattcagcattcaaaaccagtagaggaaagataactattcaatataatccaaggaacaattggcaatctataggggagataaagctagatttctgttttatggaattcacaaaagctgatttcaaataaattataagcataagtgtggagaaaactacaaaatatttaaagtgaatatagaagaatatgttaatcccttaggatgtgataggccttaaatcaagtgcaaagagaaaatcatgaaggaaaaagctaatgaatttggtagcataaaaattaaaatcttccacaagaaagaaaacaccacaaaaaaattaaaaaagtaatttacttgaagaaatattagcaatttgtacagcagaaaaaggactggtaattatataaataacttctaagaattaaaagtaaaacacaaataaaccaatagatttatggcaaaaaaagataattcacaaaaaataacatacaaatacccaatacagatataaaaatatatgtaacagcaaaaataaatttgttagataagatgaagtagtataaatctcagttgtgttagtccattctcacactgctacaaagatactacccgatacttgataatttatcaacgaaagtggtttaattgactcacagttctgcatggctgaggaggcctcaggaagcttaacgattatggcagaaggggaagcaaggcaggtcgtgcatggcggcagaagagagcgagagaggggaagtgccacacttttaaaaccatcagttatcatgagaacaaactcactatcacaagaacagcatcggcgaaactgcccctgtgatccaatcaccttctgccagatccctccttcaacaagtggcagttacagttgaagatgagatgtggatgggaacatggagccaaaccatatcaccagtcatggttttcagagacagagacaacttgcagaaaaacgcctacaatacgataatgtttacaaaagtaaacacacatccaaatagatgtacaaacaataccatgcacattctatgtacatgtaaatgtatgtaaacattttcatggaatagggttaggaggagcaggtagacagtagtaggattgagtaggagagaaagatgacttctctgtgataatttgtcttcctttaaggataatgcttttattatttaatttcaaaacaatgtcaaaatattcaaaaaaatctcaacaaaggtaccactaaggatagaatatcaatgataaagagaaggtcttaatagccttcaaagaaataaaaagttttctacaaaggaataaaaattggactttagtgttttttaaaatagaaacaacaacagacattaaaaaagatggaatagcaaattcttctgttatgaaagacaatcatcgtaaacctaaaatggaatattaatccaaacatgcaatcaaacttgagggcaaaatgaaagctttctcaatcacataggaaatgccatgcaacacttctgtggaagttacataaggatgtacttcaataaaatgagagagaaatcaagtgaaagaaatatgtaggacactagaaacggtgacactaactcaagattccatgggaataggatgggcagtacaatagttaaacagcaagcacagaaaaaacaaaaaacaaaaaactctgcatttaaaaaaggcagatggctccaaattaaatatatgtatgaagacaaaattcatttcaataagtaaaaagtaagttactagcagatattaagagtattatttttaaaagaaggcctataattctttcaataataataaacttaatagaaaactttagagaaagatacaagcaaacacacagtgctatcaatgagatgtggtccaaatatgaagcagactaaactatggtttgattatgagaaactttaggagcataagaaaggatgctagaaatactgtgtttcaagtgacttatggttcgtacagaaaaaaaagaaaatgaaaatgaaaactttgtataatatttacctctaataaataaaatttaaataattataataatataaataaggtttattgattttcagccgttacaatcaagtttttttctgtcaaaactggaggccaatcgtttctaaaattaaataatagagatagtggcagcagtgacagtggcagttgcactgatgacatcaccacctaggtggcatcatgggtaaaatcaagcctcagtggcagtgctccaggttatgggctgggataatcaaaaatgagcccaaccttagagctacagtccaggtacagatcaacttaacagtgaaaattggactagttcctatctcacttaagcagcaagacatagaaactcctactgtctgtagaaaataaagtagcaggattcccaattcttactgttcaagacacaatattatatattcaaccaaaggttaccaaacatgcaaagaaacaagaaaatgggagccaaagtaagaaaaaagtcaacttaaaatgacttgcatagtgacccaaatattagaatagcaaacaagatctataaaataatatattcaaggatttagagaaaagtatggaataagaagtaagcagacagggccgggcacagtggctcacgcctgtaatcccagcactttgggaggccaaggtgggcgaatcaccagaagtcaggagttcgagacccgcctggtcaacatggcgaaaccccatctctactaaaaatacaaaaattagccaggcgtggtggcaggcacctgtagtcccagctactagggaggctgaggcaagagaatcacttgaacgcaggaggcggaggttgcagtgagctgcaatcacaccactgcacactctagtctgggcaacaagatccagactccatctcaaaaaaaaaaaaaaaaaaaaatgaaagaaagaagccagacagaaattttaaataaactaaatagagagcagagattttataaatatttaacacaaaaatatattaggctgacttaacaaaagaataacattgttaaagaacagaacaggaactggaagataaatatatagaaattatccaaaataaaatttggagagaaaaaagtatttaaaaagattgaacagtgaattatcagtgacatgtgaggcagtattaaatggtattacttccattttactggactttcataaaaagaagcaagagagaatgaaaaggaacaaattgaaaaaataagagtgacaatattttccaaatttcatataaaatttaaagccataaattcaaatttgatagaaattttaaactcataaatccacaaagctctaggtaccccaaagaggacaaatgcacaaaaatccaaacttagaaaatcataagcaaatcactaaaaaacaagggtaaaatattgtaaaagcggtcaaaaggaaaatgtcacatggagagtaatgattatagtagaaatgctttcttctcaccaaaaacagtacaagacaaaagataatggaatgacacttctaatgaccatcaacctatagttctttattcagtgaaaatattcttcaaaaatgaatttgaactaaagactctttcccagttaaatgaaagctgagaatgccagtgtaccagtatgaacagaaacggtaaaagaagttcttcatgctgaagaaagctgatatgtgatgagaagtaagatctaaagacaagattaaatgtaccaaaaatgattaatattgtcaaatcccaaatattttaatacaataatggtgacgggtaaatcaattatatctctactataaaggttaaaagaaaaaattattaaaaacaactaacataacaataatttgttaagagatacaaattatttaaaaatgtaaattgtgacatcaaaaacaataaaacctgggaagaaggggaataaaaatatagagtttgtgtatgcaatcaaagttaagtttttatttgttaaaataggcagttatatgtataagatgctttatgtaagcttcagggtaaacaaaatgcaaaatactataattgatatgcaaaagataaaaataaaataaataaaatatatcactaaagaaagccatcaagccacaaagaaagaaagcaatagaggaagaaaggaaaaaaggatttatacaacaaccagaaaacaacaaaatggcagcagtaagtcctcacatatcagtaatcactttgaatgtaaattaattaaattctccaatcaaaaggcatagagtgactgaatggattacgaaaacaagacccagctacatgctgtctacaagaaactcacttcaccttaaaggacactcatagactaaaagtgaagggatgagaaaagacattccatgcaaatggaagtcaaaagagaacacgtgtagatatttttatttcagacaatatattttaggtcaaaaactttaaaaagagacaacaaaggttattatatagtgataaaggcatacgttcatcaagagaatttaacaattaccaatatacatgcatccaatatcagagcacctaaatgtaaaaagtgacattaagagatctagaagaagacatagactagaacacaataatagcaggggattgtaataccctactttcaacaacagactgattatccagacagaaagccagtaaggaaacatgggccttcaactatacttcagaccagatacaactaacagacatagatggaggactccacccaacagaatacattcttctcaaatgcacacagaactttcttcaggataggctatatgttaggtcacaaaactagttttgacatgcttaataagatcaaaattatatgaaattattttctgaccacaagtataggaaactagacatcaataagagaagaaatcatggaaaaagttaacaaatgtgtagaaattaaacaatattctcctgagcaactactaggtctaagaagaaattaaaggagaaattttaaaatagcttaagacaaataaaaatgaaaacaacatatcaaaacttatgggatgcagcaaaaacagttctaagagggaagtttatagcagcaagtgcctacatcaaaatagaaaaaaaaaaaacaaaaaacctcaaatagacaacctaatgttatacccaaggaaatggaaaaagaaccaactaagcccaaagttagcagaagaaagaaaataataaagatcagaacagaaataagaaaatacagaatagaaaacatcaatgaagctaagttggttttttaaaaagccaaaaaaaaactgaccaatgtttagctagactaaataagaaaaaaagagagaagcatcaaataaataaaatcagaaatggaagaggagacattacaactgacaaccaataaatacaaaggactagcatgaacaattataaaccaatcagttggagaactcacatgaaatggatgaattcctagaaacatataacctaccaggactgaatcacaaataagttagaaatctgtacagaccaataacaagtaaggagattcaatcagtaattaaaagtcatcaacaaaaatctcaggaccagatggcttcccagctgaattctatcaaacatttaaagaactaaaaccaatccttcctaaacacttccaaaaagttgagaaagggggcccaaggcagatgtttcactgaacccaatgacacatgaatacaacttaaaagtttattttaactctgtctcagaagaaatcgttttgcccctcatatcaagtagattccaaatatatagtagtaaaactttaaaatcaaatatttttaaagttgggcttgctttattagcatgaaaaatgtttaattaaatcaaattaatgagttaattaacaattattggatgcaagggcatatactcaatgctatggtagataaaagttacataaagcaaagttcctctccttaacagttagcataaaatagtactggctcctttattcatagtccttttttcagataatttttcttatatctgctagatgtgtatagtaagaatagaggaagttaaagtacatcttacatttccaatttgtgactttttgacacaaactgcaaagaaagtagttatgtggctatctatggagtaccctaagaggtaaaccccatcaaataccaactcagacacacaatagagtatatcatgtgtcatttaatgaaagggatatgttctgatatgttggctgattttgtcattgtatgaacgttatatggtgtacttacacatatctagatagtacagcctactacacacctagcctatgtgctatagcctattgctcctagctacagacctgtacaatatgttactgtactaaatactgtgggcaattgtaacacgatggcaagtatttttgtatccaaagatttttacatagaaattataatcttattagtcgttttctattagcatgaaaaatggcaattaatgtcattatatgatgtatgactgtacagcatagaagaggaggtttttaaattaaatagcatcaagcatgtgagggttaagcagaaatagtccccaaattactgcatccaggaatagggcacacatgcttttacccaatggggcattaatttgaacttggaacacaatcaaaatgggatttttcctgtcaaaagatgttttaaatgctctattaatacattcagaatactattgataacagaggacacaggtgactgtgactgacattggggaaagggcatcaagaccaagcataaacataaaaacgtcctcaagattatgaaagagcaataaacactttgccaagtctattggtaggaccaagcaagaatataaatcaattaataagaactgaacctaatataaacttggagtatcctaagatgaagaacctaaggaacttccccagatattttgagaatcctaatataaatacgtgaccaatcccagagtcaagagcaaggaaacaataagaaaaagagagagaaaaggaataaaatggcaacattaggagcattgtggacctgcttctagataaacaataatgacttataaaatttatttttacaaaaacaacaggaagtatttagagtctctgtaaattgtcctaagcatatacagcaaaggaagaaatatttacacaatattatctactaaacatcagtaagaacagtgacagtctgtggcacgtaagccacaatccactcctttactgaactccaacctccagctcaagatgacagaagttccactctgggtagacaagaccaggaggcaaggatccctttcccacagcaacagtcaagtgctaggataggacccaaggagaggtagacaaccagcatttctcgggacccccatctccatgtcacagagactaaattccagtctagcagtacagcagagaaggaaagggctgtattttttcacccaccttccactcatagagcagaggctctaccttagatgtggcaagttgagaatactaggattctaatcactcttacactgtctcatttgtagggcagaaggtccatttagagagaagcaagtaaagggaccagaggctatgacactggcccctcttgtaaagtaagggtgctactcttaaataaatgggccacttctatttctggagcagtggctcaaagagtttgtccagaaagagaggcaatccataataacatagaactctgaaacacttatcaaaggaactggctttatttggaactaaaaatgggaaagttcaagcctaatggtgcactgaaaacaaaaattgatattttgatggaaaataactcaggtgaggctggcacttccatgagaacatcaggctaaactcttgttctgttagttcatcagagagaatgagggaaagaaacagctaagtagagccttcctggaatcagaacacacctaaagattggcctcagaaaccgcctttgcaaaagagtctgaatttatttggatcggaagatgaagcaacttatgccccaggataattagtgtagcctaacagttggtgtgataccaacagaagcagagagattaacagagagatcatagacagaaacaaagagaaacctgccaaaaccactgtcaccacagagtcactgtatgcattcccaaggctgaacttcgtgaggcatgacatcagtcttcaactttggcagaaatagactttactgaaatctcctagccaagtcaaaacacacataaccaagaaagcaataacaatgacaagccctagaggagaagaaggatcaatgtccagagctgttaccgtatattacccaaaatgctcaatttgcaacaacaataaaaattatgagatgtgaagaaacaagaaagtgcaaccaatatacacagaagaaaaagcaggcaacaaaatctgactaggagaggggtaagatatccaacttaaagacttcaagatagtcattataaatatgctcagagaactaaaggaagcatgctttacaaagtgaaggaaggtatgagaacaacgtctgttcaaatagagaatatcaataaagacatagaatatataagaaagaaccaaatggaaattctggggttgaaaaatacaatttttaaaaattcattagaagggctcaaaacaatagatctgaacaagcagaagaaataatacacacacttgaagataatttgacaaattctggggttgaaaaatacaatttttaaaaattcattagaagggcttaaaacaatagatctgaacaagcagaagaaataatacacaaacttgaagataatttgacatattatgaaagccacagagataaaaaaagagtaaagaaaattgagcagatcataagagagacatggaacaccattaagcacaccactataggcaaaatggtagtaccagaagaggagagagatgagcataaaaatatttcaataaataatggctaaaaactacccacacttgacgaaaaacaatactgttcacatgcaagaagctcagtgggtaaatataaagagattcatacccagaatcatcacagtaaaaatactgaaatcaaagacaaagagtaaatcatgaaagcagcaagagaaaaataatttatcatgcccaaggaaacctcaataagaagaatgactgagttctcatcaaaaactattgagaacctaagtggttggatgacaaaaacgattaaccaaaaatcttatatccaacaaaattatctttcaaaactgaagacaaaacaatgccattccagatacacaaaaattgagagaattttttcctactgaacccacttaggaaatagtaaaaaaaattccttcagggctgaaaacaagtgggccccagacagtaacttttagttttacacacacacacatacacacacacacgcatacacacaagcactggtaaacataattatgtaattctaaaggatagtataaatgaatagttctcctttcttctcttaaatgatttaaaaggcaattgtatataataatatgtataaaatgtattgttgggcctacaacatatacaaatgtaatctatttcacaataacagtacacaagtggtaggtgggagcaaagttgtactgtagaaaggacatgataccagatggtaactcaaatccacagaaccaaatgacgactaccataaagggtaaataagaagattaatataagaaactctctaaatactcaaatttctttcttatatcttcttgaaaggatataaaattatataaagtaataagtataacaatatatggttggatctgtaactcatataaatatgtataacaataatagtatgaaaagcggaactaggaaatagagctatacagaagtattgtttccgtatctcactgcaattaaggtgatataagtatatagtaaatcaaaatattaagatgttacactagaaaatattaaattaatacaaaagaaagcaataaaagagaaatataagagcaaaaaagacatgagaccgtattttttaaaagtaaaattgcatgtgtaaatcactatatcagtaataacattgggagctgatcataatccccaaaacccaatcccaaatgccataatccctaatattgaaattccaaaagctcaaaatcccacaaatctaaaatctccaaaatcacaatcttgaaaagtcaaaattataaaaaacataattctggaaaaaaataattttaaaaattaccttaaatatatttctttacatttttaaaagaggatttattttagaaacataaaaatacaacataacacttcataggacactttacataataaaatagccaataatatatatatttttgcaagcataaacactcaggtatactaataacagtcacatgagtataaacgtatgagcagatgaatcatacaaaaaaataggtcaaaagggaaacgcatttgcatatcactatggttggtaatgctgtgcacccagctttattactgcagtcatatgaaacactatgatgaataatttgtcttttgtcgagattgatcaaaaactaaaaattttcactatcgcatatgcagtcaccgaaataaccaaaatcttgagaaatgttatctttcacaaatacacatgtacataaaggacatctcttcatttattgaggaagtttcaacatttttacatacaagcacaatgcttacaaagtcaaccttgtgataatgcacttccttggagttaaatttgcaaaaaatgcacaaaatgcattagaactctccaagtctctacggaatttatacctccagtattggagagaatacaaaaattaaatacatgtcatagtgaactgtaaaaaacaatgctgacaatttaaaatagtttaaaaaaagaaaaaaatcaacatccaaaaaggtgtattacagagatagattatggacaattgcacagaaatactccataagagctggccaacattcacgataattttgaaatcttgcatcatgaggatcagctacttttttccttttaggttttggctctcctgagagaatatattcacacttatttgctatgtggtgctgctccttttgaaattcttctatgattcaataattgctgacgtgagcattccctattaattttaccatcttctatttaagaattttgatcttttgggattatggcacttgggattgtatctttcaggattattatccaaatccaataattctaaacgcgagtaaatgaacaatcaagacaaaaggaaaaaattgtaagactagatttaaaaacccaagacacagttatctgtaggttcactgcaggagatgtatattagattcaaagatacaaatctgatgaaagtaaaaggatgcaaaaagatatatcatgaaaacagcaaccgtaaaaaagctggaaaggcatacttaagacaacataaactttaaaacaaaaaatattgctagagataaagagggaagtataataataaaagagtaaattcattaggaagatattaattttaaaaataaatatacacttagaaacagagctccataatacatgcaacaaaaactgacagaattattgggagaaatacacaatttaacaataagtgttggagacttcaatattctactttaacaatgagcaaaacatgtcagagaagatcaacaaggaaatagaagacttgagcaagaatgtaaaccagttaagacctgaaagttttctatagaacactccacccaacagcagcagaatacacatccttgtcaagtacacatggaatattcaacagaagagatgatatgcaagaccataaaacaagtctcaatacctttgaaaggatggaaatcatactaagtatgttctctggccacaatggaataaaattagaaatcagtaacaaagaaatttgagaaacttgcaaatacgtggaaatgatagcacacactcctaaataagaggtcagagaagaaagtacaaggaaaattagaaaacactttgagatgcatgaaaatgaaaacacaatacactaaaacttacggaacactgctaaagcagagcttagaatttacaactataaatgcctatatgaagaaagtttccagattaatgtattaacctcctaacttcagatactagcaaagaagagaaagtaaacataaaacaagaagaaagaagaaaataataaaagttagagcataaattaataaaatgaaaaaacgcagaaatcaaataaaagtgtgtactttgaaaagatcaaaataattgacaaatatttagtttggccaagagaaagaaaagacctaaattactaaaatcaggatggaagtgggggattactactgaccttaaagaaaataaaaggtttatacaagaatactatgaatgactaaatgccaaaaaattaaataacttagataaaatgggaaaatccctagaaagacaccaactgtgaaaactgagtcaaatagaaatagaaaatgtgaatacacctataacaaataaaccctcagcctaaacagcttcactggtgaattctatcaattatttaaagaataaataatgccagttcttgacaaacatttccaaaacagaaaattagagaatactttctaattcattctatgagcctagtattacccgaattccaaaaccagacaaggacatcgcaagataaggaaactacacaccaatatctctaatgaatatagatgcaaaactctgcaacaaaatactagcaaactgaatccagcaatatactaaaagaatcataaatcatgaccaagaggcattaatctcaggaatgtgacgttgctttagcatccaaaaatcaatcagtataacatagaataccaatagaagaaagaataaaatccacacaattatctaaattgactcagaaaaagcatttggcaaatctgacacatttttatgagaaaaagaaaaaacactcaacgaacaaggaatagaagagaacttcgtcaacataataaaaggcatctataaaaaatcgcaccaatgacatcatacttaataaatggctgaatactttccacctaagaccaggaaaaagacaagaatgtctagtctcacgactttgattcaacattacactggaggttttagctagggcaattaggcaagaaaagttagcgggggagggccgggcgtggcggctcacgcctgtaataccagcactttgggaggccgagacgggcagatcacgaggtcaggagatcgagatcatcctggctaacgcggtgaaactccgtctctactaaaaaatacaaaaacaaaattagctgggtgtggtggcaggtgcctgtagtcccagctactcgggaggctgaggctggagaatggcatgaacccagaggctgagcttgcagtgagccgagatcgcgccactgcactccaggctgagccacagagcgagactccatctcaataaaaaaaaaaaaaaaaaggaaaaaagaaaagttaggagaggagaagcatctaggttgaaaggaagtaggaaagctatcacaatttgcagattacattatcttgtttatagagaagtctaaagaatcaactaaaaatcttctagatctaataagagttcagctacgttgtaaaataaacaaaatacaaaaattgattggatttctatacacttgcaataatctgaaatgaaattgagaaaacaattccattacaataggatcaaaaaaataaaatacttaggaataaatctcctatcaaaatcccagccgactcccttgcagaaattgatgaggtattcctaaaattcttacagatgaatcatccaaaacaatcttgaaggaaaagaacaaagttgaaggactttgatttaaaaatgtattacaaagctatgctcttcaagagaatgtggtactagcataaggacagacatataaatcaatgaaatagaattgatcatgataataaaaatgaaaaataataacaagtgttggtgaggatttaaggaaattttaacccccatacacagcttgtaggaatataaaatgatgcagccactttggcaagcagctggacggttaccatatgacctaggaatttcactcctgggtatatactcaagataaatagaaacatagtcacatacaaatttgcacatgaatgttcatagccacatttttcataatagccaaaggtgaaaacaacccaaatgtcctacaacccataaatggataaacaaaatgtgatatatacacacaatgaaatattgttcatccataaaaaatgaagttctcatttatgttacaatatagaagaatcttgaaaacattatgctaagtgaaaacagccagacacaaaaggtcacatgttgtatgattctatttttacaaaatatacagagtaggcaaaactttaccaacagaaagcagattaatgattgcctggaacttgcagagttagaaaggaaaagagggtgcctgctaatggatgtgagatttctttttagggtgatggacatattctgaaatccttgatgtcagtggtggtgtcacaactctgaatataccaaaaaaattgcacagtttaagtgagagaatttcatgatatgttaattatagctcaataaagctgtttaaaaaaatgaaagaggataaaaactgtacaatgcaccacacctcccactattttgttaggtaaaactagctttaaagcaaattccctatcatacctcctgtatgatttgctgaagttatgtattttgtgtttatatgtaagaacctatagttcctatagttctcatttacttatttacccatcaaataatctgaattacttatatatttttctaggaagagtaaataaaattagagaaagtaacagtgcatggctattattgaaagttatgctcttctgtttcatagaggttgctctggaaaaaaaaattgggcaagaatagaagaaataggctaaaactgagatatgatacagcttccaatgacaaagaaggagccacctgaaacacatttttatttagcaataatgtgatcctaaaaggaaaataccatttgaacaaaccaaatagcccctccactaggagaggagattcacctcccacttgactccccagaagtggatttcacaagtttacatgcaacccagaattgagcgacattatcttctcacaataaaattgtgggccttaagtagtccatttttcatcctgccagccagagattctattgatgaaccaaataatagagaaaaacgtggacagtctgtggctgcttccttttcaaaaaagaaagaaagaaagaaatggtgtccaattatacacattagccttaattttggcctttgaatgatcagataatgtttctgcccatgaaatgaattcttgtggcaagcccatgcttttcaatgtcaaaaataaaatcttccaattaattgtcaaaacgcttttccagcatctggagacgggagtaagttgggtcttttatatttgtagcttttgacattatattaaacaatctttcgggttgtcatagtccattctcctttgtatatatccccattggtttgtgtttatcaattgttttattaggccatctaatctttcagttcaatttctatatttcttatatttaggttaaatcaagggaaatttttgtcactgtgcaataatctccatgtcctgcttcaagagggcaagaccaaggatatttttcagagtgtaggcagatatttgcctttccttcctccaaaaagctggtcctgcatggggttacatgaagctgtctcagcactggcaaccatagaagataccacgtagacaactaatcagctattgtggattgctataatctttaccgcaaggtaaatatcagagctactgatccatgcttatgtacttcttttcaagtctgagagtgtttctctttaacagaaaatgctgcatgaaaacactttccatttcccagtatcttctctcaaggattttctttgttttacatttgaaaaggtaatcaagtcacataaatgagctaaggatttttcatttgctcttaactccaaaacttttcaagaaaagttggaagcagagaagcttctttttcatttcttcatatgttcatatctagggctattttttcatttgatttctgttttccttgctcctttttttgtaagaatgtctgcatttaccaaatttaacttgtgttccttttggattcatagaagcatatatttttctttaatcaatgtctgtgttccctgagaagctaaaaattattccaggatgagggtattacgtattaacagaaaaaaaatagagaaatcatttgtattcatttttcaaaatacttctcagcccaatttagaaaggctttactttcttggatttgttcatttgaatttttaatcattaatttaactcaactatgcagatgatcaaccacagagatgtagaaagaactggagcaattgtacctaggtaagaaaaagggtgattcatttgaaggaggtgagtaaagacagacagtgtgttgatacaagcttcttgatgccctttctaccaatctccaggcacttcttggctaaggcatgtaaataattttcacttgtcctggtccttcttttagggacagaacaagccttatcagcctatcagcaaattatttacacccagtttcaggtctcctgggcaccaggatggacacaggcatgtgtgtccttaagagctgcaaatctgtatccaaaaggagttatagatccaacggcaaagaaaagtcataagtacatatgggaatggagccaaacctgagaaggttggaaagtgttcaggaactaaatgtaaagtggcagagaattatcaggctgatggaaaagccatgaaaaagttgagatgacacttgtatatgtacatggctgcatcgcctcagggtagatgtggggggcaaaggaactagacacgaccaccctaccctggacctctcctcagtcccaacactcagagcagttccctcagcaagcacttggcaccaaaaggcaaagcagtctcaggtgctgtggcttgctctctctgatcctctgtcctgctccataagatagaacttttcacatactttaggagccaagtacaaatattctaacccctaactgtaatttcctgttctcatcagtcacttaaaccttgatgtccatgggacaccactctaaattatctgcattttaaattgtttttatgattttgttctttgccctgaaattttctttacattcccattctaagagaggctatgttggttgaaggtccattcagtcttctacaaccctttttccactctttcacccttctgcaagtccctaaccttccaaaagagccacctaagtttcgaccttctttctcctctaaaaaataaaacaaaagtgttaatgatggtgatgggcaaagttgaaattatttaatatctcaataattatagctccttcaagccttttaaaaggaaatattcagcatttgtctccagcaatttagattatggttcggaagattagttaacatcctattagcctgtaatcctaaactattctttactctaaagtacattaaatcagatgggaacaaaaacccccacttttctttacattttcattttatgagataggtctttgggaaaatttatatttactgttttttcaagttatgcttgagcgctatggatagcttctacataggtttaggttgttgaaaatgaagaaaatgatacaacagctaacatctattggccacttagtatatgggacaagcactttggtaagtactgtattacatggactatctcatttaagtcccacaacaactattatcctcatttttatacatgaagaaactaaggctcacagaaattcattaacctgcccaagagagtggtatagccaaaactcaattttattttgattaagggaaaatttaaagaaacaatgcatgtacaaggatatgactgcaaatagtgataagctgcatattgtgctccagtgccccatgtgagcaaactagtggcctggaagcttctctgcatagtcatggaggtaagtctcttgatttaaggatgtcataataccgggtcatgttactggtaggcttccttatggacagtaaatgagtgagacctaaaaggctcccagccttttaggagaagcaagcagagcttcagggaataagaatgtgcttttctgcaagacccatttccacccctgaatgctccatgccctgaatgtggaccatacactcagaggaattgtagctgcagtcaagagcattggcctggtttaataccttaatatgtgtgtggaggccttcctaaaagagcacatgtgattgagctgccttcactctatcaatcaagtggagagttcatgcatggcctttaacacaaggtatcacagaggaagcccatatttattcttaacaccatcatcatgactaacactgtggaacagtggctaagagtgtggactctggagacacattacagaggctttgaatcccaaatctactacttactagctgtatattcttgggtatgttatttaacatttctctgactctatttatttatttgtaaaatagaggtaattatagcacctgctttatcacgttgctctgaggatctaatataagtaatgtttgtacctggcacatagtacatactccataaatattatatagtatcatcatgatcatcatcactatcaatcatcatctctgccccaggatttggaggtgaagaggaatcactagatgggaatatgctgagctccagcagccaccattgatgctgagcaaaaccctcaccaatcaaaccccatactcagactatgacacaatggtttcaaccacttcccttatctcctgtgcctttgtcaccatcctgcagcaggtcctcattacatcttacctgtgctaccacaaaatcttccagacggatcttcccaaatccatctcttccttctctaatcagtcatcaacactgctagcagatcaatctttctcctgagggtcagagtttctatctcacacctcttcccaagcgctgctaccccttatactagatcacgctctatggagatgctgaatgaatgttttctggaattgctgtgtgagttcctttcatagggtaggaaatcatgccagcaataccaaaaaaagagggtcactagcaatagaagtgacatattaataatgttaaattccactgacactgtgttttactgtttacaaagcactctcacacattctaggtggtaggcaaggcaggttgcatcctcattttaaagggaaggaaactaaattgattacagaggtaacatgactcaaccaaggttaagacaccaccaaaattgtgtctcaaagtctcttggctggtttcacattacctcctttcagtaactattcagaaagtagggtcatgttatatttcctgaagaattgtgctcagtatgtttagaatgataaaataacatgtattgggtacttactaaggtcaggaaccataccaagcattctacatggattatataatttgactctctcaagaaccatatttgcccatttatcagatgaaaaaacatgagtttgcacatactaaattaccagcttaggataacttagcaatagcaaggtgaatagacaatgacaaccagagggctgtgctctgaactgggccctcttctccttcctgcctctgggttcctggctgagtctcaagtcaatttaacctagatgatgatttgggctttttctatatcacttatctatatcagttatgtcttacaggagaattatgtaacaatttagaaatgcatatgtattgtgtattatagtttaaaatttatgagcttaatcaaatttttattttcatctgagatttttttatctgagacttatttaactaaaaataaacatgaaatataatttcactctaaaaacatttgtaatgggtctttttttaaatttgcaaactttttataaatcttgtgatacataattctttcttattttgggtttcatattatagttctaggacattcttgcctaagccatagttttttatgcttagttcaaaagctgtcaaaagagtattctcctaatacttttatcaactgcatttcttctttgatttgcctagttttccatttcagtatatttctatacatcgataatattaacccagtttcttatttgtggcacctttcaaaaagagtttcttgcttaacattgaattttgtaactcatgtgtttgtatctacaaaatatttaatgtttatggacttaaaccaattaatatttttctccgtgcttttcaccattgcttttttgcctagaaagtcctttcctatccttcgaagagataatctgcctgcactacctttaattatttctaagttctctatatttaatcttctttctccttctttcctctggtttatttctctccccctcttctctcctaatctctccatccatccatctatccatccatccatccatccatccatccatccatccatccatccagtctttctctctccttatctgtctttctcttactctctattttgtcattaagctctttcatctgcttttgacataaatcataatataaggatcaaaacttatatgttaccaaatagttaaccaatagtatgcattattccttgaataacttctataccaatccccctcgctgatttcctttatctcctttatcgtataccaaatttttgtatatttttggatttgtttctgcatcatcattaggggtcattgttcttatacaagcacaactctgttttaactatactcttaataaatcccatttgattatattatttttaatgcatagctgtatatgatttgctagggttttagttacgtattttgttttgtgtttataagtgaaattatgtatagctcaatatctttgcatcaaaagagaacacctttatcaagttgcatcattgttgacaaaaagaaaaaccaaatagcaaaactgttctatcttttatgatagttcaaagacatggaaattataggatccttaaaaattgtaatgtttgttcataaaatattgttctcccatttcttcatggtttttaccaagttggatttgcaacttcttctaatatcattttgataactcataccatctctaaaaagggttgataagtacatttttatatgcatctttggtcctagttttgtgaggaatatttgtgttttgccaaattcgtttttcattgaaaatgtgatttgtccatcaggctatttaatagatgagttttctcccaaaggaccagatttttaaaccattaataagttctacggttttgtattccttcacatattaatttcttcttttatttttataattgttatgtaggcttattttttctaatttcttaatttaatgtttatacattcattttcattttattaatcatgataacattaaaaatatatctatgaaagtcacaaagtcagaaagtattttgtcactttgggcataattcaaactgagatctgacattttccattactttattctgcctataatcatgtactcaacagtgattgagtctctaacacaggcatttgttctacaaatgtgtcctgaggatttactgtgtgccaagcacagtgctatgttctaaggttccagattagaatgcaatacagaacctgcttttagcaagttcaccatctagtggaagtgactgacctgtaagccagcgattttgttgcaatacctaagtactacaatgaaacaaagaacaaagcatcataggaggacagagaaaagagtgacaaggacttactctccttgttactccttgttgaatgggagaggcaataaggaaagcttcaccaaagagaaacctttaaccaagtcacggtatataaacttttcttggttttttttgttttgtttttttgtttgtttgtgtgttttgagatggagtttcactcttgttgcccaggctggagtgcaatggcacgatctcagctcaacacaacctctgcctcccaggttcaagcgattctactgcctcagcctcccgagtagctgggattacaggcatgcgccaccatgcctggctaattttgtatttttaatagtgacggggtttctccctgttggtcaggctggtctcgaactcccgacctcagtataaacttttgtttaggtgaacaagaagaaaaccccattttagggggcaagaaagagcatctgtaaatgctaagagtgtaaaaagggtgttgatgtgaggacactgcaagtatgtagctggagcattgtggctgttaaggcaatggaaggaggcgaatctcaggtctataactggaagcaaagaggtccacaagaaggttgttgcaggccctcattaaagcaattttcatgggcaggtttttgagctctcatttggtaaataaaagcatcatccactgtttccctttttgccttgaatgtcaagaaagtcaaagtcatatttaatcctcaaccacagaaattgtattagccctttgaatcagtatatttttattcacctccatttcatagagtgttcattttccattgcagctataacaagttaccacctatttagcagctaaatacgacataaatttattcccttgcagtttccatgtgtcaaaagtcaaacacaagtctcaatgggctaaaattgaggtgtctgcagaactgtgttccttactggaggctttagggaataacctgcttccaagttcattcaggttgtttgcagcattcaattccatgcttttgtagaagtgaggtcccagtggccgggcgctgtggctcacgcctgtaatcccagcactttgggaggccgaggtcggcggatcacaaggtcaggatatcgagaccatcctggctaacacggtgaaaccccgtctctactaaaaatattaaaaaaaaattagccgggcgtggttgcgagcgtctctagtcccagctactcgggagactgaggcaggagaatggcgtgaacccggaaggcggagcttgcagtgagccgagatcgcgccacggcactccagcctgggcgacagagcgagactccgtctcaaaaaaaaaaaaaaaaaaaaaaaaaaaaaaaaagtgaggtcccagtttctttgctagctgtcagtaagcggtccttctcacttccaaaatctacctgcattccttgacttatgttccccttcctccatcttcaaagccatcaacagtggtttaggtccttctcaagctttgagtatctctgacctcttctgctttttttctcattctgccatatctctctgttggactcttctactttcctcttctgtttccagggatcacatgattacattcagcccacctgaaaaatcctgaatatattccctatttcaggtcagctgatcagaaaccttaattccatcttcaaagtcctgtcacaacaatacctaaattaatatttaatcaaatagccaagtgatgggacacttagagggacatcattagaagtttacctgccaaatatgatttaaaaaatttttctatttcccttttaatagttttattgacatgacttcatataaggcactgtaagtccgtataggacttgtattcttcttctttactatgtttactgtttgggacataaaagtaaaatattctcaatgtagaaaatttggaaaataaaaaatgtataaaacattataaccaattataatttcatcacttgtacatagccactattattagtatttatatcttttcttttagtcattcttttttgcacatttttataaaagtgaaagttcaaagtgtatgcagtattctattgcacctcttaaatcactgtcaagttgagagccatttctggcatttagtgtttacataatggccacataacgttatggtgaatgaatatattttactctattttaggtgtatatgggatattaccagtttttcattatgaataacattgtgttacccatttttaaacataaatctttgctggcattttagatttctttccggatatatacttacttaggtgtagaattgagtattatgtttatctgaaagtattccttacattctaaaataggcttgaaaatgggcttttaaaatatgaactcagagtaagcagccgactatgactacatgtgacattgcaaatattaaaaaatatttctgtaaagtctcttctcatattacagcagcaatttctgaatatatttgtggcctactgtaataaacctcaatttacacaaattgcaaaaggtgtggtagtattgattgctgtacaccaaatatcttctattctctttacaggcatatcttacgatcgcacttctccattcccttggaatttgatgggtcatacaacttgtttgcataagtggacatatgtgtgtaacttatgagtgaggattaagagcagtatatgactagccatacatctctttctctcagccataaagaccgacaatgttccagactgcagctactctactagcttaggttctgcaggtaggagaaggcagagaagcctccccatgacagacacaatgtgagtaaggaacaaacctttcttctttaagccagcaagatttgaggattatttgtattcatccatcttgagtagactgaataagggctcctaactaatagaaattagtacacagaagtgggcttctaccataacaaaaatgtggcattcattaaaagccgtggtgagaaaattgtccatggagctggaagaatgttgatgcatgttgtacagtggcagactgtttggaaagattgtcatatgcaataacttggagtgaatatcaaatacctaacaaattgggagaactggtggagtaagttggaaaaaaatgttactaacatgtattggctactggctctatctgacaaggtactgtagtagagataagatgaagaaagaactagctggcttgcaaactagattaaacagaaaatagaaagttcacaaattcagggactggtaaatttttagaagaaatgactacttcttatacttaaacagtaaaatacagagaaatatttttgagtagtaaagtctgattaaaattcagccttgcagctaatattaaattaaggattatcagtttcctatagctattgtaagaaattactaaaaacctgttggcgtaagacaatgcaaatttactcatagctctgatgggcataagtcttaaatgggcctctctgggctaaaatcaagatgttgacagagatgtgttcttttctggaggctgtaagggagaatccattttcttgccttttcgagtcctacaggctgcccaatattcactggctagtggcccctttccaccttcaaagccagacgtaactggttgaatcattctcctattgtatccccctgacgctgattctctttctatctcctgcttctgcttttaagaacccttgtggttacgttgagcccacctggataattcaggataccctccctattttaaggtcagcaattccatctgcaaccttaattcttcttgaccacataatataacatattcgcaggtctggggattagatggtagacattttgcggggactgttattctgcctgccacagagtgatacctagaatatcttttaaactgggcaaaattgttttgggaaaagacattagaagtgtggttctggacacctgataggcacaagatacccacaatgcaatcaagagagtaagggaaagggacagaagcatgggagtgaggaaggaaagacgcttagcaaatatgactgttatatctaaaaagaaactgtcacgagttttggtacatgaagctgactgaaatcaaagagaaaaattcagggaagtttttgagagaattatattgccaaaagaatcagcttgaactaaaagagaatgtgacagttcaggacttaaaataacactgaggcttcaaccatcattggataggatgtaggctaaggaggctgcctgttccctaagggaggtatattccctgacacccacttcaaatgtagtcaaagaggatcatggaaaggaagactctcccagaggacagagacaaggaccatagattctaggagctaaggagacccttctactccagggccatctcaggagaagagtccttgaagcatttgcccagtaagacctgagagttgcaatgacccattgcagtgattgtagtacaccttcaatttgtacactttctaaacaagagtatttactgagatgatcttggcctgatttcgccactgcatattggctaggtagatgggtgggtagggaggttagtaacttgccttttttagttacaggtctctgggtcatcaggggccatagctggatctgatgcaaatatttcacatcatccctagatattagcttaccaaggatcctggactgtgtgcttgatgctatgattggaaggtgtttgagattgtctccttcgaggaaacaggagagggagtgtgtcttacctagagaaagcagagaggaacaaatagttggtagccacaagggcacattgtaatcagcattggtgctactcactaatatctgttcttttttccttctacccatgtaaaaaaactgaacttcttagccctttctttgttgtgtcggggaatagtagttctgaccattggaccatcatttccagaacacttaattcttaatggtgtaagatgctccttaattactgaattctaattcttaattaagtacttaatttctaattaacgcttaattctaattcttaatggtgcagaatattcctgagttctcccttctccctgttgaggtgatccgagaagcatgtgtaaagatggagcttccatcaactttctggagcttccctaccaacccactctgggcatatagtatgaggtataagtacacttttgttacaactagggagttattcattactgtagcataaatcaacttaccctaactgatacagaacacaatgacctttcatttattactttgtaaaacttttattctgaggtttaagtgtaagatcctgtaagaggttttaataggaattcatgtacatgccttctaattatacaaaacactttcaggaatacacttattgcagaaagtaagctatagctgcttgttaccttcttcatgtatataaatttcaataaatttaaataaatatttaaagatgagaaagaggtgaatttgtaagaaagtcagatttattatacctggggcaactccacctttcattgcatccatcagtcaaggatttataacatggattattggctctatttaattgttaaacagaagttgaagccttggatctgtcaactaagcagtttttgaaggttgggattgaaaggacacatggaaacccaccccatcaagcaaccctagggttgggtcacaaggggtaagacttatttgcgttatgtacatagagaaccaaagggtaagtgtcaaagtaccaaaagtcacagaaacaatatttattaaccaagccaacatgataagaacaaagtcaaaagatacaaaaaagttataaaatttaggtaaatgcacaacttcagctaaaaaaaaaatgtcaagcaagtgtagcaacaagatgaaaaggtacagaattttactacaaacacacctgagacaactgtaccgctctatcattggatgctatgctgatccagaagttaaacacacaggctgctgcaggttaaatacacaggtttcagacagatagtattcaggcttgggatgtcatcgaaataactaggccatgtttctgatataactgataaatttctacagtgattgttttaggttcctttttttttttttttttttgagacagggtctcactctgccacccaggctgcagtgctgtggtgtgatcacagtgctcactgcagcttcaacctcttgagcttaagtgatcctcccaactcagcctcacaagtaactgggaccacaggtgcgccaccacacccagcatttttttttttttcctgtagagccaaggtctcactctacctttcattgcatctatcagccaaggatttatatgttgcccaagctagtctggaactcttgggctcaagcgattctcctacctaggtctcccaaagttgtggaattttaggcatgagccaccatgcccagttgtctcagattcttaatatcatgacaacctctatgacttcataagaacatactggttttcatttaaatagaaaagttgatcacagaaaaaattgaaaggagagttaaaggattactataaagaagaaaatagggggaggaggcagaggagaaagaggagcagaaaagggagacgtaagaagagatgggaaagtaaatgagtggttaacaaaataaataaataaaaagataagtttcgctgactttggaaagtctgaggaccaaaataggaatgctactgagggagccaggggaaaggacccaaataaaagctgaagcaaccggaaatgtaaaaaagaatgcagatttattggtgatgcaggcagttagacctggcctgagaataaaatcactgtagatagttacactggagtatccagagccgagagagagctcagtaggaaacatctgatggctgtgccagtgctcagcttaactttggctcctattttttcatagctgagagaatctctgggtgcccctgggcaaccaggcaccccttcctacagatggaaaaaggtttattacatttcagaccaaaagcaaccaaagtgttctgcagaaaatgaaaaagaaaatgcttaatcatttctaaaggtgccaaatcaatttctccttgagaaagtgcaaaccagtgtaaaatttttaaaataaaaacaatttatctcgtgtttttttccaggtaaaaatgtaaaataacgccttgctttctgatcaacagtttgcctcatcaccaaagagtacagcaatcttagaaatgtacctgaggatttattccaaagctggtataaaacatttcattccaaacctatatcatttgaacaaaaattcattagggtttataaattgaagagatgcaaacacaaagttggcattcctttaacattttcaaagataataaaagtatatagtgactgctttcacccaagtaagcctgtcaaaatgttggcaatattgctttcggctgttttctggcagcatatctcatttgaaatattttcctgagttaattttttctatttaataaaaggctaaacatgaagacatgttcttgggtctataaagaatgcattaaacctctcctgatgacttaaaatatcttcaaaacagtggccatggtttgtcataattgcattctcacttgtctatgttcatttttacttcatttggtttgtagagtgaaatgagaactggattcaaaggtgtgccaatgatgttgtctgggaactagattcatctccataagcctcactccttcatctgcaaaagaggtataacaataccaattacacccccttcactgggttgtttagggaaaaatgactactgcaaactaaagtcctttgaacagagaaaagcataatggagatttaagacatgtactattagtggtgttactatgatttctcttttctaatatagtttatgtcaacagggctccaatgcaagggtttgtgaaagatctactgcatattcaagcaggtttttgtgcagctggaaagcctatgaagcagacaccacaggaggccttacagcagtccagagaactaagacctataagacactaagaaactcaattacccccaaccattgaggcaagagagtggtgatgagcaagcaattaggtggcaatcattagaggtaaactagggaaagttgatctaatcctttctcagtgctcctcagacttcagtgtgctacacatcacctgagaatctcatgaaaatacaaattctgattcagtaggtctggggcagagcctgagagtttgcatttctaataagtagtatagaaataatatagtatctaataatcagacaatatgtacactaatgacccatgacctatatttcaaatgacaaagatctatttcagaccagcctcaaaggaaatctgtgtcagggctctaaggatgaaattggaaacctaaaatgactacattcatcttaagaacctgggagcacaattcagggctgcatttctctaacatgtcagagttggtagggcagttcccacgatggcacacaggcacaggggattctggagaagaaagggctcacattgcaaattctgaggtgggtgatgtcaagacagatgaccacaagtaaccactgcttgggttggcaggggaaaggatggcttccactcagtggttgaagcagggggttgtcatggacaatcaagagcaaatgagaattcccagtgataccctgaggaccaccatgaagaggcttaggctgaggctgcagagatactgcaaaagggcattgaatcagaaggtttgttgctgttatcataagcctggtgtacccaagctggtgccatttggagaaatgccggttatgtcattatctacattttattatacaatcatcattagtatcagcatcctcagtataacaggatgatatccctgatatgaccactggaaacaaagccactcaactctcttgggcagtgatgctcctttggtgtttccttcatatagataaacccagagagtctaatggaacacaatttttttttatacaacaatcttgcatacatagaaaaactaatatctggcaagtagaattttcagaggaattaatctaatttaagagatattaacattctcatatcaataaatagttaagagaaaggtaatttgcaaagaattcaaatgaccaaaaaaacaaaatattaagctatgagaagtcatcggcattggcgtttttccagagcttcccatgtgcttcagcttcccaaatggtatctgctgtcctaaagaactatgatctcttctctgttccctcataaaccatacactacatccaagtggttttctaccaaggtgtctcatgttgctaaatcagtataaaatataggacatagagctatagtctgtgcacagaatattatgtataaatttccagctaccatatttatatagatactccagcatgagagtaaatgttactgataagtctgtcctacacatgagcattatttattttgtttgttattgacttgtctctacctcacactgtgctagtcactagagttgcaatcatggacaataagaaatatgcctgtcattatgaggattacaatacagtggggcaggggacataaataatagtaaaacattagttgctgtgatgggggaaaaaaaaaaaaaaacaaggagctaagctagcagcagggaggacctacttcagatagagtgatcagagaagtccactctgaggttatagtggtgctggaagacaagcctagtgaaggagaacaaggagagtttttctagaaaagagaagctgtttgtaaaagcctgaggcaggaaagaaattggcatgttcaaaaaatcagcaagaagccaacctgtttagagctaccaaaaagtataagccaagttcttcgcagttgaggataaattggtttgtttctcaacttaatgaacactaattcatcacctatacatcaaatactctatttgaacaagacaactctctgtgaagcttatgttcaaatgagggagatacactctcctgatgtgttatcatagaagcactggaagccattggaatacataggtagttgggggcaggggtgctttttagaatatttttttaaacatcattattttcataatataaaattttcttttttcaacttttaagttcagttttaacttttattttaagaaatatgtgctggtttcttatataggtatactcgtgttatgggggtttgttgtacagattattttatcacccacgtattaaggctagtaccccttagtcattttttcctgatcctctccatcctctcaccctccagtaggccccagtgtctgtagttctcctttgtgtatccatgtgttctcatctttttgctctgacttataagtgagaacatgaagtatttggttttctgttcctgctaaggatagtggcctccagctccatccacgttcctgcagaagacataatccctcattttttggggtggctgtatagtattccattttcttgtaggaaacaatcagttacattaacttaaaaaatatttacattgaaatattagatatttcaaattattcaaaaagttgaaatacatgttccttacttccaatatttctattccaactggcaatatgtatgaaaagttcaaggaaaggcaagttgtattgactgattcttgaatttttgctcagcatgagacctaggaatgtcagccattctttctggatttctcttttcaggactaacccattcattgagcaggttactacactttatgtggaaatatcctgtctgcatcaacagattataaatttcttgagggcgaagatttggtattcttaccttcaaatgactcaaaacaatattttggataaattagaatccatataaattggttcattcagattcataaagtatttcaaaatatctccagggtccttatatatcccaatgtgtgattaatttgaaataactttcactacttccttttcaagtgagggttttggatcctggctgtcttttagaaagaatgtgacctccttaccagacactttcccctcattctttgtagaaacgaaaactaaacagggaagcttcctctgtcaggaaatctgatgctaaatcactctttcttccatcaccaatgaactcaatcatctcatgccaatacaattaaattaaggctcttcagcaccacttggcacatagattatatgattcctgttaaaaaacaaatccaaacatagagaatcttttggagaaaatctattttgagaaggtatttttattgttaataattttatcaaaaaaatttacctttgtagctgaagttttttaaggaatctgagccccgggataatttttgttttcctctgaactttggccagagtaacttatacgtacatgaaggcaggaatttttcctaatattactaagaagcatgaacactcggtttggacattgactggcctgaatatgataaataatatatttcctctttcaaacttctacatgtaccaaatattataactttttgctcaaacaattgcatcttaaaatttccatgtagtcacagccaaactccttagaaggttaaaatgtattacatagtagaatcaatttactttttaaaaggaagaactgcacataccaactggtaatggtaatattaactaattgcttttataggacaccagactaagtgaacgaccttaggcagatatttaagcattttgccactacccatttaaattttgccatgatcgatttaggtcgtccacttcaaaattccaagtactatttctcaagataatgtatataaaatatttacagcttggcttttagagacttctacagttttctgtcaataccataatcaccatagaaactatgagtgtgggaaattaaagggctgtgtggtggccatcctttgagtttgcaaagcctgctcttgtgcttggggcaagcaagcctaatttgtcaactgaggcaacatggttgcagtctcaggtcagtgatcgtgctccaattggagcagcaatcactctgaaactatcctagctcagcaactagctcacattccaaaaagaactgcagtattagcacctgagctccagccctggagttatcagcaaaaacgctgtggctcccccgtcattctttccataaatattcattgggcatctactatgtgtcatcagggactgtaccaagtatggtagaatacatagattaaaactgatgatcccatctcttaagaagcatgcattcttggatgggcgtagtggctcaagcctgaaatccaagcactttgggagggcaaggtcggcggatcacgaggtcaggagttggagaccagcctggccaacatggtgaaaccccgtctctactaaaaatacagaaataagcctggcgtggtggcgtgtgcctgtgatcccagctactcaggaggctgaggaaggagaattgctagaagccaggaggcggaagttgcagtgagccgagattgggccattgcactccagcctgggtgacagagtgagacctctgtctcaaaaaacaaacaaacaaacaaacaaaaacaaacaaaaaaacaaaaacaaaccaaaaaaagccagccaaccaacccaccaaccaaaaaaaggcctattaatttgttttattaattcaagaaatatttattaaacacctgttatttaccagacatgattatagaccctgaaaatacagcagtgaataagactgtcaaagcccctatatcatggagtttacttgttaatcaagagttagacacagacagtaaacacataaatgaacaagataattttggatatatacaagtatcatgaggagtataagaaagtgtgatgtgttggcaaatgtggatggagttaccacttcagacaggatgagaagacatctctaaataggtgataactgagctgacacccaatgacaaataaaggaggagacaagcaatctaaaatcctagggaaacacattctaaagagcaaagaaatttgggtgtgtttgaggaaacagaaaggagagtgttgttagaccaaaggagtgaccaagaaagtataaaaaggtaatgacagagactggtcagaggccatgcagtgtatttcttatgggttatggcaaagtgttcagatcatatccaaagagtaagccactggagggctggaactagagtgccagtgaagggtcatactttttgaagaaaactactgaatagtgtgcaggtgctatttattattgaggtaggcaaatggtgggatgaaggatagtgataaggaataaaggaaggatgagagagagaaataggaacattttcacaaaggaattactcaaactcatgcttgaagaagttaaaccttcccgggtggacaaaagagggcagaatgaaagaagacagcatgtcaagtgggggaaacagcatacacagtggaatgaatgtgtaaaataacatggcatgttctgggaaccaacagtcggagttaagaatcaatggtggcttgatgaggtttgcatgtcaggcagagtttagattgcaggtgaggggggacccctgattatagggttttcatgatgcccctctttcttgccttgtctgcttgtcccctaatttcctgagatagctataggtagtttgaaaatatatgtatttcaatacctcatgctaatcccctatatactttatctgttatataaatcttcagattagcaccacttttgcaccagattggaaccagctgcttctgtatttattttcaccattagaatgtaagttccttgaagttagaaacaatgacatttaaattctgcaccctaatatctgacacagcattagacacataatatgaactcagcaaatattaaattttaataggaatcagatagataaatagatggttgaaatttcataaaatatttgaattagtctccagggctgaaatcagaatgttagcactagagcattttctataccatggaatatatactattaagatgaggtaggtagtagttgtttctctgatattatagtaagagtttctgatggcttttaagttcacaggctcaggattaatagctcacccccatccagtcttgtgatactgcctacatgtaaagcttcctcactagtctgaccagtctcaatgttggtttcctctagcctgatcatcagctccctctagaggaaagcctggaattagtacttagcctcactcatcttcctttagcctatttccatcgatttacagagcctgaacccagccaactgtggcaaccacctaatgactgatttgattccatgtgcaatctttcgggagtgccaaattctcaatctctaacacataagtatgttacacacatattactatccatctctctgagtgtcctccttctaaatgatgcagttatcatgtaaaggctgcagattacccagatatgagaaagagaaagagtaagaagcagacacagacaaggacggaggaaaagagtgaggattagatggatagaaggaagaacaacggaaaaattttttcaaaagtttccttgttcagaagatatatttatgttcttatttggaaaacaatgcatgtgactcagtattacataatccgtatgtggcaaagttcccagatcaagggcctgaagaatatatctatagcaaattttggccacacctggatgcaccagaagggcagcaaagatgacacaatgaacctcagagaagacacaatatttgaagaggtggacaactgtccctgaggttcagactccaaatgagtaaacagtaatagctatcctttgtctcaggatggaactggatggaggagttccacatagggaaagaaacacagtctgaggggaaagacaggttgcacccatttgtggaatattagttgaaggttgaaaggaagaagagattttgtgtgccaccctgaacagtatttaatgatctttctgcccagctcccagggacatatgatgggttctcaaggaattaaaaagggaatgagatggaaaaactatacatatgtgaaatttagaaatatgagaggtcaaagcaattctggttttagcttcatagcctggcttaacatagaagaaagatatgactgcttcatcaggtaaaaaggacgcaagattaagagaagcattcaggaggtggtcaacaaacattgatttcctccccctgttcccttccacattgccgtctggaggctagagtcaacacacacacacacacacgcacacacacacactctcatcctgacattagcaagtattgcacatttgacgtcatggatgcaaacctcccagtggtgacctctttttaattcctctcccgagtaaagtttctattgatcaactaaatgtatgaatgaaggagtgaataactgaacaatttagtgaaattctatttagtattcagatctatacttgatactgcaagacacctcctgatattatttaatccttattgcaacaatgtataaattgttatactcatttagaaattagagaactgaagcttatgcaagtgacctgcttaggatcacaacatagaaactaagatttgagatttaaacacagataattttaatttaaattcatttccttttctaacaaagcttcaacctataggtgatttcacatagtcacagtatcaatcttagtcattaaaatacacatttcgttgcaagaagtgtcaggcactgttgaatagctagcctaagactcattttcaaacacctaaatactcactgtttcagattctcttgaagctagggaaggccagccgtcttgagttctggtcaatgatttgtaagtggaagtttgttgatggatatggaaaactctgctttttgaaagaaggaacatacatctctaacattccacctcccctctacatcctgcctgactatgaaaatgatgcttagagcagcaacaatcatcttgtgaccattaggaaaaagtaaaaaaaaagaaaaaaagctgcagagatgctgcttcttacctcattgaataactacctatatccagactccttgctgcatgagaaaaacaaacttctatttgtctaaggaattttaaggtattctgttaattacaggtaaaacagcaactaatacagaaaaatgtctaaaacaccatctctaaagtacacatattagtgagattttaaaaattaaattgtattataatgaatatatatccttactttaaaaagcgtatttccaaagtcataattttctgctctaaaaaaagatcaaatgtcatccatatttagttgattctaaactcatgaatatgaatgacaaaagaaaatctttacaaaatttgaattattaagataaatacagttactgcaatttttctaaacggcatctagcacatggctgatgctcaataaaggctgagtgttaaaaactatgtatcttattagcaacacatctcagtactatcatttggaaaaagtcctttctctcacaaatcaatatcacaaagaatcaggcagcaggtggaggatgtaaaaatgaatcatttttcaataacttctttcagcgtggaaggtttcacatgtctagacatattttgctgttgaattccacactgatatttaagggattgtttttccccattgcatacaaaattactctaaatatagtaaagcattttgctcacatgctgtcaaccccaggcaaaacgtagagtccatctgtgtccttccctatagttccagccagtatatcccgcatcacacatcagtcatcaggtacaggttgagcaagaagacgtttctctccagtttgatgatgaacagagtgagttcttttatttttagaattgactagaaacattacagttttcccacatggcattcattaaaagtttaacctatcacttagtaataaaaatgtgaagaataacaagtaacaaaactttgactcaaaaaattaattttttttgtgagacaagaatgtgaagggatttggtgtttttgtgatgtttataccattctcagataatcagctgtcaatgtcttgcagacttataccatgtcttatttgagtaattttcagaaaaataagcccagtgggataagaaagcccaaatgcatactcatatcagggatgcacctgcatctgaaaggagaaaaggaaacaaattaaaaagaggactagaagatttacttggcctgaatgatgagagtcacctgggtagaaccaataataattgttcacatcaaatgatttctgaaaatgattttaaggatgttttacatagctaatgagttgttccccagtatacaagttcaccattctgatatatgtggaaagataatcttcattaacaaaatggaaaaattaaattttaaagtttctaacaggtcacaacattgctattgaatataccgacttccagcaccactgcacttgttctccattacatttcacttaacgtactcttgatccattacttgcagttatttcagataaggatggaactctattgtgggttgtttgtaggtgaaaaggcagtcttcactttcccatgatgcctaaaaagaataggcaattggatgcattgacttgtccaagtatgatgagagtctctgctcccccgtaaccaaattattgctaaccctcttttcagacaatgtatttccaaaaattccgttggccaacagtatagctgtttcatctgtgcagccccacttacatgcaggctagtccatagtggctttcctggagaaaacgatacttttatgtaataatggaaagggttctggatatgtcatacgtcgtgggtttaaatcctagctctgcaatttaccagatgtgtgaatacagggaacgtgcaaagcttccttgaaccttagtcccctatttacaaaactggggacatgatacttatctcacaggactgttaaatgttgaatgaaatggtttgtttgaaagtgcctggcttatagtaggtccaaaataaatcttcactaaacctgaactgtttagctttccagtaatacgaaaaaaatatatatcaggaacccagtaacttcctagtgtccagaggcttaaatgtaccacacatagaatacagattgtttatgtttatatgtgcattgttataagaaaacaaatgccacatacccacctaacaggatgaaatgattgacaggtaacattgaccttcttccaggaaatcacagattttcaaaacaagcactttttaaaattacaaaaatatgcagcatgaatcagaaaagcaggaggctgtgtttgtttgatcaacatttcattttccatagcttccatcttcgttttattgcatggtgtgctatttccctcaatagaaaaggaaggctactgggatgtttgttataatcgtctgcttaaggttctttggcagatcacatgttttacttaattaaataatgtcccaattaattgatttgtttgtagacattcttaatttagtaaaggctgagcagaatgctaaaaataccattatatttctgacagaggcaccactaaagtctgataattgatagctttgctgttttctctgatggcctgaaaggcttttaaagctaaattctgtaatcatgttcatctttggaaattagttttgtgaaaccacacatttagttcttgctgagaaatctcattttagtcattttaacataatttataatgcataaactaaattagcttttgtagctaagccagcacatttttctttaatttttatctcatcctaatatatttttgaccttgaaaactgtaatgtctgttggatattgaagcctctgaacaaagaaaatcatttccattccatcactatggttacactttcttcgctctccagcactgaacactgctgaaagtgttgaatctggattcctcaggagggcaaggggaacttcatgtaatatcatttagttctgattaaataaacacatatacataatggaacccaggaaagtagcaaattacttcactttgtttacattgcatatgatctgactgatggtaaggggcaatatatcacccaatgttatacatttcaggttctgctgtgtgtggtttatccctaggcagtcacacatacatattcgtctccaaaaacacagtcaaaatgccaggcagctcctaacacctccaatactcctgaagtcaaagcggttttatccccttctaacaacagagaacttctagtgcaaatcatacagttccctgtctgccagagatgtgtttcaaatgagcttgcaacgtgtctctctccatcctaaaatgggttgtggctgcctataaaagcaagagaagaacctggtcattcaaacgaatgctatacctgctgcctctgatagaaaaatacccttttttacagacggcagcatttgttaaaacgtgtcttgaatttcttttattacacagctggtctacaatgttaactacaataggtttgctgttttgttctttgccttagtagcttatgtatcaaagccatctccaagaaaatcgttggtaactagttggtatcattaagggtcaatactgtttttaaaagtacaatgtatccaatcagtattatggcatattaaatccatataaactcaaatggaatgtctccttcccatggtcgatattcacagatttccagctacatgggttggcttgtgcaaaagtaatgcagagctattcatttcagcagcatatgataaaaaactggagtgagagaggaaacagctagagcccaggtaggaaagaaatctgcgtcttgaatagctttcaggtacatggaccacaataatcatctctgtggcctggcacagaaaatacacaataaatatttgtggcatggaagaataggtgggtatttgaaagggctcacttttttttcagatgtaaagatcttttggtggtggaaaagaacacactgatactcagacagataaaaggcagaactccagctccaagtaaaaaagggctgccagccagggtcacacagggggtggcatccaggaagagggtagcagcaagctggagctggagggagcagcctgtgtatggcaaatgggattgagctagctaggtgtcctggactcgctgcagattagctaatttgaataattctgtgggctccaaggcatgagggctagttgtccacccctgggtaatagtggtcccagagtgaaagagcctgataagagaagtgatcggagtatagacttaatcagcaactgaaaacgggaaattgatccacatctagccagggcctcagaactggatcaatacagcatttttttttttttttagacggagtattgctctgtcgcccaggctggagtacagtggcacgatttcagttcactgcaagctccacctcccgggttcacacccattctcctgcctcagcctcccgagtagctgggactacaggcacccgccaccatgcccggctgattttttgtatttttagtagagacggggtttcaccttgttacccaggatggtctcaatctcctgacctcgtgatccacccgcctcggcctcccagagtgctgggattacaggcgtgagtcaccgcgcctggccaagacagcattttttaaaactctgttacattcatctacctacagaaataaagaatgtggttaaaatgcagcaaagcattacatgacattcagtagcaaccaaaatgtcattgaagtgtgacatggagtatgtaacaaaagctaacctggctgctatcgtttggatatggtttatccctaccaaaacgcatgttgaaatttgattccttatgtggaggttttgggaggtgggacctagtggggtgtttgggttccgggagcggaacactcatgaataggttaatgccctcctgtgagtgaataaattagttcttaccagagtgggttgttaaaaagagtctgaattcctgggtttctctctctcttgcttcctccatttccatgtgatcgttttgcacatacctgctttccttcggctttcagccatgagtggaaacagcatgaggccctcactggaaactaagcagatacaagcaccaggcttcttgaacttcctggcctatagaaccatgagctaaataaacctcatttctttataaataacccagcctcaggtattctgttacagcaacacaaaatgaactaaaacattggccctgacttgaactaacgatgcagataattataaaataatttattagaagtcttttgggggggataatcaagttttcataatttagttttgatatgtaaaacactaaagagaggcaactcccaaacattttctatatttttgttagcctccaatgttttccactatgtgccaggaacaattctgcatatgggttggagtctgtattttttaagcaaatgtaactgggactgcccaagtttagtaggcactaccatcatataattcatcatgctgcattggaggcagaaaccaaaggctagctgtggtaggcagaataatagtccctgaaagaggtcctcaaactaatcccttgatttgtgactacattatgttacatagtaaggagaattaaggtttcaaatggaattaagctggctaatcaactggtcttaaaatagggagattatctaggtagccccattataatcacaagggtcctcaaaagtagaaggagacagagaggaagtcagagtgatgagatgtaagaaggactagataaactattgctagctttgacgacggaggaagtataccatgagccaaggagtgtgggcagcctgtacatgacagaaaaggcaaaagaatgggttctcccctaatgctgtggcctgagaagttgggctgtattcctttcaagagaaaggaatacagcccaactgacacctcagttttagccccatgagacccatgttagacttctgacctttacaactgtaaatttgtggtgtcttaagctattatatttatggtaatttgttgcagcagcaaataggtaactaataaccatctaaactcccaaagcataaaaccactacttctatttttttcccatatttcctttacacaaaattttgtttactaagaagacaagctctcaatgacttttccagagacaactgacttttgcttttgctgaggtatttgaatgtttcatatacaacccatgacaacttcatactgaaagcattttctgtcaatggaccgtccttcattctcaaatattaattttttgaatacttgtatttaaaaataaatactaatctactttgattttgtagaaggcaaccctagaatataagaaaattgcttctcaggccacagtattgactttgaggacttcaatactactgccaaataatatttgaagaagataaccataccctctgttccttaaagtaatcattatttttactttctttacccatattcattcttgtacactcaaaaaacacagctccaactaatccctttagttagaagtagaggataccagaatttacgacgtcttttgaatgaaacacacagaacagaagtggtttcaaggtcaggtttaaggggtataaaggtacatgacagtagctagaaaacgcaaggtggctgagttgtcatagcacgaatccttcatgagcaggcattattctaatctggttatcaagtttatgggtaaatatcaagaggtgaataatctagagagcagttctctgaatggagagtgagaaaaaaactgaatgtcaatcctagcttctctcctgagtaacagagggtagttttcatgtagcctcccctctgtttttgtgtgaccttcctctgtttctacagctaaatcaaaatgcttctgtatcttgcagggacaccctcatccctttactttccagttgttgcccttaatggagttttgattctttgatctgtctcctctgcttttttcctttctgagttcagaaagcttgagtatctgattttcctcttttgctttcttatccctccaatctggtctttaaatgtcagttttagtcaagggtctttccatttttacactaagcctgtcttttttcctttttttcttgagaggaaagtttcttttcaaatccactttgttactgttgtttatttttgttattgttctctttagtaacaaaactttgtatctcacaggaagtagtgatgacatctctagaggcaaattttacttttttcagcatctattcactgaacaccaactttattccatggtaaacttcagggagaaaagaataaaagatgagtgagacaatctaccctaaaataattcaccaactagaaaattttttaaaataactatattatagaaaataaataaatgtgatgaccatttcctaaaggtcctgacatatggtactatgtgatggttttcttctcctttctcattatcatccctgagcactcaaaatagcggacctcagtccaaattcccccagctggagtacaaccaaacagaagtgtaaatgttcaggcacccatcccatcagtgacccacaaatccctgaactaaaaatacttcataagaaagaagagcaaggagtactgaaacatgataagtaatctcctctcaaaaccattctcagtactcactctcacaatgacaaagccccctttgaagatactcaaaactctgcccaggaaaaaaaaatgcaatgtatccattctcttaatgatggtcatttggattgtttccatttggggctattattaatagagctgctgcgaatatttgtataaaaaaatctctttttggggatatgttttcctttatcttgggtaaatatgtaggaatgaaattatttggttttaagttattcttatgctttaatttataagaaactagcagttttcaaattgtttataccattttgtactcttaccagctatatataaaaattctagttgctttacatcctggccaacatttagtgctgtcagactttttaaatttaagccattctagaagtggatatcttatttttatattaatttgtatttctctgatgactaataagattgtgcaacatttcaagtgcttatcggttatttctatatcttccttttgaagtgtctgatttgcctatttattattgagatgtctttttattattgaattgaaggtattccttatatactttgcatacaagtcctttgttatatatgtatgtatgatgaatattttcttttatgtttgcctatccattttcttaacagacactttcagtgagctgaaggttttaattttgaataacagattattgtgttttttcttttaaggtcattgttctccaagaacactgtaccagcctcaggattatgaagatattctcttaccagattattctagaaactacacacttttagcttttgtatcagattcatgacccatcttgaaattatttttaaatgatgagtgatacatagactgagttgttttgatttgttttgttttgtttttctcactgtgaataccagtgttccagcttcatttcttgaaaataatttattttctcccattgaatggcattggcttttttgtcaaaaatcgcttgactatatgtattagtccattctcacattgctataaggaactacctgagactgggtcgtttataaagaaaagaggtttaattgattcaatttcaacaggctgtacaggaggcatggctggggaggccttaggaaacttacaatcatggcagaaggcaaaggggaagcaagcacgtcatcactggccagcaggagatagagagagcaaaggggaagggctacacattttcaaacaaccagagctcatcagtactcactatcacaagaagagcaaaggggaaatccagtcacctgatccaatcacctcccaccaggtccctccccaaacattggggattagaattaaacatgagatttgggtggagacacagagccaaaccatatcactatatgtaagtattgatctacttctgggcactctattctgttcctttgatcataatagatctagcattaggtcaatatcaaactatcttgaatactgtaacttcacaatatattttgaaatcaggtagtgtatattctttgtcttttctcttcaagattattttgactattcctggtcctctgcattaacaaataatttcagaatctgcttgtcaaggagaaacagcctcttggaattttgagattacactgaaaatctggagacacatttggggaaaactgacattttaacataattaatcttgaatatggtatatttcttcacttatgaagatctttaattttatccagcaagatttttaaattttctgtgagtttttgcacatcttattttatttctaatttttaatgtctttaattttttttcaatatgattagcaaattatgtgcttctgttacatagaaaggcacttgatgtttgtatgtggaccctgtatttggtggtcttgctaaattaatgtgttggttgtagggttattttgtgtagatcccatagaatttctatgtacacattcatattgccatttttctgattgtgtggttgatttgccttatgctagccatgaccttcagcacaacattgaatagaagcagtaggaacaggcttccttgccgtgttcccaatatcatggggaaaaccagcagtacttcaacattaaatattttagctgtacatttcatcagactaaggaagctccctactatttctactttgctgagaggtttttaaaaataactattgaattttatctttttctgcatttttattttaactttttctgtggcatactactttgattttcgaataatgaaataatattgcattcatttgtaaaataaatcccactttgtcgtgatgtactatccaattatacatttttaaattcaattcctaatattttgtcaagatttctgcacctatgtttatgaaagatattagagtatgacatcaaggttatgttcgctttataaagtttagtagcatttccaactcctttttctgaacaagtttatgtaaagctagaaatatttgttttttaatgtaagacaaaattttccagataagcaacctagctctggaattacgggtatatatatatatatatatatatatatattatgtatatatataatatatacatgtatatattatatacttatatgtatattatatacaatgtgtatatatgtataattacatacatatatgtatattatatacatatatgtatatatattatataatatatgtatatattatatacacacatatataatatatacatatattatatatgtatatattttatatatacatgtatatattatacatatattatatataagtgtatatattatatatatatatataatatacatacgcgtatataatatatacatatataatatatacgcgtatatattatatatacatatatatgcatatatacacgtatagtaatacatacgtataatacacgtataatacgtgtattatatatatatatatatacacacacatatatatatatatatatatatatatattttttttttttttttttttttttttttgagatggagtctctgcactccagcctctgttgccgggctggagtgcagtggcacaatgtcggctcactgaaacctccacctcctgggttcaagtaattctcctgcctcagcctcctgagtaactgggactacaggcacccaccaccacactaatttttgtatttttagtggacacagggtttcaccatgttggccacggccaggatggtctcaatctcttgaccttgtgatccacctgccttagcctcccaaagcgctgggattacaggtgtaagacaccgtgcccagccaattatgggtatattttaaattacaaattaaatttctttaacagttataaattaagtttttaaatttgggagcataaagttactcacagtattttcttactaatttttgatgcctacagcactacagagtgattccaacatttcttttattggtaatttgtatttttattttcttttcaaattgttatctgtatagctagggcaactcttctcaaccggggttccatgaaagaattaagcctgaatgccctaagggtatctaccatgtaaaatgaaaaaaaaaaatcctattgatctaaactagtagtattagatatgtaactttcttggaatataaagcaaatacacaatccaatcatatttgttaagtctcaattatctttcaaaatcccagttgtgaaaagtcacttctcaattttattgatcttctcagataattgattttttggttcactgattttttttaatgtttgctcattttctgtttcattgattttcattatttattatttcttctcttcaatttactttgggtataatttactatttttttcttcttcttttccactatgttttttactaagatgcagcctcactatattccccaggctgaactcaaactcctgggctcaagtggtctgcctcccgagaaactgggattacaggtgcacaaaaccatacctggtttactcttctttttctctcttcctaaagtgcaaacctagatggttaatttaatatgattcttctttttgtaatataataatttaatattttaaatttccatctgaacaatgttgcatctgtatctcacaaactttgatactttatgtttttattatcatttagtaatgtattttgtgataatccctatcatttttttatttgttatatagattacttaaaattgtgttgcttaattccaaaatatttgagaattgagccaggcacattggcacgtgcctggagccccagctactctggaggctgaggcaggaggatggcttgagaccaggagttcaagagaattgtgcagatattttgacattagtttctaatctagttattttatggacagagaatacatactgagatattttgataattttaaatttacaacactttttaatggcccatcatatatacatagtctttttttcagatttattaaggtataatacaaataaaattgtttatatttaaggtgtacaatttgatgtgttcatatacgtgaacattgtgaaatgattactacaaacaagataattaatatatctatcactacacataattatcatttttttctttgtgcacatgtgtgtggtgagaacacttaagatctaccttcttagcaaatttcaaatatgcaatacaataaataatgttaactatggacagaatgctttatattagatatccaaaactcattcatcttgcataaccgaagctttataccttttagcccatatctccccatttccctctccctgcagcttctggaaaccaccattctactctctgcttctacaagtttgactattttgattccacgtataaatgctaacatgtagcttttttctttctgtgtctgatttatcttagttagcataatgtcttccgtgttgatttatgttgttgcaagtagcagggtttcttttttttcctaatatgtatatctcacatatatgtatatacatcttatttttttatccatgcattcataatggacacaggtttttccatatcttgggtataatgaataatgcttcatgctacaatgaacacaggagtgcagatatctctttgagatagttattttatttcctttggatatatgcccagaagcgaaattcctggatcctgtggtagtttttatttttattacttttaggaacctccatactgtttcccatagtggttgtacaaatttctatttccaccaacagtatgcaagaatttccttttctctatatcctcaccaagacttactttttatcttttgataataacaccctaacaggtgtgaggtgatacctcattgtagttttgatttacatttccctgttgattagtgatgtggtttggctgtgtccccacccaaatctcaacttaaattgtatttcccagaattccgacatgttgtgggagggaccaagggggaggtaactgaatcataggagcaggtctttcccatgatatcctcgtgacagtgaataagtctcacgagatctgatgggtttatcaggggtttccacttttgcttcttcctcatttcacctcccgccatgattctgaggcctccccagccatgtggaactgtaagtccaattaagcctctttttcttcccagtctctggaatgtctttatcagcagtgtgaaaacaggctaatacagtaaattggtactgagagtggggcgttgctgaaaagatacctgaaaatgtggaagcgactttggaactgggtaacaggcagaggttggaatagtctggagggctcaggagaagacagaaaaatgtgggaaagtttgaaacatcctagagatgacttgttgaatggctttgcccaaaatgccgatcgcgaaatggacaataaagtccaggctgaagtggtctcagatggagatgaggaacttgttgggaactggagcaaagtgactcgttatgttttagtaaagtgactggtggcatttctcccctaccctagagatgtgtggaactttgaacttgagagagatgatttagggtatctagcagaagaaatttctaagcagcaaagcatacaagaggtgacttgagtgctgttaaaggcattcaattttataagggaagcagagcataaaagtttggaaaatgtgcagcctgactatgtgatagaaaagaaaatccattatctgggaagaaattaaagccagctgaagaaatttgcataagtagcaaggagcttaatgttaatccccaagaccatagacatgttagaggtcttcaaggcagccccttccatcacagacctggagacccaggaggaaaaagtggttctgtgggccaggtccagggtccccatgctgtgtgcagcttagcaacttggtgccctgtgtcccagctgctccagctgtggccaaaagggagcaacacacagcctgggctgtggcttcagagagtggaagccccaagccttggcagcttccacgtggtgttgagcctgcaggtgcacagaagtcaagaagtgaggtttaggaacctctgcctagatttccgaagatgtatggaaacacctagatgcccagggagaagtttgttgcaggggcagggccttcatgtagaacctctgctagggcagtgcagaagggaaatgtggggtcagagcccccacacagagtctctactggggcactacctagtggaactgtgagaagaaggccaccatcctccagactccaggatggtagatccaatgacagcttgccccttatgcctggaaaagctgcagacattcaacaccagccatgaaagcagccaggagggaggttgtaccctgaaaagacacaggggcagagctgcccaagacctcagaaacccacctcttgcatcaatgtgacctagatgtgagacctagagtcaaaggagatcattttggagctttaaaatttgatgaccccgctggattttggacttagatgggccctgtaacccctttgttttggccaatttctcccatttggaaaggctgtatttacccaatacctgtacccccgttgtatctaggaagtaactagcttgcttttgattttacaggctcataggcagaagggacttgacttgtctcagatgagacttggactgtggacttttggattaatgctgaaatgagttaagactttgagggaccattggaaagagacgattggttttgaaatgtgaggacatgagatttggagggtccaggggcagaatgatatgggttggctgtgtccccacccaaatctcaacttaaactgtatctcccagaattcccccacgttgtgggaaggacccagtgggagataattgaatcatgggggtcagtctttcccatgctattctcatgacagtgaataagtctcacaagatctgatgggtttatcaggggtttccgcttttgcttctccctcattttctcttgctgccaccctgtaagaagtgtttttcacctcccaccatgattctgaggcctccccagccatgtggaactataaggcccattaaacctctttttcttcccagtctctggtatgtctttatcagcagtgtgaaaacagactaacacaattagtgatgctgagcaccttttcttatagttggtggtcataatatgtcttctttggagaaatggcttttcaggtcctttgcctacttttaaatcaggttatttgggtttgggattttttttttttaatctgatatatggtttgcaaatattaatattttctctcattctttaggttgccttttcactctgttgattgtttccattgctgtgcagaaaccatttagtttgatgcaatctcatttatctattttgttacctgtgcttttgtcgtcatatccaaaaaaatttgttgcccagaccaatgtcaagacacgttttcctatgttttcttcaaggagttttaccatttccagccttatgtttaagtcgttaatccattttgagttggtttttgttatgaataatggtcctaggcaaaaaagtaagaattaaatgtggtgtttccttatctcaagcatcacagccctgtgctatctattgtctaatatctgagaatagttttttcatacatgttatccagttatacagttcttcacaccaaaatgtaaggtccaataatcatatctctgctatggctggaaccacttctacacttaaaatatactttattttattcatttcattctcataacttcatgaaataagtattattaagccattctatggctaaaatgaccaaccttaagtaaccaccttctgttatcctttaagcccatcaagcgtagaaataaatcttattaactttgttgttcattgcatttgactccgttcttggcacacaatagatgctcagtaaataaactttgacagatactattttctcctattttctccattatacatataaaaaaatcctaaatctcagacaagacaaattgtggaagtggggaagaaactaatattgattaagtgctgggatttgaaaactatggaacataggccaaaattggcccactttttgtttttctttgtttgtttgtttgtttgtttgtttgtttttgagacggagtctcgctctgtcccccaggctggagtgcagtgcggtggcgcgatctcggctcactgcaagctccgcctcccgggttcacaccattttcttgcctcagcctcccgagtagctgggactaaaggcgcctgccaccacacccagctagttcttttgtattttttagtagagatggggtttcaccgtgttagccaggatggtctagatctcctgaccttgttatccacctgccttggcctcccaaagtgctgggattacaggcatgagccaccgcacccagccaaaactggctcactttttaaaaaataaagttttattagaagatagccatgctgttgtatcatctctgtctgctttcatgctgtcatagccaacctgggcagttaggtctgcaaagcttaaaatatttaatatccagtccttgacagaaaaagtttgccaacccctggctattatacattataatgccaagcaatgtgcttggcaccgttacatacttttcacctcattaagtttcccagctactctaagaaataaaaaataataccgttatccagatgtggactttgggattcagagaggtatttacaacaggttctatggcttatagatggcaaagcacaaatttaaattctgatttgtcagactctgatgcctatgcactttttatttctaacagtcagataactttgaaaagaaatggaagatgataagtggaatggcccattttagtgatctgcacatcatcacacatgaacaagttgatctaaagctaaagctactgaagaactcgctttataacctataataaaaatagttaaaactattattacttataaggaattttttatatgtcaacctttgagctaataattgtatgtgtatggtgtgttttatgtacatgagcatacatatataacatatatatgctatatataacatagatgtatatatgtatataaatgtgcatgtatataatttaatttatttctcatagatattctatgaagatattgttataggtacagaaataaatgcttaacaggattgtattacaagatagtaactggtaaatcaaggattcagatgattttcctaactcactaattctatctgtatcttctttccattcttttcaactcattaacataggttcccatgaactcaaacattactcgatggcataagaaaggataatatattcaggagctctatggtctcacaaaatgccaaaagctcactttccaaccactcttccgggcctccttggcaagctttccaccatcactcccagcactgtcaagatgtgatgcttttctttcttctcttttttaagtgctttaagctctgagccatcattatttaattttaaattatcttctgatttcctacgtgggctgagaatgagagtagtctagggaaaaaaatggtagtgacaataaaagagaagggaagcatttgtgaaaatccttttcttcttttcaacaagagctgtaatagtgttttgtatcaacatgactccttccttcagctgtaacaaagttagagaaagtgttggtactataaattgagagttcaggaggtgattctacccagtcttttcaacaagattggtattataggtttcccacatagaaaccagtgcagaaatatttctaaagcaattttgtctttgccaggagcccttccctacctccttacgcctcttctctttcccaaaatgttcctaggttattcgatctcctggtgtcttccatgcatgatcccctcccaaacctcagcaacttcccatggtgtccaaaatccaactgctcaaggggcagagttagggatgtaactcaccatttgcccaactagatctttaaataactacctcaaaagagagctctttgataataaacaggccaataggtattatatagacacaaataatgccaaatctctagaacaactaagagtctgatgaaacataacatgccatatctatagattttttttggaggatatttattcgtgtaaagatacagagatacaggtcactgttgtccctcatggatgctctgtaggttgtcttatttttagaaatgttccaaaggtgagatatggcaatggagtaaatgtgtaaaacttaaatgcaaatgtgacatcttctatagccagtcagaaaatttccagtgtattagcaaccatgcactcatttctccaataatagacattgcactaacattctatcccaaagggagcaggagtgggcctgacagcctaggggagaccaaagagttgaaaaatcacagcaaaggaaagtgaaccactaagtgggacaacaaatcccatagggcctatgaagctggccaccatttcaactatatctcaccaaaagtttttaattgagtccattgaggattttcttttttccttgtggggatacatccttgattttataacagcatttaacaaggaaaattggattcattttaggatgaacagctggagcgcatcagttccataaagcaaaagctgacagtatttccattttagtcaccatgtagaagcttctatgatgctcagttggattatgcttaccctgaaccagctcactttcttccagcatgtccatgtacatcaatatcatattccctggcacccaaaccttaactatgcctccttttctcattcatttcccaaaatttagcccaaggatagatgccagccttacagatagcatcagtagctaatcagagttacctagaaatgtagcaatagtccagagaggatgacaacagcgcaagctaagagtcacttgactttcaccatttccctgctccctgcctcaaaggcctgtgaaaaacagatgggggaaatagagtaaattagaagaccatactctttgctacaagtcactggctatatttgataggtctgagagggagaggaaaacaaaaggagattagaattttagacttacatgggctgggctccattacaactaaaaaggtccaaaaagaactggaatcttcttaaaatgttaacagaggacaaaaatggagtaattctgcagaacaagtttaagatagtaactgaaaaacaataaggtatttttcagacttgtcctgtagtaaattcaaactgataaacagatagcactgtttttgtaacttaatttatgtagccaaaacacaagcttagactagtgcagaaaacacattctttaggatcacataagtctggtttcaaatctccatcacttagtacctgggtgaactggattaactcacatctcttgagtctgtttttacatctacaaaatgagaacatcatccatctactgcacaatcatcatgagaattacttgagataatgtgtagaaagtgagtagcacaatactggacacataataagcattcaacaaatctttctattatcacttttgattgcctataatgtgtttctctcattttggccaatccaaatgctatgattcttctgcaggtttgcctttttatgaattcatacttaactatcatattcaagagttttactcaagtatctgcaagtgattgtcaggaaaaagaaagggtggacattctagctacaactcccacagggcaattttatataaaaataaaaagcagattttggttcagtatctgaaattgccttccaacaatttaagctaatcgataataaattagaaagagtgaactcctcatctccctagatagggatgctgctgaatggtgcaacatacggcaaatataagctttggtatctgatagattgaggttcaaatcccagttgtgtcacttattagcaacaaaaccttggccaagttgcaaaacctctgagtctgttcccttaatgtgaaaattggttttaataatacctatctgatcagagtggttctgaagattataaaagagcctcccctgttccctttgccctccaaaaagctgccttggcctctctgggaaccagggtaaccaagaaaacgacaaagacctgtcgggctcataaagccttaggaaaaggtaacggcacgacaatgcctgccagtatcacagaagctggcaagactgtagcctaagcccagctcagagtaggtattatgacacagtcatttacaagataaaaactccttctcaaacatgcacactttcataacatcctcttcacagtagcccttactaccatcatattccacatccaatgactaaaaagcaggagcattttttggaagggatgagaagaaagtatgtaaatgggactttgcttactttccagaagtgctcatcttttattttttctgggcttcgagcatctttttatacaacataattctttagatattgaaaaagtatccaggtaggttcagatgctgtgttatccattacttggaacaacagtcttctttgcaattatcattattgacatgtcaaagtgactaccaatggtgccaaaatcctatgtattaaggaggaaagaaaatgaaccaatatgatagactgagtacacagatttacctcccaatatcccaaatcccttgaagttacagaaaaaaaaaatgctttgtaaacatgattccttcattcatctgacaaatatctaaggctctcctactatgctgtaggtgctacggtggtgaacaaaatatgtggtgaacatgaggtcactgctaaagtggtgaataaaatacgtggtgaacatgaggtcactgatctcatggaacttacattaaagtcaagccgggggagaagagaaaaaaatacaataagcaagcaaacaaataggtcagtgagataattgtggatagtgatatattcaacaaaataattaaaccagaatactatgattgtgagtgactggtagaagagggttgggggactatttcatatgtagcagccagggaaatccttttagaggagataatgtgtgagcaaagacctgaatgatccaaagatccagatctgcaaaaatctctggggtagaatattcccagtagagcacatagcgagtgcaaaggcctagagcagatgtgagcttggcccacatgaagaacagtaacccatccttaaaagcaaagtgatatccatggaccaggaattttgaagaatgtctaggatagaaaaaacaaagggagttggattgccagggaggcaaatgcaaattttcctaagacaaatctgaactaaggtaattcccaagtggtactgtctgtagtgggatgctagacaaaggtcacaggacaaacaaagggcccgtgtggaaagattatcagccaaggaagcacagagtttcctagtatagctcaattcacatctttcaagtgcctcaccttttaagtccccttgaagaaatggcatattttatacattaaggccctttccatctctccctctcaaaaaaaagggagcactgtcatgagatcattccagacaaactctaacattcccttccagatctaaatatgtaattacctaaatttagatattttatttgctgttattttataatattacctaacacttggaaattgtatggtaatattataaaataacagcaaataaaatatctaaatttaggtaagttgtttttctctcacaaataaagaaacaattgaatttcatgtagaaataattgactagctttactttaaaacacacacaaaaaaatattttgtaaatatttatgaacccaccaaatattctaagggagaaaattcaaatttagagattttgattctacatattattattttcaaaaccacttcttctgacctggttagacactgggttgcagaaagcagatcagttctgggcctggtcatgccaccaaacagctttgtgactggggtcaatccacgacatgtctttacctcaaattccgcagcagaaaatagcaaaaataacacgtcctacttacctcaaaggttgacttttggagtcctataaagttaaatattgggaagtgatttttttttttttttacaaataatgtgttattgagctgattatatagccctctcagccactcattcattaaaatgtttaaaattcttactatacgcaaaatcctgaattagatattacagggtttaaggaaaatagcaaacagagcccctaaactccttataatatagagaaataagtagtcaccttttctgagtactgaaacatggatgcatggaaatcatctctgcatttctacctgagaatgatggctgttatttaatgtgtttaaggtattttgattttgtaaaattctgattttagaatacaccccccttggggagaatcttctaagcgagaagttataaagagcccgtgggacatggtctgatctggtagagagagcctgaggaagacttgctcattccgagatttcatgttgatcagttaccttggtctgaaaatagcaaagtgctagaaatacctttcagagagagaagttacatgtccactgaggagggaaaacatgggaaaaggaagatgccaggtttctctatgagctctgtaatggggacagctaatataaattgtggattggtagggaagtaagaaaaaggaaaacacatgcaggttagagtgttttcaaagaaaaatctccacaagtcacagtgactgaataccatgtgtaatgaaagacagggactgtcaatgctgatggagtttcaagcctgcctaattggggaaatgctggtgttattgatgaaggaaaggtacagcatgctgagcccagtgtagatggaaggaaaaggatgagctcagcttggcaagtgatcatatgaggggagaaaatagaacagccaagtggggatcttcagcaggaattaaagacagcacagctggaaattaggtgagagaacatggctgatggtatagatttgggcattatttttatagatgttatccaagaagcagacagacatttgtagcaagagaaagaggccagaaaccaggctgaactttcagaaatgctcagggttcagagttaggggacagaaagaagaaatgccaggatttgaggcaaagatcaagcaaggaagtaaaatgaataagcttggaaataggtagaggggtttcaagacagataatcagtatattcttgagcttcttattcaataaatgtgtccgtaaaggaaaagaaataagatggtagctcaggagggtaccaagatcatgctaagattttctttcaaggtgaaggaaaaacatacagattggaagtctacacagggaaagagtttgaagctaccggagagaaggaataaataaagcaacatcattctcagataggatttagctttagagaaaaataaagatacagattcctttgagctgaagggaagggcaacaggggtaaacattaaaaacggaatagagaatcatttatcactgagtgaggatatggacttcagaagaattaagagactctgaaatggctattagtagacatgtgttaaagcatgaggaaaaaacttgcagctaagtatttcagtgctgaactggggagcaatcgcaaaataaatatttgctgagttccttctatgtgctaggcacatgcatttgaagccgaatacatcttttactagcaacactctgtgaccagggctcaggggtgcagagagtcaaggagaggactacttagtatggaagtggggacagcactgaaggaagtgctggccaggagtccagagtccagagccactcacaaaatgctattcaagattctaataatttttctagttttgttttgacaaaacttaccacttttggcatccctcatttacatctagatcttagatatcattgaacccaatgtttcttaaagagggcttctgtgagattcagcaatgagaccgaacagctccacatttattgattttatatattttggtctttttaatatgtctatgccggcaagatttcttttggttagaagagaataccaaatgatatgttttggatatgtccccactcaaatttcatcttgaattgtgactcccacaattcccatgtgttgtgggaggaacctggtgggaggtgattaaattgtgggagcaggtctttcctgtgctgttctcctgatagtaaatgagtcttacgagatctgatggttttaaaaacaggagtttcccagcacaagctctctttttgcctgctgccatccatgtaagagatgacttgctcctccttgccttctgccatgattgtgaggcttccccagccaagtggaactgtaagtccattaaacctgtttcttttgtaaattgcccagtctcgggtatgtctttatcagcagcgtgaaaacggactacataccaacctaaactaacttaagttaaagaggaagtaaatggatcaaacgactaatagcaggaagaggaaggtatagcagggctcttgggataaaggaagccaggaataccactgagattctctccatctttccacactgtatctagccatgtataagttttacttccttctatttcagaaggacttcttcctcataataaagaacatggcctcagtcagttccaaagtctcttataatcactctctctctctgatccaaggtcaaaaatcttggaggaacagcttgattgtgattactcttgaaattataggcatgagcacaaggactatggccagcctggattgttcagtgtccagccctggctaatcaataagaaactgtggatattttagaaattgtcagctattgctacaaagagaataaaataccaaagaatccaacttaacttacaagggatgtgaaggaccgcttcaaagagaactacaaaccactgctcaatgaaataaaagaagacacaaacaaatggaagaatattccatgcccatggataggaagaatcaatatcatgaaaatggccatactgcccaaggtaatttatagaatcaatgccatccccatcaagctaccaatgactttcttcacagaattgtaaaaaagtactttaaggttcatatggaaccaaaaaagagcctgcatagccaagacaatcctaagcaaaaagaacaaagctggaggcatcatgctacctgacttcaaactatactacaaggttacagtagccaaaacagcatggtactggtaccaaaacagacatatagaccaatggaacagaacagaggcctcagaaataacaccacacatctacaaccatctgatctttggcaaacctaacaaaaacaagaaatggggaaaggattccctatttaataaatggtgctgggaaaactggctagccatatgtagaaagctgaaactggatcccttcgttacaccttacacaaaaattaattcaagaaggattaaagacttaaatattagacctaaaattacaaaaaccctggaagaaaatctagacgataccattcaggacagacgcatgggcaaagtcttcatgactaaatcaccaaaagcaatggcaacaaaagccaaaattgacaaatgggatctaattaaactaaagagtttctgcacagcaaaagaaactatcatcagagtgaacgggcaacctacagaatgggagaatatttttgcaatctatccatctgacaaagggctaatatccagaatctacaaagaacttaaacaaatttacaagaaaaaaacaaacgaccccatcaaaaagtgggcaaagtatatgaacagacacttctcaaaagaagacatttatgcgccaacagacacatgaaaaaatgctcatcatcactggtcatcagagaaatgcaaatcaaaaccacaatgagataccatctcacaccagttagaatggcgatcattaaaaagttgggaaacaacagatgctggagaggatgtggagaaataggaacgcttttacactgttggtgggagtgtaaattagttcaaccattgtgaaagacagtgtggcaattcctcaaggatctagaaccagaaataccatttgacccagcgatcccattactgggtatatacccaaaggattatagatcttatcttgctactataaagacatatgcacacgtatatttattgtgtcagtattcacaatagcagacttggagccaacccaaatgtccatccatgatggaccagataaagaaaatgtggcacatatacaccatggaatactatgcagccataaaaaaggacgagttcatgtcctttgcagggacatggatgaagctggaaaccatcattctcagcaaactatcacaaggacagaaaaccaaacaccgcatgttctcactcatgggtgagaagtgaacaatgagaatacttggacacaggaaggggaacatcacacatccgggcctgtcagggagtagggggctgggggagggatagcattaggagaaatacctaatataaatgactagttgatgggtgcagcaaaccaacatagcacatttatacctatgtaacaaacctgcatgttgtgcacatgtaccctagaacttaaagtataataataattaaaaaaaaagaaattgtcagctaaagtgaggaaagaggaatagttcccagaaagagggaaaagaatttgtattattaggatgaataagtaaatgttaatagatatgtctgtgatctttttggcaattttattaaggctcactagatacggctttctttgtatttatccagaatattcataagttgttgaatggataaataaattatatttatgtatgcagtggaatactattcagcaatgaaaatgaatgaactacagttacacgcagcatggatgaatctcacaaacataatgttacgtaaaagaagacttaatagcaaaataacatgtactacagttttctatttattagaaagttagtctgtgatgttagaggtcagaagagctccatacacagctaggatggagggcaccaggaggctagtattgttctattcctagatccaggtggtgtcacatggatatgtttaccttgtagtagttcattaaaccatatgcttataatttgtgtgcttatacagtatgttatacttaaataaaaactttttctacaaaaatgcttgttagcaatgttggggggtgggaaagaaatccgctcaatttagcttgaataaagattgccactattaagaatcattgatgtaattctgtcccctattcttctgcccacagttcaacatttttcctactcctcagccttatacttggttgactttctgctgtagagagtcagactgggaaaaaaaaagacacagacatatgaaatgcctgttcagagataatcagtaacagattctgaaataaaggctgtctttgacttccaaaccaaaatctagaacattccaccaatctaccataatatacacaattctactagttctgttaccaaagattgcattcatttattcactctgcatttattataggacagccagtcagggagttctcattctaccggcctgcagcccagggagtgctggaatggaaatatgaatagagtgctgtataacacatgcaggaagccattttatacctggtggataagggttgtcttcaaggaggtatttatatgcgtatgaaatatacacatacaaatgagaaacatatgttcagtagttaggtgggtgaactggtgcaatactgcccagattaaaactttggccacatcacttacctgttaggcagtatgatctgcttgaccttagcacagcctttttgtgcttccgtttcctcatttgtaaactggggacaaattatggaagttaatacatgtaaatggttaggaaggtgctatacacatacaagagtactaagggtgatagagggctcagtgggagaaggctggccttagtggggaggggtattttatcatggacattgtttataactgccaacatatggtagtgagaaaaagtagactccttttttggttttattattgttttttaaaactctatagacaatgtaaccccttattgccttcatctgaaggaaatattcccacctccccaccctccaccccctgtactgccaggtacacagaatgtaccatataagtgcttgctagtatcattgttattatttaggtatggaaggccacgtaggaattcccagaagaactgggagaagggaggtggaaaggaccttcctgacggtggcatcaacacatgcaaagacaattttataaaaatactatgttcattcaaactatcagttaatatccaagccaggaagggaactgggctttcctgagaacggtagtgccatcattgggaagaaaaacgaatcattatgagaatttcctttgatagtcatcactgaagtccactcacaatttcacgtgagattcttctgcttgcaattaaacatttttcccattcctcagcattacacttgtttgtctttctgctctagagggtcaaggatggcttgaagatatccatccttgagagcgcaattctgccaatgagctatttctgtgcagtgcttcttactccgccaatgtgagcacctactttaataaaaagaataatcaactgctttgtggtttaaaggattcttaatgccaagacttcagagttcttctctataagtgcaattaagtaaagggagggacaaagcccagttaaataattcataaaagcataactacaggaaaaaatgtttaacttatagtttttccattaaccagtgacttggctccaccaagttagaggattcctttacatcaaggacccagcataccagaggtccccaaccctcaggctatgggctgttatcaggtctgtggcctattaggaaccaggccgcacaacaggaggtgagtggcgagcaagcattactgcctgagctctgcctcctctcagactggcagcggcatcagattctcacaggagcccaaaccctactgtgaactatgcatgtgaggaatctaggttgcatgctccttatgagaatctaatgcctgattatctgaggtggaacagtttcatcctgaaacaatcccccaaccccagtccttggaataatggtcttccacaaaaccagtccgtggtaccaaaaaggctggagacaactgatgcataccattgtatgagtccacatgaaaggcaagacttgtcttactggagtcccaggaggactaaatgaaaggattataagagaatgacagacattagcacatcacgtagatgacttaggctcccccgtcccccacacacaaaacaaagcaaaacaaaacaaaacctctatttcagctaaaattaaaaataagcaatatatttaatcaatttacactagcaagtaaatatcacttgtaagtgtaatatgactcctccttaggaggagcaccaaagtagaaagccaaacaaaacagactaaatacaatgagattatctagagccaaactccagaaatgttcccagtggagactgtggaatagacaaaataaattttaatccatgaattgtctttatgaatcgacaaagctcagaacattatgtagaagaatttgtgaaaaataaaaaatattttttaaaacagtaaagtcccagtataaagtactccaatagacagtattctctagcctaggccgaatttcctatcccaacataatgcttagcagtacagcacctgcagccctccaccttggtttgcatcctggtcttgccactctcaagttatataaccttggacatgttagttaacctctaagagcttaaattaccttgtttataaaatgaggttaatactgctacctatcacatggaggtttactaaaattaaatgaagttttggcagaaagcacttggaacagtgcctaaaacatagtaagaattctattaatgttagctacctttttttaaactcattaactattacttcagcacaggtgcatggccagtgtgcttgggcaggcaaaaccttagtgaaattttaaaaacaaaatgtaatttgtgctgtcagaacgcccaaacaggatctcatgaatccttgtgatgctcatgagaacaaaacaccttacggtgcagtcagatcagaaacatcaggctctaagaaaactcaggaaatggaaatctcccacgcacccttgaatgccacatacccagacttacctcattaccttcttatccctctcccatcccgtttcccatgccctggtctttctcctcctacttctcttattgtctatatcttaggaaatagcatagtccccatccaggggcccagttgaaattctagctagtcagacccctacaagtcaactgacatttcattcctgccttaactccccatccctagaacctctaatacataccttggaaatagttcattttcatccactcctcttcaggcacactgctgctgccctgggctctgcctacactatttctcagctgagctgttgcaatagcctccttatgcacctctctgcttctatgcttgctccaggccaatcattctctataaaacccttggagaaaagtttcaaacttacaaaaccaatcatggcacttccccaataaaaatttttgtttcttttgagccacctcccttctcctctctctactttgaattccttccacaccactggccctattttatcctctggccacaaaaattcactgcaggtgcccaaatctcccacattccctcttcgctctgtgctctgggcacatgccctttcctcttcccagtaagaggaatacgagttgagaaaacaaagacagctatgaagaaataagaaggaacaaagaaagtctagcatcacagaacatagtaaataaagaaaaggttgttttaagaattggggaaggaaataaattgtgtcagaggcagaaacaaaaataagaactaaggatttggtcacaccgattactgcttttgttctctcgatttctctattcagaaatctccaactcaccctacaagtcccagtccaaatgttgccgcctctctggagccttccctgacttctgtaggctgccaacccagatgttctactttcccacatttatagcattatacacacagctccacaaaacaatgttctaaccatttttatactggcttccttgcaggaatatcctccagcactgagtctggatattgcagaccatgacaatgataatgacagcagtgcaataataataatagttgtttcttttgttgataatggcgactatttggtagactctaggcactttgctaaggcatttattgattgaattgcatagaattgctgtgtttattggccaaaagggtcatatattatgaccaggtcatacctggtaatttcaggtagttcagcctaaaacatgcactgttttcatcttcaccacaatttgaagaggcagatgtgttattatacccattctatgagaaacaaaattgaggttcagaggttttaagtaacttttcccaaggtgatataacagaaaagtgaagaagcccagaccctcatccaggactgcctgactctcagcactcctaaccagtattatattctgactcccagaattattagttaaattggttaaccaactaaagcaataatatgggggtctccaaagataatggttgcctagcataaagaggcaagttggtgttcacggagtctgggtaggacaaatcctgatgttcatgtgtgagttaaaacaggcttctctgcagcaagcgaaggctgttaaatattgaaatgagctaataaggaaggttatagactctccttcaagagaaggatttcttcccccaatggagaatagattctatctgtctgagatggcttaaatataatcctttgtgaaggtcaataaattggcttgccaagtcctttccaggtccctgatgatactcggatacactggctcaatgtggctcagtgcgtggcctgaaaatggagggtgctgaaccctgagccagaaataatctcttccttttttaaactcacttcgccctctgactcgtccttctttgtgacatacgtggtgaatttgtacgttgttctgatttctgctgaagaaaaatgcatctaaagcacaaagcacgtgtgcttcattttgacatctcccggagtgcccagcacagtgcttcatgctacatttttaaaatgtgatcaaatggtgcttctttttgtcttctgaaagaatcctatagtatcaactgaaaataaggctgttatttttgtctaaaatttattgtcaaaattaaactcacagcataagaacaaagctttcttaagtgtgcttttggtttaaagatgaaccagtactgtagtcaaaaagaaagagatctggctagattactaatagataatagcacatcccaatatctaagcaagtgtctaacaattcccaattacagtcactaccatctcaaaataattatagtggaaaagtctttttcataattgccattccataagaagcataactttttataatttttagtaaataagtacaaaaaattactctagatccttattctcaataaaaataacaataactacacttgtacagaacattaaagtaggaaataaaacaaaattccttcaaatggtttggctcatttgatccatataacagttcttaccatttatatcaccactccagaggatatttacaggaaacttggatcagagagatgaagaaaattgctatgagtcacaaagctagcaatagcagggtctagactaaaacccaggcattttcctggtttcaaatttcataatttttccactgcatccacatggccaatcttttttttttaatgcatttttacctcagcaatatagttaatcaagtttcagagaaagtgaccaatttgctgaaggaggcacattttattacttttggtaattgagcttgaacattaattactcacatcttataaaaaaaaatacctgtagttaacagttattgagcatttgcttcttgccactgaactaagtgctttacatggagtatcgaattcattccttaaaagtctggaaggttggtcttccccttttccaagtgtggaaactgcagctggcagagattaagtaacttttccaagttcacatggttgggaaagttaagtgggagagcagtggtctgaacccctatcagcggaacccagaatccaggctcttaaccaccatgttcatctgctatgctactggttctcagggctttgtcctgggtagtcagcatcaacatcactggggacttgtaagaaatataaattatctggccacaccccagacccactgaatcaaaagctccaagagggagctccagaaatctatgttttaagccctctacgtgctcccgaggcacactaaaatttgagaaacactgtctaggctgaaataagagtagacagtagccatttacaaggattcattatacattctttgctatcagggaatgcaaaaaggaagtgagaagttagggacaactgacaacgttgttgaaaatcttcagaggatattaaagccaaaaagggaaaaaataaccttaactagtgcatgcagaagctgaaaacagcaatgatgaccaattaatcaggcaatatgttacactgtaatcaaagaccagaaaactccggaaggactaaatgacatggagtttattactgcatggtaaatgaccattaataaaacatggctgttaaaagaactaaggagatgaataactgtagaaagaaatgtcagctgtagaaggaacaacttatggtcttaatcacttggagaaattacaggtatggacacagaataaaaagaaaagaatggaaattcactgtgctataagaaaaacatggcatgaacctgatagctattttaatacaaaatcaaggtagttacagagacactacacactggttaatgaaagtttgacctggctaacatttcaactgccaaaaataatgaatttacataattttaatagtacattgtttggcaaacattcccatctctagtatggaaacaagaaactctcttggagttgctaaaatgtaaagattacttgactgggaatttatcttgcacccttggttattccttggattcatctggctgaagacctccactgacctgtaatttttttttaaaggactaactgcacatgagtgcttctgaagagaaaaccaagagcagcttccaagggcatatccttccaatatcattcattatatctctttagaggactgctttttcaaagtacaatgtggagggactgaaaagtgacatcaagcaaaaaaagcatctaataatacctgcaagggagtataaaaagaaaaaggattccaacagagataccaaaagtcattatacaacataactgtgagttatttttttttcatttgatggctactgatttgaggtctttaaaaaaaaaaaaaaaaaaacttcagttgtttaagaggaagcaaatcaaagagaatgcattcattgaagctgtcaaaggaaatattaaccagtaaaattgtctaaatgagatttattaggaaaaagtatgctcttatctaactcagtgttttgtaacaattttccattcccatattttaaaaaattaactaaaatgtattgactgcttactacatgccaggaatcatttaagcttattatgtgaattatccttggtaattttcatagcaactctattacatataactgtttgtgtcctccctccaattcacactttacagataaaaaagttgaaggcagatagctaaagttacaggtggtatctgttctccaaggacagccccaaataattccatctcttcctatatatacaagctgctccagccacaataaggtggaactcacattcctccgccttgaacctgtgctggatctgagactgatttgaccaatagaatgcagagaaaaaaaatattataaatcttccaagacaggaattaagaaggcctggcagcttctacaacttgaaatctagccaccatgttgtaaggaagcccaagaagccatgtggagaggctcatgtggagaataatcaaggcccctggctgataatttccactgagctatcagccaacagccagcaccaacttgccagttatgtgagtgaactatcccccagccccagttaaaacactctagctgatggtgcatggaacatagataagctgtctgtctccaccaagctctacccaaatgacaaaaatcattgttttaaggcaccaagatttgaagtgatttattgcacatcagtagataactaaaactttgaactacccaaagttatagagagagatgactcaacattaggtaggccatagatttcactctcaaatatattaacaaactgcacatgaggatgtacaatggaacaattccaatcagaggcaagggtgaataaagatgttcatatatggacattttattcaacaagcattcattgagaaccactgaggaagcaggcactgagcccaaatgtgctggatataaaggtaaatagtcagaaccctgagctcaaggaattctccatgcaaggccactaagaaaaaattacaataccagaggaaatgaacaaattggtgtagactaacaggtagattcttgagatcacttggcgacctaagtaaatactgttgattttcttatatctaccctaaggcaaggaattataggggaaaaacttagaatgagttgagagtaggggtatgaagaaaagttgcacttagagaaacaaagtaaacttgcatggtacaacaacaacaaccacaaaaacactatatatacacacacgcataaatatacacatacacatataaaatggaggaggaaaggcaaaatgtgataaatggttattaggagaaggaaaattttgtgtgtgtggacaagcgcgcgcgcgcacacacacacacacacacacacacacacacacacacacacacacacacactactcctatggcacggtccataaaaacagtttgatcaaagtgaaggtcaaacaaagaggtttttttaaatgaattctagactggttgtggtggctcatgcctataataaccagcactttgggaggccaaggcagaaggctcacttgaagccaggggttcaagactagcatggacaaaatacgggacctcatctccacaaaacaaaacaaaacaaaacaaaagaccaaaagtattagctgtgcatggtggtatgcacctgtagaaccagctactcaggaggctgaagtgggatgattgtatgagcccaggaggtcgaggctgcagtgaactatgatcacaccactgcactccagcttgggagacagaataaaatcctgtctcaaaataaataaataaataaataactcttttttaaaaaacagggactaccatttccagacaagatgggagttattccatttccccctcttacagaagcagaaactcttcctcttacaactagaaaatcgtggccataacagcaccaacaagctgactcaatttctgaaagaggaggaaaagacagtctgcctagcaatctcaggacttaagaaaagacactgtagtaagtttccctccccttacttcccctagcccctcatatatcccagacgtggcactgcagaagcttccaacaagagaccgtcaacatgcacagaaaaagcctactctcctcagccaaaggactaggacagggtgtccaaccaacagaaatatttatggcaataccacctcactgcagccaaatcctaaagaaaaaactgcattcccccatcctgtggttttagtgaggctgagtacagcgctcatcttccacccacctataaggtttctctccttatagaaaccatcagtgaggctcatattccccacatgggtagtttcttgacccctaatagaggtctggaggcaagaggagcctcttgtccctaccaggtaacaaaaaaatttaaaggaactgtgagtccactttcccctggccctgtggcagtgaagcccagtggaaagctgaaacatccatgcccacccagcagtaataggaggtatggggctgggttagttggaactccttgtcctgccatcccctctttttattttatttattttttttttttttgagacggagtctcgctctgtcgcccaggctggagtgcagtggggcaatctcggctcactgcaagctccatctcccgggttcacgccattctcctgcctcagcctcccgagtagctgggactacaggcgcccgccaccatgcctggctaattttttgtgtgtaattttagtagagatgggatttcaccgtgttagccagaatgatttcgatctcctgacctcgtgatccacccgcctcagcctcccaaagtgctgggattacaggcgtgagccaccacgcccggcccatcccctctttttgtgttaaggacacccagccaggagctgggcttccgtcccatcctgcagcaacaaagcaatgtgaatcagtcctctgctttcctccctcgctgatgatgtcagggcacagtcacagtcattagctggtcttacacgcccactcggaggcaaagaaggaatacgaattaataccccactttctctagaaacatgtcagtggggctaaggaaagagctaaatttttaacccaccaacctgcagtaaggcagtgtgaaccagcacttcacttctgctactagcagagcccattgggaagctggacacatactcatacccagccctcaggctacacctcaatagggggactatgtataacactaaaaaaaaaaaaaaaaaaaaaaaaaaaagattaaatagaatccagagtgccacaatataacatccaaaatgtccatgatacaatagaaaatcacaatttaaatagaaaagatatccacagccatcaacaccaagattaatcagatatcgaattatctgacaaagatgttaaagtaaccatcataaaaatgcttccatgagcaatgatgaattctcttgaaacaaatgaaaaaaaacaattatcaacaacacaatctcaacttgttaggtttatataactagcaactatggctgggacatctgttctttctcaaaatcagaagttgcttattctataacgataaggataatttgtccacctgaaaataattacagtgctgactctcattttccaagaacctaagaaattattacgcaatttaatcttctaaagaccccacagccaacatgatgaccagaagttaacttgattgtctgacattagttgtttagccatttcccatcaatttaaccctgtttattcatttgcctagcatctattttgaagcttcaaacctctcacaaaaatcctctagcacatggtaaatggaagaaacagtgagtattttgggcttgacactgacttttatttatccttgacaatgataaaaatatacctcttttcttctgaaaaaaaaaaattgtcaaatgtttgctgtgggataagaccttaaagagagaaatgcttccaatggtctttcttcattgttttaggtttgtatgatatcaatcaagaggtgccccaaagtgaacctttgcttaatacctgccataattctaaaatctatacatacagtctttgtgcattaaacacctttctgtcttgaggcattttctctcgaagtgaaaacactgtgaggaattccatctcagggatgagtgccctgttaggattcaaaacacctggctccatctgacttcactgctcactgcccagtgtgacttggggcaagtctttaaacctctctaacctcgtcttactatttgtacagtgtagataacccacctatctggtccacttggcagagttagcaagaaaaataaaatgctgcctatgtggatgatttttgtaatgtaaggagctatacaaatacaagtgattcgtattactttttggtagaaattagtagaattgtatagaaacttgttgttacgtcaaaataaactcttcagtaattcaaacatacaaataggattttaggggcatctggggagctagtaggtatatttaaaaggaattagagagactatgagagggaagatgggaggttgccataaacaggttttgcctgcacctcagatgtccctgagatacttaattggaatgggtggtccttcaaacaggtacagtggaggatatgctcaggaccaagacaaggctggaagctaaatatgctgtttctggcatgacacctggatccaagggggtgggcaacctgaaagtgccatcaattatgtacacagtatttccttgcaaggaaaaatagaaatagtctggagttagtctttcaccaagattggcgggtaggaggcattaagatagtcaagaagaccaagctaatggataaatactacgggcttcagtgcctgccatcatcaacctgcttccttaactaaaagttatgtattccggaaaataatgcgaaaatcttgttgctattgaagagcagttaaaggcagataaaatctcaacgctgtaatgtgcattcagttgtttcaactccagggacatacaggtgttaaggtcaaatctcagggaagccaagtgcccagcactgtttctagccagttgtcctctccccagtcaacttcgagtctctgtagagaatcatagttttctttcagaaactgctgtgcctacagtcactgaacaatcaagcatttgtgttgttactcctcccagggatgtcaaattagaaaacagcatcccatctctgggtgatctgtgttgctgtgaagttgcaaatgaatttgttgtcttgctttaaaaaaaaaaaagtgctcacatgtatacctatgtaaccaacctgcacattctgcacatgtaccccagaacttaaagtaaaataaaaaaaatacaaataaaaaagtggtaactcatgtaaaaaaaagctcaaaaattatagaccttcctcagttaatactattcctggagtgtgttaaacacttttccccagttcatttttgttaaaaagctattcccttttcttccaccccaacccctggaagactgcagaagttacaggaaaaagtactggaatgaatgtccaaaggctagagtctaattttattccattactaacttactgagtgactgaccttgaacatgtctcaacctctttagaatattgatctaaatattatacgtatttactgtctgtggttggctgacttttttctaatttgctttactcttttgttggcatctgcttctatatgaaaaaaaattactggtcttggcaaccatttcctgaaatagagtttaattttcttacagccaaactatatgtaacatcactcagagtagtgactcgcactacagtttcacaagtgtgtatatgtgtggattctgataattttgtactctgtaggggaggaaaagaaatacaactcaagttgagaagaaaaattatcctcaaaaatgtttcgttatcactgtttttagagacttttgttaaggttagagtttgagatagcaccaaggtggtaaaatgtgcagagaacaatgataaagtctcaagtttagcagtcagaaagacctgggttgaatctttgtctctgctacccactagctatgtgatttttacacaactggtaagttggtataatatctagcttgcaaattagattttctatggcaaatataatgcaaataaagtccttacacatataaggaactcaataaatggtgcttttataatgatgatggttgtgatttctgggggcagaaggagaacacagaaggaggagaacaatactttgcttctgtagcagcaaagtcatcctttgtcagaaaagggctttcagttcggttctgtagagccttctaagggggactgtaagctacaactcatcttaagaatttcaacccatgtctcctgttttctttgcaatagaccaaagcataccctctaagattccaaagtgtcccccatgagcttcccctgaggatatttcctcacgagaagtaagaaaaggcccatcctccaatttctgggacctaagatgatgatcatagcaataataataataaaataatgcttaccacttattgggttctttctatagaggccaagcactttactaagtattttacatatattatcttatttaatcttctcatcaattttgtgcataggtattatcaccccattgagagataaataagaatctcagggctcaaagaggttaataactgaaagtgccaagattcatgctccactttcttattcactactttattctgcattatgtgctacatgaaaatacttagccttgttaatacttaacccaggctccctggctgctaggattttatgctaaattgtataattagaatttcaaatttagggcagtgactgagaattattatacctcaatatatgaccttacaaaagtatttactataataaatttgtctgcactatcttttggggaagtctacagaattctaaagcagagtcacacacttaaacagaaaagaaatagaaatgagactatacttttttaaaaggtgctcaaattaataattaatcttttaaatttttaattgacatataattgtacatatttatgtggtacagagacacatttctatgcatgtatacaatgtgtaatgataaaatcagtgtaactggcatatctaccacctcaaacatttatcatttttttgtgtcgggaaatttcagaatcctctcttacagctatttgcaaatatacaataaattattgtttactatagttgctctaagtgctagagaaaccagaacttattccttcaatctagctgtagtttgatttgccaatatatgtgtaaatgctatgtgccaggcccagttataagcatcttatacctattatttaattcttaccacaataaaaaattctatgtgtagatgctattaaaattcccattttacagatgagagaacaaaggcacaaaaattataaacaactatttttgaaagagttgattaaacacccaggacaagaaaaagtctttaacaagcaaagaacacagatgcaaatgaaaaaatcaatcttatttataaagaaaaacaataaaaacaacataggagttgttcctcgagattgaaggatattagtgatcagtttacaaataaattgggtttgcatatcttagatatgttggattttacactactgagtcagagaacactctcattttgctcagatttagtcctcagagatccaaaataacacccaaattgctacttcacacatattatcaacatttggtcttagatctctccaataacttttctgtatttctggaattgtttcaggagatccatcgcctaggtttcataacatatttaattagttattcgttcttattttgttacaaaactcaacaaatgggttgtggcatcttcatttatagaatgaacactttcactttatgaaattggtgctacacactaagtcatctgactattccatggtcaaccttcctcttcattttaaataaatcgtttccagcttgtactgcttttaatgagattaaatgaatagagacctagcctccttttattataaggagttgatcgtttcaaatatccccaaagtcatcttgaatctgtgagatccactgcctgccttttgtaatacttaactggaatgctttattccaagaataaagtggtgctcaaagtcagcatttaaaaatgttatcaaacagatttttttaatgttgctaattgcccttctcctttctccaagaaactgtgctagccttaacatacattgccacatatataaatactaaatgcttattaaaagacaggcattgtgctaggtgctggagatacaaagatgtttaagatacacccacaaagaactgaacaagacagggcaccaaagccactcagctgactgtcatcttgaaattatggattctgtgtcctaatttatcaccctcattctgttctagcctttctgatgcttggcattaattttccttttctgagcactgaccccacctctcctattctattcctccactgttgaaccggaacaaaggtcacttgaaagcgaagcaaaactcagctgttaccaaaggcgcaaagatcaaagttggcagctacgctaaagttcaggattcagagacttcctctttaagatcaaaattccagatgatccaaatataggcaaatgagccccagtagaacactcagctttctgtgctgaatccaggaaagaagcagaaatcaccatagaagcaactcagtttcactctttgcaaccccgtgggctctatgctaattgcctaccccaagagtgagatcgcatttcaaaatatggtcaaacgcaaaacagccaagtcaatcaagcattaagtattcaagcacaattatccgaacacatgcccaaggaccagcagtgaagcagcttaatttgggagcggctccgtaatcatctctccgggcagctgagattttaacctctcccctcgggcctcctgttcggggcactaggctagctctctctgtgtgagagatcacaacgggagccgctgccccccagttgtgaggcttcatttaaattcatgctaagggtaagggagggggagggggcagaaggtctgcagaagcccccattgttggggagagacgtgtgggagcagatggtctggctggtcactcagtctggctgtcagatgctctctgtcaagttccctggggactgcagggttttctttccactctccgctctggtcatatgtgtttgctcagcgtgagcgaggggtctttttctttatcacccctcagacttccagggggctgagttgccttctccgtcccccactccttccctctgctttctctgctttttctggaccagctagtgccgcgcctccaagggcccgctcgctgcagagaaaagcaagcgatttcctttgtctctaattgatgctgcgctctcatccagcagcttctgactggcatgctcactcggttatttaacaaattactccacagccctcattagaactattgacatgtacagctaaccaacccctacagttagggacgatgtggtaaccgacttccatcatcttcgtggctccttttacttctgtcctgcaatgggataagcagatagaccttcagaggtttagtgggccttaatactcaccttttatattatgtcagggtctaaaaaaaataaacagataaaacatgggttacagatgcgactcttatttgcatcagtaagggacaaacacggagtcagcttttctacatataactctgtctctaaagcattagctgttgaacataaatcttggcctcaaaacctgctcccttttaagattccacacagcttgtgccaaggcagctattccttgcagttctcagttaagattttccccagctcaggaggctgttaaattttagtttttagaccatactggcagctcaggactcactaatgatgcctctgtcagctggaggaagtcaatgtcagcccagagaggatagtgtctgagattgggtggcaaagtgaaagtgagaaatatcatttgatcccctcatctggctgggattaatgttttcctttcataagttatcctctggaaataaacgtttgagtgtttccatttacactcatcaacagaattttgttttcgtgtttatctccctttctccccaaaattatagaaacttgaaagcagagattgtagtagtcgtatttattggttcaggatacagtgttatctcttcagagtagctcaataaatgttaaataaacaaatgacagaaattaacaaatactagaaattaacaaaatggaatataagaaaatgtaaaagaagactagctctaaactaaatgtgaaacattttttccatacccccactattctagatattcctgtatgctacagcaaaaaccataccattttactgtgaagtaaaatggctgtgaagaattaaacagaaaacctgactcactaaaaacttatagtctaaaagatcaaaaactctaactgcccaagtactaatgtcaggtgaagaccagcccacaagctagcaacttggacaagcagttttgcaagaagtgcaattgacacatctgtgagggatgggacaggagcttaccaaggcctgtaaacctcacccagttatttgcatgagccctgagtagacaggggttacatgcaaaagcagaaggaatggattaagtgcagggctgctttagtgcccaagatacaaagtgtgacacggagagtgggggctgtcttcccctgagtagcactgctgcaggagcttgagcatttacagctttcagaacctcaggggatggcatctttagcacagacatcaagcttcttcattgaatacttgttgcagtaagataccaagtagcttaccaggacatcattgtgggtggaggggctgaagaaaaaagaaaaggaggaaatggacacaacccattgtagtacagaacactgtgcaaacacccctaaagaaagtcaaaaattgaaaacttaaggaggcctgcctatataccctactttagcagataaaggtgaaagccaggacatattgtttatgcacacttacatacatacttttctttttacggcatgttagcttttcttttcatgtagacataagtaccagaaaacccatcttgcacatataacaatacaccctccaatttgaaatcatagaacactctttaggagtgggtatctctatagtttgtgttctataattttctaagaaagacttctctaatccattcaatctactgttttttacctttacaaaagtctttttgttataacatgaaccaaagagaccactttaaaataagatgagcaaatgctctacagatagactgccaccatcccttctcatacccgttacagacattgctggtcactaaaggctttaattctagccttcaaattctgctaaagcacagtataccagcagcttttaccaatcaatctgtgctggtatttgatattgctcctatttgtcaccttctttaaagataataatcacatattgcaaatattaaagcacaggaagtgagcttcattgctcaagaggcagtgagaagactatgacacaacttttactatcaaaagggcatgtccaccattgtcaggaagtgctcctggtttccacaagaagacatggaatgtagcctgtgggatggggtagaggatcatgatgggaggacaagcttagaaaaatggtaacttgacatacttacatttgtgtgtgtctatggagatagtgggtatttggtagcattgaggaagctgaggagtcctaggaagattttcagggaggtagcttctcaggcttggcaggctacaggataggaataggaagttgtttctccttggccacatcttcctagaagtgataagggaaagccttggatctcatttcctttttcttggacaggaccttcatattagcatacaggccccttaggtggtatgttaatacataagaaagtccatgacagaaactaacaaaaaacagtcacaacacagagtgccattggccaggagcctttgctgcacactgtcaagaataagaaatttgaagagcaggtaggttttgttttgtggttcaggtttcagctatcatttgagtgctatgtgctttgtatatattaaccacctcacttgatccccacaactgccctgtgaattatccccatttaaaaataactaagacccaggcggggtacagtagctcaagcctgtaatcccagcactttgggaggccgaggcgggtggattacgaggtcatgagatggagaccatcctggctaacacggtgaaaccccgtctctactaaaaatataaaaaattagccgggtgtggtggtgggcacctgtagtcccagctactcgggaggctgaggcaggaaaatggcgggaacctcagaggcagagcttgcagtgatccgagtttgtgccactgcactccagcctgggcgacagagtgagactccatctcgaaataaataaataaataaataaataaataaataaataaaaattaataaaataaaataactaagacccaatgaggttaaagtcatagagcccgaagtggccaaatcagtattcagattagaacgggtttgtggcaacaaagccagggttctttcaccacacactgtaaacccatctcaggggtgaataacctacacacctagaatatctttaaggcccatccatgcttcttccttctctctctctctctgacatgagctttacagggacttctttttcctggccaactctgtttcatgtgccacatctgggtctgagaatggaacaacaagagaaggacagtctctatggcttaactttccaacagtagaaaagaattgaaggcacccttctctgaagtttcactccccttctcttgtccagtgaatatctaaccaggctgttaatagcctcatttgtgggtgtctatgtttgttttacaccaaaattacatatgattacattaaaattatgaatattcctgattggccactcattgatggtagtatgagacagtgaaatggaaataaaattattctgagatttcagctcttcaacaaatgtacactgacataatgttaatatttaacagctggtatgaatcaggtatcaaccagagagagtgtacaggccctgggggctgcccagctgtgccagacattaggaacctcttaattgctgaaatacagagaaatgtggaaagatggtagagtacaatgagaagacccaaaggagcgacccagtagcaagaaagttttccaatagtttaataattggtagggtcatagaggtggtgcaacagtggaacatcagccctggagatgcttcctaaaacatgactcacggtaacacaatggaatgttttaacatgtcaagaaaattatgttgacaaaaaatggggttagccaccctgttaagccacctggcatagaacatggaggccaatgccaacagctgcactcatcttaatgctaatccaggagagactttggtccattcatcaggattcatcaatggtggagatgggcccagctggctctctaagcctatatccattaaagagttaagctacctaagtaatcccttcactctgcttccatatctattttaaaatttattttatttgaacttctgtgctgctttttctctgtgaaacagctaagatgaaaatatttttacacaatcatgttgagcatgttgagcaaacttggaggaagtagtagatgtctattacattgctgctttcagcacccttccctgatcagcttcaagtatgataattaacacagatattgggcaagagaacattcctaggaaaaagtttgatttcactatgcctagtatgtttaacttggaaagtcctgaaggaactgtttcagtgataccagccaggttttgcattaaacatgatagttatggggaaaaataaaagaaggagagtgaaattattttccaagtgctggtaacactgaaaatgtaaacagattcaaggagggtttggtaaatccagtgatgtaaaatctgaacagattagtgtcctctcaagtcctttgagacttgtgtgttagagattttcttcccaccaggctgatgctatgaaaagggattattaggcaagttgaaaaattacaacccatttgatgatatactatgggactgtgaaggttggtggcacaaaatgcctgataggaccaaccaaacgtcccatttcttaaaacctccaacctccacatgttctaaggatgaagggtttgaatagagggaatcagaggcttgagcaatcattggaagggctggggcagcaaggaacagacaagcatttgctgaagatctctgccacaacagtgagacttgtgattcccaagaagctgctgcaaatgtcaagaacctccaggaagctccctctccctatctcagccagaacatgcaactaaagattttttaaaagccgcattgtctacctccactgcctggatcacaaagcaggtaattcacaggagcttgctataagcttctgcaaacctcctctgtcaccggttcacaaatctgcatacactgcctctggagtataatggcctctttttctgttcaccttctaaatctgacatgattggctgtcatgggcagaccctaacttggaaccatgtggggagggggatcctggaagacatgtctctagcttctcctctataaaagcttagatgcagatgaaggtcatttgaagctgataacagatgactcagcacaacacgaagaggcccaggcttgcgaatgaatgagtaagtgaacctgaatccctgaacacttgaggtagccacattttcacacagccttttaaaaactagtcagaaacattctggtggccgagagacagaaccttatttggggacattgtaagggttagacctcagctgatccctaaaacttaatgtttctcagacttatgaaagaaaagaagaacctggaagaaataacgctctttgcaaaatactatgttctgccaaataccttaaaatatcagcatagtgaatttcatcatgtgaagcaggaacaattttactaggagaaaaactctgtatgtagaactgggagcccacatgtccacaaagaaacaagctgtcaaaccaagcatgatcaactgtttcagaatttttccattaatattcatttgctgcttgttcatttctttggtcgtctgctagtgcttgctaccagacaagtggtagcaggcatcaaagtcaaagaataaattttgggataaaacattgagaaaattatctcctctaatatgacaatgtttttctccctgcaaattttgaaaggattgccactacccttgactaatactagccatctcagcccaatattccactgggcagttttataaggtaacgaatttggatcaaacctggaagagtattaaaatatggccaggtgcagtggctcacgcctgtaatcgcagcactttgggaggccgaggtggtcggatcatgaggtcaagagatcaagaccatcctggcccacatggtgaaacccgtctctactaaaaatacaaaaattagctgggcgtggtggtgcacacctgtagtcccagctgctggggaggctgaggctggagaatcacttaaacccaggaggcagaggttgcactgagctgagatcatgccactgcactccagcctgacaacagacaaaattctgtctcaaaaaaaaaaaaaaaaaagaaagaaagaaagaaagaaaaaagaaaaaaagagtattaaaatattggcctaacaacattttaaaagataaagtaggccaggcatggtgactcacatgtgtaatcccagcactttgggaggctgaggcaggtggatcacaaggtcaggagatagagaccatcctggctaacacggtgaaaccccgtctctactaaaaatacaaaaaattagccgggcgtggtggcgggcgcctgtagtcccaactactcaggaggctgaggcaggagaatggagtgaacctgggaggcggagcttgcagtgagccgaggttgtgccactgcactccagcctgggtgacagagcgagactccgcctcaaaaaaaaaaaaaaaaaaaaaagataaagtaaatggtaataacttgatacccaataacctattcctactggaaacaaaccttaaagatgggaatctctaaaaatttttccaaacctgagattctttgaactgcacatctctaaaagttctttgccagaattttcttctgagtggctcaaaatcatggaaattttgcagaacttttcaacactatgttagaaatccaatgcaggaagtaaaaagggtcttctactggaaaaacaaaaaaaaaagtatagacattaaagctgaaagagtggctgggtgtggtggctcacgcctgtaatcccagcactttgggaggccgaggcgggcagatcacctgaggtcaggagtagagtattttcagtagagactaaaaataccaaaaattatccgggcatggtggtgtgtgcctgtaatcccagctacttgggaagctgaggcaggagaatctcttgaacccgggaggcagaggttgcagtgagttcagatcacgccactgcactccagcctggttgatagagcaagattctgtctgaaaaaaaacaaaaaaaaaaacaaaaaaaaaaacaaaaaaaaacgctgcaagactttgagtacatttgtggtgtgcacatgtacatgcatgcgcaagtgggtactaactaacatttttagcagttcaagggcatagtccagagttttgacgctgaagtatcatgtatgggcattaagagagaaatgaggtagaccccttctcctaaacctggaaaacaaagaatgggaccttgactcttcccagatgaatatcaaatatatttattttaaaatgtgtgtgatggactgtcttgctgtaactaaaaccggatgatgagaaaggacatcatgcagcctcataaaggaaactgtccagaaggcgggactctggattgtgtaacctggatcccacagcagggtcaaggtcagtggaattataaacaggctatacactaaaacttgaccgggccagcctggttcagtggatgacttctcattacccttagaataaaatctaagctccttactatggtttgtaagtcctaaaggactgggcctctgcccacctagtactctccttcctgttcaccaagttccaaccacactggcattcttatgttggctcaaatatacttaacttattccaacctcaggggctttacacctgctatttcctcaattcttcacttgcacacatcttttgaaacagaggtctttcctaaccaccctacctaaaagaacttccatcatcccaacccagccatggtctttcccatttccctcctttatgttcttcataggacatgctatcatctgaaatgaaaatataggcatactttttcaactacctctcctgctagaacataaaggccacgaaaatgaggatcttatctttcttaaccacaacaggaatgagttgaaagagttgtaccaccaagagagataactcttagagcacattctctactgtgtgttaatttattttttttgtcattcaaaaagcacttattaagcacctaccctatgccaggcaccattctaggtgctcaggataaagcaatgaacaaagtccctgtcctcctggagcttacattctagtatgcagagatagtcaataaacaaatataacaatatcaagtatgcttatgaagaaaaagaaagctggatgcaaaaaaatgatacataattggtatttcatgttttattatatatggggtattctgtaaaggcttctctgaggaagtgacacttaagtagagagctaaaagaagtgaagaagctaccatgtgagatcagataagagtaaatgttaccccacacagaggaaataggaagtgcaaaggccctgaggtgggtgtacggttggcaggctcagagaacagcaaggaggccagggtggctgaagtagagagcatgaaggggacagggatagaaaatgatgctggttcaagtgcaatgtctcatgtctgtaatcccaggattttgagaggccaaggcgggtggatcggttgagctcatgagtttgataccagcctgggtgacatggcaaaaccccatctctacaaaaaaaaaaaaaaaaaaaaaaaattacaaaaattagccaggtgtggtagcccacacctgtagtcccaactacttgaggagctgacgtgagaggactgtttgagcctgagagttagaggctgcagtgagctgtgtcacactactgcaatccagcctgggaaagaaagaaaataaagaaagacaaagaaagagaaagaaagaaagacagaaagacagaaaagacagaaagacagaaaagacagaaagaaaagaaagaaagaacgaaagaaagaaagaaagaaagaaagggaaaagaagaaggaaagaaagggacaagggagaaacaaaggaaaggaaagggaggaaggaagaaaggaaggaaggaaggaaagaaaagaaagagaaagaaaggaagaaagagaagtgtctgttcatatccttaacccacttgttgacgggattgtttgtttttttcttgtaagtttgttggagttcattgtagattctggatattagccctttgtcagatgagtagattgcaaaacttttctcccattctataggttgcctgttcactctgatggtagtttcttttgctgtgcagaagctctttagtttaattagatcccgtttgtcaattttggcttttgttgccattgcttttggtgttttagacatgaagtccttgcccatgcctgtgtcttgaatggtattgcctaggttttcttctagggtttttatggttttaggtctaacttgtaagtctttaatccaccttgaattaatttttgtataaggtgtaaggaagggatccagtttcagctttctacatacggctagccagttttcccagcaccatttattaagtagggaatcctttccccatttcttctttttgtcaggtttgtcaaagatcagatagttgtagatatgtggcattatttctgagggctctgttctgttccattggtctatatctctgttttggtaccagtaaagaagacatttatgcagccaaaagacacatgaaaaaacgctcaccatcactggccatcagagaaatgcaaatcaaaaccacaatgagataccatctcataccaattagaatagcgatcattaaaaagtcaggaaacaacaggtgctggagaggatgtggagaaataggaacagttttacactgttggtgggacggtaaactagttcaaccattgtggaagtcagtgtgctgattcctcagggatccaggactagaaataccatttgacccagccatcccattactgggtatatacccaaaggattataaatcatgctgctataaagacacatgcacacgtatgtttattgctgcactattcacaatagcaaagacttggaaccaacccaaatgtccaacaatgatagactggattaagaaaatgtggcacatatacaccatggaatactacacagctataaaaaatgatgagctcatgtcctttgtagggacatgaatgaagctggaaaccatcattctcagcaaactatcgcaaggacaaaaaaccaaacaccgcatgttctcactcataggtgggaattgaacaatgagaacagatggacacaggaaggggaacatcacacaccagggcctgttgtggggtagggggaggagggagggatagcattaggagatatacctaatgttaactgacgagtcaatgggtgcagcataccagcatggcacatgtatacatatgcaacaaacctgcacgttgtgcacatgtaccctaaaacttcaagtataattaaaaaaaaaaaaaaaagaaagaaagggagatgttggaggtgcaatagggtcagatgcagagagaagcctgagggagaggtggggttaagtgtatttgagcaaccataagaaaggtactgtggctggagcttagcaaccaggaaggacagcactaggaacctgggctgatgggcagaggcccagtcatttaggacttacagaccatagtaaggagcttaggtttttaatgtaatgttataagaatggaggcttacactgaggtcttcagagaatcaagcaaggcactgcgaaagcaggagcttgaggtctggccaatctcaatctctttgagactttcaaggttccagcatgaatcttatcagacaccattacttaatcagatgcccctttgagggctgcatcaggcttttaattctcctggaggaggcagcaaatgagcaaagaggaggacacctctgtactagcattgcaatcctgaggactgcagtgaaatttagggaagaaaacagatggaggtcagagcctctgtgacccagctatcaaagaaaccatgggcctattttggccttatttaagtactctccgattactgggaactgttatttgtgaaatacatgtataaatgggtttgcatgttcacttgtacatcacagatattctctgatatctgagtagggacaaacttaagagtccacatcaaagccttcatttgacattgaggaagctaaagcccagagaactgaagtgtttgccacagtatgaacaactgtttcagagtctagcctgcctttgtcttctcccatgtcttctcctttgttttccctgacactgccttctgtttaacacatataatccatatagtttaggcccatggcatgcccgtctaaggaaaagagcgtcaattaagcaggagaaaaaactgaattgctgttttaggcatgaagtcttaagaggggactgactgtaataagctagtgttttcttcttgccctataccacactgttacttccttccacacttcgtggctcttcaggaacttgcagattacaccgaatcccagagaatggagatcccattagtaggaaaagaagggttgaatatttgcttgaatttttctctcccaaatgtacccttcaaagcagagttccgccagtcaggcccaaataatcttactctgtggctgaagggtgccccgtgggagtgtctgtgtgtacacagtggctggcaaacatctgattttttcacttagcatcactctacctgctttgaccattttcataagaccaagcctggacaaggtgactggcctaagccacatgactatgtttgtctccctgctctcacaaatgctcagtcgacttaaaactggctatcttcaaagatatgcttgaaacagaggcgttgctacttgaagattactaacatcactccctttcctcatataccctttaaccatcattaagcttcagtgttcttccctcttcattgttccaccttctccatcgtatctcctcccattgtttccttggtcattcatttatcagaaactcccaactctttagcaacagtttggaactctctcctaacttccaaaccaatgcctaagtcttacagggagcacattctgcccatttccttccctatctgcccccctaccaccaccaatttttccagaaaatcattcctcttcctcctatatttagttagaaaactgcactactatagatacagtctcccaagctgcaaatgtttctcgcgtagcaagttagtcactgtatcttttcaattctctcacatctgcccttgcctccaccactactgcccctgaccttcagtcatctcctgcacagactttaacaatgcagtcctaatcattctctttaccccttgtaaacctacctgcaagaggcaataactcaccattattgactgacttcaaatgaatgtgacaccgcccgcctcggaaggaaattcccaaacaggaatccaacaaagcttgaacataaacatgggttgtggaatagcacctgccacagtttcttctttgaagaagatgatagttgaatgtacaagtgtaggtaagtctgtcacaaagaaaatcaacctcatcacatttcaggcacatgctcaatggaagggaaggagtgtcggtagactttagattttaagagatctttgggggactccctagttagatggctttcaagacacatggcctctcctagcttccatcttcccatctggaaattcagatattaatagtgctcacttggcaggactgttatattatgtgataatgtgtgcaacgcaaatctctctctgcctgatgcaaagtaaatggcatgagatgccttttttcccccccttagcacctcctggttacttctccctttatccaagctcctgcttctccacagcaatattgtacctgagcagaggattctggatgatctcaccaatgtgctaaccgtgagggcgatttaaggtgagcagccttttcttctgagtctcttgcctgggtgttgggcaaatgcttccaccggctggctgacatatgtggcctgctgcagactaatttcttgtgacatgttgccttgaatgcacagtcacagagcatgtgctgaagtgctaaacacccccaaactgtgcactttccaatctgtgaaagctttttggtgggtccaggctttttttctagacctgaggcattataatgaggaagcacatggacacgtcattgaggcaatctgtcaccttgcaaatgcttaatagcagcagcaggacctgtgtgtccctctcagtgagccagacaccaccacacagctgctcttctgttgaagttgttgctgcattaatgagcttccagacaaaggcatgactgtgtggtgtgtagctcagggtccgcacgcaggctgggagtaatgcacagagggagacctatgctcaaaaataatacttcatttgcaaaaaactggtttggagcccacaggaattactgtgtttctttagacttcaaaacttgtaaaggccggatcatcctcctgcaatattttacgataacagtagcatgttaacagttatctgatcctctagggtttatagtgttttcacactttgaacctcaccatatcactgtaaacgtattgttttacggatgagaaaatttgagtccttcaaaggttcaacaaaatacacaagttcatgtggttaataaaaggcagggacagcccttgaatggagacctgtatgactccaggtgcttgactttctgaagaattatcaccagacttactctcagttcccccatatgtactaagatgtcactgaaacagctaaaaaggaagcttctgatagaaggagctttcaagggactgaacttctccattaagattttaagtcctttatctgccagcatgttaaaggagactagggcatcccagacatttttcaaaagctaagccttacacccaaagcaggtccttcctctgccttgcttatgatgatgatgtaggaaccttatgtgatacctcacaccaccaatataggagagtaacaactgaaacagaaccaagaatatagaacagatgtagaaatcaaaccccaaactacctctactacttctacgactactattaataaaataataatgcagataaaacagcaataacaaaaataacagtagtcagcatttctttagcctctaccatataacacttactgtttgcatacattatcttgaattctcccaacaatcatcaaataggggttgtcgtccctctgcagatgaggacactgtggttcagagtggtaaaggaacttgctggaggccacagagtttgtacatggcagaatgaggcaagatgctcaggtgtcccgactccaaggctgtgctatttccattgggccatacttgccttctctcaaggagatagataatcaccaaactagtgagtagtgttcaggaggttaggaatccccataacccagtgtggccaaggctgacaaagcctaataggtgcatagctgctccttctgatcatccaaggctaacagttatccttcaggacccagaaaatgggtttcaataacctgcttttaattttctgtgcctggccaagaaataatgaacaaagggacaacttctaaaaaaaatctggcttcaggtgtgagttcaatcaaatcctctgacagtgtgttaaagtatctgtgtatgtgcacacacacccacattcatgccacacaggtgtaggatgcgagcagagaacagtaggctgattccatgtccttttctgcctcctgacagctatgaaactacaagtgggtagattatagttgaagataaaaatagacattatactgccgctttctcttcccagctttttagtcgctccagcttgaaagcatattgtagcattttattgtagtctaggctcttgtggcttctcttgtttgccattcctttttggaaaactagaaacattccctctccatggggaaatgaactcaagtaagtgagagagaggcggcagagtgcgcacatgtgtgtctgtgtgtgcctgcttgtgtgcacgctcatgtccttccacgcctgagggaggaaaggaggtggaatgagtgcatgtgtgtgcctgtgtcccactgcctctaagagaggagaggaggcagagtgtgaatctgaatagagcggaaattggaaattgacacagctgtttttgtttcactgtaaccatttttagaacctcaggatgcactaagcttccaaaggaggcagcccactcagccttgggattcaacactagccaagagtgagtagtgatttgaaggcactggatgcatcatcccaaggtctacagtagacccctcatccaagcattgcaggtcacttggtataatgcatattcggtgccctctttgtgtggcagttaaactgaattgtgcaagtagttgcacgtcaggtctcatcccaaaccctctcctttccgcttatcatctccattctttctcccgaaattttcttttaggggcacaatgttccatgtttcacgcttaggttccctggacaacagcaccgccagtcagtgtagctatgttttataatacacatttctgtgcccactgcagatctactgaatttgattctatcaagaatttgaattttaacagcctactcctggttattagtgtcataagcactaaatttttcaaatgcctaataaagcagcaataaaatcaagacttcggagttgcacttgcctggtatcaaccactgaaatattcagcctctcatcaccttcactagttctaccactttatacccaggaaaaaatgagagccatttacaagctttgtgaccctcatcaactcccaatttctctgggtttcatttcttcatcttcaaaatggggatgataatggcacctagtgtatagggttgttgtgagaattatatgagaaaacatatgttaacacagggcagtagtgatcaactgggagtggggtgatgttgcccatcaggagacaactgactatctggagatatttttggttgtcatataggagtaggggtgctactacgatgtagaatagaagccagggatacggctagacatcctataatacacaaagaagccctccacaataaggaattaccagcccagcatatcaatccttaacattttgagaaatccagatgcgaagttcagcacatcaggactgggttcgaattttagatgccaccaatctggctgtgtgatcttgggtagattgcttagccatttggagcttcaatttctccatctgtaaaacagggataaaaaatcctgtctcacaaggttagtaagagttcaaagaagtaatttataaaatatgtttggcatattttcagtagggtcctttcttttagttcctcttaaaagaggctggtttccacattcctaatgacctaggaagcctaaggcttccttacctttaattcgcaagtgaggtactttatgtgttggctcaaggcagggcacagatggcccatcatctgagcatgcatgcatggccaggccctgttactgaggttaggaatcatagggccccctattgggccatggctctaggacagccccatagacagccacaggctgacatgcttaccctgaatgcactattaaccccatgatcctatttttatataatgaaagaaccaacttattttgtaaaaagagcataaagcctaaaaataaatctagctaacaaggtgaggtttaccatctagagagaagagaaacattacaccctttaacatttaggccattggatataggatcccccaaaattaccatcagctacttatttatccacttaaatgagagagagcagaggtgtagataaatcaatgctgttttagattttatttgtgacctcaaagagcacataaaatctaaaacattgcattgatttgtctatatcttgatgcaaaaagcatcaaggatatgcaagatcttggtgtacccttccaaacatgctgttgtttctggatgtctcatcccaggtactctcatgttaaacttggcactgctgtcagtggagtaggagaggcttggaatttcactactctgggggcaacctgaacctatgaaaatcacaaacatacagcagtaaaattaacttgcactaggagagagatgtggagacctccccataacctcacttctctccaagtcccaaggccacccaagtcatcttcattcccctactttctagcacaatcaattccaacatcctttgtcaattgaacgctcattttttttttttttttgtccacctagtgtactcaaagtacaaaatgactaagggcatggttcaagccctcaaggaatagtaaaggcagaggaaacaagatccccactgcccccaaaattaagggctgctgtgccctaagaaagaaaagatgcaaatcagaatcagggttcttaatatttgtgttttgagcccagtgacacacctccctcctgggaaggggagagaagggagttgcgtgagtggctctgctataggatttttgctccggatagagatggaaacaagcaaacactacacaactgctgccacagcatggagcctgtgatgaagtcagcaggcaggtgccgcctcactctccctcatccccctcatcgttatcacacacagctgcatcagcttttacttttcattccggtcaaatacactgtaaattcatcctgctcatcaggaagtctcctgttaaggaaatgagactctgacgcgatcccagcagagtgccaagaccagagaagctcagacccccagtggctctctgcctgagggagacttagccacacaaatggaaggctgcttttgtctttctgggatggtggaggggggagcaatgctgccttccagggctacccctagcgtgggtctcagaatcttgagaataaaggaccctgcctacgttttctctgtactgtcagctttgcccaggaaaaaaatgtgctctccatctaccctgggtcgggacaaaatgcaatgttgtgtaatcctatggcagcccttgaagtatgtaggtagtatcttcattttatagtggaaaagaaaatgattctcagagaacagagaagggcctctttccccaaggaggcctcctcagctataaaattcactttacattgaaatatgtgcaagtggttaagaaagaatctgatcttgttactcctttgcttaaaaccctccaaaagcttccccattgcctgaggcagtacttctcaaccctggctgcacactggaattacctggggaaatttaaaaaatgccaatgttctggccccaacccagaccaattaaaccagaatctatgggggtggaactcaggcttggcactggtgttttttgaaagctgctgagcaattctcaagtgctgtcaagattaagaaccactgccctaagggattagtgtcaggctcctcaacatctcttgccgaatcctctgcagccaggcccttgcttatttctgtggccctatcactcaccactctctcctactccctccttagccattcttcatccctcctctgccagcttgagcttctccagaggagttacacactcacgcctctttgctttgatgctctaccatcgatctccctaaaatgccactccctctcttcacctaactcctacttgttctttcagatggagctcagcactgctgcctccaggaagccttccctgacaccctctagtgatcctcctaggtgctctatatgagcatacctctagcactcccatacattgcagctgattttcacttatcttctccctccctggaatgagtgccttgaccagaacagatcctatgcttctgctcattctcagtacacagcaccagggcactcaaaaagtttgttgatccaaaagaatcgagagtagggactcacacacacactcatccttgtacaccaatgttcacagtggcattattcacaattgccagaagtgggaaacaacccaagtgtgcatcacagatgaacggataagcaaaatgtggcatataatacatacaatgggatattattcagcctttaaaaagaaggaaattctgacacatgtgcaacatggatggaccttggaaatgttatactaagttaaataagcttgacacacaaggataaatattgtacatgtatgtgagatgcctaaaataggcaaatttatagagacagaaattagattaggggttaccaggagacaggggcgtgaaggggaaggggtaatgggagctgtttagtaggtacagagtttctgtttgagatgatgaaaaagttctcaaaatgggtaatggtgatggttgcacaacattgtcaatgtacttaatgccactaaattatacacttaaaaatagctaaaatagtaacttttatgttatgtgcattttaccacaattttaaaaagaaaaaaattgctgaataaataaatcacattgtacttagaagagcaactaaagccttactcacagccccttacaccatgtgatgtggctcctgctgtcctctctgatctcatctcctacccttttcccataaacattctactctgaccacattgcactcttgttttttctgcaaaaataccagacttgttctctcaagttcattgcaatagctttccagtgcttaaaatgatcttcttctacatcttcatatggcttcctccctccctcttaattatgtatccttcctcagaaggacatgaccactccatttcaaactgctaacttcactcctgccatccaaattactctgtgtattggttaagctaatgcttgctgatgtcatgaacaaactctagaatctcagtgacttaaaacagtcctaaactttcgggtgcatccggatcattttgaggactttttaaaacacagtttgccagaccccacccctccaagattcagtatatctagggtggggcccatgaatatccatttgtggcaagttcccaggtgctatggcttgaatgtttttgtcacctccagttaaaacaatccccactgcaacagtgttgtattagtccattttcatgctgctgataaagacatactggaggctgggcaatttacaaaagaaagaggtttattgaacttacagttccatgtggctggagagacctcacaatcatggtggaaggtgaaaagcacgtctcacatggtggcagacaagccaagagagactgtgcagggaaactcctgtttttaaaaccatcagatctcatgagacttattcactatcacgaggacaatgcaggaaagacccactcccataattcaaccaccttccaccgggttcttcccacaacacatgggaattgtgggagttacgattcaagatgagatttgggtggagacacagccaaaccatatcaagtattagtaggtggagtctttactttaggaggtgaataggccatgagggctccactctcattaatgagattagtgaccttatagaaggaccagccggaactagctagactccttttccccttttgtcccttttaccatgtggggacacagtgttcaaagtgccatcttagaagcagaaaacagccttcactagataccaaatctgctttgctctgatcttggacttcccagtccccagaactatgagaaatacatttctattatttataaattacccagtcttaggtattttgtcatagcatcacaaacagactaaaaccccaggtgatgctgatgctgctagtctagggacccaattttgagaaccactggtttaacacagtttatttctcactcacatgaccattctatatgggcactttgagctgataagtattcctccatccagtgattcaaggatcctgtggctccacttcttttaacacagtgcccacagttgtcccaggagtggtctccctccaagtcaaccaaaatagaaaaaagcatgaaggaccatacattaaaaattgttatggtccatgcctgcaagtggcatgtcacttcttttcacattttattggccagaactcagtcaaatgaccacactgaactgcaagggaagttgacaaatacactctatctttgtgtccatgtgaaagagtaaatgggattggtaatctactatacctaccagcccctcatgctattatatttgtctccataataaggcctatctctacctgatatgaaatcacatatttatttgcttaccttttaattgcctctcttcatgagagtgtaagctacacaagggcagagaccctctcttattcatcactgtattttcagtacctagtacagtgcttggaactgtgaacacataagacaccaataactatttcttgaattattaaatgcatttttgtggggcacactctctgatgacgtcatatttacctcttctttcagatgctctggaaaccatattctttatcctgcttatgtcactgagccgctgccatcagagtaggcccgtgtttacttaagccaacatatgggacaagtttttctaatagcagtaacaaacttatgttgccctcacaactgctctgtcctgagcatagcggtcatggtgtcttatcattcccaatgtctctttctagttcaccctagcggccttcttcgtaagtgacaagaagagcccccaagttcattcccagccaggctgaggactcatgagctggtctagcataaagcaaactctaaatggactgatggtaactaagacagataactatcctgtgggatttgaattagagcagtttggaaattaatcagcaaaacataaaagagtaaatacacagaaagaagtagacacactctgactgtgaagtagtgacagtcaagagagatgaagcaactgccttggatcctcatagccttcctgtttcaaatgtagtaaattgcaggatgtctttaaaataaaccccatttatgaaggggtctaaatgagtaactgctcctcatttggttatgggcctgactaagctgaatcagtacctgttgacaagatagccaacagtttagtaagggggctcagtgaggggttagcacattcatatgccacttaaatgtcatatgaatgccagtttaacaaaatgaactgctccacccagagatggtatctaggtctacatactccatccaggatattagttgctccctgccctcattaccttatactaaggataacacagcagtttcttcactaccttcctcatctcttctgcaccttttcatcagattcatctctcataaatcacgacttttgctccaacactcccctgctctgaaccctccatgttttcccacagatcacagaactaacatttaatttacatttgtgtgataagaattcttccagggctgcatatacattgtctcacttaatcctcagaccaaccctagaattaggaccaccatctttattttgcagctatagtgattggatcatgaaaggaatgaataaattgcccacaaacatggagctaggaaccagcagagccaaagtagaaacccacgtgtgcctgtttctaaagcttctcctatttacaaatagtatgcattctttcattcattcagatattggctgagtgtcaaccatgtgctgggaattatgctagataccaggattacaataatttactgatagataaagtatcattagtattagacagggagtctgaatgctaaggaagcaaactgagggaactctttcaagcctagcttcattgctcagggaagcccttctcaaggcagtgtcattgaagttatctgaaggtcgaataggagtgagcaacctgctttctatcaggaacataatcctggtagtaaagagacagcataatgcctttctctctctgactctcatagactgctgggcagggaagagggaggctgggggaagaagggatgaagggaaaaacccgaaaagacctattaattgtcaaatgatatcaccaaagcatattttgtatttcaacgattcctatcctttgggtttccaattgttcctgtgtaattttaaactaaaatctatttccttacccagcagcatctctttcttcttccatacagagatgcaatttcattgctagtctgttggcagtgctaattatattctccctagcacattcctgatggcatggaattaaataaggcaggtgtggaggtgacagaacaaaacaaaatatatgacttatatgacagactgattggtctggtggaggacaaggtaaaaacagcaaatgttattctatataaagattagggcaaaaggcacaatagagtcacacttttatacagataaatcacaccaaattgaaaataatttttagcagtttcctctattataaatgtagtctgaacacactgtcttactgttttcagcctttcacaagcttctgatttaccttctatttaagatgtctccaaattaacagagagaactattttgatagaatattcaattttgcatttacaacttgaaggttgattcacaatcatcacttcaacatcagagtgaaagtagaaattataaacatctttataagagctttaccaaatggggacaaaaatggaaaataaattctggataagaggcagaaatagaaaatctgggcaaataagtcagactgtacatccaaactggattagataagtttcgtaagcgataaaatatttgtgggaatgggatgtccccaaatcagaaagcctgacttgtggttttgctgatgcctcccataaaagagaaactataatttcagtcatatgcatatatactatagttgtgtgttcaccaaatcccatttccttttctccctgggttcatcttctgtgcccatattcccagcctcccctagatgaggtgtggcctcgagactgagttccatccaatgaaacgtgaatggaagacctaggggagcctggaaccatgaatgaataagcagagcacagccatcccacccctccacacacatctgccctgacccacattagaccgcaatggaagggagcaaatgccttaagtgactgagcttccagtgttgttttttttgtccagtagctgaccaaccataagtcaaccaaaggcatgaccaaccaaaggcagaaatgacacagggcccaccatagtagaccacaatgttgtaggccatgagttaacctacagatgaacgagttaactgcagatgttctaaatggttctactggatatcgatggttgaaaaactttatattaagatataacaaggtttttgaataaatttccaaaggccagagcatataagaggaaccaagttataaaggaggagtggacagaaggaaagatgagtaagggggtaatgcaactggtacctaagatgccgcttccaaatttgtgagcccctgaaagaggtaatcaggttcctctttgtctaaatgcctcatgtatgcaccagcgactaaagtccaaaacctctaaagttggcactaaacactttccataatctcatccctgcccagctctttaacccatttatgctggaggttgcaaatttttgtgtgtgaaaaatcagaccttggcaatgaccttgagcagtagggaggatataaataactcccacaagcttagcattccaatgatggaacactaggcataaatttaatcttcaactactatctatcctctgcttgacccaccctgtattgcatgtgtttccttaacaactcccaccttatgcctttatgtgtaacattccctttgtaaggtgtacccttcccccacctcatttactttcataattcataatcatctttccaagctgagcttaaaccacatctgctgatacctattcttcctaggaaacatgctccttaagctgggttcccataacctttttttctttttttttttttttagacagagtttcgctcttgtcactcaggttgaagtgcagtggtgtgatctcagctcactgcaatctctgcctcccggattcaagcgattctcctgcctcagcctcccgagtagctgggattacaggcattcaccaccatgcctggctaattttgtatttttcgtagagacgcggtttcaccacgttcagcaggctggtctcgaactcctgacctcaagtgatccacctgccttggcctcccaaagtgctgggattacaggcatgagccactggatcggcctcccataaccctttataaccacatgtatcacagcacttatgaaagtcatcattgttgctcttcattctcatccttggctagatgggtatgtccttgatgacaagaatgacgtgtgatggctctttcctcccgttggcctgttgagtatcttgccccttgctccccccaccccaccacagtaacaaacaataagtgtgtgattgagttgaaaacgaggcacttcctggggtgtacagtccagatgtgactagagacagtggaatgctgtgaagattttccaggaaacctaggaaatatgccagcaaaagaagtccactgcagctcttgaataagttttgctttacagattgtcagtcagtcagtcagtcttgaggtgaaattacacttttctgtaagtacagatgtcaaaggaaagcaagcttaggaacgtatacattctctaaagatggcttagaatgtatacaaataaaaagtgaacatgacaacctgagaaataaaaataaatctagatcaaatgacttcttgattccaaaggccaccccttcctgacttcacacattaaaaatattcattttcccgttaaagtgtgtttttattccactgttaaaatgcaagtaccagaaatatcctacatgtacaataggggcatggttaattacatcatggactatccaaaggaagaaattgtaatggcatagaaaaatgttcacttccaattttgactaaaaggaccataaaaactctattgaaagtatgaactcaacaatatattcattttaaaatatattcatatatatattttgagacagagtctcactctgccacctaggctggagtgcagtggggcaatcttggctcactgcaacctttgcctcacgggttcaagcgattctcctgcctcagcctcccgagtagctggggctacaggtgcgcaccaccatgcccagataatttttgtatttttattagagacagggtttcactatgttggccaggctggtctcaaactcctgacctcgtgatctgcccgccttggcctcccaaagtgctgggattacaggtgtgagccaccacatccggccgctatttatatttttaaaaaggaaagaactgcaacaaactgctgtaattgtggttttataagagcagtagcgtggatggctttattttcttccatatgcttttgcatatttttcaggttttctatgataaaggcagaatatttttataattagaaaatgcaaggatgctctcttttgaatcctattcccacttctttataactgtgaccttcatgcaagtactacacttctctactgcttcagctttctcatctggaaatggagatgatggttctttttagggtttttataagataatcatgaggtagtccacatgaaacacttagaacagtggatggcatacagcaaaccttgataaatgttacccaaagttgttgcatgtggaagagcccagcgggggttcagaaactgaagcagcgaggtcagatggggagaggataggctcaaatagcaaacctttgtcccctacggttttactcaagactgctcagggattcaaacctggcaaattattggttccctgtcatgcaatgctcagtatctcctttgctcaacacagctgccagagaggaaggaagaaaagatcaattttcaactttattctccattgtctttctactttctcaccgcaccctccctttcatttgtattttgtcttaactgccaattttgggcttaattggtagaaggcaaagaagctcaagtaaaacaaagctcagcagaatataaagagaaaaaggactaaaaaaatgaaggcatgaatggctgtctcaattctatataatctgagaagcaggttgacatggcactgaaacatatatgacctcctattgaagtgggctaatgtttcatttactgctccaattttctcatggcagagataatttacctgtgtgatgattacatagtgcctccagtgtctcaggaacttttgcctactgttgtatcttgaatttgggaaatctgtctgctttcaaagtactgaagataacttgagaggcaaggcaatctcatttcccgtccaacacaattgcagacttgggttcaatctattaaagtcaattggtagatttgcacaagtagtctaattagagatattcagatagcaggcacaggttccgtttgcattctaggatttttaaaaaaatcaatgtccatgcacaggaagaaaactgaacacttattttaaagccacagattacagcagtgccatgtacagaaaaccagtagaggggctataggtcaatacaaaaatactaccgcatggggaagaatgattagaagggacgggcagagttttcacctccaggtcacaagttcaaaatgctgcccagccctgcctgtatgatgtttataacccactgacagtccatgtaaaaagggccggctcagagactatcttttcaccagaaatgtcgtcctttcagggaagagactgagaaacaataggaaccccgcaaatgaactcacctatgcagctcctcgaggtgtattccacctggcacagccatgtcaattgcccattgactaaagcccatttccggcgttctcgacccaggctctgtggctgtgggccctgggaagttgaggcttccagggggacactcagttaacatctcttaccttacatcctgactttcagccacagagtcagaaagaaggaaggcaaaacataaaagtacttccaaatgtccaaataaatctccttcctccaggttcctggggctcaagttcttctgagatactgaatcaaactagcaactaaaaactgtagatgaaagattctctaaaatttagcctttgtttaaacagaaaacgagtattcattaaaccataaccatgtgacaccactctatgaattgctttcctagacttccttcatttcacaaacatttaatggagagttgctaagccaaaaagcaaattaaaaaaaaattaggatatatggatgagggaatatattccctgttgcaagagagtctgcaggagtcttcaattcttaagcctgtgaggcaatttttacctcgcattcccaaaagtattttaggcaactgagagttagttggcatcatcatcacactgttatcataatcattcccattgcatagagttgagaactgaggctaaaagaattggagtaattgcccaagatcacacatctacaaagtagcacagcccataaggcaacatagactatccagtcactggtttctgcttacaacatgccaccttttattataattcagaaattctttctccctagtccaggtttacccaaaagcttggcaagatcaaaaggagacaacagaatacttgatactattctaaaatctcaaggaaaagaaaaaataaattttctttgagtatgacaacacaaacctttggaattagtcagtgctacctctaggggctgcaagtcctcctgccctaagagttttcatgttggattaaaaataattagtagcattccacactgtgcaaagcagaatcagaacactgcaatcctcaccatgtgggtggccaagaagaaatatccttccctttcagagaaagtccaaggtagagaagctgtatggcagggtggagagggaacagcatctgtatgaaacccacctgagtgtgaatcctcaatctacacctggtaattctataactcggggcatattaatgttagtgtccacatctgtagaaaagtggtgataaatcccattttgcaggattgttgacaagatgcttgtaaagcaccgagaagcatcctaggacatggtaagaactcaataattggatgctattatttttgttcctggtcctcctaagcccctggaaattgatatgcagtggaagcagtttcatggcacgttccatggaattctctattctgactgcctgagaacagcatgctgatctcctcttgaggtacacacaccctcttgcatctgagcagtcactcactatacatctctagggccacccataaaagctaaaaaaaaccctcagaagtcaccaagaagttgtgctttatagagtgcaattctctgacccaaatcagtctttgcctttgaatcagtttatgctactagttatttagtagattgattgctgctatggcaactgcacatccctctgcacagacacaggcataagtccttgatacaatcctggcttagtttctctggctgcattcagtacatgccaaaaattacataatattgggaaaattaatttctttctgcactgtaggcactggggctgcattgtggtgcaaagaacaaatgaagcctggtgtataaagcgagggctgtgcttctcgtccaccagcttggaaggagagagaactgaagagtccccagctgctttttggccacactgctcaccttcggtttccacggtttctgccaaatatcaaggcaggatgtgcccagagactgcaaacgccacttggcagtgattaggagtctttcaggaaagctttccactaaggtaggaaagtacaggtttttcttacattagaaagagttgggtaaggattctgagcctaccacttccttagctgcatgatcttgggcaaatcccttaaactctgaaacctcagttttcccatctacaacatggagaactaagaatagcatctgctccccttggttgttatgaagataatatgacacaacaaccctggcatgtagacagactctgataactggcaggtccatctttctttatcttccctttaaaaaaaattttttttttggttcttttcttctgattagtaagagatattattaggctcattgattaaggagctggttctatgctgtccttaaatatttctaatttacaggcttgaacttcaatcaaattctgctaagtgtgtcaagtttgctgtagaatatagatcagtgtttttggctggtttcagcccaagaagacaggctagatcccataagtgagttttgctctgttcgattctgtcacctcagccctccccccttttcccccagcttcaacttccttaaaatggcagttatttattatgaaggaggatggaaaactagtgtgtaagtaaaaaaactgcacccacttctcgaagagtccctcacctctcatattctgagagaggctaagcactgtgatcattgtttgctgaggaagccatgttattagcagccatgctatttctgtatctggagacgccaggaacacttacagaaatgcttctaaaccatatgttgtttttatattttaactactctttatgtctatataatttgcataaatacaaaaataaatagctgtcctgcatttctctgaagattgtaaactccaaagaaagagggaaaaattttcccatgtatcagccttaatggcagaggacttggtattcagtgaaagtcagcaagaccaaactgactttctgggatttcatagttaatcatttatgacgcagatagtctccttgtatgtactttctaccatcaaggttgagaaagcatggcatgatcagacataagaccagaaatatcattacaccataaaccaataccaatttcatcaagttattctgaagatcacaggattcaaggtcagttacctgggataaaacaatttatatgaagaaatgctttggccacaaattataacaaacgagaacatggctctaaaaccagagaggcctgggttctggatttaaccctgtctaattctcaatctcatcttctttaaaagtaatatttagttacttgcagggttgtacaaagtgatggttaggagtgcaaactgtgcagttaagaatgtctaggttggattcatggcctgtccacttagtgttcagtgaacctgatcaaacgactttacctctggaagcctgtttcttcctctgaagaagagaggtagtcatggccctattgcatgggttgttgtgaagatgaactcctattatctacgtaaagtgcttagcacagggactggcatgtaagcgctcaacaaatgtagccagtggcggttgtagagtagtagcaaatgaaatgatgggtataaaaaacctggcttttagtagattttttagaaaatggaaacgtgtgctgtcaagaaaattccagaccattgcaaatttctttggaatcaaaaagttggacagggactgactatgatgagaaaggaatcctcttataaatcggtcctccattgaagtggcttcagtgctagcagaacagtaagggggtagtgaagtctggcctgtatgcagcctccctagttctgaagcgatgcctgctggaacacataggccaggggcttattgcactctacaggcccaggagtgggtgattactagctactgccaaggatgatggggagaggaaacacaaaagcaaaattttaagtgaatcggcataacggggcagtgccaggaaaaaaaaaagaaaacatcaacgaaaggccggccaaccaccctctgagagcaacggggtggtttcctttgaacacagggccatctctgaggccaataagggagctccacaagagttacagcaataaagagaataatgatttttttatagacacctagcctagatcggattgctggtcatgctttttctgttttgttgcttcaaagatacacccacacacctttggcagtgttatcctcaaacgacaagatgttacttctaagttgcaagacctcaggcgctatttgtcctcacccacacccaactgtctgccatcttcagcaccaaacatatccctgaggacaaaaatggcccttcagttcctgagtcgtttaaactgaaaaaccagttaaagtgccattcccaaaataaaacagaaacatggccactggcatgaaatatttacagctgtgagacaagggggaaaaaaagcctcacttgacctggtagtcaggggaatgatgtagctacacaggcctgtagagaagcactttggcctaaaatcgttttctcttttgggattcctactggcacctgtcactgaagctaaagacccaaaagtcatctccaattggtccattctcttacccctatatttaatctcaaatgtagctccatctgttctaagtctaacatttcctaaattggtgctctccttgcccactggacatccctctacagttcaggctctcaaatctctgctgaccaaagcagccacatcactcactttcttctatcccatatctccccctttcccattgctcttcatactgcaacagcatgacttcaaaggcccttcaagatcaagctcctacctacatttccagagttgtccattatctatccagtcccatttcttcacagcccagcaaccctcgtccatcctgaaacacgttctatgtgtgtgtaccttcacactgtggtgcacgcttttccctctctgcatggagttttctcagccctcacaaacctgcctacccatccttcaacattcagctcaaatgctttgtcttcttctcattccttaatttcctcaagttaggtttaggggctctctacactgtgctggctttgcccttttatatgcttttattatagcacatttcatactgtatggccatcatttaaatatctctatgtctactcctgtgtttatgatggtcagtcaggtgtgcttacaagaggaaacacggaagaggctcagggaaacaaagtttattatactcactggtcctagaaacaaaaggcatgctgatattgtttggcggtgtccccatccaaatctcatcttgaattgtagctcccgtaattcccacatgttttgggaggaaccaggtgggagataactgaatcatgggggtggtttccccatattgttctcctagtagtgaatacatctcacaagacctgatggttttaaaaggggtttccccctttgcttggctttcattctctcttgcctgtcaccatgtatgatgtcccttactcttctgccctgattggaggcctccccagccatgtggaactatgagtcaattaaacctctttcctttataaattagccagtctcaagtatgtctttattagcagtgtgagaacagactaatacacatacctatgtagggtcacaggggaagcaccaggttttggtcaggagacaaaatataatagccaggggaaagtctagaccagagcctttgttgggggtttcctcaggaaaggcaaggcggggtatagtaaacagattaggactgactaaattgagtaattctggtggcctttgggctctagggatggtctgtagttgcctggtacctggccagggatgcttacagtgaaggaatattgcttcctgtggtgtatgggctagacagaagaggtacggctcttgattggttagtttgcatatcaaaggcaatgctcctggctgagtcctgggctgtctctaagaattaacagtctctccccagtaagaaagatttttaagatgtaaaaacattataatacatagaaaaggaacaatgtaaatgatacaactcccagcctcaaactaaaatctgagttcctccctcctatgttctaggccctgttgaaagcagggctgatattctgctgacatgctgatatgtacaagtttactgcttttctacacttgcttcttcctgatttactaatcatactggttagtaaatatttttatcatcatcccaattgtgttttgaatctaactgctttattaactatcatcacagctttgtgaaggatgtattattatcaacattctacattatctgtagaatgtaggctcagaaaatgaggctcagaaaagttaaataacccaaccaaatcacagttagtaaacagcagagccagaatggggagccacatctgcttatactagaggctctttcctctccatgatactgcctctctgcactttgtttttccttctagacgcaggcatccagcacggtgcctggcatctagtagtcattcattaagtgattgcctaatggattaaggcataaatagcagtgatataaaatattttaaactgttcccatagctaatttactctatggaacaaaaaggctggaggtttgtaaccttgttttaaatgaaaaacaacacctcacaataagaattgcttactttatccaggtctgtaatcccagcactttgggaggctgagattggaggattgcttgagcccaggagtttgaggccatcctgggcaacatggcaagaacctatctctacaaaatataaacaaattagcccggtgtggtggtacaaacctgtggtcccagttactgtggaggctgaggtggaaggatcccttgagcccaggaggtcaaggctgcagcaagccatgatcatgccattgcactccagtctgggcaacagagcgagaccctgtaccacattgctataaagaaccatctgggactgggtaatttgtaaagaaaagaagtttaactgactcactgttccacagggtgtacaagaagcatggctgggaaggcctcagaaaacttacaatcatggcgggaagcaaagaggaagcaggcacgtcttacacggccggagcaggagaaagagaatgaagggggaggtgctacaaatttttaaacagccagctctgtgagaactcactcacagtaaggagaatggcaagggggaagtctgcccccatgatccaatcacctcccatcaggcccctcctccatcactggggattataattcacacatgagatttggatggggacacaaatccaaaccatagcaccctaacaacaacaacaaaaacagaattgcttatttcatcaaaatgcaataggttcatttcaatagctaccatttattgagtgactgccatgtaacataacataaactatgctaagagctttgtgttcattagcttatttcatcttctcaccaaccctgcaaaattgaaacctatatatatatatatatatatatatatatatatatatatatatatatatatatattttttttttttttttttggcatttcagatgaggaaccagaggctcagaaaagatatgtaatgctaatggttcagagctggtaaacaacagagcagagatcgaagttatgacacaatctccaaaatgcctgccctttccactaccccacgtaaccattttatttccatgtccttgtacaatttgcaggaatgagtgtatagggcaggaattgggactccatactacttggaagtttctgagacaaaaaggtcctatattaccattaagtagccttgtcagtaagggcttattgtagcttccatcttctgggcccagtgggagacatggtcatgggctcaggacccatctcctgctggaatcttattagtgcttcctctgcacaaataagaactggtgtattgtgttaaatggactgacacaaacaaccatgctttgtccagaaatagaaaatgctattttctttagcaaaatagaacataggaagtggtgggggttgaaatgtcatgcacagaacaaaggtttggcagaggagaaaggttaaaatcaatcactctacaggagaaaaaaaaaaaggtctgcagtattctatagtaattatccacccaaagtcacactatagaattgggagccactgctactcaaaaattcttttaaaaaggaaagaaagaaaatttccaaccccataatgttaaggttttacttttcacaaatcatttggaaaagatgatagatatacaactaaaaataaataaaagaatgccattttaacattctcacctctagtggtaggaagtaaccttttcatttaagaatgaggcagggagaaaccaaaattgctctctcaaaagaaagtaccaccagtatgttactactctgacttgtatgctagaggaaattagaatttaagttgaaaatgaaggcttattcactattcatatcttctggctaatcatcttctcttcaagagtaatgtccactaacattgctatagtttcacaaacctcaacgtggcacaactttctgggattgttattttttttttcttttctgcaaggttttcctattactttctacataagattacaaattcttcaaggtccgacctctgatgtttgttgtcctcatccccattgttttttaatcccatgatatttctcattcagaccaagaggaagttgctaagaagaatcataaaacaaagacagcaacatattggtttttagagtcaaatgctgagatatgaagtaaaagagaaaattttaggcaatacaattgatcaagaatccattaagaaaagtacaaagtaattaccctgtctccaagaacaaaaactatattctgcccatcggatcaagttcggggaagaccaaatggttcacggagactatgacctgttttctgatcagttgaaagcagaacaaacagaataaaggacttatatcaccacatgcgcgcacacacacacacacaaagatgaaaaaattagagatcagcctttctcatatgtatctatttatttaggtaatgtaagatggcaaacaagtattcagtcagaaaggtgaaatcattaaaaagaaaaaaaaatgtgtgccatgctttagcctcgatttgacctggaagcagaagagtaagagaaggaagtaaactggctcaaggttccatgagtcgactatgcacagtgtgattgatcatagtaattccccagatctaaagcctcctcctttctagcatactctagagagtcacttcttctgttaaatatatatttggattcctgtcactttcagctcttggttctcaattctttcttatcttgaacaagtcataagacactttctgagtattaaccgtccccaggaaactatatcccttacttaataagaactatgtaaaataagagataaaggctatcaggtatcctgacttcttggaagaatgagtcaatagaaatgagtttgggtagggagaaaagaattttaccatataagtaagatgaatattagagaatttgatttgggagagaaaacgctgcaaagatgatgctgatgagaaaagagcattagcatattgtcttaagtcacatacggtattctcttggggcctcaatttgtacatctgtaaaatggaggggttcagctatgtgagactgtgtttcttcctggctataatatttatgaattaagtcagagctgaattgtgattcagaattcaagatttttagctgtctgcttaagacatgttaaaaagccattttctctttggaactgctatatgtgtcagaaataaatccagtattcaggagagaaaacattctgcttcttcctccacacccccactccccctgtctgattgttgtttaataaaagccaagatagggaaggtccaaggcagactcttagcctggcctctccattcaatggattcagaattattctggtttctgaataagatgattctccccttcacccccagcatttatcactttggtcaaccattaaaaggatgaagcaaaagcattgcccagcaagaaactcctgcagctggcagaaatgaaaagcaaagatcttccctcacaggtcaaatctaactgacactacacagataaagctaagctgggagagcaaaggcagacgtgcaagcagttgaaactagagaggaaactattttgagttcctttcaccaaagattgtaacatatttgtgttgtttttttttttttatcagagcctcctggagctctctgacttttccttattaatattattattattattgaaagattttttttcaagcaattccctgattagctggaatattcttgctctttttaaaatctgcagtcatactatagtgtttcacccgagccctaggggcaatttgaaacaacgtctttttctgcttgtggtccaggatttttaagatcctacctgaatagatctgaagttttctgaaaagtctcctgtctccctgcagcccctagatgttctagagagaaagtgtcctgggatctgccactcagcacaccacttgctcttgaaagcacatagtccctgcttggaatccgctttgctcctcctggtagtcctgctcaaaatgggaacgcaaatgcctatgtggccaagtgaagcattcacttgcataccataggcttattctgtagctagggacatcctgatactcgggtagttagcataaagaagaaaactctgcgcccaggtgtcaaggtttcactggaagagagaggcaagcctgaggacaacagggaaggagaagggttgaggctacaactgggaggcctgatcctcggagtagaatgtgttttcaatgacggagaatgattaatgacttggaaatattttggaaagttgggagaatgacaagcccccttcctggccccatgaaatatggagtttaagggaagattggccttcactgcagagcaatttttttttttttttttaaaaaagggtattctgaggaagacaaaggttttttaatttggctgaatgtcattttgataaaaggtcgaggggccaggcgtggtggctcacgcctgtaatcccaacactttgggaggctcaggcagatgaatcacgaggtccagagctcgagaccatcctggctaacatggtaaaatcccgtctctactaaaaatacaaaaaattagctggggatggtggcacgcaactgtagtcccagctacccgggaggctgaggcaggagaatcgcttgaactcgggaggcagaggttgcaggaggttgcagtgagccaagatcatgccactgcactccagcctgggcaacagagcaagactccatctaaaaggttgaggatgtagggtacagtttaacagagaaaggaacgtttctgagcactcagtggaaaggatccagaggagggttaatatttggtggacctagaagtagggaatggcagagcaatcagataatttgggtttgagagaggatggacaatttgctgggaatggaagggtgcagtttgttggaagctaacagctatgtacctaaactttccaagggtcaagagagagaaagagtaggaactatcacacagttggcaggtgattacaaaatggtctgtactggcaggggcagcaagttctgtaatatgtggcctcatttttagagaaaataaaatcctgattggggttgaggggagatgaccatgcacataaacacacgtgtacataaaactagagtccttgcttttattgagccctcccatgccaaaacaaacaaataaaaattagtagcctgctgcagtggagcttgcacatgattatgaaataggccaatgagctctattgaggggttataaagattgaacatggggctcttcctgaggaatataagatgagtgttactaaattttgatattgatggaattctgcattcatgaaacttttaaatgctttggtagaatgggtaataatctgggagtcagcagacttgaattctggtccccaaacccctatttacctttgaaagaagagaaaacctaccgccaatgttttcccttccccacctcccctctcctccaaaagctagtttctgcctccacctttctgatgaatctacttaagtgaagctcatcagtgactctgtcctgccacagttgccatcccatgggtgctttcaattttaatgtaggttccttttcttccctgtttcccatgaactgagctttcctgcttttcatccactgaaccgcttcctggccctaatggtggtaatgcagggcccatcacttaatcatctttgtatgtcaagtaagagtataatgattatcaaatagataattgaataaaatgcttttgtcactaagctttgatatcttcatcttttcaaattaaaggtttggacttcaaaatctaaaatatatgattgtgtgctcttcttacagtggttttatgaatttaagaatcaagtatcatccacttagggaaaagagtccctcaatagaagattcttgagtttatcacataaaaaggatgtgacaatatagtcttctctcaaggtcccagaagcaatacatcagcctttttaggttgataccaaagctttggatatgtaacactgactgcttcatacatagataggtattaatgcacagatacataatacatagacatactgaatacaatggctttaatgctgccattatctcattctctttagaatatcatctaacttactgagttgtatattgtaataaaagccagcttcaatttgagtaaatagaactgttctttttagcagtatgtgcttaagaagctaattataattatacagatctatttatataaacacattaaaaatggttctgctgtttctatgtcaattcatttgtcatgacttggtacataattccttagactcattctttttagagtataaaaataatgcttcctaattacaataaaattagaataaagtcaaaaaagtagaaagaagattttcttgatcacacaaattcctaacattcagtggcattagatgaacatttggtgtatttccttttgggtatttttttttctatttaaagattatattttgctgagtttatttttaaagacatagtttatatatagttcttgaaaagaatatatgtatcatttccctgaaaatattaatacatgatcatcaagatatttggggataaattgccacttcaaaaatgcatcttacaaagagcattcacatggttttaaatagaaatttctaaatatcttattcacagtttacagtggtaatgcaccttttagataaatagagctaaataaagtacccagaaaattaatgcaatttaacattctcctcaaacactgcccctacctcttccctctcaacagttaaatcaccaggtacagatgccaccaaaatcttaacacaacaaccctaggaagcacatgatgaaaacagcattcaggtgccaattaacacaggcctcacttcctgaaacagctgtcctccagtcattctaatgtatcatcccatagtcctacttcctaggaaaagaagtgaaaagaaggaactgaatatttatgctgttgtctgactgcttttagaccttagctgaaactgagatttctctgaaggaagtactcttgtctcattcatctttgtgtacagtgactaggatcccacaaagcacaaggcacaagttttattagtatttgttgactactgaataaggccaagggcaaatggtcaactaggagtaatttcaactgcaagtggcagaaaactcaaaggcagtgatataagcaaacatataggtgtctttttcttatctagctagatgtccagaagaaagcaggtgttgatgtttgttctatggctcagcaatgtcaggggtgatatctctaaaattctctcagccttccccttttgcctcaagatggccgcattagcttcggtcacaaatccattttcaaggcaagagtacgccttgatgagcccccagtagacttccagttaaatctcattagcagtgttatatgacttcctcttgctgcaaaagagtctgggaaagtgcttgtatttcctggagcttgtgtctggagttgggcatagaatctggattctgttagcaacaaaaaagggagaaatgggtactggatagtcaattaacagtgtctgcctcaagaaatgttgttctccatctttttaaagtgaaaataaaaagtagaaattgaaaacagctaataaaacaatcaagaaaagaacatacattccatgcaaacttccataggtatgaccactcactgacagctgctacggataatagtgacttggtgagttggaagttgtggctggttcaacagcaaggctaatcaagtaacttgagaatgcgtgtatcttgagtgatgcactcaactacatactatgtctgggtctcttgtccttaaaaggggacctaatacaggatagaaacaaacaaatttgatttgtcaaagctagatgaattatgaatgtcttcctttggttttaatgcagtccaatattttaaaaaatattttatggaatttgtagaggtggaattggaagagactctatttagactatactcttcatcatatcatgcagcctctgcttaaaatttccagcaacaaggtctctactctgtaaagtagccaattcaacatttaaatttctctaatgatcagaaaagtctttcataatttgaactggattttacttctcagtgttatgcatctactgtttctaacactgatttttagagtgagcagaataagtttgtgtctccttgcatatgacagccctttaaataaatcaacaaagttgagatccctgttcttgtagagaaacaatttgggccttgaactcttccttagttggcgcaacttccgtagtccctttgtccacccctcattccagatagttgcccttctctggttactctgaagtagtgaatgttacttattttatagctcttgcaataacacaataacacaatatgcctataaccaaccgccaagggtgattgtagatgtctacaactacccttggtgtcgacactcaccatttcgattttggtccacgtctctgggcctaagaagattatttgacatccttactcatcaaatatgcaagttctccccctgaacgtatttgccaaacaagccctccatgatgtcatccaaatcgttagaataaaaaaattcaacaaggcagagacaatatgctaaaagagctttcctttctggttatcaagccatttataaatattggggtgaaactgttgttcaattgtctgttaaagtaccacaaaagataactctccatatttttccatttcatgcagagttctcaggattttcctttctgtctctccaccaggtaatttagagcctccataaatgatttatttgccatgctctccaccacattttaaacagtacaccacagatgtctggcactcctttaaaactcaggtggaaaaatgagggtgggtgttaacatttatgtaatttatgtacagttactaaataaacactgcactaggagatttatatacattatttccttcggtcctcctaaccactttttaaggtcttacaataccccccagctttttaaagagagattactaaaaagtttactgtagttcagaaacttgctttagaactatgttatttttctggacaccaaatacacgttgttttccaaacaaattctctaaatctttgacatcaactgggtgtccgacaatttaattcaattccaacaactattgagaaataaaaacaaaatcctaagacccaaggagacaccagagaaatcttaaaaactgagttcctggccatgacaggacaagtggtgagacatgcctcagtatgctcctttcttattaacctttaaccagaattctttcctaaggagtaaacagaaaccagctttggaaaagaagaaacagacaactcatttcattaatcacctttaaccaaccatctgaggccatgtctgcacttcccctccctctttgctgtttctacatgacaactcaccagtttcacaatgcatccttcctgaaaactaaccaccctctccaggctggttttggccaactcatggaggatgcacagtgagggttctcgtgtccctctgcttcaccttttgacatcagcgagctcaaaactccacccttggaccatgctaacaacaccctttattttcgaacatgtgactcatgaagagccatgaagctcagttgtgcatgcatatgtttctcctttcaaatattccttatatagctattaaatatgtatacttagccaacctgttcagcataaattcctgtattatgcttccttccctcaaagtgcttgctctcggtggccaaaggccatggttcctagcctgtggaatggccagtttatttctcttttatgagaaatagttttcctgtccaaatttatgaaactcatcattcttcagatgtcaatacccagagttgacacagatcgtacagctcaagggctcaatcccacaagacttctcccacttcagatgccaactgcaagtggggtgctcaggctacccacacttctgcccagctgactacaaattcaggggttcccacgaccctctcctcaagtttataattccttagaaaaactcatagatctcaggaaaacactacacttaaaggatagccaaatggaagagacactagaacaagatatggaaggggtagaggggtagtccagagcttccatgccctctccaggtgcaccaccttcctagaatatcaacatgttcaccaattaagaagctcaccaaacactgtcgcttaggagtttttatgaaggcttcgctatataggcacggttgactaaatcattggtcactggtgactaaattcaatctccagcccctctttcctctctggaaatcaaggggtggggctgacagttctaacattctagtcacatgactctctaaagcctctgcccatggtttagtcatctcattagtacacaaaagacagtgaagtccaagggttttagaaatctgtgccaggaaccaggggcaaagaccaagtttatattttttattacaccacaagatcccatggttagtaatggtagagctgtatttctaactcaggtcggcttatggttgaatttcatattctcctcttatgacagatttcctactgatgaatcaaattttatagaacgaaagctatattagtacaagatattttgagatgcgctccaagtagaaatatcctgtgtcaaagtcacatcaatctgaaaactggtaatcaagaaaattagtcttgagaaatgtgttttccttattctgaataatcatgatcagctctttaattgttatatttacccttcatacgctaaagcaagtcaaataggtaagaccttcgttctccatcacttacgtattactaactgtaggttaaggatccaactaatattttacagtaactttcacacttatcctttgcccactgattcactcacatactctcacgctcaggggtttatgtaactatactcatctagaaagcaaaaagaaataggtttatcacacacagaaagaattttaaaacaatgaataatgttgtaggaaaacagaggattatagcttgagtgacttgtgtaccaaacagtacagcatgctctgtgtgggtctgttcctgtcacctgcaaaactgtgtggaaaatattcttggaacagaaagtagagcctttttgtgtcatcctactccattttttaacagcttaatagaaatgactgaacatataattcatttgagtaacaaaaattagttataaatttccatttcaggctgggcgtggtggcttacacttgtaatccgagcactttggaagtctgaggcaggtggatcacctgaggtcaggagttcaggaccagcctggccaacatggtgaaaccccatctccactaaagatacaaaaaaaaaaaaaaattagctgggcatggtggcgggcacctgtaatcccagctacttgggaggctgatgcaggagaatcgcttgaacccaggaggcagaggttgcagtcggccgggattgcaccactgcactctagcctgggcaacaagagcgaaactccatctccaaaaaaaaaaaaaaaaaaaaaaaattaatttcaaaattttcagcaacaaaagaatctataccatttattgagctcctttgatgccaattgctaataacattaggcacctttaaaatatctaatccttgcaaccagctccacaacacagatgtcatatccccattttacacaaaactaaactgagactcaaaggttgagaggcaaaccatgtggaacatacattgttcttatgacatcttgctatactaaactctccatcctcatatccctgagaagtcttcaagaaccatgcagatatattttcttaaaaagatgatagggaaagaagggaaagcaagggaaaattttttaaaaagggaaaagggaagaaaaggaagggaagggaatggagggtaaggccagatgacacaaagcaaaacaacacaactactctacaccagagcatctggagaaacaatagctaaaattctgtatgtttctcaccacaagccagagattatattgacatcgtgtcaccactccaatgtgtttccaaatatcttggtcattcagtcaatatattcaatgagaacttctctgcactcagaatgttgtaataggtgctgtggggaaaatacacacgcaataaaagataagttgccacccttatggcactcacaattgagctaggtcaagaatataaattcatgaaatagcaggagactttcatggtaacaccttaaggacagatatctctagcaccagctatgaagccagaaagtggaagtgcacgagttgggcaggctcttccataagccagacttctcaatctggatttgaaaagaaccaaagaataggacgtgactttgccaccaagaattaaaactgaaggttctttattgtgcatgctgcgtgtcaacagacagcccatggtagactctacttcaagaccattatgagaaataagcagttcctcctctggactctcagcaaggtagttgatcttggtcccaaacactttaccctaccaggatgcacacttcaaaccttgaaactcttggtgataatgaaacaaactaagattctaagcctgttcctctgcaaatagttctttgtcaagattctatgccaaacagtggaatagtgtctacttctgttttagtaacacagtaacaggcacctgggcaaaaatgatcacgaaaataaagtcacactccatcatcataagtgatttatggatattccattttctgaggctgccgtgtctatttctaaaaccaaggtgccagacaggacgaagatactcgaacaacaaatggctgaactgaagccttcacataagcctcaagaatttggcaaggtttatgttgatatttaaaaccccaatatcagaacagttgtataaagacataaaaggacatgtttttgttcaggtgtctgtgactgatggagtgatttcagtgattttgagacagtgttttgaaaagcacatcctgacacacatcttgaggaggattagcaatcccctgtatttcttgatgtcccacacaggcacagtatacagttctcactgactggatgactgggtgctatattccaatactcccttagagaaggtgtccaaaaagtgacacaatgtaaactttgtgtttacatatttccatataagtccattttaaaatttcaatgatttttttctgaacgagcatctgtaggtccacgtagttccataaaaggagagatttctgtttcctaatactctgtgctaaatccctgttggctccatgtatacttaaataatctggagtttattcattataaaagacttagctcactggctcactgaatacactgattttcatccaacaaacatttactgaggaactactttattataggccttgtatccagtgtttggagagatagaaaaggacctggttcccaccccactcttaggtcactcagtctaaagggctgtcagaccactaggcaattacagtgcagtgtgaagagggctaaagaagtgcaaggtgatgtgcagccatatgggcgggaggggtagaagggagagccagcagaccagcctgaattgtacctttctaaatttacctttcttgtggtaaatccacacttcagccatgtcaggaacgatggcacctttttaggtagtgagtacttgaatcaatgtgatcaaatgcttctactcctaagaagtgacaattgagtaaaccatattctttcttatatttttaactgataaaaataatgatatatactatgactttaatagaactttgaatttatttactggagtcaccttggtcaggtgacctagcctctctaaacttcaatttcctcatctgtaaaataagaataacacctatctcataggtttgttttgagggtcagtgtagaataatgcacataaagcatttacaacagtgtctagcacaaagaaagtgctcattaaatagctgaagttttaaattatgaatgccattcgtgaatctctcttcttgccttccctcctgggacatgacaatttcctattcagctcaacatcctgcactttaagctctctcaatctcagtggtatactatgttcctcaagcttgtttaagagaaagcagctgatatctggaaccaaacttctactttattcagtgaaaaaaacaaacaaacaacaacaaaaaaccactcaatgatcttctgggtatgtggtgctggtttttatttttccataggagtaatttctttttcctaatactctggctctattccttttggcttccagaaagcaagaattactctgagatgcccagaccagactagacacagacacagaaagccagtgacctatatcaactgccactaatcatcagagtgagagaacagatacttccccttttctgtcaagggcagaccaatgaattaggcactgaagcagaccaaatgtgatctggtatcttagttctgtgcaatcagctacaataaagctaagtggtctgggaaagcatggcaaagcagtaatcatccctaaagtaactagaggaataactaagtaagtgtctgctaaaatacggtctgtaccttttcaagaggtgcatgtctccatttgggcctccccaaaactcgcttaagtggatagacaaggcagcctagtaaacaacctgaaaggcctgtaatctataattttgggatggtaaacaaaggtattggtcataaggtggacttactgtgcccttttattaagcatgagaaaataatttttctataaggaactgaatttgagctcatacttaaaagttgtggctgtggctatactacagaagggaagagttaatccccaattgtgcccacatgtgcagtggcagcagaaactggcagaaagaaccctgaactagccttgagtactattcttgtctccacactctctaactgcgggctccctgccagtaactgcttttgtgaagccactaggagctgctgactggttgcatttccttgttcatccaaaagctatatttagagtgacaacccctagagatttaagggaccctgagacaggtcaagtgacgtgatcctgctctgaggaagcctctcgtgacccaagccaagggagtaaactctacaacagggagaagaaatgggagaataggaagaagtaaaagaaggagggaattcacagagtaccaatagcatgccaggactagagctaggtgctctcacttacatgaactcatttaatcttaacaattaggcaaagcaggtattatcccattgttcctattctaaaatgacaggcaacttggctaaattaaaagagtaactaaagagttgaacttagggctccacaggctacttttaagtctattaccatggtttactgcctctgcatggagcaccctctggtgggcagggggatatccagactgagtgaatgccttctccagacctttttcccaaggacactgagacctgtagtaccttcctagttaaattggccgggagcctgcctgggtatgaaagggatactgaagcagctggagatttctgggtttgcttcagaagttctaggcacttcagcgtatttaacaaaaagtttcaaggaaagtagacctccttctttgggctatgaatcctttccagagacaggatatctatttagataaatgtaagtttcaattcttccctttctcacagtcctcctctctaaaacagaattagtgagtaacacccatcttagagtgatacagcctggtagacagtgttttggaagactataactctttaactcttggaaaaggaagaaaaatatacaaccctgcaatctgcgaagttcttgcacagatataaactcattgattctcagagaattggaggtacaagtatcgtcattcccattttacaaaagctcaagtggctcagtgacttgcttaagataaaatggttaacaggacccttgcttttactaagcaatttgacctcaaaaggcatgtctttctcattaaatacaccctttctataatcatgttaaataacaaattgttcccagggtaagagaaggggagtgatataaaattaagccattatcttattccttgctatggtttgaatgtttgtggcccttccaaaattcatgttgaaatttaatccctaaagcaacaatattaggaggtggggctttagaaggtgattaggccatgaggactctgactttatgaatggataaaatataaaatataaaagggattgagggggcaacttcacctcttctgtcccttctgcctgaggaaacacagtgtttgtctcttttgtaggatgcagcaacaaggtgccatctttgaagcagagagcatccctcaccagacaccaaatctgccagcactttgattttgaacttcccagtctccagaactgtgagcaatacatttctatttatagattacccagtctctggtattatgttatagcaatacaaagggactaagacatccctgaataatatttcagtggtataaggcaaaatgttatatatatatatatatatatatatatatatatatatataacaaaggaaacagacatattattttactcaagtggaagaaaagtagtgttacacaggaaagactttatgacacaggcagcaatttatcaatttatgtgggtcttctgtgaaagataagatgtcatgaacttaagacaggaatctggcaaaggaatgaaggaaatcaagtggaggaaaaactgagaaatcctagtattgcccaactataggttccatgagaggaaacagtgaaaaacagctctggaaaaaatcaatgtggatgatcctgaatgggcaggccaggtaaagcattaggcctttattctgccaataatttggaaccctgaaaggttctgagcaagagacagaatgatccaacctatcctactctggtactattgtaaagtacagattaaaatggggagacattagaagatatgaatatctttgcctcaattcacatgagaccaaaagggggccctatcagggttccaatactaggaatgtaaaggtggggtgaaatgacataggtagaaaatggatagaactcagtgagtgactggatatgaaggctagccaggggttgaaatcaagagctataattagggtttgaacctagctgatttgaaggacaatgacagaactaagcaagacagaggagacaggaagaggaattggcagggaaggggatatggtgaattttgcacatgctgagcgtaaaaaaagttttgattgattattcagaacgagattttcagcaaattcttgataatgtatagtagatctaaaacacaggaattacgtcaaaggtggagactcaggagtcaacagcataaggaagacagaagtgaacagaatgaccaatggagagagacgagagtcaagtgcaggaacccaacagaccctcaagaaagcacactgaaagagacaaaggagtaatattaagatggacaggagaagaacatgactacaacgccacatgataaagggagtgagaaacattaagaagtagattatggccaatagtatcaaatctcagagattcaaaggaagatatgggttaggactagactattagtgaaggtcctggtggtctttgagagcaattttaacagagctatgtgggctttcaacagattgaaagaggttagagagagagagagagagagcaggaagtggaggcagggaaagtgtaggctacaacttttgggaagcagacagcctgaggcacgtagccaaccatctggttctaaactacttttccaactttatccaccattttgctccaagaaataattttctccatattgccttgtcatgtgtctatcacctggctacaccagactcattctgaatattctgttttcgcatccactctataccttcaacctctctgcccattagaagttgcacattgaggcttacacagtctgcattgtgtaagactcagatcatgtcctaatgcctcatgaatcattttccatttatttcacctatactgatttctcagatctcataaagtaactagcagaataacctggactatgcatgcttcatttccttgtgaagaatgttatactgctatttaaataatctgcatacaaagcaagggagacttaagcctccctatgaaaccgaaagtaaaacttatttgccttttacattgtagaagttcaggctctgataatggagttgggcaagaactgtagacagcctgaaggagagaatgctgaaagaaaaaagattccctcagaagttggtggaatggaaaaatacagatgtaattagttataaaaataatcagaagaaataaacacaattatacaattataaaatttgataggcataaggaaggaggtgagctaaatcttaaagtcatgtggggcaacagataatgcatgtttaccaataaagtagtttacacatatattttagtgctggaatcacaactaacagaagatctaaaaatagaagtagttaaaagtagttgagtctagatagtgagtggaagcagggaggggcagggtcagggcactttaaaaaatacataggctgttcttttaatatttgctttgtttttaacatgcatatctattactttgacaacaaaacataaataaaataattttggtatgcccgttacttcagtggtcaggttggaccacctggttcaaatattcatttttcacaaaatccagaggagtcctttgacgtgggaattttcatttgcagttcattgtgtttagcttaagcatggctaatatatggcaaatttcaatttccataaagtaagattctgttaccaacttctaactcctacttagtaagacattgataaaccctagcccagtgtacctaagaatgatatttgcttggtaatgtttaaatgccagatgatcttttccattccaactctgttcttattccaccaaagggcacactagcatgttgctttgttgtattagagttcagattttcaattgcaaaactttttctctgtctatatctgtaagtgtttaaaattcaggttttaagtcagcaacacagtcaattacaccactaagcaaactttactttccatcaataccattcgcaaaaagcctttctgtctcatttccatctctgggcattctctgcccggctgccttgtgctctttaggccactgaggttgttgaaaagtcttcatttgcaagctcttttgtgggaagtggagcttcctggttgtatcataactagaaactggcctcctgttgggctgaaatctagcatccttatgtttcctttttaattttctaaactaccctcccacctgtagcttcctagaccttttctgtttggctatttcataccctgtgccacgcaagttttatttgacacaccacagccattcagatatttgttccatgtaggttaacttgacaaaaatagagtactaagatatagaaaactaccaatgtgtccccctacccctgcctgccaccatgccataaagttattacagactgacttggattttggatccaatttcttcttgaaaataaggcagactttcctaaggttgaaaaagcatgttttaaagaaaatagaatgaaaaacaagtctacattacagcatgaaagaggaatttcaaaatgtgtttaatttaaaacatccagtatgccatttgctatagtctgaaaggtcaccggttgcttatgttttattattttgcttggttttatttttaataattttgattctggagatcctgcatttcaaatcctaaaaccagtggcaaaagcaagtaagcacctagccaaggtaaggctttaatatctgactggtagaaagagacgcaggaggaagacagcaaaacaagtcaatgtaacactgctgtttgcacaggcagctgcagaagcaaggcaagatctgcagatgtggatgtctgacctttaatccaacaagagtctcactaaggattgaaaatagatcatttcagtctagtaggaaggtttgagacagatgtgctgacagaagaagaaagtctggcattaaattgtataggtatctgctgaccagaaaaacacagcttctaagaaaagagcaaaaccatcaggtctcctaatatttttttggccacagggttgggaaatgagattgcagatgtcaatatgggactacattctcaacaatttaagatttggtttcagtcacacatcccaggtgaatgtgtcccttccaaaattcaggtattgccaatttgatactaataggagataaggcctttaagagatgattaggccacaagacctcctcctttgtaaacaggattaggttcccttatacaagggcttgacaggagtttgtctctttttgcccttctgtcttctgacctgtgaggacgcagtgtttcctgctccagaggatgctgcatcaaggcgccatcttggaagcagagagccgccctcaccaaacaactgtggcaccttgattttgcacttcccagtctccagaactgtgaaaaaataaatttttgttctttatcaagtttccagtctcaggtatttgttatagcatcacacaatggactagaacagtaaggaacacagatctagtgacatgtgataatttctatctctgaaattagtatagtttacttttctgtcccaggatgaattatatcatcaaaaaaacaatagctttaatgtaaatataactgacacttctcatattgttgtatgctaggctctgtgcaaagaccttacttcatgacctcttctcagatcaatactgaaagtaaatgaatatcattcccattttaaagacaaatgaagggttaagtaagtcaattaagagttctgcatgtccccactccaccaaaggaagaactcaaagctaaacctttcagatgataaaaccaatgctctttcaattaaaagcaaagtagattatacagtaagataaatctgaatttgcctcctagctctaccatttactagctatctaaccacaggcaagccaatttctggtagtctcactatccttctattatgtaaaatgggactattagtctacttcttgggggcattcagtaaggttaaataagataatttatcttaaacattttgcaaggtagctggtttatagtactcaataaaagactagacaaatatgtctctccaatctctttttttaaagccatcataagtatgaattgtattttagtattttaattttcaattatttcactaatattatttgtgcatatacctacgtacactacaagtgtgaaactaggacaataatgtatcaagacaaaaagagaatcaattctagagaacttagcttccaaagagatgcctagaacacagagagatgagactaatcagtgagatgcctttaaagaaaaagatgcaaagacacaaggaattggtcaagaggaaaataaggaacaaaggaacaaatacttgtcacatttttaaagaaaattaggaattcaaatccgtctgctcaatttccaataaaaattaaaaaaaaaatcaacagaaggctaagtccactctaatagttggataagaaggaaatacaaactggaaataccatttggcattacatagcaggctggagtggcaccaaaggaatcaacatgtccccaaaatatgacagtagcttgagacaaaacacaaggaaatgctggagcaagggggaataatctaggctgtgggaatgggatttgctatttccttttgaatactggaccctacttttgtaaaatgttgaatgaggactgcactctactctattctgcactttgatttccatatacctactcacgtgtcagttgctttaactgccaagagcataagccatcaattgccagggagaaaagtcaaagaagagccttttttctcctgtgtctttcagttagagtaggcataaaggaactgactgctacaattcactttctttgtctgacagagaataatgatgcttcttttctcaatgtctcttaatccttcctaactagtagagaaaggctggtgtaccatttctcactaacatgttagaaaaagtagtcccccaaattaagagaacccccatttctcaacgtcttgatgatttccagagttttttttttaactaatatacaatttttagagcagttttagatttatggaaaaattgagcagactaagtatagagttaatgtacattccatatattccctttctcttccctgccatagttttcctgtgttaacatattgcagtagtgtagcacatttgttccagttgaactgacagtcacattactaactaaagtctataatttacattagagttcactctgaattgtacagttctatgggttttgacaaatacatactgtcgtgtatccactattacagtatcatacagaataattttactgccctaaaacttccctgtgctccacctatttatcactttctcccctcaacccctgagtctcttcggccatttctatagtttgccttttccagagtgtcatacgtttgaaatcatacagtatgtagccgtttcggactggcttctttcacttaggaatattcatttaaggtttatgtcatttcattaaagttttttttaacaactctgcataacaagagttgactaagtcatagataccttagtgttgaaaagtcagcaaaattacctctgacatttaggctagaacaagcctaaagcctagcgccctcccaagatgttgcacattttccctcagtttctatttcacagcgtaacaatttcccaccaggaaaaccttcttcatatctgcactaaattgctgaaatccttttagattttagtgaggattcaataggatagaaacgttctctttttctcattcaacagacatttattaagcacttatgtgcattcaatacattgtgtgccagactttgtgctagtagccactagaggcgtaaagatgaataaaacccagtccttattcttaaaatctaaatgtctttgttccttctaatatcctttgcattcttccaattaaagcatgttttgccttgtcactctccttccagggaaactatttaatacaattactcttagttgccaaacacaccaaatcaagaattaatgccaagcatggaaagtgctaccatattaacttaactaatcgaacttccattatttcccaagtatgcttacaattgtcacaaattcatgtgacaagaatatcctttgtaagggaaggtttaaaccaaggttatgactttgctatccatctgataagacatgcatgttcctatctggtgcctgccataatcttcttcttgcaactataaagattctccagctctaacttcttgggccacatttgccctactgcaagccacatgggcaaacattctgccactccacactccataccatgaagggatggggaccctctgaagctgcccgcccctgccggggcacctcttgtagccattctcacctaccagcctaaaccatgctggccacagttgcttctctatgactctgtaccttcccggcctgactttctggaaaggaggatacttggaaagcagaattcccacagctgttttgaggtttatctgtgcttcaagtttgaaaagttaattctgaaacccaaaatctgagcattgcctattctatctttctacagataggctatagcaaaccgtaggagagaaaaaaatgaaaactttactactgcctgaaaggggaacatggtaaatttagcagaaaatatgggggaaagaagcatagttgtagtatttcaaaacatggttccattatatgagtagaaaattctaggtttatttctgctttgggttaattaaaaagtgaccttgccaaatgacggtcagttggatacctcttatcatccttcagtggtattacatggtttttcctggaactacagatctgcattacttggttggggaggagtgggtggatatatttagaaacactcaataattaaaatcactttctacttaccttctgcaaacacatcttaatgatagagtttccttcaattccattaaagcacagttttaatgaaatctgttatctcagcttcttttaaggagatatgttctcagtaattctattttaagggggctatcttttctttctaatgcttaccgagaacacacacacacacatgcacacacacacacagtttgctgtgatctctccaaaaataaattaagaagtagtaaaagaaagtgagtggagttaggcaagaaaaagcacccaagggaagctgctagctcttttcaagtcctcaggaaaacagcataaacaaatatacctttttagcagtgtaatctttaaataaccttataagagtcatgattcacttttaagaacagctccttgaacttccttcaaagttcccatggccttgctgacgtcacccttccaaggatactgaggtcatacctctagactttttctggaaatactctgcactttataggaatgattaatttatgcaaaactgcttaattaccttgtgaaaaacacatagacaggaaatagagaaatcatgcatcaacagactagcaacgtgggtcatctgcaattcttcatgttcaagacaacaacctgcttgttagtgaagggatgctgtcctaaagatttgtcagattgtgttggaacctccctgagatagcaggtgaaccctaaggggatgtggagattggagttacaggacccaaaagacagcccactggtggcagtagcagcttctggattctgtcagtgggtataatctgttaattcaatgtgtcctggcttcagcttccctttggactttgagatctgctaaaagtttatgagagaaaaaaaaagtgggtagcatttgtttttctttatatttcgtcttctaaactcccagatgtcaattggtagtagtggtagtattggcagcagcagtggtagtgccagtagtagtaatagttgtaaaaagaacagtagcaactaacattaattatgtcttataaaatgagcacataaaactcttatatcaaatctgagatatagctatttacaatgttcttctacaaaggaagaagctaaacctcaaaaggagagtgacttatctgcaatcactcacaattagtaaagggcagagacagaattcaagcccagacacttgcctctaatacccttgatgctgtgtgataatatgtaagaccataagatgaaaagccattatctcagtctctgattgaatactatacaaaagtagtttgttgcttcattcgtattctgcttataaaaatacactcaacaaatgacaccatggtgtttcacattctctccacagtattagaaaactctggcacagaagttatcaatatttaaaaaaaaatccataggagttaccatcttctattcacattcagccagatacagatttctttaacatacattattgactactaacaatgggcaaagcactatactaagtgcctccacatacatattttgatgtaaccctaatagcagataagggagattgcattatttccacttgctagatgaggcaatgtaagaaaaagaagatagtcatgaatccatttaattattaatttattcaaccaatatttgaatatctactacataccaggcaccattctaggtactggggatgcaggaatgaaaaaacagaccctgctcgaccaaggtttaattcaagggaaacacacacacacgtgcaattcaaaaagatgtcaggacatggtaagtgccatgaagaaaaactaaacaacacaagggataaatattgaggtggtggtgacagggaagcccttttacatggaaagcctctctgatgatgacagttaagcagaaacatgaagtgaaggagtagatatatgggaaaagagcactctcaccagagacacatttatcaaaaccgacttcgtgccagtactgagcttggtaccgtagatataatgattaatgaggcacggtcttgacctaccaggagcttttggtctatttgtgaagacatatataaatacattattatagtatgatccatacacgttcagggcattatgagcagggccaggactaggacaaggcaagcaaacaacttcattttaaaagcagacaacaccaggatggctgatttttgtcttgtgcctcaggttctagtatggctctgcatggcactgattataagtacatacaggaaaggtttcttaccctcttcctggggaccggtggtcctggaactgattacatatgagctgagccttaactgatagtagcagctaaattcagtgccttgtcagagtcacagagcccaggaagtgtacaacaaggcttcaaaatacacatttctatattaaagatcatggctatatctacctgatcagcatttcctgaagtatgtttgctgtgtttgcagagcagtgaatccacaggatattaataagtattactggaaaaactggtttggtgatcaaataagcttgagaacattcagcatataagaattttaaccggcttctttattgaagaacttttcagagacttcgtaagcaaacaatacccaccactgagagaagcatttcttccttcacaaggacaacagagaagcaaagtgcaaccaaacaacaataatgcaactattgtttattgtgtgtattacaggccagcactttacacatacatatatacatgcaaagtacaaactatgcaatatatgtgtgtgtgtgtgtatatatatatatatacacacatacacacacacacacatatatatatatatacacatatatatgtatacgtgtgtgtacgtgtgatttcatctttataataaccctggaagatacttgttattatttccattttgcagttgagaaaaactgaaggatttaaagactctaacaattagcctgaagttatgcagtttatatgtagcagacccaaaggctttgactccaaagtttgtgttttcttagacactatactgccactctggagtctaggtaatattcagagactgcacaaaagctggcgaaagtacctctggtggattcacgaatttgaataataaaccagaacagtattaattccaaatgatttgggaaacaagcctatagaaccaaatgaactatgaagatgctgaagtttgcaaagtcgattttggtttggttgttttctgagccccgtgtgtatccacctatcttgcaggtttctggtaattatgaaaaacataccattttccgagtttttttttccgtagataatactgttttactcatttttttttcattcaactgagagtgtatgcaacgatcctctgtatattctgaacccaacaaggcaaggatcttgggttatgtcagccttgccttccaaccacatgaccggttggggttgtcctttctatagccacaaacacttaacccagtcaaatttcttccatgatcaaaggggctgacttacgagcaggaacttcatgagcaaaatgcataaaaatataagatgaatatcaaagggagacccaggtggcagattccctgtgttatttttagttagaccaccaaaacctttttgtcttcataaacagaacctatctggattcagccttattcctttggagaagctgattaaataagaaaggaattttgccactaataggcaatgcccaacaaaaatgaggctcttgtggctcatctcaaaaggaaaagctacaagaaagcactgaatttgcaaagaagtgaacctcataaattgtgcacaaaaaggttttgaagattcagataaaaagctcagttccagcatgaccatctgttatgtccccctaaaagaagataactagtagtttataaaagcaataaaacagttccagagctcaaaggcaatagtaaggacttccagttacaaatcagggaacatgcagactgatatccaactgagcgtgcttccattaccccccgcactgcctctccagtcagaaacaaagattctctagttactggtgtctgatctactcgttttctccctcaaagggattatgattgggcatcaaagctgctgtccctctttccttctgttgatgtgcactgcttaattttttttatctggctaccttttccatacacatatatcatctttgacctcttccatctcactctgcctcagcctcttccaagtcttatccacttttcttagctctccacccccaccccaccatttgattgagtagtgagccaagactggaatcatatccggactagtcagtatgagaagtcaatgatatacctggtcaaaaagaagaaagtttaaccataaaccagataaatcaactcctgaaactgaaataaaaggctcccatagtttctcccctcaagcctccttcccagcttcttaatcgagctttgcagtcaagagtttgggcaaaggcttgtgctgcctggaccgtaatcttggctgtgcactttctggatatctgaccatgggtgaattacttgacctttaaatccctcaatttcctcattggtaaattgtgcacaggattaaatgaaataacttatttaaagtgtataacacaatgcctcacaaatttttaagtccacaattaatgttactcatcattatcagcagcaacagcagctacatctttctccaattaaactgttatttttttgctcttaccctccttttgtagtaattactgactgcaactatatttttcctattcttttattacaaacacacactaaaattacttaaataatcataggagcctagctttggccaatgataatgttagaggaggtgaagccaggggaagacccaggctacctggtgggtacccagttcagggcctgacgttcagatcacaggctctgctcgaggtctgattttgtcagcttgctaagaatggacccatctctcaaggggtacatttgaattaatcaaactcaggaaacatttatagaactgcaacacctatcttttaatttacaataataaacataattatgacagagctgtaatacttgtggcaacaaaaccagagaaatgtctccctgtagatctatataagaagcccaattttaaccagaagttattaggcgagtatgcaaataaaacaagagagttagctgattttagctatactccctaaaacaggctgatgcatctattttccagagagacagatctttcagcagtcattggctaaagctccctctacaatatgtagtaccacctggggatgctgccagtggttgttcaaggggctaatttctcagttcttccagggctaagaactgagtttcccttctttgagtaacattcttataggccccaaagctattttgcttcttaaaggtaactttgcatatctctgttctgatcaattttatactaattttatagttgcactccctagggggtattttttttcccttacacataagctcttgggttgaacctcaacatactaacagcatttactatttccattactttgcagggaaaataggtatgtgggaagatgggggctactgaaggtccagttatgtatcatattactttccagaaaaattagcttcaagttccaagtaaataactttacaaatgtatctgacacttgctcccacaccctccatctctattaataaactagccttatgctaacttcatttttaagctaaagagtttctatttctaacatacctcttctcaatgataaagaggtcattataatttttggcataaatgtggcaaaaagaaaatggtgacacttgtaccacctacatgatctgcaaaccacagttaagagttgttaataacatgagaaatttttgaatttaaagggttaagtgaaaggaatcaagattaaaagtcatatattcagaatacgggcagtataccatagaattcatccttgctccgaaacttactgcctggggcagatgccttactctgctgtgtctaatcagataagccagtgatgtatctttttgcttcagtttcttcatctgggaaatgggaagaccgtgcctacatcatagattgtaatgaggatgaaatgagttaatatcggtgaagtatttagaacagggactaacacataataatcactcaataactgttagctctttatcatctccactacaaaaatacaattaaaaaactagggagaatatatccaaacattattatctacctctgaaaagggctttcttcctctttatagtgtcctgtgctttctccaaattttgtctaacgcccatatactactcagataataaaaaaaataaactttttcaaaaaattagctcagttggtaacttttaacctgaaataatgtttgccaaaagcccctttaatgatgccactctagattcataactgcatcacttttctactgctgccgtaactacttaccacaaacacagtggcttaaaatgatacaaacgcatcatcttacagttccacaggtctgaagcctaacacaggtctccgtgtgctacgatcaaggtatgagtagggctacgttcctttgtggagacaggagaccactgagttgcactgcctaaaatagtagctgtagccatacatagcgatttcaactaattacaattgaataatattacaacttcagctcttccatcactctggccacatttcgagctcggtcgccacgtgtggccagtggcttctgcatgggacagcacagatgcaaaacactcccatcactgcgcaaagtatggacagtgctgagctagagatgtgactcatatggacttactcactggcgttcttgtgctttaggcatcttttcagatacaaatgggctcaagtcaatctcctgtttaaaattcttctctggtgtctattgcttataacattttcccaacattttagagctatataattcaaaccaaatcttatatatacatcataaaatgtagctgctgtcattataactctagtaggtgcttcaagacctccattagcctcattccgctgtaaatatctgagcactttgatactatctgtctaaagacaaagtgaaactccttagcatggcataaaaaactgttcttcatctagtccccgccccttcgctcttccccagagaccactccactattccctttcacccttctgtaacttcatacatgaaatcccctctactgcaatgtctttctctctttcctttttctttcttttctttttttttttttttttgagaccaagtctcactcttgtcactcaggctggagtgcagtggtgcaatctcggctcactgcaacctccgcctcccgggttcaagcaatttttgtgcctcatcctcctgaatagctgggactacaggcatgtgccaccatgcccagataatttttgtatttttagtagagacggggtttcaccatattggctgggctggtctcgaactcctgaccttaagtgatctgcccactttggcctcccaaagtactgggattacaggcatgagccactgcgcctggcctctttctctcttttctacctacaaaactcctcctcagccttcaacctctaactccatgttcgccatggggagaagcctcctgatggagaattttcactcaggccaggtgttctcatacatattgagagcaatcacatggatagacctttaaggacttttctgtgaatccccaaaattgtatgcataatttcatgtgtaggtacatttagaaggtacatgctctctggtttttctacagttattaactggccagtgaccccaaaagtttaggaacagtgctagagaaatttcagggttcaaacaggagtcctttcagcactttatgatccctcttttaatctgtttccaaacatacctttttatttttaaatttccttacacaaatacagtcatgtactgcataatgatgctttggtcaataatggactgaatgtaaaatggtggtcccataagattataataccgtatttttactgtgccttttctatcttgagatatctttagatacacaaatacttaccattgtgtcataaatgcttacagtattgaatacagtaacatgctgtacaggtttgtaacctaggatcaacaggctataccatagaggctaggtatgtagtaggtgtataccgtctagctttgtgtaaggacactccatgatattcgcacaatgatgaaactgcctcatgatgcatttctcagaatgtatccctgtctttaagtgacacaggactgtgtatatagtcaattctgcagtcttgtcttcaggttagaagcatatgccccattctggttcattctctcatgacatagaacgccaggttctccaacatatgctctctacaagaaaaaaaaaaaaagaaagaaaaggtaaggcagtgcacattactgaactaggaaaatatctctaccattattaattcaactttgtatattttagaagacaatactaacagcaattacagaggtcttcacgtgccaggtacagtgctaagtggtttacatatagtatcttaattaagcctcaaatcccttgagaagtattatctcaatttttacagatgagaaaacaggcttaagttacacagctagtaaatggaacactgggattcgagcccaggccatccaataagtgggtattaaattcactgcattcttgtagtgttcttagttctacctgaataatcactgtaaaggatctctcttaaagtgatatttgtggctgtctaaacttaaagatcccaaggaaaagcgtgaagatgttaggtgaaatgttaaaatcattcccttttaaaatggagacaaaggatagcattatacagtgactatatgttagataaaaacatatcatgaatctacaaataaggctgtcactcaccgactatatttctctagggaagttccttaaactctcagtgcacagtttcctgatatgcataatgggggccataaaaatatttggttcttgaaaataaataacataggtatgatggttaattttaggtgtctacttgactgggctaagggatgtccggatagctggtaaaacattattttggggtgtgtctgtgagggtgtttttgggaggtattagcatttgaatgggcagactgagtaagatcactctcaccaatgtgggtgtgcatcttccaatcctttgagggcccaagtagaacaaaaaagcagaggaaggatgaatttgctatctttagttggcttgtgacatcaatcttctgcccttgcatactggcattcctggttctggggcctttggactcagactgaatcacactactggcttcccttgtcctctagcctgccaatggcaaactgtaggacttttcagcctccagaattgtgtgagccaattcctataatcaatttcctcatagacagatagatggataggcaggcagacagacagacagagcctactgtgtttctctagagaaccctaatgcaatgatgaaatacatgttagtaatggtcattactgttgctggaaaacaggtttgaggtggaagaatattctttctgatttattggccttcctaagtgagctaagattactgagctgaaggttgttaagactacctgctcttctgcttttgtctaagaaggaaatgaatcagagaaataagactcctgcttcatatgtaagagttttatggggtagtgaccagtgataaatgtgttattctctaactatcaggagttggagcgaagcaggcagatgagaccattaaaaatatgagcccctaaacacattggggctactgcagctggctttatatccagctcatcagaatgacatcttagatctagccctgctcctccagatctctccaggactgggtgcacaaagccaaccaaatgaactctggtccacaaagagacactaacattatgtctgttataaccacatctgctccaggaaatatttcatgacccataaaagtcctctatcttggtggccaggaagggaaaatgcaatggctaagtgatgaatttctcttttggtttgcggccacgtcttagtttggctgctataacatgcatttataattctggagtctggaagtcctagatcagggtatgaggttcttggtgagggttgttttcctggtttaaagatggcccctctttattgctgtactctcacatgacgtaggtgtggagatacacagacacagacacacatacacacacacacacacacacacaccgagacagagagagagagagagagagagagagagagagagacagaaagtacatgagctctggcctctttatctttttgtaaaggtattaatcccattcatgaggcctctgacctcatggcctaattacctcccaaaggccacaccgctgaacacattgagaacttaggcttcaacatactaattttgaaaggtacaaacattcagtccacagcaagccatgaaaccaaaaatgctcttatattctggttttacatgtagagtattaaagagagcttcatgcagatgaacctcacaggataacagaagttgaagtgtgtggttttaacttgtaaagttattccatacagggtattttacaatttttgagttaacgcaaggctatcctataattttcaatgaagaattttgcatacttctattaatgcttgacattctaaagccatgaaacacactttccgttcctccacagtctccccagctgtctacttgctgtcccttaaacatactgaacccattcctgactcctagatttagctccttagtgttccattctccatgtggaacacttttatctctgcatattcaaacttatctaaccttcacattttgtcccaagccccatcttatatttagatgttaagacttctccaattcctgccatctctagtcaccttgcttacaactgtgtatattccacagtgaattaatgtactctatgtgccaggaagtgtgctgggcactggagatgcagcagtgaacaaaacagatgagtggtaaacaaggcagaggaacaatcagacaaaaattaaaattatatttctatagtaaaaggtaatatggcaagattaccaagacggacttcagaatgagaagagatctcaccaggttttctgagacctagggtgatgctagattgggtcagacctcactgtgagctgtcctgggaaagaatcaaggtttgagactagtagttaccaccacccaatgaagtgtagatagaaataaaccaccagtacacacacagtttattgtggataagtctggagttatgcaaagcctatcctctcctctcaagatttagcgtactgtaccattaatgacacacttctttgcctcctttataaaatgaacaggtctttttaagttctggtagttatcgctctttcaaaatatcatatcaatgctatctttcttcaagcagcataaagtgaattttgaagtgttttattctgatgatgtcccttgaaagatatccacttgttaagtatctctcatgtaattttcagtctaaagtccatcatctgtagacagaagtgaggacagcacagttggaaagaggcctaaagctgttattttaaacaaatagctagttacaagtgctggtgagggagagcttttccatttctcttttcatacacagactagcttgtcactgcagcatttgtgtccctcatctgatcagctagaggggtgtccagaaatcccctagctacaatagccacttgcaaactccagatacatcaaaacaatgattaataaaatatatctataagcgtgtttacagtcacagggggttaagagggaaatgaaatagcagctattgcaaactcctttcccctggaattcataatttatttaccttgtctgtcctgttcccggtgtggctacaatcaattgcattccatgtcaactcctagtaccacagtctactgtgcctgcatttctagctgtacacactaaaaattctatgaacactttcaagaaaatatcaacatctacatattagttatccaggtgaaatataattgctactagaaaacgatctggggggcctattcttccctgtagaagtgtccttagagagaagtatattaatcagggtaggctaagtgaggaaagaaccccaaaacctcaatgacttaatataatcaacaattatttctcatctatgccaaatgtaatgtggatattcctggtctggctgttctcctaaacacaaactaggggatccaggttccttccaacttttactgtttgcaactgcaacataacataccactattttcatgcaataatatgagtgtaggcatggcctaccaaaaatttaaccacctcttccaaagtaacacataataatttaggttcacattaaataagccagaaatagccaaaggcctcacctagattcaagagccttgggaaatgtaaacccggcaaaatggcattcaacctcctggaaagggaatgccacgttgccggtgatcagctagccatctctgttctgaggacctaatgtagacatattttttaaaaacacacacacacacatgatctaccaatctcaactcttaccaatcctccaggagattatcaatgcctggctcctaagtcctcacagtgatacagtcccggtttaaagacaggggcttaggaggccaacaaacctagattcaaattctaacccatcacctagcagtggtgtgaccttgtgcagatagcatatcccttctctgcttcacctcaacaatggagataaccctcatattttattcacagggttgttgtgaaaattaaatgatggggcgtctcaataaagatacccccaaaatgagaacaaaagctgtttaattagaacttgatgtaacaaggagtcagccactgtcacttgcatttgccagagtcaaggtcaggcagggaatgagaaaactttataatgaaaaaagggaaggcttcaggtatgctttgattggaggctgctggcatggggaagctagatgggctaaccaggaccagacatcttaagtgattggcttgcgaagcatattggactttctctgcttgatcctgagtggtaactggcaaaaattaggggagcagagggtcactaaccaagtcctgataataatgggctgatgctacagaagttgtggtgtggtgccccgggttggtggctgtgcagttcctgagtcacttgtcacacatggtctggcctttgcccctttgcttgctcagtctctcatgagccattattttttccaaattggatggtgggtctactcttctttcacagacaaaggtgatcttcccagttctccactcctatggaagaactttaatcagaatttttatgttcttaggcccttgtgttaagggatgagaggcagggaaaatacaagacaatagctttaaattctgtgctgtctggcaaagccaggtctaccactaagctacactgcatagagcaaatctctccatagccaggtgaagccactattaaagagcaatagtgtgttctacagtgctgtgaatgaatgggctttccaggatgctggagagctgagggcagagaaacagtgctcagaaatgcctacacactgattgccatttcccccaggtgaggatggaatgctctgacctgagtttggctcaacaaccagcagagcctaaagtttgcaaatatctccttgaagaattaagtacagagattttattgagtgtgtagattcgttatgaatggtgagcaaaggcacaatataaagtgactctgacccagcacaaacttaagcttcttggatcctgcaagaccttaccttacatggataatgttaccagcagctacatgcccccacctcacccattacagactctggggcccaggtgaagcggcaggaagatattctgcagctgcttttgctgtgtgttgtcatatcgcttctgctaagtttctgtatccttgactaagcctcacacagcatgtgtgtgtgtgtgtgtgtgtgtgtatacatgcacacttgcactccagggtttggatggttttcatcattaaaacatagaccacttgaaattatgtaggtgtcctgggtcagaccacaggtggtggccagtctcagccacaagcctcaaaagagacatgtagcacatttgaagaaagcaaccaggacaaagagagacttaaataaatgacacatgagaatgaatagttgaagaatgaaaggaaggaaggaactaggggatgttaaacctggaaaaactgattcctgctaatagcaccatccaaaaattcaatgtgttttccctggattggcaggaggtaaactagctaagtctctatcccgggacacatttgaacaaatgtaacaatactatgtttgaaatgttcattgactccttctgtccacctctaagacttttcttttccctcgtagcccttgattctttacaagcagccaagatgcctgtcctcattgcctctgggaagggatgaacacaaagcagaggaaaatggagcccttttttatatttgtattccaaagtctagactccagggaatgagaacgggaaaaaaaaatctcccactatactagaaaccaaaaccatgctctgaggcagaaggtggagacagacttagaggtttttgaactcagagtctgtgaagctcaggatgacagcatttacctggagagaccctgtaggcaagaaccaagtcaacatttgcagatggtccaaatttccctggaacaaggtccatacacactgcctgtgcctcagggtgctgcattctgcctgcttcagtattttaagtacacggatgcctgcccgggaggcaagaagcatgtgaggggcaagacttcgcacagcccctggaagactcatctcctgaggggaactcactcccactacagcctcacaacagtccagatgtttagacttcagagattaaagggcggagagtggaatgctaagcacctagcaagatgaatttggtgataaaaggcctaactactacgctttggcagagttgaagagaccaaccccacatccccctgagccaggaaagtagaaaattacacacagactgaatgatcacttggcatggggttatgtaaaggaaatcaaattaggagtctgtgatagttggggttctccagagaaacagaaccaatagggcgtgtgtgtgtgtgtgtgtgtgtgtgtgtttgtgtgtgtaaagggacttatcataaagaacttgctcatgtgattatgaatgctgaaaagtcctaacagctgcagggtgagttggcaagctcagagacccagaggaaatgggatatagttacagtctcagttccaaggcctgtgaatcagaagagctgatggtgtagtcccagttggaaggtcagcaggttcaagactcaggaagagccgatgtttcagttcaagtccaaaggcagaaaaaagccaacatgttagttctaacgcagtcaagcaggaggaagtctctcttacttgggggagggtcagacttttttgttctagaagctctcaactgcttggatgaggcccgtctacattagaggacaatctgctttattcagtctatcaattcaaatactaatctcctccagaaatatcctcacagacacacccagagtaatgtttggccaactttctgggtactctgtggcctagtcaagttgacttgcaaaattaaccatcaacagggtctcaatgggatgatgatgaagacctttccaaacatagatctacggtgtttaatcaggaggggatacaggcatccagaacttggaaaaaaagaaaatgcactggggaatttgttgaggcttatgatgtttgccttatcttgctgatgtttctttctaggaatatttcagtgtagccagtctgtgttcatcttcagtggagcatccagctatggcataagtgctttgcacagttttgtagttaaatccatgttatttatccagcataaaaccaattttttagagacataaatagcaaaaattttccaaggctataaaaattgttcttccaactttccggataacctgatcttctggacccagtcaagtcagtacaacgtggtgattaaaatcacatgttctagaatatacaggcccagattcaaaccctggctctgccaagacattcacaatgaacttcagcaagttatttaaaatctttgaacctcagtttccatatctacaaatgtgaagatagtgactctgcttacacttattacatcagaggatgccagtaaataacttagccctgtatttgccacagcccaaatgcttaagatgtattagaagtggttataataacttggatggagttctttaaaatgtgctgccggcattgccctgacaacttttaaaaacacttcctctacttatcctttctcttcctcttgcatcccataacttaactatccataacaactaccactgattttcaaggttagcagatagatttctggctgaaatactggaggataatttctccagaaaccaaggaagccatttacgaagggcaggtatttgacttgcatgccagaaaggtggaaaccagagaacaaagataaataatcctatttcctccttcaaattaaagctttgtgtgcatgcatgtgcaccagaaaatactgacttaatcagaagcattcaactaagattagaaagagtaaaatacagcctcagaactgagggaagcacagtaaacaagcagttatttctacaaaatccaacctcatgacaatgctcagtatcactgatatgtggatatgagcaattccagaaagtagaataatcgcaccatttgacaataatgtaaatgctatctcctttactatgttgctttacctctggctgtgagtccggaattttccagagagaagacactcaagaaagatgttgccttgactacttttaaagatagatttctagatgcaaatgtatttctagatgcaaattttcagtcacataaaaaaaaaaaccagcaggtcagctatagtcttgttattattttaaactacactggtttcaaccaatggtttcaagaggtagatgactttgaaaggatagtttctttagagaaagtttcacagacattatcagtcaagggagataccacatgactgaatcgtcattatcccatatggaaagagtacctttctgcacaagatatttgtcaacaattatctctaatatatatgaaagatctttctattttgataggattttttgtatatatatatttctattaaatacatatggtgaaattttatccatagtaaaagaaaattcctatcctctcctggtaagaaattatgtcaaaatgagaatgtgtcattagtcttcaggaaggccaaattaaagctcactgcgatactccaacacacacattagaatgataaagttgaaacaaaacaaaacaaaacaaaacaaaaactctgactatacaaagcactggaaaggacatgcaggaaatggaactctcacgtgcttgtgatagaaatacgaaagggtacaaccactttggaaaactatttgctgccgggtgtggtgactcatgcctgtaatctcagcactttgaaaggccaaggtggggggatcacctgaggtcaggagtttgagaacagcctggccaatatggcaaaatcctatttctactaaaaatacacacacaaaaaaattagcttggtgtggtggtgtgtgcctttagtcccagctactcgggaggctgaggcaggaggatctcttgaatccaggagatggaggttgcagtgagctgaaattgtgccactgtactccagcctgggtgacagagcaagactccatctcaaaacaaaacaaaacaaaacaaaaactatatggcagtttcttacaatattaaacatacaactgccatataacccaagtattccactcctaggaatttagggaagagaaacaaatatatatgttcacatgcagacgtcacatgaatgtacacagcagctttatctgtaatggcaaaaaactaggaacaacccaaatcaacatgaaataaacgggtaaacaaattgtggcacatccatacaatgaagtggtactctgctacaaaaaggaacaaattattgatacatgcaaaatggataaatctcaaaatcattacaccatgtgaaagaagttatatgaaaaaagagtatatatagtatttttccatttatataaaattgtagaaaattgaaacattaatttacagtggcaggaagcggatcagagatgctgtctggaaaggttttggaggaaggaatggattccaaataggcacaaggaaattttgagggatggtggtgatgttcatagcagctttatttgtaatggcaaaaaactaggaacaacccaaatcaacatcaaacgaatggataaacaaattggtgatatagataaagatggtggtgctatagatgtttgttttctagatgtagtgatggtttcatagacggattcacaggtcaaatctgaattgtacattttaaatgtgcgtagtttattgtacctcatttagctatcaagcataaaaacaaaaaacatctcctttgtgaatttctcttcctgtctcttattttgctccatatatatatatgtatgtatacgtgtgtgcgtatatatatataaatatatatgacacccactaacagcgtcttcatttccccttgaggaatatgctttcctgattctcactccttcaattcctgcattgtggcaagcaggaaagccatgtgattcagtcttggtgagaggaggatatccttttagccagtgtgatagttaagagacaaggtgtaccctaacctgggccaatgagatcagactaggaagtcctgaattaggacttctcttcagatcgcagagaaagagcctgacgtaaagtgtgaaaatgtaagcatggagctgcaggcggacatctggctccaccaagggaaagcctgcctaaaatggagccaacacagaggagagatggcacgatactgtgtgagctgctgagttcacatgtgcctgaaggcagacctatctctgtactttcagttttgtggccaatacatttcacttctcattaagccaatctcagctgggttttttgtcacttgccattatctcttctcctcctggccaaagaatgacgtgtgatgtccacgggaaagtattacatatttggtagttttcccaccagtgaaaaattgatgggaatgcttaagtgattttaaaaacccactagttagctcttctaaaattacggatggtggtaaatgaatagacaatttgacaagccagaggatgctcatggtatggtcccctctactcaatgtatctcaagataatcctagacaagatgaacacaagaagcaaaataactcttactagctgtgtgactttaggcaagttgtttaaccagagtctcagtttcctcattttaagagaaggctaatggcagtatctacttcttgggtttttaggacagttacattaaaccatgtacatgaagtccccgccctaaggtaagtcctcaataaatatttgttgtattactctttctaagacactagtaatctttacctatactaaaaagccccagtggttctcccttctcttaacaaaaatcttatgcattcttcaagtcccaccacctcctccaggaaaatctcccttgattacttcaatacacaatgtagtgatttctttttttctggatttccaaaccatttgctacaaatgtgtgtctgatacccttatcttattttgtcataaactgaatttccagtcctaggctggagccagttcacattagatctttggagttaattatcaaattttcagaaattttgagagatagttgctaaatatcccattatttaaaaattaaattacagaaaattatgattaaataagttatattaaaaacgaaggcaatacccaaaacataatgctttccactatttgtataacatttatgatattttgctattatctatgctcttgaaattatgtctgttatatatgtatagaggacactataaaatggagtgttactttacctctctttctgaattcagtgtcatcatgttggcaacctgaaacttgcaattggtcatggcaggagaattcacaccttagaaatcagcaaatgctgcaaatcaggattccacatccctgcttttctttgagacgcggtctcactctgtccccaggctggagtgcagtagtgtgatctccgctcactgcaagctccacctcctgggttcaagctcttctcctgtctcaacgtcccgagtagatggattacaggtgcatgccaccaagcccagctcatttttgtattttttagtagagacggagtttcaccacattaactaggctggtctcgaactcctaacttcaagtgatctgcccacctcggactcccaatgtactgggattacaggtgtgagccactatgcccagcctccacacccctactttctggtgccagttgttaaacatttacaggtacaccactgattttagcttttgcacattttaaattgttccactaggttcattagctctttgatcataggaatgctacacatttgtctttgccctctgtgttgttcaacatatacagtgggtgctcaacattttgccacttgataggagcctataaagaagcaaccatttcacaaagacagctttgctatgtgcttttaatctatctgaccttatgcagttaaaaatacctccacgcacacacaaaaaccttgcaggtctatcactgtttgagttgtaaacaatggggaaaatgccaaacatgaaaacagagtgaaaatattacaatgggatagtcgaagtgaatgcatactgacacatccttaccccctaacaaaaagctaagatcagtcgaattcatgtcacagggaactggtccaaaaaatcagcaatgtttcacctagagaaaagaaaaatgtaggtggcacagagggcaataaaaaagtatcttcaaatagctgaaaggctattacaaaaaaaaaaaagactaggtatgttctgtattgcactagacaataacaacaccagaatcaatgtttagatgttacagagagatacatctttatataatgaggaagaactgtcctacaaagatggcccaaggtccaatagtcaacctcaggaagtaggcaaattcctgctccagtagtactcaagtacaaggtgtggcatatagtagcaatttaacatttttacatgaatgaatgagtgaataggctggcagtgtttctcaaccgggactactaattcttcctaaaaggtgtttggaaatgcactgaggcacatagtgagaagcaaagatgttaaacaatgcagtgaaggatgtccccacacaagaaattaccaccacacaaaatgccaacagcatctctcttgagaaatattgagaaatactgagctagacaaatcctggagggaatgttttaaagatcaacattcaatcatgaagtaagtgtttattgagtgactggcaagtttcaagcacattgctaaaactttagggttaaaaggctgcacaagatagtttcttcttacaagaggctcgagactaatgggagagaaaaagtaaccagtttcaagagagtgaaaaatggctaatctagaaatctgaacaggcacggataggacagagggctcctctaactattggggtgtggggcagttcaaaggatagggaggcctctcagaggccttgaagttgggttttgtagaatacgtacaggaatttgccaagatggagtaagaaattccagagagagaaaacagtagggggttaaggaacagaagtgtgagaaaacatggtgctagaggtctgagaaagcaatccatgtagaaaagaattacttttgtcatacttacatttgggtaactggtatattttgtaaacactcccacacagagcatattatgagaacctaagcactgtttgagtgaaacttgagtatgggcactgctgaaaaaggagactggggagttgaggacatgttctttgcaaccctgggaatctgactttttagaggagaggggaagagttatgtctgggttaccataggatgagcagagaccaaggccctcatcttacaccactctcctccttctccctgctcactctgctccagcaacatgggcttgctttctgctgcttgagctcagagctaagcttattctcccaacaaagtatttgcatgtgctcttccctctccgtagaacactccttcccagccttgagatctcatttcagtagcacctcctcaaagaggccttctcttgtccacccaatctaaaatagcatcaactgaaatgttcacattctttcacttgattattgcttgtcttcacaactagagtgcaagttccatgaaagcaagactgccaaggccttgttacttgtatagtccagaactatgggtaccactagaccatttattcacacctggccatttcatcctatgacagataaggagaaaatggaccagaggagaacacacatgggatggttaggagactccacaccacagtctatgaagaagaagctactgtctggtccacctaaaaacctgaatgagaatagaaaaaacttggaaaccatgtgctttgggagaaaactgcagggcctgggatattcagccccagtaaaaagtactctcagatggtgcatcctcttttcatatgtctggaggtatcatgtggaaggaggactggaactgctctggatgacacaccaggtgaaagaccacaaggtagaagacaagtgagaaagtaagatttcagctccacatgaggaagaacagtaacaggcaaagtgacagtcgaaagttcacaagggcatttcagaaggttccaggttcccatcagcagaactgtttaagcagaagctggctaaccaatccaatagggttgaaaagctcaagccttaggttacagagcagacaaaataactaacatttgtatgtcactaactgcatgccgggagcaatcttcgaggtgcacgacaaatatgaactcatttaatccttacaacaacctgagaaggcaggtgcttctgtcatcattttacagcacagactaagacacagaagtcaaataacctgaccgagttcaccttgccaggaaatggcagagccagctttttaaatgacctttaatgtgtcctctaaatttcacagtaatttttttatgcctccactagcaatgagttgctatcctatttttatcatctccagggaaaaagctttccaaaatgtccaagtgtgactgtccagcaccatgggggctcagagtgtaggtggcacataacactgtacttcagtacttgcatagaacagtcattctgaaaagctgtgctgaatgagggacacagcccttggtgtagcacatatttctttatttttattgtctatatccccataaccttcagatccacaaggaaaaggattttttctgttatcgttgactgctatgttcccaagtgttaaataaatatttgttgaaaatagaaaagaaaggaaagaagagaaggaggaacaaagtcggtatcttcaaggattctccaccttggactcggcacattagcttctatgcgggccttttcatttgaacgtatcaagagaaaaaccactaggagcccagatctcagacaaactaaacatgtagcttttgtggttttcaagagaatccattgcaaacagtttggtttctaggttaaaagaaaaacaaaaacaagcatttttcaagcaaggtagctgaagcacagataaaagtttagagtacatctctgggttgctgtcaaaatccctttctgattaaatgtaataaaagagagtcaatactaaaatgttaataaaatgatgtttttcccctagtcgctagcatctaataaaggtgttttgatcctatttatgaaataaattatattacttagtacccaaaggtgtgattttgtctgtgggaggtaatcatattctaatttaatgacagagaggaaaaatcatgcatgactaaaatagctgtaacacaggctatccagctttaagaagacttacatcttgaaaggggctacagacatgccaatgcttgttaaagtattaaaattaacatgtttaaattttttcatttactatatattcagtgtgccttcttccagatcccataagcccacactatctttctcatgcatatttaatctttttttccctgggaagtcaactccacaaccacccctccagaaaaagaactgtaaacaaggctgaagggaaaagtgagacagggagatgaggcgagagcaatgcaaaaggacagatggctaagaaaagcagagcatcctagagtcaccctcaaaggaagagagagacaattagaaccagaagggagcagattcatttcggaggcatttaaggctctaatatcttccccaagcggagaaatgggttctattttgaggcaaaggggaggcttatgaatactttataatgtttgcattagacagcctatgtcagcatgaatagattgcatcctttgggtgagtaagccactccctggtcagtggttagaaattttaaatgtctttcctgaagcaaacttcctgggagcagttgagtcaccaactaaggtgatttagaggcagacagaaaacctttaatggaggaataatgaactactctgcatgcatccattaggccccaagagtataggaggcctcccaacagggttcagcagaaaaccattagtgcagccacattttgaactgtatgaagacaactggggaagaacctaaagcgtaaactctctcttcagccacaccaacatcattttctaccttaagctgggatggcatgactggtatgtgatttcgtaagaaaaaaggggtcagtatgatttattaaaattctaatcattcaatcaaaatttctggtgagaattcccttgtctaatacttgggcaaccataactaaggccatcctgctgtccaagcacatttttgtttcaagtgagtaaggcaagtgctgtgcctgagttatataggaaatacatgctttcctataagattgctaagggctaactaaattctaggcctaattaatttcattaaaatgacacttggtttgaaaaatattttagtttcacttctctcagaagtagatcaagaggtggatattagaatgcaagtgggaggtgatttggggcaactcctgcaaaaacatgagacaggaaaaaggaagtgagctaataaaaggttcattgtcaataaattaccacaatgggcaagtggcgcttaatctcactggggaattctaggaagcagcatggaaaatgtgcctcaaaacttaacccgcctgagagaggaagtatagtcatataccagctccccattatgggatgctgggggtgggaaaaaggccttaattgtccagcactttccaacctgctgcctgcctgagggtggaagagtgggtggtggttgagggagaaagccgagtgggtttcagcagccacggaaagcacgtaaggagaaagaagctggtgcttgcaccagaggtcaagcccagtgtgcactgaaatggcaggggtctagggcagcaagagcaactgctgctgcaggaagaaaagtcaaaaaggaagcaagcgccagtggactatagcgaactagaaaacatgggctttcagtgtcgcttgtagatactaacattcgttacaggcttcaatccaaccaaaaaaagttactcatatacccccagcagctgcagccacacaaccactaccaccacccagtgcccagaatgcttaggtggaagacaaagctggattgctctgcttaataaggggtgtggaacttaaagtgccctaagagaatcaaggaaagaggacagatgcctaggagcctgggtactgtgtgaaagttgaggaagaaaaaaaaaaaatcaccacccctactctccattctgctctaggaagaatagctatgtagaaaagactggagaaaagaaatctgtaacagacgatttttcatagtttcttgtttcttaatgtgagacacacatatgcacatacaataaacttcctctcccctctattcttaaaaaccttcagtgcaaactacattatccactaacactttggtaggaggtgattctagagtcactccgaaggttgccatgccctacatctgaggtgggcattgacaaggggacagtgcacttcctagctatatccctgttcagagcactttctaacataccagagctccacaacaagtcactcgttcgctgattcagtctcagatgtacattttggtgtttcccccaccgagatcccccattagatgttttaaaaattgagaccaacatgaaactctgacttctggggtaaaaactcccagcagttttaatatattgggataaccacatagctcttatcagttaaagagtatgtattaagattgccacaatccccaccactctttttgtttcccatacattacacttgcactgatttttcccaggaaatcctagcaaaaacgtgtctagcaaacatggaaaaaggaaaactactgctagccagagcactgcatgattctagaacaaaagagaatgtatacttctctgtggaaatgaagaacaatcctaagtctaatacaaaaagtgtgtgttgtgtttgaagtttctggagtccttgagactgacctttatgctcagaaaagattactctgatggcactttggttttaaatattaatatttgatttttcaggttataaatttaaaagtctaaaataaataaatttaaaagcctactttttccttcagcttacaaatataattctgtttataatctaggaaagtttagcaactgcttttaagggtacttagaggaatatttagcaccatttataaatagttaactaaacctcttcaaacatttttaaattcatttataaatttaatatatttgatttcctttaagtacttcaattgtctgactttaaaccttcctgggtaattaaataaatctctgaaatctaatgaattaaatttataaatatggtgaatcaaattcatttaaatattccagcactgtagatcaatttagtaatatttcaacctaaaaccataagcctaagtcaattacgcaattatgcattttatattggaattataaggctggtctgtttaacagaacaaattctcttaagcattacaaaaacttaaataccaaataaacacggattccttttttacacaaaagcatgttgtgttagttttgattctctcaaatactgctatatttaaagctttactcttttaactccctagttgaaagagatgatgacttcttttccaactaatgaacaccactgttgattttgaccaagtcattagagtcttcgcaaaattgatgggagatcatgagccctatttatagactatgtgacggacttcaaactaaagttggtggtcatgtaacttagttcctaagatttgagtcacattgtaaccaaactgcaaatgagattagagtttctaactgtcactcaggtagctataccacttggctggattctatagttcttccgctcctaaaatatataaatatctccccttttaaatctaaagacctgtgatataatggcagaatactcattctttttctgtatttcccaactctgccccaccctataatgtctgttatggacattaaaatgatattttccaaatggattcctgacatttcaaacagattttgtctatttggtcacgatgtccaagacagttctactgacagtgctatatggaaagaccacaccaagtcccctctacttatcagttcctggtaggtatctgctatgatcacctgtgagatacaccatactatgagtttggaaatccaaaggctgttaatgtatggatttcaggcaaactgtataagcactcaagttaaaaatgaaaggggatgcagggatgtattgtttaatgattcttaactttttggaggtcaccgacactttacagaatctgataaatgttatgaaccttctgcacaaaaacacacaaaccctgtagtttataatttccaggattttgtgtttcccctgacattcaccaacagataccacgttacaagaaacaacacaaaaccttggactagatggatctctaaggtccttttcccaacatggtcctgaaaacacaatccatcaaagtgacgcattacagaggaggtatcagaaatttgttttggaggattggttttcacaacgactaatatagagagctcatcataatcaaagcagaataaagttcaatggaaattaaacagactaaattttctttcttttccaaaattttctgtagtctgtcctaattttcattgacatgtatggcagaagtagggtagagtgaaaaagtaacctagaaggttagaaaagataattttattcagcttggagaaataacagtgaagaaaatctttatgatgggtattccaagtatgtaaagggcttttatacaatgcaagataataagcttattctccatcattactaaagataaaatataatttcaagataatagaacattttggggttttgtttggttggtttttggatgagttacttaagataaaaatggaaacaacttatctggaaatcacaacctccagtgttcctcatttgtctgggattattaagaactactaaacagcaagaggaaccacatgttttgtgaatgaatgaatatgaatgaatgacctcttaatattcctttcaaactggtaagtcgacatacttcattgcaaattatgtcgtttttctatttgtttaagcagttgtttcatctacacactctacgctatttactaaacagaaataatcctatttcatatcattgtattttttagagtctacattttatctgttaatatcaattctgttgagtttaaattccccattgatagcataagtttaaagaaagagttacagctacttaagagtctctttgggccctctatgtgctaaaagctaaaggcaaacttctaatatggttttaccttgtggagtatttttggaggtttagtgggttttgaaattattttatctgcagagccccccaacaaagccagggctcctgcactgaacacattcaatgcttgggtttaagctgcctggctcatagagtaacaaagaaaacaaagctctcatgcatgagtccgtcaacaaaagcaacacattttctttaaagtttcagttcaataaatgtttgccttacgggaaagatctttttgctttttgagactttttcctcaaatgctctcattttaaatcacgtttaaaaaaaaatgccttttttgttgttgctagagatgggactctccaaggtgcctacagcaacaatgaggttgtagtgaactgaaaggcaaaaggcttgaaatctatgaccttgggtaagcccttacaccggtatggtaagaggtaatgagagtaaggtatataaaaatgaatagacctaaaaccgtaaaaaccctagagggaaacctaggcaataccattcgggatataggcatgggcaaagacttcatgactaaagcaccaaaagcaatggcaacaaaagccaaaattgacaaatgggatctaattaaactcaagagcttctgcacagcaaaagaaactatcatcagagtgaacaagcaacctacagaatgggagaaaatttttgcaatctatccatctgacaaaagctaatattcagaatctacaagaaacttcaaaaaattcacaagaaaaaaacaaccccatcaaaaagtgggcaaaggatatgaacagacacttctcaaaagaagacatttatgtggccaacaaacatgtgaaaaaaagctcattatcactgttcatcagagaaatgcaaatcaaaaccacaatgagataccatctcacaccagtcagaatggcgatcattgaaaagtcagcaaacaacagatgctggagaggatgtggagaaataggaatgcttttacactgttggtgggactgtaaattagctcaaccattgtggacaagagtgtggtgattcctcaaggatctagaacgagaaataccatttgacccagcaatctcattactggatatatacccaaaagattataaatcattctactataaagacacatgcacatgtatgtttattgcagcactattcacaatagcaaagacttggaaccaacccaaatgcccatcaatgatagactggataaagaaaatgtggcacatatataccagggaatactatgcagccataaaaaaggatgagttcctatcctttgcagggacatagataaagctggaagccgttattctcagcaaactacacaggaacagaaaactaaataccgcatgttctcactcataagtgggacttgaataatgagactacatgaacatagggaggggaacatcacacactggggcctgtcgagggttgggggctgggggagggatagcattaggagaaatacctaatgtagatgatgagttgatgggtgcagcaaaccaccatggcacgtgtatacctgtgtaacaaacctgcacattctgctcatgtatcccagaacttaaagtgtatatatatatatatatatatatatatatatatatatatatatatatataaaaggatagacagtgagaatgcagagactaaatgtcttcaggagatgggcagctaccataaaaatgtgactttggagactgcatgcttcctctaatgccattcaaatctgaatttaaaaaaaaatcagcaaaaaagatgtacataaggtggattaaatccgagcattcagagtgaggtgtttttgtcccctccaacactcctcatctataaagaagttggcaaatctccatggatcttcgccttgtagaagaagtggcctagaagtaaaaataacttctatgaagttcctcagtgctgctataaccaaacctgtcaatatgttagtaaatgtttctattttgccctcactttccttagggccaagtcactgttttcaacaccgcatatttttcatagaacactccaattaccaattggggaaaaaaatgcttcatatttatgctgaactaaaacatgccatacactagaacttaaagtcagaatatgcaaatccctaaaataaagcaaaatgacaagtcaccacaggagatgtattttagtccaatcatatataaaatccagaaattatgctaagttggcaatcactaaaaaaggcatgtattcctctattcattcatccaattatccattcatttttaaaattcagtcatcatatactgcactcctattatgtgctaggcactgaggataaaaagatgaaagaaacagacacatctttcaaggggatactgcctggaatctgacaagagacatggtgttgatcataagacagtgtatgagaggactacagatgctgttctgagcaaagagaagggataccttgctcagataagggaggagatgggagctttaaaggtttcttgaataaagagttttaaatgataagcaggagatagttgggtaaaaagaagaatagtactttaaagctaatagttgtttttcacatgtaacaacaaaacacattcccagtatgtaaaagttttccgtgtcttttatatccatggaaaactcagatcagatctaaggatagcacacaaaattctctctgaagcccagggaaagttggcatgatttttcctaacacaagccctactgattcctctgatggcactggggacatacagtgcaaactccatgacatctcaaatacatggagcttggagaagacagcagttaaaatcccctctctttcccttgcgcgcatacacacacacacacacacacacacacacacacacacacggcagttaaaatcccctttccctggcgcgcgtacacacacacacacacacacacacacacactcttacgaaaagtcccagagtcttaaagacctatctgcaaaggaacattcaatggccctttcaaccagtgaactaaatttaaaagaaactatcttataaaaatagttataaatacacttaacaaagaagattaattcttgagactccttgcatattccaagtgagccagaggagctgtatcttcatccttcctccttgctgaagttacttttgttttcagctcactgaacttttatcagtactaattgggacattcttcccgccagggcttagcattttcagatgtttttgtaggtactgatttaatggcactgacattaaggtttctatccactgggtcacataaaagccaactagaacaggctgcaaaagaagcagagtgttgaatatcaaaaggagtgggtggtcaggaagaggactgtcaatgtgcttaccccgctggacagacatgatagctggtgctggctctagttattagcacagcatgttgaaggtctactgagagtttctattgagcctcctcctgatgggataaagctcaggaaggaggagaaggctacagtctatctttgattttgcagacactgaatcaaatattcccatctcggtaaaatagcagagacacatgtcaatctccaaatcagctttctgagcctttcttaaaaggttccgatcaatttggccaccctggtgaaacctgggcattgctataaaaaaattcagacccaaagaaagatgcagtactttgagggggagagagcagaggtatgaggtatggccaagagttgagttttttaagccagccttgaatcagttgctgcctaaattctgttggagccagacaagtatttgagggaagcaagcgtgggaagtacttagagaacagagaatcaggacaaagtggcaagtccaggccctatccaaagggcagccactattcaactctaacccaatgttttgccatgacagcatgcaggtctagtatggcaaatgtgatattttaagagaagtgaaaatacaaattttattgtgaaatctcccaattctgaaatgttggcaatgaaagtaaaagtcatccaggtcaaaaaatacacctggtgctagatgcagctgagcaaccactggtttatatcatctgatccaaattctaaagtaaaagtttgtaattcatctccatagcagaaagtaatagagatcctactagagcgtaggcacctgaactatgctactttttaagccagaagggccccaaggggcataccagctggccttggatataaacacgttatgttttcttctctcttctcaaagcaaacttaacattaggttcaaaatttccaaggaaaagaaataaaaagggaactgatgttgatattttgcctttcttttaaaggttttagagggcatatgggactagtaagtagtttgcatttgatctctacagtcagtcttatttattaaaataaacttgccggttcttatttattgaaatacgtttgccctgactctcagatgacttactttcacagatattaggactgaatgatctgagtctcctgttaaagtactgtagacaaaataagggttctttaacctggctttcctcagcatttcagggattgttaagagcaatttcattacacaaggacatcccaggtgaatttcctgatggtcaaaaggagttcagggctagaaattacatcataagtctgacaaaaggcttcacaaccacagggcctgcttcctcaaagtgggcagtcaacgggcaaggatggaaagtgctctgttctgggtaggcaggggcagcagccttcccttcttagaatctccagcaaatgcagagcatgggggtaagaagactgaaggagtggaggaggatggattcatgcactcattcaataaatatttatttaatgcctgctgtaagccaggtattgttctaggtgctgtgaatcaccgctaattaaagtttctaccaccattaaacaaaattctaaacagacacatattacaatgttggacagcacccagtgccatgggagaaaggagagaactaggaaggataaatgggccaatatgacagaataacaaggctgcttctgaaatgtttccctaaggcctcctcagagagcatttcctggataagaggagcgagaaacatcagtatactttggcattcatatcttggttccctatgcagaaaaaaagaacaccaatttgaaatccagtaaaattgactaaaacttgtattattaggccacctttaattccttatgtctcagtttcttcacctgtaaatggcaataatatcagctactcgtctcaaaggattaagtgtagattacacatggcaatgaaccaatgctctgtacagtgagctcagaacagaatcagcatggcgtgagccacatcgtgactttcactggtacctcgcagtgtctgcctccaagtagttactcagttccttttccctcctcatctcccttagagtgagggcacaaggtgggtaagaacttgcacatctgtgttccacagcagagatgctggggctgaaaagagctaaacagttcttttggaaccaaagtaagaagcagagttccgtattattagctcttttttctttttcctttccatacctatttcattcatttatttttgtagagatgggggtctcgctatgttgcccatgctggtctcaaactcgcagccttaagcaatcctgcctcagcctcctcagtagttggaattgtaggcatgtgccaccgtgcctggctcctttccacacatacagttaaaacgtatacattaatgaagaatcagcaacttttgaaagcatttgatggaccatattatttctttcagacaatgtttcatggtcaaaagaaacttgtttccataaaaaacactgaaaaaaatgaacagttttgttaaatagttgtgttttattccttctctcaaaaagtatggctataatgggatttcagattgatttatatgggttgataactgccaaaaagtcaaatgataaaattttccaatgcaaaaataataactctagtaaaatgaacaaaatactccaaacatatatttgatgaattgtgacaccagttaaatactgcctgccagatttttcaaaggttgttaaaaatgggtccctttagcaatgcaggtaagggaaaagtgagaaattgatttcaaattaaatttttaaactgcttttgccactgctggtgccacttcagtgctccttaggtgaagactcgatacctcctttgtgaggtggcagctgaggagattctggcacccactgaggccaatgaaaagcccaacgaaggaatgaagactcagaaccaccactgcattactttgaaggtggatgggcataatacatctggggtgtagtttaagcttaggtagtatacaccacttagtaaactaatgaaagcctattgtcattgaggcagatcaaattccaatcaataaaacaggcacacgtgcacagttaaatacaaggatgaagatacaactgatgtattccagcagcagacaggaggcgtctactaacaaatgaacctactacttaactccagaactcttttcctacagactaagaatacaatctcaactagaaaactctaattcggttttaccacatcctgactactacagcattctctgttctttcatttccctcttccctattcttttattgtatataaagtagcttgcgtatgtgcacaagcataatgctttttttttttaaactaaatggccaatggtattttttgatggtcatgaaatggagatgagatggggaaaaagtactggatctgtgaaaatgccccctttcttcattagttgcatgctcattcagctctcatttttatattccagtaaattattttgttctcaattttaacaataacaacaacaaaaacccttgcatatctttgattggctcacttggagaatttgaacgtttttcattcatcactggtaaaccaaagccaattttataacttttttgtatacagctgttatatatagggcaatgtctttaagtagggataaactactctaaaaaaatgaatcctcagtagtgttcccttcaagtcaagtgtcttgtttaaataaacttcttgtttaaaaataaataaataaattcacaaacttaatcccgcagctgcttacctacatttggccaaaaatgaatcaaattgatttttctcactcaccattacaaagagggtgtttgtttatctctggaaaaactacttctagaaagtctatttgagaagtgataaaagtagacaatcattactttatgaggaacaattaatttgtaaatgtgctatccagcatatatccagcatatctgcacacttattctaattttttcaaattaaatgtattaaaccagaaggtgaataaatcacattacaaaaattagtgtttctagacttaacatatctgtggagaaactatgtctggtaaactccatgcgatgtcataggcagaaggaaaacaagagcggagcatctttgactcgaaacaacgaaactacattgcaatatccgttttcaccatccgatacaaaaattacaggtcagatttgccttagaataactagataagtcctaggtacattttgaaaaccctttgttgattagtattccaacttttagcaatatccaatataagttcatgcaaatacaatcctttggaccactgaatttaacaatgtaacactcctcaccccaattctggaggtctcttgttctccttttttatccacagtgcatatcttactttttctatatgtacgtgtatatatgtatatactatgcctaatgtttatggcctgcttccttcaaaagactttaagatccacaagggcaggaatctgtattgtgttcagtgatatgtccagaacacttagaacagcgcctagcacaaagtaagctttcaataaatgtgttgcctggatgaaactaaatgcattacgccaggttattatttaaagcaacacaatgggtgggttttattggtcagatgagtttttctcccatttaaaattgtacatttattttctaattatgagcctactgctttcgctgccaggtgctcttaaagcaagttacacttgtggtaatgcaggtaaaataaaataaaataaaataaaaggtcattaaaccaccatgtgggtatgcgggtacaggagaaaaggggtcatgccaatggattttacatcctcataaccagtgatctcctgtttaatagctctaggccaacaacttaaaataccaatgtaccaaaatacttgcagtcacacaacctggcccagaaatcaaagcatgccattgcaacattaatgcaacgagcaggcttcctgcaggtaacaacctctaacctcagagcattcattaggtcatagtcacaattttatctatatttatgttcactttatttttctctttaaaggcaaaatgcaaaacacctatgctgaacactttcaagtataaatataattccaaggtacaaagttctccttcacatggatagccctttctctttcattttgagttgatcatcaaatcatctattttttccagtcttcttataaggaaacatgtaccaaagtctcacatattaaaagtgatcttctaatccgggctcatgtcatatcctaaggcatatcatatacgttcctgaatcctcagtttccttatatgttgaacagagccagtgccatgcagaatcgtcaaggttagagttgctgaacgcaaagtctaggctgtggttctagaatgtagcactgtggcataatatctattcagaaaataatctgcattttactaactgctttaagaagcaaaatcatgagcggcatttcttctgttataataatgtagccatgcccttgtcatctgagttctggggtcttacctgggggctaaaagggagcagaaggtagcaagggaagagggtggggttcctgccctcttacttctatccaggtttgggttaaattaacataaatggtttctttgatttgggagagggaagagttaaccttccttcacctgagaaggcaaatatgtgcccaagttgattttccaaataagactacatgatgcctggaagggatgaaccaaatccttccgcctagagccttgacaaatgattgctgtatataacttgcctttaaaatggaccatgttgatttcagtaagttgcctggtggtgaccaatgtagatcagaacaaacggcacatcccagaatgtcagaactgtgtaaggtctctggaaggcatgtaaaactctatgaagatccccacctcattagtatcggtcatctgtccactttggcatgtatgggtttagactcacatttaagttttgaataataagaaaatataacatccataaacccaaatgttatagaacaaattcatacccatcactcaaatggaagactcacactaattctatggagggtttttctctttaagtgtggggaagtaaagtgtcctcatttcattggagtgatatcacggcaacttcagtgctattctatcatgccttcaggccacagcacattctaacgtccaatctttgtgacaaagcactggaacacagtcaccagcctcctcaacagatgagctgcaactcccctgcaaagcaactaaccaaccattctaaattgaagtcatcaaagaaagttttctgcttaaaatgaacttcaaaaaggtgagtcactctttttcacagtcagcaagtttcctatgggtagaaagagagggaatgatcacttatgtttcagtgctgaaaatatgggctatgtctgtcttgatgccttttcaaaacaaaagtattttagtaactgcagccacagatatcaaaaggcactccccagggtcaccatcatcaccatagaaatgggcaacccttaggcgagaatgcattcatgtgccactcactgccctatgcactttgtaagcatcatctcatttactcctgaccacaacccactgatattattatcccatttttccagataaagaaattcagatttaaaggtgtcaactaggctactgaagaaataactagtaaataaaagaactcaggctccaggagtcaagttcttcacctcactggcattcctttggcatcctaaccataccatgtctgggtttctacgtctcagtcaggcctagcaaatctgagtcctcaatgagccctcctatcttttgctgtaatagcaaaagtgtaatagtggtagtggtgtaataccacttctgctagttacactgtaatcactaaatcttccatcttaggaggaaaacagaaaccacaccagatatcttaccagagagaatttgagataagaaattagttaaattggtgttgtggaactgaaaaagtaaacgaagaacactgaggcaatccaggcatcaaaaccagaagaagcaacaaccacccctagggaacgtaaggaggagacagggtaattagaatctggaagtttggaggaggaactctgcagagctgggcaccagacttctgaggagctgcccagctggtactgggtgtaccaaaatgaactggagactgaaaccaaccactgttgctagggtgaaaacaggaactgcaaatatataggaaggagcaaatgcttctcctctcctctagtctcccagtcttcttctggtgctcctataggcagaatctaaggacttgaagaaccagcttcaggaactcccagtccaaaaacaaagctaagtacagaagggtgagtttgaagttggagacaaagcttaagtactaattagcacaactcccattaggccaggtgtgctggtaaacagaatagacaggacaggctgaaggaactcatcaccaaacatcctgtcccctcgattgatggtgaagtgtgacccctaatgattcccaccaaaaagactcttcccatttgatctggtccccattgaatcacttcatgaggggaagaaaatcagtctggactgatgcccataatgtgtgaatattgtactgagaattttatcatgtgcatcctaatatttaatccttaaaaaacagtcagttatgccatcatgcagcacaggcattaggaacaaataccttgctatgcaaaatcacatggtaaaaaccacagggctcacaggaaaattggggctaggggtcactcataaagttttgttagtgacatagaggaacctaataaaaatagcacagttttacacatattagatgattaagaactacatatatgccacagtaagtatgtatggaacttcatgaaactttatcttgaaacaggctcaaagtttgcttgtgggagtgggtcgtcagtcgggctgcacttgagcctgggtaaaagagcaagatcctgccttcaaccaaccaaccaaccaaccaaccaaccaacaaaacaagaaaagaaaaagggcacactccttttctcggaccagcatgctattttctcatttaagatatatcacttgacagtatgatgttcaggcagcagaacctgagggcagttttcagtgcagttttaccaatgaccttttccaggtgggagcgtagtgccctgggacgaaatggctggtgatctcaagcttctttaggtccgtgtttaatgcagagctgctgaacaaaggaattcgtgcctgtctcgtactttgtcataagtgcatttctagatctgagtcatagtgatcctcaaaagatgtttgataatacttcaaacacatggaaatacatgtcccaacctctgtggtccagaaataaaacgtaatatgaattgctaagtttgttcttccatcctttgccacggtgatctttctaagtcagtaatgtcattcctatgcttaatttccttcagtggctccctatggcccaaaagataaaatccaagctccttagcatgaaggacagactcctcccagatgtagcacctatttacacatcaagcttcaactccagctaagcccctacctaagctatggtccagtcagctgaactatttgctttcccacacataatttcagagtcacataaatttactcacactgacccttaacctgaaatgcccatgtcctctatgcctgcctgctcaacaccaagccaccatttcgctcacagcctcctctgatagaaagttctttccagtctccttatctttccaggcagaatgaaccattttgtggggccccactgtaccctatgcttgctaactcctatcacagcactttgctgtacatatttgatcgaaggtcaactccccttaccccacctttaaaagacaaaaaacaaaaagccacaagctatctgagggtactggccatgccccagtaatctttgcatccctggcacctagctcattgcctggtaactaaatgtgtcatcaatgtttacagaatgaagcaatggctacattatcataacaggaaaagagtgcagtaatatagatcaagctgtacctttttttttctccatctgaaatctagaaaagaccctcagcgccactaaatacgtttcaatatagacaaaaaacctactgaattggtaaaggcaaggtgattaccaaatgtatcaagtgattttgccaagatgaagatggcttgggaacaccaaggtggaagattctcaagcacaagaaactcactggtactttgccttaaaagcatattgaattaaatacaggtagtaccaaagaagtggaaattatactacagaaaatactccttctggatgaatgattaagtgaggtatctggataagaagctatggagaaagactgctgctggtaataaacacttttttacagaatctgaggattaagaaaactcttgccctgtagtgtgagttcgacaaatgctgtttaaataaaagcaactaggctgagtgcagcggctcatgcctgtaatccctgcacttcgggagtctgaggtggatggatcacctgagaacgagagttggaaaccagcctggctaacatggcgaaatcccgtctctactaaaaatataaaaactaactgggtatggtggcacatgcctgtaatcctagctactagggaggctgaggcaggagaattgcttgtacctgggaggtgtgggaggtggatgttgcaatgagccaagatcacgccactgcactccagcgtgggtgatgatggagtgagactctgcctcaaaataaataaataaataaataaataaataaataaataaataaaataaaataaagcagctagtcatgctgtcccacattaaggccaacttaatcaaaataccataaaaagcgtgcagataccagatatgacactataactaacatggattgcttacctagagtttctggatctacattcttcaagtggtctcttctattccaaagtgactcactctttctgggcagcagtggcatgaatcattaatcatgtaacagtgtatacagtcccaaggtatattaggcatgatcctctcgaaaacacacattctaaaaaatctttccaacaaaagcctactttccctgccatttgggtagggcatttcttatcacaaaatagtgaattctgagaatcattttctgacagctcaataactaaaatgatacatgcaaatgtaaaggcaggtcatacttgtcctccttaggaaaaatggacacacggaagctctaagcctgttttaccaattgcctaaggaagactcccacagtacatctcacagtcacttcaaatcccacagtacatctcacagtcacttcaaactccttatgccccaaacacccttctttttcccacaaacgtgctgtcctggccaatggtacattttcctacaatggtatgatcagcagcctggttacatttaccagttaaaatcctcaaatcattcttcattcctatttctctcctctatcaccaaatctcatcatttctttctttaaaaacttggtgacacaccaaaaagatctcagccttcgcttgactatgttttagaaccacagcatacattaggtagtcagctattctccaaaattcatgccccctttctataatgtagagttgttgccaggaagtgactgcctactctgaagttctatttaccctacttgcaataaggtgtgctagtgaatgttaggccacagaatgtgagcagagatgatgtgtgccactttcaggccaggcccatgaaaaacttcctcatagagcccctatatgcttctcccttctctgctggccgtgatgaaatttggggtcttaagtgatggtggagccacgaaaggaagccgcttggattctggatcaccatgtgaagtaaagtatcctctgtccagcagcacccacgtttcactgatatgtgaagacataaatttcacgtactaattcactaaaatattgaagtgtgcttttttacagcaccaaaaaatcaggacaactagaaatatttaaggtttcagttaaaaccatctccatgagcatgatactgagggctatggaattgcccttgaccacaggaatctaaccccttaagagtattctaccgctttttgaaaaaaattgtaaccattatattgattaaaaatagccacaatttactcacctttccctatgtgccaggcagggatcttactgtgtgttgtatggatttttaaaaatcatatatatatatatatatatgattaatgattgatgcccctatatatatatatgattaatgactgatgccactatatatatatatgtatatatggtacacattgctactatgtctcattttgtaaaggggaaagcttagaggtaaaaggtgaaagcctaggttacacagttagaaagttacacagccaaagctcaagctcctctgtctttctccagagctcacgccccaccccttgttaccctgccttctctaaggaaaaaaggtaagcaagataagaatgtggtgtgatggctcttgctccagttaccacatgaaactgcattttacaatataaatgtaaatttattttctgccatacagaagaggcaacttggtattttaggtaacaacactgaagagttgtataagtctagcttcagggtttcccagcccaatggaggcagctggataaccaagatgcttttctgatgctcacctctgccttccccattccccaagtgcagcattcttcccttcaccccatgaggacctcacgtggatgcctcacacgttacatctgaccatctatgaccatctcttcattcaaccacccatttccaaatccagatttcggagttagcttttataatagcagtccctctctggagtgtggactaaatatcattaaattaaccatttcatcatcatcgattttctccctctcttcaacaaaatccagatgacagttagcttgtattgtgctttctaactatcgtgagaaatgtttcagatcccaaaataaatctaccataatgttttttgaaaattaattcatctttccataaactgccttgtttatgactgatcattttccaaattacatgctgatgggacacctattagtcacggactacaacttgtctgaccaactgttcctgacaaagcatttcccagcagacaacaggggagccaatttgtgaaacggtaaccagagatggtggaggtcacctcacagagagcactgacctcttaacccaagaagctctgctcaggtattttatgtgccaaccttggcacagaatgtaatttgttgggttaaaatgaagacaaagacaaattacgcacttctatgagagtgctgaatttttttttctattgctatggtaacactactccattgtaggagacggaaaagaaagagtgggccttaacaaataagctataaaatctgtcaatgatgtatcaaaaaggacttttaaaagatactcctttcaattatttcactgctagaaatttatccaagagcaatagtctgttaaatgtgcaaaatatgtacatatcggatgcttataacattttattaaagatacatgtccaacaattaaattatggtgtattcatacagtggaattccagaggacaggtatgagttaggatgtagatgaagacttattgatgtggatgcatgttcatcatgtgccattaagtcagtatgtgagttacaggatagtacatatcatttgattctgttataaacattacccagggaaaaatgtctgaagatatttacatcaacatactaatagcaggagttatttctagtgagagaaattttgggggtgattggaaatacttgccatgtgcttttctgtattttctatgatgatttttcatatctgtgtaatataaatagaaaaaatgcaactgtggctgattacactatttattcaaaaatatccactgccccttcttagtgaccctttcctggtgcctctttttatgggaggagtataatttttgtccccatagacatcaggcttaatgatgtgacgtactttgactcatgaaataaaaataaaatatgagcgaaagggacacgtacaactcccaacaaaaaccttgagacttatcatgtgcttccatcaattttttttttcctccaccctgagacaggcatgctctggataggagatgcttcttgagcctggacagcaaaaagatgtgaagcagattcgagctaacctgccgtagccaaaatacaggtaagaaagttatcttgcgttgccataagccactgagatatggggctgtttgttaccatgggataacacattctaagctgactaataaagcaaatctaccaccaccccccacaagaccaaactaggatttaaataattataacagtccctcagttatttccaattagtgctggtgttccatattaacttcagacctctctgctaccaatattttttaactggtatttatgggagagttcattgctcccagcctcccctgctttctttctgcctgcccacatcatctcagagtcacagtgattattcctttgcctttcatgactgtttcttttaggccttcctattctccctgtagtccatggacgactgctcattccatgtctgcatatggtggctatggccaatgatattacccttcaaccctctttttaatatttacttatctttaaaatgttatttttaatatatgctttttaaaatttaatttttaattaacaaataattgtatttatgtatacataaactatatgtatgtattatatgggtacactgtgatgtcttgatacatgtttacattatagaatgattaaatcaaactaattaataaatccatcacctcacacacttattttttgtgctaaaatatttaagacctactctttttcagcaattttgaaatttacgattatttaagtcacaaatcaatcttctttatacatcgttgtgggattcatgttccttaaagactattctccaatttaccaccactggtttcaagctccccagcccgttagcctagaattcaggaactgcttaattcttcaagctcactaccctcataacacaaactctcagcaccagccaaactgtttcattcattatttcctccgcatacctcacattcccagaattgaggctatcaagatgatggcagtagcctgaaccctccggagaatggttaaactggtggtagaaggaatcattcaatgagtgactgacatactgcaatacaggtagcacagccctgaggtacaagctgcaaagtagacaggctgacaagacatggtgatagtcgccaacaattcctcccatccctgaacacacaagacctttttcctttctcttagactctgggctggctttgtgacttgttttgaccaacaaaaatgcagtggaagtgatgaaagactttcaagaggttaagaaacctggcggctgcctctttcttagagccctgcagccaagctcaaaggaaagccagggcagactactgaaggatgagtggtcacatggagagaagccctgaaggatgtggccatctgggacttatctgctccagccaagtttccagctgaatgccacctgagtgactaagccaaaagtacatggaacagaataagtgctcagtcaccctgatcaacccagacttgggaggaaaaataaattatagttctctgtaataatttgtttcatagcaacagataactaagacaaagggtattctccttacttctgctcttaatacagtaccactcaagcctctagggggacagtggctatggatcccaaaagacagtactctcttggcacagtggtagtactggggtaccctgagatgactaaacaggcagtgaatttaaatggtggcaagagaagtaggagtgcacatgaagtgggagagcaaaatgatgatagaggccatatggtaagtattgccaataaactagtccataagatataaagagatgaaaacctaggaatggtagaagatcccagctgaaggtgtgggcaagagccagtacaatctgagttatagtttctgtggctctgtttgcacaagctaggaaggactcagaaagagtcaggtggcattaataacgcctaagtctattaccaccactcatatccgccacactgtggttatcaggaagggacataaatccatcatgggcagaaacacaaaactaccaacaatcagagcactgaagccgcaggtggcagaaactgccagttgatcatcaaactgatttcttcctgttcctgggcacacgatcagacgacattccccagcctctctagcagttggatgagtccatgtgactgagttccagccaacagaatatggatggaaatgatgaacaccacgtgccagcctgaccaggaaacactgccacactctcctgcttgcccagcaaccttggaaattacatgctgatggccatggagcctcaagacagaaagaccgaccatgagtctctgatctactgcttgcaggagagctgccacctaaaccagaactggtgaatgaaaaagtggtgtactactaagatttgggaatttatcttttatgcccttataatacatcctagctgtacatatggcagcactaagcatctatacctgaaaatattctttagagcaaagataccccacaagggtctccaggtgttttggaaaactataatatagtaatgaaaagtccgtagctatgttcaatattcaaaatgcctaaagaaaattctacatttaggtttccaggctaattaaaacatcaagcctctctgcttttggctgcgatgcatcacttgagctagcagcactggccaactcgtgccagtcaggagcctggagctgcagtatggccaaataaatatccctgtaaaatgcagcttgtttagtcaacaaaaatctctcattacatgaaataatagaagtgatacctggtggtacaaagatttggaatcactgctctcacataccatatcgatatagttgggtcccttcatgttatttttttccttaaggaaaatgggcatcataacaatgaacgattatataaaagcagattcaaaaattactaaggtatcaatggatattattttatctttctgaaagcaccaagaatagatctggctgacgctattaaccaattggatgactttgggcatgttatttaaatctttcagaacctaaatttcctcaatggtataagggggcttctttcatttgcctacggtggccctcaggcttgggggccaccagcactagcaggagtgcttgttaaagaagaccgctggggcccaccccacttccattcaccaggtctggagtggggtctaagaatttgcatttctaataagcactcaagtttaacaggtttctccagagaaagagaaccaactgggtgggtgggtggataggggtgtgtgtgtgtgtgcgtgtttgtgtgtgtgtgtgtgtgtgtaaagagaaaaagggagagaagggagagattgactgatttcaaggagttggctcccacaactgtgggcctcgcaagtttaacattttgcagggcaggccagtagggtggaattccagtaggagtcactgttccagtcttcagtctgaaggtaaactggaacggaattcctctcttctgggtttctcaatcttttctcctaaggctttcagctgattggatcaggcccaccagaattatggagagtaatctgctttactcgaagtctactgatttaaatatcaatgacatctaaaaaataactccatagcaacatctagactggtgtttgagtaaacaagtgggcataatggcccagtccaattgacacccaaaattgaacaccacatcaggtgctgctgaagtcctggtattcctgaaagccactgccctacaggacagcgatgaagatacataagccaagccaagtaaaatcatctagtagcaatgggcttttaaattataatggcctcttctactcctcttttcaggctattactttttttttttggagacagtttcactcttgtcgcccaggctggagtgcaatgacgtgatctcggctcactagaacgcgggctaatttttgtattttttagtagagatggggtttcaccgtgttggccaagctggtccggaactcctgacctcaggtaatccacccgccttggcctcccaaagtgctgggattacaggggtgactgggattacaggtgtgagccaccacgcccggcctcaggcttttacatttttaacccatcagagaaaccacacttttcactccccaaatatttgagagaatattcttgaaaagagaatgttaaaatgcatacctgtggctgcttcctaaattcgattacccaatttctggattacccccttgtttctatcaactgagccccttttctattccgtaagtataaaaaccaaaagtttaatgacattactgaagtcaccaaatctcagattcgacagaccaccgacactaaaacaaggttagtatggttttccacctatgcctacgatttctcaaaccttcatggatagaaacgtagaaacctcaatttcaaaattaatgctcatattctgaccaggcggttaataattacatgttacataaagggggtgaataattttgtatgttgcaaagttgtaaaatgatattaaaaatgctaatttatctaagagagttgtttcctactaggattacattcttgctttttttttttttttttaacacattttaaaaatctgcacttcacagcagttaggaagtatcagaatctggttctgatttaatcagatgagaagtaattcagcttcaggccataatgacacttggtgggagaggtcgggaggctttcacacatttaaaaaaaaaaaatacaaatctctttcactcttcccttgaactttcactctgcttgatactattcctagattttaattccaaattctcccaagggcagagaaaagccatctaatgtgttagaatgtaagatatctttaataaggttttcatgataccagattcaaataagccactgtttaaaaacttattttggcaagggtggcaataaaaatatttatatagagacatacatccacacacacctctatttactcatccatccacacacacacatccttttttgaccaaccaaactcttttcttaccaaaaacatttggataacccttatctaaattattattttacttcacaaattttgttccacagtttcttgttatagggattaggaaaaaaaaatcaatcagctggggggaactctagatttaagaagctccattattttggaaagtctctgatattttaatacgctgatacgtgctgcgacttttattaaaatgtgtgtgtgactgtgtgtattcactatttcccaaacttatttgttcatcaacttttgttccctgttcagtacatctctcaatatttaagttctattcaaacatgcaagaaaatagcttaaagatgtattcaggaagaatttacactaacagttgatggacttccattaaaagaagcatctgtaaatattacgctctgtttgtaaattcaggtcagtaaggctatgtcttcaaccgaggaagaaagtagagtctaagccttaacaacgactctgcttcttcagttttactgcatttgaaaaaacttgtttccctataataatgatgatggtgtttcaaatccgtctggacaaatggtataacaatagcttaacactctagggagacaacaaatgtcgtatgataaaagaacccaaaatatcaacactagtcctttctaggttaagattatgagttctttcttcttcacgctgttctgcattttgtaaattccctgaaatgagctataacttttctaatcagaaaataaatataagtatcattttaaaaggtagtctaatatattttcttaggggatatttcataacataaatagttacaatgccatgatttttatcgtcataaccaaccagagaatacagaaaacctagatcagaaattaaaactaaaatatgaaacatgtcccaaaagtgctaaccttgcctctgttttgtcatcatatatgagctgctcttcattaagaaaggagaatcttcactttcacaggaaatgtgcagcaaactactagagagctatgttttcacctaactagaacttggatgaggaaaaaaaagaaaaccattagcattatagccaataatttactttcagaacagtcatttatggaacagtttctaatatctgtggtaggctggataacaattacaacaaccccccctccccatccctggccccaaaacacacacacacacacacacacacacacacacacacacacacacacgatatccatgtcttaatttctggagtcagtgaatcttaccttatatgttaaaaaggattctgaagatacgattaaggatcatgagatggggagattatcttggattatctgggtgaactctagatatagtcaggtgtgttcttataatagggaagcagaaggcaacgtggtgacacaagagaaggcctgtggtcacagagactggagtgatgcagccacaagccaagaacttgggcagccaccagaagctggaagagggaaggaacagattctcccttagagactgtgagaagaatggcttccagggggaggtgtggttctgtgaaagcactgattttagcccagtggaaccacttcacaattctggcctccagaactgtgagggaattaatttcagttgttttaagccaccaagtttgtggtaatttgttacagaagccatagaaaaccaatgcaataccccagtcgcaagtaggcaagtggtcttgacttctgcaaggctggggagacagaccttctggctgattggatcttgaagacaatccccacctttggtgactattcctccaccctggtgcagggatgagcagggcactggcttgcaagctctgggtgcagttccttttagtcgcactgttgaagtgtgttaactaaatctgacagacgtgaatctggtcacgtgaatacctgggataatgtccgtttattattaaacacatcatttcctgagattcttagcttgatgtttaaaatcatctctcttgctaggaaattaataaaatatgcatctgacacaattatgtccacacctacaatcctgatgtcaaacaaaaagccccacaaatctagaaactagagaacgttgtatataagaaacaggtgagaaagaggcaactcactaagcttattgattaaactttgaaagaataaaacatatactgtgggaaacatcggcaattgaaggaacaattgctgtacttgtgaatcaaattcattccacttaagagctccatgatctccaagtagtaccagaattgaaaagaagttattgcatttaaaggtttaatttaaatttaggtccttcaacagcaagttcaatgatttatcatactgattgaattctaattctcttacaatgttgaaatctaaaaaaccatttccttcaaacactagtgccactgagaaacacacttatagaactccttaatcctccaaaaataatgtaacacatgcatcatttaattcaacgaggcagtgttattgtcatatagtgataaaattagtagttctatgccaaagaataccttgggcataggaggcatggtatttttttctggtagtcttccagaaaacctggcgtagcaaaatgacaaagtattgatggcttaatatcataaatatggaacgaattatatataacttactagaaaacagagtaacaatctaaataactcacgtttcttcaagagggacttaattccctttcctaatacctcactctataccacgctctacataaaagtggcttacatcacttgaacccaggagtttgagaccagcctggacaacacagggagaccctgctgctttttttgagagggagtctcgctctgttgcccaggctggagttgcattggagtgcagtggggcaatctcggctcactgcaagctccacctcccgggttcacgccattctcctgcctcagcctccccagcagctgggactacaggcgtctgccaccacacctggctaattttttttgtatttttagtagagacggggtttcactgtgttagccaggatggtctcgatctcctgacctcgtgatccgcccacctcggcctcccaaagtgctgggattacaggcgtgagccaccggggagaccccgtttctataaaaaatttaaaaattagccaggcatggtggcatgtacttgtggtcccaactacttgggaggctgaggcagggggactgcttaagcccaggaggtcaaggctgcagtatgatcgtgccactgcactccagcctgggtgacagagcaagagcacacatctaacaaaaaaaaaaattaaattaaaaagtatattactatctcagtgtaaagtaatgggaattcaaatctcaatgtcgattaatttcaaataaaggttgtggcagagacttgctagctgttcaaaacccgttttgtcttattcatgggtgcacagctagactagatttcccagcctcacttacagttagcgttgaactaagactgtggccaatcaaatgcaagtataataatgtgcattgtttcctggtctggcccatatgcccccaaagaaacaattctccacattccttacctttctctaccccagcctcaggagccatgtgttcaagaagaccggcagagccacaaaatggaaggagcctggaggaataaatatatttgattggcactgatttcttgcagtagctagcattagctttactatacattggttttgctttatttgttaacttatgtattgattcagttaaaacaaaaacacattgggtactcaaaacatgacagaaaacaaacaagtgactcaccctgaaaattcagcaagtaaaggaaacaatgtaactagacaaaaatccaatgatgcacagtcctgagtcctacgaatgaaatgtgtacagagttctggaagtttttgtggaaatgggagaatgaagctagcttaagttgattcttgaagtacagacaaggcaggggcgtttccaaacacaggaataagctcacgcaaaagccgcaaggtgtccgatgattgtgggccctgtggggatgcagtggtggcaagaagtaagggacggggctccatgtacaggcaggggagccgtaactgcaggcttggtactctcagcaacacccttcacacactagtaccactgcccaataatgttaataccactgcccaacaatgttagtacctttgctggggagactggactttattccgaaggcatttcctgaatggaaaatcacagtctggtaggcacagacagagttaaaactgtgatttgagaaaaacatccacgtaccaggtagagaatacacttttccccttaagggatgtggtagttaaggaaggcaaagaaccagtaataggtagattaagtttacaagttactggattattacatctcaaatccaaggttttgtacagatgacttttaacccaccttctaaaatatacccagggtaatcgtttccaaaaacgacatattcagttaggcaaattactcctttacaaatctagacacttcatcactttttatacatccctattagacattaatcacagagtatttctatctcatgtctctttttaaattcatattgaaggagagaagaaaaaacgaacagaaaggacaacaaatacagagttaatatcgcatctatccagagcttagctgtcaagcaacgatacgcaggagaaccatccaaaaagtgaaaaggtctctgacaggtgaagacagttgtcacactggctagtgactaaagatgtggcaattttcccataggaaaagctctcaaaaccttattttgatagtcaaaatcatgtgaaaatccctcaaaaccttattttgataaagctgtatagaaaaggtaagtatccaggtttttaaaaaattaagacttttttagagcagttttaggtttacagcgaaaatgtgtagaaagtatatatactcctccttcccaccctgatatatgcagttttccctactattaacctcttgcattaatgtggtatattttgaaaattcgtgtacgactatggatatatgattaacttaagtccattgtttacattaggattaactgtgttgcacatgctacgggttttgacaaatgcataatgtcatgtagctacctttaatgtcatacagaacagttccaccaccctaaaaatcccttgactaccaattcatctctctgttcctctcaccccctgccactctggaaatcactgatgtttttattgtctctatatagttttgccgtttccagaatgtcatatagatggaatcatatagcatatagccttttcacaatggtttctttcacttagtagtatgccagttccatgtcttctcatgactggatggctcgtttcttaccacgaagagtactctattgcatggatgtaccatagtgtccccattcaactattaaaggacatcgtgattgcttccaattttggccgatgatgaataaagctgctataacattcacatgcaggtttttgcgtggatgtaagttttcattttggtaaataactaaaagcttgattgctgggttgcatgtttagctttctaaagaaaccgccgaactgtcttccaaagtggctgtagcattttacgttcctaccagcaatgaatgagagtttccattgctttacattctcacccgcatttggtatgatgagcgtgtgaattttagtcattctaatagatgtctagtggtatttcactgttgttttaatttacagttccctaacatatctcaagcatcttttcatataattattttcatttgcatatatcatttggtattcagatcttttgcccattttaattgggttttcttattgttgaattttaacaggtttttaaatacattttgcttaatagccctttatcagataatggggttttgtaaagattttctccaagtctgtggcttttcttctcattctctaacggcgtcttttgcagaacaaaagttttaaattttaataatatccagtttatcaacttctttttcccatggatcatgctttttgttgttgtatctaaaaagtcatcaccaaacccaggattgcctatattttatcctaggttatcttctaggggctttataagtttaggttttacatttagggctataatctactttgagctaatttttgtgaaaggtataaggtctgtatctagagtcactattttgcaaaaatattcagttgttccagaaccatctgttagcaagactgtcccttctccaataaattgcctttgctcttttgtcaaagatcagttgacaatatttgtgtgggtctctagtgtctctattctgctccactactctatttgtctgttctttcaccaataccatgctgtcttaattactgcagttttacaataagtcttaaagtcaggtagtgactgactgttaataagaaaggggaaaaaacactcaccatagaaaggtacatggtaactcattaaatatatctatctggagagaaaagaagcacctagaagtcgaggctgctctgtcagcctggatgcatcccagagtgaagacacagcaaggcagggtactttgggcataggaggcatggtatttttttctggtagactttcagaaaacctggctttgcaaaatgacaaagtactgatgacttaatatcataaatatggaacgaattatatataacttactagaaaacagagtaacaatctaaatagctcactttcatctctaatgaatcggatgaatgccattttaagccaatgaggtttgggtttttgtttgtttgttactataacttagcctatctcagccatgacatcctgatctggaaataatttcaattactttaatgaaggaatgtcacttttgatctccaaatccttcatcaagaacagaacaaataagcatcagcaatgctcctataagtgtagccatgtaacattagacatggtagttttaagaaataagaagtaaaaccttgggctttggaagataaagatagggcttttagatagtaattatttagaagttaaagggcatctgcatccaggcaacagcttttagtttgaacttcatttaggcagggactcttactacctgagagagtagaatataacttctcacactactgtagggaggctgaagcatggacaggaaatcagagcagagggcaggcagagctgcgatacaacaccaagacagcaatttgctgacaatcagtgatgaggtgcatgcatttgtgaagaaaactggatgcaaatcactagtgagcaactaaacagactctgtacttgaagaaaattttggccactttcattagaagagactgagaaacccatgcaaagaaggtaacagattccaggacagacttgaggggaggaacaaaatagttcaggacacacgggacaatcagcagaacatcaaaggggcaagtagactggcctgaagggaatggtgtaccccaccagatcctttgtgaaaaacagctaaaagttaataccacatcccatactctgaactgtgcaattattgtgaatattcacatttcaatacacaggccacattttcaacaataatagagtaggcattggcaaaccagggtgtcagtccaaatctggctgctaattgtaaatgaagtttttctggagcactgccacacccacttgtttatgtattatctgtctgtttcagcactataagagagctgagtagttacaacagaggccaatggcttgcaaagcccaaggaatttacaatctggctctttagacagaaaagggttgctgcctcctgacctagagagtatggatttagtcattcaataaaaccttttgttgtctttgagaaacttaaagttttagaacacgcttctactacctttattttaaaggccctatctgtccaccaatgtcaatattcttgtatctgtaagaaatttaaaaaattacagagtgagttaatggaggaaagcttctgggatgctggtcttactctgttcctgatctggaggcccgggacatgggaatttccagtgtgaaaactcatcaagctatatacacttatgtgcacttttctgggtttttggggtatatatgtatactgtgcttcaataacatttttttaaaaagcatgtattacctcatcccttatagaatttcaataggcagcatgtatcaactacctctcacagactggactccacactaagtactgaaatgaagatacataaagcgtacagttacagagctcggcagagtagacggtcaatatatataaaagcacacaaataactatatactgtcaagtatgtaagctgcaggattcaactacaagctcgtaacaatctaactaaactagctcaggcaaaagggaaactcattggctcagagattccaagcaagtgttatagcaaactgggaacagagaagcatctaggccagtggttctcaagttaagatgatttttgccccgcaggggatacttggtaatgtctgaagacaattctggttgtcactactgggggagagctagtggcgtctagtggtaaaggccaggtatagtgttagataccctacaatgcccatgacaacccctgacaacaaagaatagtttggctcaaaatgtcaacattgccgaggttgagaaaccttgatctgagtgttactataagtgtggtctgtcgaaacagcagcttttagcagcatcttaaagtagatcaaaaattcagaattgtggccctaccccagataatttaaatcagaatgtgcataagatcccaggtatcccttgagcacatgaaggtttgagaagcaggaccctcagctcctaccacatctggagtcaggtaatgactttgccaggcatgtttctccctgcgtgacttctcatctcttgctgtagatgagattttgcctcacgcaggaatgttggctgctataggttactaagattcacgcctcgtatctccccctccatgcaagcggtgctgacttgcttctcaggtgctgagtttaccaaattttaggtggcttttataggtaccaaggaaaataatgggggtactataataaatctacctggatttgggatcaggaaagccaacgctgaaaaatttaagctgatttctgaaaaacaacgacagttggcaagcaaattaaggcgtttgtcaaatatttactaagcacttactatgttccagacgctgttctggacctaggaatgtatcaatgaaaaggacaaagccctgatcctacccttgaggagtttatattccactgggcagaagcagacaaacacataaacaaagagaaagcacaatacagttgcagaacctgataaatgctgccagggagggaagcaggcaaagcatctggagaataaaggatgatgtgacagaacacctagggcccaaggacaaatatgttaggaaggactctccaaatgacgttaagatttggactgagacctgaagaaggagttagccaagcaaccaggagaacggtattctacaaagacagatcggcacaggaaaaggccctgaggagtgagagctccacaagctccagcctaagggcagggttgagggggtgggggcagcaaagaaggggaaagctgaaggtgcaggacgagggaaacagggtcctagcggttagttgtaaaacagaccttcagcaggagagtgcagtggttccaactgaggcggctcctggctctggctgcctcagtttgaatctgggatttgccatttataagaagcgtgacaaggccaggcacagtggctcacatctgtaatcccagcactttgtgaggccaaggcaggtggatcacttgaggcaaggagttcgagaccagcctggccaacacggtgaaaccctgtctctattaaaaatacaaaaattagctgggtgtggtggcgcatgcctgtagtcccagctacttgggaggctgaggcaggagaatcccttgaatccccaggaggcgggggttgcagtgagccaagattgtgccactgcaccccagcctgggcgggcaacagagtgagaacctgcttcaaaaaaaaaaaaaaaaagtgtgactatttcttagggttgtgaaaattataagtaaatgtcaagacaccctacaacaggagtcagcccaatctggcccactgcatgtcttgtatggcctgtgacctaaggaagttttctgtttacattcttaaatggttacgttttaaatgggcgtataagtacctacttcatacccttgattctgccccttaactccacaaagcctaaaatattgactatgtggccctttacaataaagtctgccatagccaagcctgtacacggtaggtgctcaggacgtgagggccaacactgccagctaccatgtcaacggatatgactccctggccaggcattacctgaggctttttacattatacttccccaaataaccattatcctaatttatagttaaaatgcaagcaagtaacatggaacatagaattttaattctagaattaaaacccaggtcactatgtcccaaaaacccatgatctttcagtctctcatgaaaatcacacagttaagccctctattaattcgtcctccaagctaggtattgttatcccctgtgtatctgatgccattatagcttttgatagctgagatagtgtaagtaggacccaggctttcacttctgaagccacttttgaagccagaaatgggaggtttcccagtgcagctcttaacgttggcgcatgcaaagattctctcttgggctcagtgaaagacagtcaagatgaaactgaatgaatttgtatcacagtgctcattgtatgaccaaagcaaagagaggattggggataagaaaagggtgtagctgatattgagggtggtacttaaaccaatttactgtccctctttttgcttttattcccccaatattctctagtaaatgttactttggtaataagagaaaatacttatttttataaagaaagaaagcagaaataatcagccttacccagagtagctacattgtactttttaaagacagcactattttgacagccaaaaaagacacttaggaatacagcattacaaattcaagatcatgtctatgaacttggcttgaaaaaaaaaccctccgctaaaatacaacctaccatctgtacaatgtattcaaaaatgattagcatagtatgaaaaaataatgctggaacagcagatttttttttttccattttttaagaacgcttcctgctcggtattattttcagattcctccatgaggtataagcaaaggcaaaatggaatctcaggtcaagaagatggaaacagaaagtaaacagagacaaaaaaggaacattaaatactctttactgaagatgtgacactgctctagaaatttcactgagcccaagagagaatctttgcatgcgccaacgtcaagagctgcactgggaaacctcccatttctggcttcaaaagtgaaagcctgggtcctacttacactatctcagctatcaaaagctataatggcatttctctgacagcaggactctcacactctcatgtcactaaaagtgaatcagcagagcttgcagatgcatggagcccagaaaggcacctctcagaagagggtgtggagagcgccggggcagcgtggagcacgatgatggccacagacagcagtatcttgccctgactttctcactaaccagggtgcctttttgcagaatctctcgactcctgaaatccttactaaaaataagggagttaggctgagaagccctgtctaaaagccattctatgcttctgtgatcttaaatcatgaggtcattttcacgtttgtgtaaatacatcctaacaaagtgaaacccctacagtatgttttgggaaattgtatccaacaataaatgttcagaatttttccccaaatgaacaaaaaattgagtatcaaatttatacctattagagaatatttaccacattggcagagtgcctcaaaggacttaggaatgttctatttgcatctgaaaggcaggttgcatgagttttgctcctatctcgtcagtcagcactagaggatgcctggggatgggcttctgcttgtaagaaaacttgtccacacaagaggtgatcaagagagtgacctccagctgcctaccgcatacagatgcttggtgcctgacacagaacttcatctccagggcctgaagagctgaatcaagccaggagacaatccctggagaatttaaataaaaaaaaaaaggtgaggtatgagctactgccagcactgctttccttacttccttctcatactctgcccctctactctcagggtacacaagccctcaaacttgttttccctccaacagggcccaggtggtaccttccaagacagaggaaacctgtggaaaccctagcataataggaggctttgttcatgatcattgccgatcacctctacactatctgcaattttagaaaacgccttaattggctgctggcaaggtcaaggctctaaggctggcaaacaaagtgctcgtttaataagttggctttcttcgctctacagagaaaagacagataaattcacacgtgggacagcatccttgccaagaggtatctaagggttagatgtgctggacatgtaaacactagcatgtttttccatagagtgctaaataaactagcacagaggtcagcaaactttctctgtaaaggaccagatgataaatattttaggttttgtgggccatatggtctctgtcacaactactccactctgctgttctagggcaaaagcagttatagaaaatacataaatgaatgagcatggctgtgttcccataaaagtatttatggacactgaaatttgaatttcatgtaatttttgcaggtcaaaaaatactcttgatttttctcaaccatttaaaaacataaagataattcttagctcgaaggccatataaaaacaggagtctgtagtttgatgactcctgactgagaggatgagacaactcatattctgcatcttaccacagaaaatgcaaagtgcagagtctttcttcacaagctcggttatactcaatttatccctttcccttcccaaatccaatcctccaaaatattcctccaatggggtccactgtctccatttcctttgtctctgctcccatcatctctcccatggcctccacctcatctggacaataatcttaccttcaaagcagtcaccacccaccagagtgaagggctttgaagagaaatcatcactccttaaactccttcaatagtcaacagcccaccccccaaatataatcagaatcaactctataatctgtgccaagccttgcaaggccctgcctctctaactttgtaatcctctccttgtctttgactctatgtgatggttcactgtatgtgtcaacttgactgccttaagagatgcccagatatttggtaaaacattattctgaatgtgtctatgagggtgtttctggatgagactaacatttgaatcagcagactgagtaaagcagattgccctctgtgttagtcagggctttccagagaaagagaaccagtaagatggagattatacatataaaatatgtgtatgtctgtaatgagataaggaatgggctcacatgattacagaggctaacaagtcccacaagtggtgcaaatgacaatctgaaggcctgaaacccaggggtgctaatgctgtaagtcccagtacaaggaaagaagactaatgtctccactcaagcagtcagattaatgttcttgtgccattttgttccagtcaggccatcagtgggttggatgatacccaccctacaatggggagggtaatttgctctcagtccaattacaatgacaatctcttccagaaacagcctcacagatacacccagaaataatgtttaactaggtatctgggcatctcttacattagcccaactgacacataaaactaaccaatacacactccctaatgtggatgagcccatcagttgaagccctgaatagaacacaaaggttggccctctagtcaacaggagaaaactccttctgcctgactccgcctgcctgactgcctttgaactacgacattgactttttcctcccttcagacatgaacattggctccttctgggtctcaagctctcatgcttctcaagcctttggactcatattattaatacaccattggctgtccggggtctggagcttgcagactcaccttgcagatcttgagatttgcccacctccataatcgtgtgaaccaattccttataataaagtcctttatacataaaaacacaaaaatgttttatatatatggtatatatctagatagatatgtatctcctattggttctatttctctgtgtaaccctaacacaaccatgaactgtcacatcatttttctcaaacttcttcaaacacattagggcctttgtatgtttcctttttcacaaatgtttattactatgttgttaccttctcattcaagtctcaatttcaatatctcctgccctaatattctttgaaaaatggcttcctctcacccttcaccaatgattctctacctcagcctcttatttttgttcccttcaaaacccttatcaaatctataattatttttattacttactcatgcctgtcttccctgaatggaaggtaaccttcatgagggtaggcaccacatctgtgttattcactgtatcctggagccctagggcagagcctgtcacagcaacttttaatcaatgttgcagaataaagaatagcccagagtttacagtccctgtcctcttctttggaacttccatccactttatcagataatgacctttgcatgaacaagatgatgctggtgatgataaagacccccctgtaccctcccccagtaaagtgatgcttgctcccctataccactgtgaagtcctctgccatctttatgctattcttactctctggactcatcactgaaatgaggacttactctcacaggggctgtgccttactacttaactgggtattcacactggtgattcaggttaacagttaagtcaccacctcatgtgacgcacagcagggacttttccccaccaccaacaccaggctacatgcagcttgaagctctgggtactatgataagtctcatgggtttgctcaatgaactgacttatccattccagttcctctgcggcacctaaatcagaataaccctgggtaacaatggtggatcagtggtggggataaacattaatgggtacaacctttaacaagagtctatgcttagaaatggaggatttgagggctaatcggcttcacctttccctaataaaaattatttttgtactattattcatagctacctttggctggttccacccaatcagtgcttgctatctgttcctcacactggacccatgaggagagctcttatttccacatagcacggaaagcaaagtgaaagcaggacaggaattcactgattggtctgtggtcagttcgtgaagctgatgagcttctcactgctgttgttccactggtgctctgattctctcctgcttcacaaaaggcaacaggaggaacatctttaactcaggtagaacaatctgatcttggtgcatgccaccacctaattgaagataaaataacctgtcagcactagttacgtgaatttgtctctatatacctcaaagtccccaaatgaggccaatcacagttatctgaaacctgccagcaagccagggaactgggtcctgggaaatctttcttgactatatctgctgtatcacaggaaactatgtagaaccttaaaagatcttcagactgtatatgcctgggatgatactctgctcacccagttcctgactgcataaaatgtgactggagtgtgaactatgttcatttcctgtacaacagtttttcttaccaagtaaaaagtcccctcatacctgctctactgaaaaaggcttaatccttttcacttcgccaatgtgaatttcatgctgtaatgggccaagttttggaaaaacaaagcagttgttttatacctgcccaactttctgttcacacaggtgaacaggactatcagtggtgaaatctcgccaacatctctcgtaaaagatccttgatttaacaatgactgacatctgcgcactttcccgttgactataattctcttcacaaggccacaccttgcggaacaaactttaaaagagcaaccagtgctaaactgcaggcattcttctttcctagctccagacatccctatctaggctgtttatttttcagctttctaatataatgttgggttgatatgtctgtcatatgacagcaagaaaaccaattacatgagtcacgctctaaagtgatcaaatgctggccagtgaagccacagctgcttttgattcattagaaatacattttccagccctgcatttttaccaggcaatgtagttcagctggtattgcagtttttatataatacttctttatttgattcaaagtacatatttgtaagatattgctaaaaagtcacaaagggaaggagggcattaattgtgcatctcctaaagctttatttccacaatatgtggtaagtgctagaaatgaagaaatgtctcaatttgcctgaaaacctccaacatggctttctaataagtaagactacagggtaaatgcattcctcagcatttgactagtgaagactcccacagctgctaagattaggtttctagcaggacttcccactctctcctcaattgcatgagtgaaaaatacaatggtctcagcttgattccaactatactttatttcctgaactgacactttggttttctttaggatagagctgtttagagtcaattgtagcaataaaaaataatgacaacgtcatgaatattcttactgaaaagctgctgcaccttgtttaggcactgaatatactgtcagtctgttcaaaaatagaggatcacaacagctgactgatgtagcaagaaatgtctatcttaacaatcagaaaaggtggtcattttccaaagtgaattcatcatgtggatagtaaaaaaaaaaaaaaaaaaaaaaaaaaaaaaattctatgaccaaataagtacacggtgtagagttaaataaaagttaaatgggttacttttccacatttctgagcttttaatactctgacatgtattatgaatttaaaataatttcttattgaatttttcttataaagtgcaacagtttgtagggctagtcttccacagagctttttgaatcttcggaataggccacttaaaagtgtctgaaatattttactgtctttcctacctctctctgacactcatacacacactattccacctatcatatggatattttatataatgccatgtattttatatgcttctatgtatattacaacatagtaaagcacaatgagcatgtttcacaatgctttttggcataattactatgtttcctacctggatgatatttcaggcaattctggtaagggcctttttcttcaaaacacaaggtgatttaaccaaagcatgagtgaacaaaaagaggggatacacagaagtgtgattgccacatctgttagcagtgcatttggtaagccttcccctgtcactatatatattcagaaataatgacaaaaaaatgtagttcctctgggcaaatgaaacggaggtgcaaattagaatcacacctccagtctcattttggtatcacttcttgtctggataaacaacacttactctcactctcctactcatggcaagtagccactgttaacacttgcattagggatcagtcacaacaaattacagttaagtttcacaccacactgcaggaggcagcctgggcccaggagagcataagagcaaagctgggccgcaggaccaattttgagaaaactagcgttggggctgaaaaggcccctgtgcctcagccacatgaagtggttaaaattctaatactctaagtggtatcttaatatttctgtgtgtagtgattcattattctctgtggagagtaatagtaggtagctgcttgcaaaaagggtgattttgatcaccaatcactttcaagaacacaagagatcagtggtactcaactgtgaaagcttcattataatgggaaactgcctgtgtggattaaaaacacaaacagatttcacttcaagatgattgtgtgagatgctaaatttccatgatgtgaaaagtatctacagactatgagccacataaaagtatccatggggaagatgagaaaaatcaggactagagacccagttcatacatgaattttccctacctacttgtggggcagaagataaaaggagctttgtaagctgtaagttggctagtttattgtttatccaagtagggcaaagtccacttttttgagtgaaatacaaaggtgaaatctgaataagagtttatagaatgcatacaattaatctccactaaataacaagaagtaaaataaaatcataaacctttaagaaacagggaggggcatggtggctcgtgcctgtaatcccagtgctttgggaagccgaggtaggaggattgcttgagcacccaggagttcaaggctgcaatgagctatgatcatgccactgcaacccagcaccccagcttggatgacagagcaagacctcgtctttttttttttttttttttttttaaagattcagcataaatgtgagaaataagtagagctaaacagtctttaagtgaagcaaatacacatgaattcattcactatcagacttgctccttttggaggcatattacttactagggcacctctacgaagttttctgagggatcctgacatctcaagatgagggagaaatcagggtgctttgtgatactgagccaggtggtcttctgagatcggggaacaggatttgtttgataatttagtaaattaaggtgggaggtattttttaatgtccttcaacaccaagtaaaacatgattgggtttatgatgattgtagttctcttttccataaacttcttgttgatatgatttaggtatctgccagcacctccagaagtagagaaaaatcattagaatgtatcatttccatgtcccctcatccatacactctgggacatccattagtataggtgtcctttgtgatttatgagaaattcttatgggaagggctccttgtaacccaatatccacacattgctattataataactctcaataatggcatctgtcatgtgccaaacatgacactaagtactggatatgcatcattatctaccccttcacaacaaatttctaaggtaggttttatcatgttcattttacaaatgagcaagttgaggctcaaagatgtaaattaagttgttccaggtaacagtgccaagaagtaaacaggacagatttaatcctgggtggtttaattctaataaacatctgtgcatgcttttattgagaaactactaggtataatgagaaaaacaggcacaaataatcaagacatatgtggtcaacgtgtcagaagtgtgacccactaaccatgatacaggcactacaacagattttagaccaacagggaaggattcagaaggtggtatttgaagtaaagcttggcggagagaaaaaggttcccttttctcattaaaatcctactctcccttccagattcatcagggattcctaagtgcaaaaaggacatttatgatgaagaaaaaaatgtaacggggtggaaaatgaagctcacatttatgacacgcaaactgcctaggttggctgaggttaagcatgtgaaaggaaccgtgtaaggtaaaactagaaagacgagattgagctagttttgcaagcaagaattctttggaattgtattaaaccttttcgacatcactgacaaactccatcaacatctatacttgcattttcttgcaagtctcttcattccagttccataggcattttcctttcctcttacttggcttactccaaagtcacttaatatcctagtcctcttccatctctcgagttttccttcaaatacagctcaaactaagtcactactcctcatctgcaaacctgccctgacattgaacattcatgcacctctaacttggtcccacgccttctctaccaagttctggctcctattcatatctgtgagccttgcctctcactattccctgccttgtccctaactctagttaaaagaactactggaaagttcttaactctcatatattctttcttacctctgagcctttacacaggaccacctctgcacatggcatgcctctccttgctcttcacatgtgcccagctaattcccccttatctctgagtatcagttgatacgttacgtctgtcaggaagatatgtcttgtctctcctcacatctaaggtgagctcctttgctttctacacaccctgatctactcatactcaccattcagtattgcaaatgcttttctacttgtctttctcacttattatcttaagcagctactgagctactgagcgtcattaaatcctgcaatctcacacatgaaaaaatgaactattttccataacaggccaatactactgaattcactcatatattactcatttttcacaactcttcttcaaattctgaagaaaaatactaaagatgaaaactgtatcttcacataattttttcccctctcttccatttatttcctcttcttagagatacctacaccttagatattggccccttcgagggcttaataaacatccatcagtatgagagtgcaataagtgagtcaacttaatatacaaataagtacgacgagcgactgctccatggaccattttcatgagactattacataaatttcattaacctcagttggtaccgagaagcacacagtccactggactaatatgggagaaaataagtcagtattcatccctctatgtcactgcatttcctcacattctctgttattcattcagtcttctctgttgtttgagactaaattctcccagtgaagacaagctctcgagtgtgtttgatgcttccacatatctccaacaatgagaggtttaagtggggacgcaactagtcacccagttgttgactcatccaatcaaagaaaattaactgataaaacatttataatgttaatattgccctccaatcacctggtaaagaggttagtgcctctccctgccacatattcctgaacacaaatccaaaggcaaatactagacatatcaaacaaggcatgcgcctctttaaactgggcagataaaagcagaactttcaggtgggcacaattagcaccctcccaagggagaatagagagaggggaaatgatgcaaaataatgcagaaacacttaactggtattcacattctagcttgcaaacaatttctaattcacttgcctagacagttaaccatcagtctggatgtaaagaattcaaactcaaccaagaaacaggaagcataagttctgtcacaagtgtgtttattttggtggctcacatctgcagctttttccccctcaatgtatttttttcagagccaaacgaggaagggaacaaagttactgggcctaaatccatcactgtgattgtgatatgctgaaccacccacagcatcatgagaaggaagctattagtttcatgctgaagaactccaacccacataggggcagaatctagaagtaaaggaacagtctattcagcatgattaactttattcagtacacccaacaatgtctaagaactgatctagtcacactcgatttaaaagcagcattatctaaggggatgtgttccgatggatgttccaaggtacctggtgttccactgggagtccagcatcagcatgagatcttttggtgtcatcttgcgttgataacgttactgctaaatcactacaactgcgaatagagactgaacactgtgtaggtgcagggctaaactatcttaaaccaaacttacaaaaccaaagggtgcagacttcacaacagcagccttgtcaactgcatcgcatgaatccaaatccttggatgggaaaatctcctatacagattgagttcttgtaatccagagaaagggtcagcaaactacggcctgcaggccaattcctgccagccactttttttgtaaataaagttttactggaacacagccacaataactcatttaaatattatctactgctgcttttgtgctacagtggaagagctgggtagttgtatagagatcatatggtccgcaaagcttaaaatattacctggctctttacagaaaaattttgccaatccctggtctagaatggtggagcattcactaattcttgctctgcaaaacctggttctaggtcaaaattattttgtcttgatgctgtaattcctcactgaagatcctagtacttaaggccttgggttggcccacagacatcccaaccctctgcttggaaacactataggaacaggtccaggtggcaaccctgcaaatctgaacagatgcctatttttcttctgcccatgagacagatggtcctcagagagggggagaagaattagtccatgagagagaattctctgtgcagcactaattttggaaatgtatccctgatccatctggccaaagaggattccttaggagtacctttgctattcgggtttgctgaacattcaggaggggaatcctaagctccaaggctagaacctcaggtatttgctctctatcaaaatgttaagtaaagccctttagacaagaagtctcaaataattatgacagaagatgattataaggatgaagacaaggatagctgactactcattcagggactccttttcagagaatttcttcaatttcccttggcagtaaattttcccttagatgaaaaagataataccctgatattctgctatgtacagaaagcaggaagaacaatactttctgaactgctaacaagagtagctctcctctagatataacaatgtttctccttctcattaaccaccttaactcatctttgatattcagaccttgttattctaaagaatatttccccgcggaacaaaccataaatttgcaaagttaattaggactctgatcttaacgcatttccccccatttcattcctaacgctctgccgggggtgtccaagggagaggaatacagccgtgggttcttggtttctgtttctggttgagccaataaagcctcttcctcatccctcttttccgcttatcactagagacataatagaaaaactatataaaaatagaaggaatgtcttaaactccttttcccttttataattagttggcagagagacatttaaagtgtgcatatacttcaggaagacaccatataaatatgatttttatctaggtatgacatggcttcaggctgctaaaagcctaaaacaaaacaaagcaaaacaaaacaaaacagaaacaacaacaaaaacaaaataaggcgggttggacaagattgctagtatagcaggagtgtccagtattttggcttccctgggccacactggaagaagaagaattgtcttgcgttacaataaaatatactaacactaatgatagctaatgagcttaaaaaaaaaaaatcgcgcaaaaaaaaaaaaaaaatctcacgttttaagaatgtttatggatttgtgttgggctgcattcaaagccatcctgggctgcaagcggccccacaggttggacaagctcgccgtagagggttggttctgttcagctccaggtaggaaagagacaatattaagatcagacataaggggaaagttaggcaactagaagtagaggcattaagaaaagcaactgctaacagattctgatcattcaatcttagccaacaggcttttgaagtatgatggacttgggtgtaagtgaaagagttgagtagttgtatagagaacatacggaactaccacttactacctggataatctcagagtcctcatctataaaacaaaataataacgtagttactggtgctgttattgtgaggattgaatgaaaaatgcatataagtcatttaatagtgcctgagtcacaacatagtaagtccttaataggtacctaacaatcattactgagcaaagttcctgctaaaagaatagttgctgttagaagcagaaacaaaggtggagcacagaagaagtcacaagggaaaaatatctttcttgattttcttctgagtcatatacttggagaaaaaggaaaattcttagtgcttttggtcccaaaaccctgtgtagcgttacctgtgagcctgacaagatccttcatccagtttcaacatcaaggggaaagaagatgctgcttcacataatgcaggtctctgcagacgatgctgtgccacaggaatcaatcaagaaatagttacatccccagcattgctccgtgggttgtaaaataaatgtttcttagacaaagaaagtataagtagctgaaacattaggaaaataatatcactgatcctaacacggtgaagtacttggcttaaattcagccttacaaggttttcttaagaatatactattggtttacaaaatttaactcagtatttttctaaaattgtaacaccttctacgtgaggtccccagacacaggcacaagttgtaggaacagagaccatggcaaataataaaccaggaaaaccagagttgacttcatgataaccagggtgggaacaaaattgacataggtctctataaatgaaaaccaatacttgatttgtaactagaagcaaatgggcacccaggacagacaacacaacacagctgcgatgacttccagccactgataatctcataaagctcacctccgtggcaactccctgaaagcaaatcaagatcaaccccgctcctctcggcagatgcttctttttccaagttccatgggtttaggttacatctgagctcactttcacgcatgttgcgagctaattacaaagaatccagaaatgtgggaacaaactgggaatactgtaggctgtttcagcaaaccttagcaccatctgctgaaatattaagatgcttgtttaaaaagttggctgtcagagaaggaggtcacagcacagacagtggggaagttctcttaaataactacttcttacttctctttcctgtatacaagctgtagggcactgagccaaaggtgaaccgtccagagaaagaagaccgtatctgctaacttctcctggtccacgtgccagcaggagagaacctagagcatgctggtcatcaaaagagaagagatacggtcaaaagactgtagcatgtttgtgcatttcagtgagcaacaacagtcatttgggaaaacagaatggaacgtcttaaactccttttcccttttataattagttggcagagagacatttaaagtgggcatacacttaaggaagacagcatataaatatgattttatccaggtatgacaatcccttagtaatctgagacttgtgagatttggggattccctttgtaggttagatgtttctctcagaaacagagcagctgaaaagagcctcaggtgtgtagacagtgatcaagtcaatggttagagttccaacgggcttagggaaaacaaaagaaagccttgcatcatttaatgtgttgaaaggccccaacagaatcacatattaataataataacagcagcagctaacatctttcgagcatgtaccaagcattatgttaatggttacatctgttatttattaagtcttccagcattctcaggtaggtactgttgtctcatattatagaggaagaataaagatgctttcagaaattaaagaacttacaagagctcatcagtttggaacggataaagctgttattgaagcttagctgctgactccagggactaatttcacttgtaactatgaaactatattgaccatggactgagattcatgtaaggccgctcacacaagggagtgtcatcataaggatatgagtggtaaagtggaagacaaggataagagcccaaaaacatgcttcagggagacaataagtggagccaaagtaactagaaggatgccaggcagcacaagttcatgggtcttcactcctgtgtatcactattactgacacagctactctgcctacctgctttcccttctattaacttgtttctgttctctgtaactggtccaagtcactcattgtctaggctacagattggttgtcggctgagttaggtagcaatggttcaattaactgaggccaggtacaagagcaggggcctcaagggctgctgagggccccaacttcagctgaagttatgggaaaggcagatacctatggaaggagccataagaacagtgggccccatgctgctcatgtagtacagaaagcaattctgcatccatgtttgtaatctgcctcacattttttggcttttacagagattgtttatatccaaaagggcacacgggattacttttcagtcccagcagtctatgtgtagtgactacatggatacaatagtatatacatacgtgaagatctttcctactaataagtacaaagagtactaacaaagacaggttacttatggaagggtttcctcttccttcttcactctgtttgtttcaaagtcctgtttattagaattaaaaggtgcatggtcctgatttccacttaccaggaggctggtcatttttcatcattacgtagaggggtggctcccagtttagctcaaccatctgtcgtccctcgcaagcctgagagattcacagcaggaccagtagagtttgccaaccctctcaagcaggctctgagggcagggttgacaagttacttcccaagcctgggtggaccagacaggaagaacagatccatacatatgactagacagagccagacacgcagggataataggtcatcataaaagcaaagttggcctccagaaagaagaaaacccaccctgcgacaatcactatcaaaaccacaggtattcacacaggatacttccatcgaactccaaatgtctctagagcaaagaggttaaaaatgttcttgtggtaagtaaaacctccttttcatgcaaacaaaaattaatcacataaacattacatggtgacataagccaaaagatcaacaaagctttacagtaagtaggatcaatccactgaaaagaataattaatgttcaaataagcagggcattcatttttttttccctaagaaaattaaactctgaagatatgggttactgaatatcattagatcagaacctaactattaacacacttcatccaggtggtgctcagctccacacagcttcctgctggagtcagcttagaaaggatgacgggggagtgaaagtaaaggcgcagttttcggccctttttatgaaatgttacaatcctgaaatattccacttaacttctccaggctcttttaaatgcacttctaacaaactggtaggacaggtgtgagaaagtatatgaggctcggagtcaccaggagcgagtttacactcgctcccaagttctgccatttactagcctttgttacatccagcaagtccttcagttctcttgagattcagattcttaccttctcaccccaatcccaatgagcatcttagcacctgccctatctatcacgagattctgcagatcaaattaaaacgtatattcacagctttacaaccctgaagtagtcatcaggcattttcatttttaatggtggcatggactcaaatctcttttacccagctttcaataaaacagggtacatggtgagaatgggttccagaggccaggttaaaaccccaaatttaaatcttagctctctaaataaatcttggcaatctacttacactcttgtttcctcagctgtaaaagcggaagacacaactcattttgtagaactatgaggtgctgcacacgaggcggggctaacaatggatactaaatgaaatactggttttcttcttctaatcctgtggtgccttccaactaaatcttctgtaattatccaatggctttgtggtattatatcttaatatataatatacaatgttcaaaatgaacacaaaactgaagatatccaaccttttcaattcttatattgttccaaaaagcacacctttataaactgaaacaaaagaaatttacaggcagtaaagctttaaaaatcctgacacgtgtcatataggaacgtgctctcttagcagttactttatattatctataaatgacttactttttattacaggagataagtgaaaattaagggcaaatgaacaaaacttcacatacccaggctttacccaaaattctaaaaagtagagtttgctaaggattgcacccaccacaagtaatgaagcaacttttttcccttctattaagacataccaagtacttgatgccatccagagaagataaataatggtttaaacattacaggaaaaagatcctttagaaaaacttacttttggggtatttttcctgtgccactgctatattaagactttacaacacaaacaagaatacgtatcaactcaaaagaattttcattttgacaagaacacaaacatacctattgaaactcatccaatatccaaatcctcctgtttcctcagtcttacagatttagcagtcttacaacggtgagggccagtacttcctgaccacactgatcaaccgaactgtttgcaacccctcaaaggtacccgtgctctcagcgtataaacacataaaaacaccttaaggcaaagtaggaggtggccaagccttggctgctcaagaactgccctaaatcaattttaaaaggaaaaacgaaatggccatgtcaaccgccgggttctgatatgtgttggctgtacttggctagagaaatgatggaagttatcaaaattcttagaaagaagtagcatttagaaaagcagagatgtgcaatttgttttttcttttccatggacaaagacagtaaagcccctagccaacccattaaatggttaactggaaacagttcgcatattattcctctggcctatttctctctacacagattttcacctctagtaaccacagaacagttttttccatcaaccatagtcctttgcagagtaacttttaacaaataaatgtggaactactgtagactccacctccagcccttagtaaaagtaaccagaattggttgcaaaggatctgctacagtttgaatgtcccctccaaatctcatgttgaaactcaattgccattgtgacaatataataggtagacccattagggagtgattaggcattgacagctctgccctcatgaatgaattaatgccgttatcacaggagtgagttccagatgaaaagcaagtttggccttctctgcccttgttctcacattctcttgccctctagctttccaccatgggacgatgcaacaagaaggccctacccaaatgctggtgtcatgctcttggacttcccagcttccgcaaccaagataccaataaatttctgttcattataagttacccagtctgtatatacctaaaggaatataaatcattctattataaagatgcatgcacacgtatattcattgcagcattattcacaatagcaaaggcatggaatcaacccaattgtcgatcaatgatagactggataaagaaaaatgaagacacacacaccatgaaatactatgcagccataaaaaggaatgagatcatatcctttgtagggacaaggatggaactggaaggcattatccacaacaaattaatgcaggaacagaaaactaaacattgcacattctcacttgtaagtgggagctgagcaatgtgaacaaatatacacagggaggggaacaacacacactggggcctgtgtagggggagggagagtatcaggaaaaatagctaatgcatgctgggcttagataggtacagcaaatcatcgtgggacacgtttacctgtgtaacaaacctgtatatcctggatatgtatcccagagcttaaaataaaatttaaaaagaagttgcccagtctgtggtactcagttatagcagcacaaaatggactaagacacaatcttaaactaattgagttcaaccacctaaacgacacttggaatatcccagccctggaagacatccaaccaaagctgcaagatgtccagggaaaagacaactcccaatgcacataccccaggcctatgaaatcactttttgggcccaggaatctatgtatacatgtttcaacaagccctctgggtcaatcttaagaatgctcaagttcaagaaacactgccttacatcacttcttctcaaacttaaatatgcgaatggatcaacctgggacttctgttaagatgcagattatggctcagtcgtttaggggtagaagctattataaagtaagtttgcatttcttacaaatttccaaaagacatcaatgctgctgatccatgggccataattagaacaacaagaccttgagaacagagtccaggtcttattctatgtactataataatttattagcaatctactttggcaaccaagattatgtcatgttgaaggtgatatggtggtaagtagttggaacactgtgtgaaatactgcacattttatttcaggcaagtccatatccttcatgtttatgcacgtcaatttagatagcaagtgctactgtaaaatgtatttgaatacttttaggtattatttcactcatatgatactactcagtttctaaataatagcttggtacatagaggtctgtggttctaatcacacagagtgctcaacattggtcaagtcaatcacttttcctttaccagagttccttacctgccaaatgaaggcatttgcatcaactaatccacaaggcttattactccttatgggtccaacagcatgcatgaacaacaggaaacagcaaaaacagaaatacccataactgctaccgaggtaattttctacacatacaaagcagttaagataattgcctatcttgccaccaaaagaacaaatgttttgtctctgaagacagaaaaataaagattttaatcaaagattttaatctgaactgggttccattaaagcttgcaagctttcttacctgttagaggctcacataccgcaagacaaaagggaaataatctgggttctactccaaaaagtctgactctgaccatgctttagtcaggatacatgctttcgtctttttcactcacttacctagaaacagataactcatctttccatcttattctgtgacgatgaaagaagctaaaccctaacccctaaccccttattccattagggaatatgtatctttcagaattacgaaaattagtaatcaggtcatggtctacattcagcaaaggaaagcaataatgacaagacagttttatataagagtctgatactaagtcagagaaatatctgcccaagtacacccaagaactccacatgcatgtaacctcctgatattgttgtatgtctcttaggatttggcttttggtgaataagtggcattagtcaagctatcaactctaagtagaggatattctactactaatagtaaattcaagcaggtcaggttaccttttggctattaacaccataatattaccatcaaaaagaggaaagttatgaagtcttgtatttataagtgtacgctaaataccactcacctggtctcttaagaaatagaacatcagacatttcaacgtttctttacattcgtctgatttttctgatacacacacacacacacacacacagagagagagagacacacacacacacacacacacttcagacacaggaccagtttatatattgtccaagatggaagacgttataattaactgtttatatcactaactttatataagaaacattcacacttacaagatgttcttatccaaggagaacagaaacaacacacaacaaagtttactgagtgtgtacacttgcactttcttttgaaacatagtaattccttttccctacttttcctggagtcactgttttataatttaggcattattttcaaccctgacacaccctcgaaacaagcaaatccaaaatgtaaaaagaaaacaaaccaaaaaaaaccaaaaccaaaaaacaaaaaacccacaacgaatattatcagcactaatattttgatagagaaaataacattttagaatgagccaggcctcacaccctaactgtgagtaggtaataactcctcagacttcactctccccttttatgtatcctgcatgcattctgagtgctcacaatgctcaaggaactgtggtggatacagaggaaaagaaacaccaagctgacctgcaggaaaggtactactctaagggattttccagtctaggaagctaaaacatgagctaagttatgtatgtattatagacttcccctcacacaaaaagcccagctaggcttttttccaggtgatgtatttcagcagtaaaaccaaaccacctcacttaagggtaaaatgtttctatcaaggccacctactattaaccattacagtatactgtgttaagactgcaggttttgaagtcacacgagttgcagatctagcttaacaatttgctaattacagtccttggacgagtttttaaacctctttcagtctcatcttattcctctgtcaaattggattagagtatctctctcataatgttaagcgagataatgcacagaaaatacttagcatggtgcttgactcaaatcatttcgtcaaatataagttttctgggtgtcaactagtatagaaatagacaaccacagggttcctggaccctgaagagaacacaacagaggaggaggaggaacgagcagagcaagaacacctcagatttcctataccctttccagctaactccaaccactaatgtgtctctgccttggctgaaaaagccctgtctgttataaaggctgtctgggatttaccctagagccactgaatcagaatccagttgtgtctgaagcatctgtattaataagttccaaaggtgagttaccatgcatacctaagtttgagagccacagtgcaagataaaatgctttacaagtgtttcaatatttgttgcgacatgattcaactaagatctgatgttttactctgagcccaatacagctgtctacagtcttcaaaatctcaggatcactgtccaaaatgtcactcagaaatcttcctaatggaattcttcctgatttacctccactccttgcccagggctcctgcccattgtgtgggaaagaagagcatgacacagaggtgccctcactgatccatcttgctctgaggtctggtcaacccatctatcctcactcacagctccacatccttctcatctcacttttccatatctctaatgggtccttaactaatttattcaagatgatgttaccacattgctttcaaacactgagtattaaaatcaagtctgagtattaaaaaacattgtctaatagacacactccaattctaatgattttggtgccctagtatatattggcttggtttccaaacagataaaatataaattgtcttaaagaaacaaaaaaatccatcaacaattcacactacgataattatttaatcttcattagaaggaaaaagggaagaaagtcttgcatttgctgaaatttgcatgtggtcaattcaaaacacaaatactgtaggagactacagaattatttaaaaatcgttatccagagaaagataaaaaatatttacagaaaaagtttcattaaaattactagataaattaccagataaaatataccagcatttatacctctccaattgtatgaaaatttctattacagggaggtgtgattaaagaactacactacttgacttagtaatagatctaagctggctactcaaacagattgccatctggtcactcaattgccatttgaaaagctgctctaaaaatatcttcatataagtgcgtaaatctcatcaaaatgtaatgacttctaattaatttatgctagctagcaggaaacaaaatttcaatgtacacttgagattcccacttataatacaattaccaaaaccctccaagattcccaaattatttccccaaaaagagacacggttaacatctcctgattccacttactatgaagccactataaactagtcctacaattagggcaatctctaccagccttttaaatgtaggggagtccatcaatttgctttagctacagaatacacaaaatacgcattttcttatttccacaaaatggcaacagtacacaaaagtaagcgggtgctgctatttaccaactctaagattatgtacacttctgtaaaatgggaacaatacagaattctctgcctcacaggttgtgagaatcagagagaaaatgtatgtaaaagcatactgtttcccagggcctagcaaaaggaccaagtctccagaaccctgatgacaaagggtaatacaccaaaatatggactcgttttccactccaccttcactggccaagcagctgccaggaataaaggtcgcatctcccaatacctggcaaacaaatgcagtattgcctcgcaaatcgactgcttcgctgaggtgctcatgagcatatttggggagaagcttcaagaacaagttgaagagagactgtctttctatgagactggagagatcctatcaaagaaaatggatgtcatgaaaacagaaatggttcaggcagagaaaacggctgctgagattattaggaagctggagaaacaggagtagaaacacttaaacaaggaaaagaaatgctagctgcacttgccgtcccatctttggaaaacagaactccagaggagtgtgcaaagacaagtgtaaaacccaaaaagaagaaaaagcaaaagccccaggaggctcctcaggagaatggaatcaaagacccatctaactctttctccaaacctaataaaaggaaatctttttccaaggagaaattggttagcagccatcgagaagagaccgctggcagcatcagtcttcccaacaggaagacgtcttcacccaaggaggaagcagttaatgatcccaaagaggcaggcaacaggagtgtcactaagaaaaaaacaggaaattccccttcaaagaggaaggagctggtcagcagtggacctgaagaggctgctggcagcaagagcagctccaagaagaagaaaaagttacataaagtaccccaggaagatgagagtgcaaacggacgtcccccgtcaggcggggcacatcctaccccaaggcgacatttcccattccgtgtcctacaccccaataaaaaattctcacacacgaagcatattgtgaatcctaaggcagtatgattatggatatgcacagaaatatacactccttcaccaaaatgatattcacaggcagaagtacagacactagaaaaatactgaaacaactccttcatttgagctgctgtttctgaagtgtcagccattaaactggagccaagattctctaagaagatactctttccaaaagacataaatcaatgggcaccagattgtatctgtgaatctctctcatgcgtgcacatgcagattatctcacaaaagctccaacaagtccaaagcagcaaacaagaagtaaacacaaaaggaaaaattcctgagaaaacagcataatgttttgagatgagtcacatccaggtttgcatggggaggattcaggaaaaggaacagtacatgctctttctgcacatgcagccacagccatcctggcttgcacaaaacagcaaggtgtttaagtgactctgatcaacacagcatgctgatgatcccattgtacatttgatttggctcaggatcgcccaatcgaatttgctaacacagtagactccagaagaatcacccattaacaacaatccaaatacagcctctaaatgtgcataaggccttttgtgatctccactggagcttatagtatctaacagctgcaactgtgactgttctagctaattgctctcagcaacaaaaataaacaatcgcttcaggaaggagactgtatccaccaaatattaatgaatttttaaaatcagaaatctcaaatcttggtttaaaaatcttgctactgctaaaaagtctgaaacagagttaaggaggccctgaaagtccttattttgtagttaattcgcccctcccacccacctaaccccctcccccacagttaaaaaaaaaaaaaaggaaaaaggaatgtggcttgggtttggaagaatttaagcaatctgagatattttaactcatgtataactttttaacatatgggggaaaagagtcgcactgattggagctatttttaaagtgcagctctaccataaaaatagacatttactcataaggatgcttgaatagagaacaagcccaatctacgtctcattgttaagaaaggggtgaaaaaaggctgtcgtgctttctggagagccgtttatggtccgcctgtgatgtcatggcaggatccaggtgcactctaacgagcagctttcagtctcatcaattcctttaaaagtgctcttctaccatcagctagttctctgagcacaagcaataaggagccagtatttacccagacccttgcaagacagaacatcaccgcaatcacagacccaggaaggaggaggaaaaattactcacacacaattgggttcatcgtcgtcctctcctcctgtccccattagggatggaagcattttcttttgctaagaaaagaaggacagaagtagttatcagtaccctatgacatctactcaccctctgtccgtagagagaaaaagtagcttcatacttctctccctatccatgaccctactgcatagctgatgcttgcgaccaaattacccaccgaacacagtagcaagtagtcatttaggcatcactaccctaaactgaggtttggagagatcatcttagcgtctggacttcatctgtctttagcctttttaaaaggctggagactcatgcctgtaatcccagcactttgggaggctgaggcgggcggatcgtgaggtcaggagtttgagaccagcctggccaacatggtgaaaccctgtctctattaaaaacataaaaacaaacaaacaaacaaacaaaactgggcgtggtggcaaatgcctgtaatcccagctattcaagaggctaaggcagaacaatctcttgaacccaggaggcggaggttgcagtgagcagagatggtgccactgcactccagccttccagcctgggcgatagggcgggactccgtctcaaaaaaaaaaaaaaaaagcctggagaaatacagttgtaataggaaaccacatagaactcctgatttttacacctccctgacataatgtcagcaacaatcaatgtaacaaaaaacagacaacagctttgacatgtcttaaaaatcagaaatacgttattttatctcaaaaaatattattcatatacgcatagaacacaattaaaaaagcaaaaaaactttattaaagaaaaaagcaaatctgaacgtttaaaaatgttgtagaaaggattaaaaataaagaggcagcgacaaaatgtactaaaaaatgttttctttccatgaaaggactgagtaaattttgacctgaatttttttgtactttatgcattttcgacagtgactatactattattgactgaaattattcttaagggaggtaaacgatattgagcacatcaaaaaatactatatgcacttacctatgttcaacttctagatgccatacatatcctgaaggatttcaaaaatctgacctcctaaaaggacacagcttattaaagttaattcagcttgtgttttagtactttgatggtaggaaggacagagctccaagagtgggggagggctgggtttcagtgccaggtctcaggttagcaaaaaatcttggagaaccttaatctctctgggtctggctcatacatctgcaaaataaggtgtgctgaacaagaccactgaagtgtcttccaactcaaaaccagactgagaaatagaacatagattaagtcttcagcctaaatcttacagcatagtgactggtacagcgtagatgcttgatgtacacttagtgaaagaaaggaaattttaaaaaagtaaactatttaaatcagagcttcccacacataagccctggtgtgctgcttggcctagaagtggttgtacgtgtgtggagataaaggttccccctcaggacaggcactcatgacataaacgagcttgggaagcacaacttttaaaatgtactactatttcagcaaaaaataaaataaattttcattattaggatgaggataagtttcagactaaatttatgaaaagttcttaccaccctttatgtaggaaagaccgaatgcttggcttatcatctggtcctcaggccatcttaagacagaaaacataagtagcagtttacttaagcaaagaggacttctttatgcaatgtatgaatagaacacaggtacttctttaagagtaacccctgaaaaacagaatacattcaacatatagttctctacatacagaaaacacactgcagcaaccattctcaagagatgaaatttctactaaagaacatttcataaagtaacaactgcaatttctgcttcagcatttctagtaatatctgcttaacctttctgatagtcacccaggttttttttttcttggtgtgaaaatctgcattatttcttataattactactacacctaaggcataacaaaacatttttaaagaaatagatgatctacaacatggatgtaaaagtacggggattttctttcaacaaggtgctcaatggtacttcctgatgggctgctttttttcttcaaggtccaaggaatgaagcactgcatcttttggatgcctacatagatttatgggtcatgacctccctcccccattctcatggccagctgctgcacctttgccacactgcaattaaaaacccgcaatccagataacaaaactaccttgccaactgtgtttcattccaaagagtgagtcaccctgagaatggctgctggtctcatcatgtctgcaagaaaatccgcagatgggcgggttgtttctgaagcatgcattcaacaggacgaggagcattctcaaaaggagtacaccatgaaaatcagcattagaggtagcatgtggctatcaacaacctgtaggtcaaagggccttacaggattaaaaaaacccagcaaggttcatcattgaaatggttattgagtttccaaacaccaaaaaaaaaaaaaaaaaaaaaaaagggcatcctatcaaactaaaacctcatcttgcatatatctgagaagtatttgaattttataatttttccctcaccttcgatgaaggtgatgcttgagtgatacaggtaagaagagtgtaaaattcatatccaagaaaggaatgaatcaggtactgtaacactagaaatagtataaatcctaaaaaatgataacttttatcatctgaacaatagagttttttaggtataatagtgggagaaaaagatcagtattctgttgctggagagattctatttttgtttgatcttttcacatacactgactgcctgacacaccccaaataaatgtctcttttaaaagagaggaatgtccctaccaagttctacggaactccccaaaccacacataacctatcatggcaagtaatttttagtgttgcagtagaaatgggcaagaaaaaaagttttgctgtttaggtattttttagacttaactagtcatgggcacaaactcctaagtctagactgaatatgacttattaattctccagaaataatagaggtagaggcttgcctatgtctttgatcccagggatgtcttcttgaattgcctccccgggtatcttttaaaatcccacctacccttactgatgcagctcaactgctgccacttctgtgtggctcagcattcccatcccaggaacaaccttctccacgactacatgcaacattaggagtctccccacttcctcctcttttaatgcactttgtgtacaacactttactgtagttacttacagatgtaatcttctagagcatgacaggctccaggagagcagaaaggcgtatgtcttccacacatttatgtctgcagaaatagactgttttcttgtatttataaggttgctataaggtatttatttgaaaaaacacctatgagtgattttgaggctgagtattaacgtagtcttcacccatatctttagttacttaaaccaaaagtaatgttaatactaagtttaagatcctaagatagtggtgagtcttaaggtagggtaaaacccatcaagcatacttataatatccagggtactttactatattagtacattcaaaatcgtcactccatagtttatgtttagagagagcaagactatccagccagatacctcacgccatccagttattcagatcgacagtgtcttatcgtttattagtagctttgcgttttttaaagagaggatctggacaacttgagcatggcagcgttcaaagatttgcaaaactaagtgataccactgtcagactgaaaattaaacaatcagccaacaattagtccaagaaaggaaaagaagcatctgtaagaggagtagaacaggttttacttttgtgagttgtaactgcatttataaaaactacagcaaagtagcttgacagctgctcctgggctctcatagcacttaggacgttgcagtcgtaacctgctggcttgttagtcctcccttccaggtggtatccaagaaggtaagagcagtattttgctcacttttatagacccagggcacagtatggtagatagttaactatgtgctgaccaaccaaaaaatctttatttttatgagccagaattctagaaaggttaatttcaataaggtccatcctatatccacaggatgcctgtaatagtggtgtaaatattcaatctttgcaacttgaagggagatgggcctacttttggaaattttcagaggaggagtgtgactactactagaagtagaaaaatatgggctattaactgcaatgacagactataaatgctcttcatccaataataataaactgtcacgattttatcagtatttgtttggtcccactgtttgaggttccactataatagaggcataaaaaagctaaatgcccctctttttttcttctacccaataaaaggtatatggcctattgctccataagtaggttaataggcctaggtactacaatttcaacaaacttattaaaaaacacattttctttgttctaggtaacgctgtaagcaagcagttgtcagtttccactacaattcatttgtaaacctcttataaaaagtagaaatcttgcaatctgtttatcttaaaaaaacagaatggttaaattgctaacatttttttctcagattataataatgtaaaatgatgttaacattaagaatttcacgtaggccgctctaaaactgaatttcaatattgttcagataatttccaagcacaggttaaaaaaaaaaaaaaaaaaaagggagaaagacgaaatttctcctcaaatataccagtagttactataccaacttcctttgctgagaatttttccactatctgctcaattataaaagaactgctgacatgcaaaccaatcaaaataccgataaaacatgcaagaggagagaggtgaggggaggatgttccaacatcacaaaattagagtattaaattcatataataagaagagggagtatggagatttaagactaattgcatgttgaaaaaaggaagtgtcttgtcactcaactacgctcttgactagtaggttgtgaattcaagacaattacttttagaatggcttttaccaaaaaagccgacagatacaataaaattaaaataagtcatttagtatactttgtttaaaaaaaaagtgtttcattattatactcatttgtctgaagttctatagaagtagaatcctttcacaaaagatcagcaggaaatccttttaaccttcacagatctgttaagggtgtatacaagaactgaacttctatgcgaaatacggggttggcagagttcatggtttgtaacgtgtgtgacacacaacaacactaacttaacagaaactgaatttctgattttagggaacaatctcttgacaatctagcatttgtgcaaaaaagtaactttcacacagcaacacttaatcccatgagggaattaaagattgccagtggaagccgagtaagctactttcctcctgtttggtttttaactgacgtgtaagggtgattatctgtgcaaaaagctgaaggttgaatcccagccataaaatggtgtcgatatccgatttcccaaactttacaactagcagatgagagtatgttctcctgtgagaattactcatttagcagtatttgaaaactaatcagaaggtgtcattcagtccaaaaattttctgcacgttctacttcaattaacttgccttttggaattctaagaggtaacactgctttccactaaaactctcagggaacttcttttaattcaagaaagcaagtctgcttattagactgagcacaggtgcccccgaattgtgtataaagacctactcaccacactgttctttcccttcaactttgtttattgatgtactgaacatgaaaaagtacaaagaatccaaacacaaaagaaaacatgtacagcctcttaaatactcaacagaatatattttctattccaacagatgtgaattaagtcatactgtacaacttcaaataaataccagccttacattttattaagtgctctgataaaacactgtaaagtgaagcacaatttgcatgccctctcatcaatgccttggtttgctacagtagtataggaaagaagcatgtagctgctgttttcccttgagggaaaccttattatttttttttaagtatatacatgtattttattttttagtgtttttctttttttaaacgcagaaggttaactctggcaatctaaatgcacctaaggatatgagaaagtgctaagccaattgatttctgaatagcattgagtgggtcagcatgaaaactcgcttattcactttagcacgcgcctcacagtatatgtactgtactatactgaaaaattttataactacaattttaaataataaaaaataaaactcaaagcaaccgcaaagataatgtacaactatgttatgcatagcacattgcctgttctaaggggaagcatgtgagcatctcagtttatacaaaaagcaggacgtaactatatagttctcagtgcatcctgatgaaggcatttttgccttcagcttttttgaaaatttattataagctagatgctaatcagaaaatattttgtattttttaaaatttctttcatacatggtaaagacttattttattatttccccaaatagtggtttttaagcatcatacaaagttaaatttcaatagcatacagatatttatgatttttgtatgaaaaatgtaaggaaatttgttcaaaacctatggttatactcatttttttataccacaaacatatttataaaccaaaatgtagcatcaccataaacagctgaagctagactatctacagacaaaatttgcaacaaatctgatgcactgtaaattcaagtcctcaggacaacaaaagtgattaagcaagacctcaagtaacaatgttaatgccatttacaaaggaaaaaactgatacaaaaacattcaaaacctgaacatcacttggcatgtaagggaaaaaaaattaaattagctgaaaggttcataaacacaaggtcttatttacattacacaaagctcaggtgttagccttgaacgtaactttcaaaataccttcaaatatatccaactcagatcacttttgctgatttgctgcagtacaaatcatgtgcaacgtcttttttccttaagacaaaacaattcttcaaacaatactgcaagtacatcactaaacaccatgagctctatctgaagggatttctttaggaagaacagattttttcccccatctctcggtaatttaaatttcttgcctgctcttatatattcttttgtaaattttttttatttgtttcaaaatcacaaatcaatgtgagccacctatcacataataaccaggatgatcagacgctccactggtgattacaaaaatgaaaccagcagtgtttccccccattgattctactcctttcatacaaagatctcaaaagtattttctacaccataaatctttctaaattttccaaccgctgcaaatttcctggtaaattttaaaagctcactaggtgtcatatgaagagatttctcaaagtattcaagtcaaaatatttgttccaggaccagtaaaaagtttctccaaattttcttttttataaaaatagatgctttttttaaacccacatcaaagaggctcttatctctttggcaaggtactgctttacgaaaagttctccagtattcttacaataagcgtttataatgtagcccccccttccccaacccaaatcataattacaaaataaatactgttttaaacttcataaataaaaatgtaaacttcaaaatacttttcttaaacagacataacagcaatgctttaaatgtaaaccaaacacaaagctaatcagaaaaaggaaaaaaaggggggaaaaaaaagacacaaccaactgaagaattacaacacaaagcctcaatatttactcacaggttcaaggcagttatgtaaaaagaaaagaaatgtcttcccttagctgaaacactttaaaaggtccaccttcttcaaagaaggcaatagaatgcaatgtgacaggtaaaaaccctgtacctcttgtccatattcaaacataaaagatatttaagaagttttaattcaaatactagcaataaaaaatctcacatatttcttaggatgctaagtagtcattttatccccatctcaacactgacttacaaagacatttactaatgtataaagtttctcttaacttgcctttgttgtatagttttcatatataaatggactgaggacaagagctcattaggctttgtgcgttttgtttgtcttaaaggagacctgcagtactctgtctcccagacggtatccattgaggctagctatcgccatggcagcctcatcatagtttgtcatagtcacaaatccaaaacctttgcatttattggtgttaaagtcacggatgaccttcacattggtgacagctccaaaaggcccaaacatttgccacaggatactctcatctgcgtcaggagccaggttgtacacaaatatacaccaccctgttccagggtgcccagggatattaattccagccaaactggtcattccgtcaatggtcattggagaaaacctgctaaacagaataggaaatacacacatacacacaaaaaataaaaacagaggttggttatagcaatgaacgtataccttttccatccccaagaattttagtaactctcctcccccaacaaatatataaactatttcatgttttgaccaaggtctgtgtgtggctttgcagtgacatgctagactactgagatattaataagttatgaaatgaccattattcactgtactgaatatcatccacaatagcaaagaaatatatttagaactggcttcatgaattaagcaggattggcaggggaagggatcaacacatacgtaaacatgctgtaacgtcgtaacgcaatacgaaacaaatgatgggtttttaaaagaccaggtggcatccggtggtataaaaatttcttgagtcaattgtgcttcaaagagcagcttttcattaggttgcacatgcaaaataaaacccaacaaaaacttatgaggggtgtgaatagcactcccaaaatcaaagaaaccaatcaactgtggaaagggattatgagtatcatgaacctctatcattacctctttactccataagccatattgagcagattgtccaacctgcaaaacacacatttagcaaacttcagtttttaatttttccccttgatgttcaagaaagttgggctcattactgccatcttccgaggggatatctgtacactgattatatgtgaagactcagaatgctgggtctttttacgtttttaagctaatgggcaccgactgccacaggacagttcttccaatgaatggtttctctctacaagggtcagtacatgggacacagtgacggtcatctgaggatacctttcagagaggaagtgcgaaagctctgggatagttaactttagggttctcatcaggtagcttcaaagtgatcaatgtatagctacatgttctttatactacttttgattttcacaactctgttggtgcctgcagatacctaaggcacacagggtttaagtggcttgctcaagaccacagggctagtaaattatggcattgatactcaaactctgcaggttacagaattctatacattttcctttcatttcccaactttgaagggctttcatcttttagaatcaaggaggtataattacaggtagaaaaaaccttatggacaacccaagctaaccctcccatttctcaaatgtgctcagctgaggtctagagaaggaaaaaagaaaaatccatcactccagtgtgcaacaaagccaagagttcagatcctgatctggatgctgtattcaaattacgctacaggaagtgtcgtcctactcagttttcaaaggccaggtaggaaacaaaacaagccaatctgagcctcacttaaaatgtttatagaaagtaaataggggtgggggtggaggtgtaagtactctttaaaaccttctacatttttcctatatcaaatattagttttacagcatttgactcttctttatcagtttcaaaacaccactctaatgtcccaaatttccacagtgcttaccaactaattatgtgttctgaggaggaggcataacttaatacatagtccacaaccaccctcaactgctacaatgctcaacactctccaaagacatcccagggttgtccctctgggactgggggtgggggtgagaattttttctttaacacccgtgaaaggtaagtttgaaaagtctcagccttatcacctaacctgtggcatcaagtcacgctaaagtatacatgcaaaagccaacaccttttagttttgtaaaagccaaaacacatctcatctggtctttcagaatggggaaatatatagcctcccacatccctgccctcagtctccactgaaaattctgttttgtaaagatgagaagaactgagcttatgcaaagtgtaaggaaacagaacagatcacaatgacaaaagatcttcgtgtgtgagtgtgtctctgtgtgcgtggtgcgtgtgtgtgtgtgcgtgccttgacccaccaccctctcattgcaccactgagcacaagccagggtcactgatagtttataataaatatgtgatgaccaaataaagacaatgaggttaccaaaattatggtcaacttagtccagaatgaaaactagtaagaggattggttggatgaccttgtctgcacataagtaaaaagatgtggggttttattttttgcagaggtgagtacagtcaaagatgccatgcctttatagtcaagaataaggatcacaactaccagcaataaagacaaacacatattagcaccaccaatcataaagtaacaatacaattttatcaaattgctggaatgatcaacacagaatgcatttggcatatgctacctgtagaagagaaccgcatactgaggtctccaaccaaagtgctagaagacccagaatgcagaggcaccttatcaattcactcaaaagttacatcatctatgcccattaattgcatccatgtagggacaggtcatgctttgctaccacccactcaggacaccaagcatacggcccagagacagatgagttttcagaattttcaaacagggtagaaaccaaatctgcccctgaagtgaattaccgtcaggccttttttaacaatggggatatgttctgaaaatgtgtcactaggtgatctcgttgttgtacgatcatagaatgcacttatacaaacctagatggtaatagcctaccacacacctagttatatggtatgggctatggctcccagtctacaaacctgtataacatgtcactgtactgaatactgtaggtaattctaacacaatgctaagtattgtgtatttaaccatatctaaacatagaaaaggtaatgcattgcacaatattaggatgactatgatatcactagacaataggaattttttgcagtctactatattatggtaccacggtcgtacatgtgattaactgaaacgttatgtgatgcatgactgtacatgcagtgagggagaaacatttcgttttccatcctccatctccctcacttccatctctggcatccccagacaggaggtttcgaattttttataacaggatctccgaggaccctccaaattatgatagggcatcttttttaccctatctgtgaagttttacatgataccatgatcttcactgattccttcacttctctctcattttagaaaaaaattggtcctttggaactaagccaagttatccactctaatctttcttctcctccatcaccaacgagtgtagggagaagcatggaacctagaaaacagtgcccaggcactgctgaagccccctgactgtatgcatctgagcccagaagtatttcctagctttctcggtgccatagattcatgtttcccatgggagctcagaaaaggcaacgggtgctctacatgggcaccattcactccaaatccagtagcagttggcaaactgtaacacaggcagttgtaagagaaaatagtgcagcagctcaaacacaaggactactacaacaagcccctagaaatatgtctgctgggtctgtccactgctcaaggacatctttttattttatttatttatttttgagacgaagtctcgctctgtcacccaggctggagtgcagtggcgtgatctcggctcactgcaaactctgcctcccgggttcacaccattctctggccccagcctctcgagtagctgggactacaggcacccaaccaccacgtccggctaattttttttgtatttttagtagagacggggtttcaccatttagccatgatggtctcgatctcctgacctcgtgatccacccgccttggcctcccaaagtgctgggattacaggagtgagccaccacgcccagccatcttttatttatggtcatttataaatggaagtcaatttttaaatggagagcaagctagctgcctccagaatatctcagggaggggtgtggatgataacgtagtacatatggaaggtaaatattaaagtatccattaaatatatatttaaaataaaatataaaataaatatgtatttaaaataaagtattttttacttatatttaatagatgcactgaacccagtaccttctcagtcctgtgtatcacctgcctccctgggggaagactgagcaatcatcgaaggggagaggcggcgagtggcactctctcctgctctttagcctgaacaaaatccattttacaaataacacagcaagcagatatggaggattagactggataacctgctttaattaaaatgacctccatttaaagaaaaagtaacttaaaaaaagattactacaaatgtaaatcagagtaaagaatggtaccagtaagggaaatacaagtaaataaggaaagggagagccgattatttctcctactcttagtacaagctacattataaggttagacacaagataatccaacatgcatcacatgaagtcagatgagatatctgaaattattttatggtcttgctttaaaagacatttattaagatattaggtacatggaaaatgaagccaaccagtatagtaattagcaagacatttaatacagattgtctcatctttatccttttttatgtttgattagagtttataatttaatgaatagcacacgcccatgtacatatgtaatttatgaaaaaggcacataggagagagatgtgtataaacatttttctatcaacaggaccaaagctccaattataacctgtcaaaattttgaacagaaccatgtatcagatcattcctattttaaagctaggtgttcataagtagaaaataaaaataaagtacctgcctaatttctaaaaaaattagctgatggactatgggaaggcctacatgtaagtaaggggaaatgtgaacccgattaaagtcagaaataaaaataggaagataagttattgatgggtaagaaaatatactcggaatcccacaaataatgattatcaaaatctctccaaagcgccaaccgagaactgcttggaaattatctacaacaagatcatcttcttactgccttactgccttattcaattagatggtatcatctgtcctctaagaaagaggaaaagtattcaaggggattgataccggtttcttccaaaaggaaattgtgataatgcaaccagtacgtcatgccttaaaggcaactcaagtgctcatttaaaaggctttttaaaaaatgcataaaggctcatagaagcaggcacacaggtcattacactagatcatattcaataaaattatagctgtttcacagaaaagaacatgaaaaaatttggcttaaagtttaattctgatatcatgtcccaagaatatacttaaggggcttgaattacaccatccatccaaataaataaggcttgtcctattttgaaaactgcagtcaattaaataagcgtattagaccagcagtgctcatattacaacaattctctgattattcatagattgactaagccataaacctcacaaacccacctttaaacttaacccttattacatggatttttaagctttttgaccataaaagatatggctcatactttatgattattaaaagtattcttgaccataatacatataacttatattgctcaatctctctcaactcccaaggtactatgagaacataaaaatacagtgagaaattttctacatgtctgctgaaaggtgacaaaaactcaaggcaagagcattaaaacacaaatatcagggacaaaatatatctgtgtgatgatttagactcgaactacagaaaacagcaaaataccaacaaaacaagcaagcccttaattcaagtttctttatcaggtgaaagaagaagggggagtggggcggaaatcaagataatgacaaccaggttcaatatactgtattaaagaaaagcatcaaacatcaggttaaacctgaaatctgatttcttccaacacacccaatctagatcaaacactatctctgagcacactaactcgttcatattttattatctggacagggatcatgggaggaatgagaaatggggtgaatgggacaacagttaaaaatctgaagagagaataacaatttctcccattttctgaaaccaagtttcccttacaactgacaatctcttattctcttcttccaaaatgtctttctataggagtgaaggaaaaagaattttcaagttaatgataacatatggtactaaaagataaaaacacagaatgggccagaaaaagataattaaatttgaccataagaacatcctgtaaagctttactcaaccaaaaataaaaagcacagagcctgcagggatggaggctaggtaaacctaagggctgacacccatcaacaacctagcacctgagtcacctacaagccttgccatttcaataatcaggcactctcccaaatcctgtcttctcaatcttcctaagaattcaatcttgattccaagaactttgttttacttaataactatcaaacaaaatcattgcttcaatctggaaaaaaaaagtagctaatatagctttccactaacagcaaacattttataacttcacaatgttaaaaatcaaccaatacattatgaagaactttgttctatctaaactcgagatcattttcaaggccccaaagagctctgaaattaactggacaagctgcctaggaaatacctgtaaaattccttcaggcttgttcatcctacgtttgcaatttaaaaaagtatatttatacatatattattcacttaagatgtcacagaggaaacctatgtgcagagctgaaaaagggctttctttgtgagacttctttctccacaaaggcaagcatcaggcagccccacgcatctcccacactagtctgatcaccactaccatgggaagtcaaaggtggcaaaggttttttttttttttttttttttttttttttttttttttttaataccaatgccttttcctcacagcagagcatgaagtacaaggctcaatgcttttgacagtaccacctcttctcccacggcaaaggccaacttaagttgaaatttaatgtggcattcataacaaatttccttctcatatctcaagcaacataatttagtatttttttaaaaggagctatttttaactgattttatctccactctcttcagcactgcaaatattccaatgaaaaaaataaatgcatagatttaagctagaaaacataactcctgatcttattaggttatatttgtgattatatttttggtaattaactattctgtcccatgaatgaaataaataaaattgatatgcacttggaaataatttttaaaaatcagtgtggggttagatagcattctgggtatagtgtaccatatggccaaaaaggatatttaaaaatgtcctggaaaataaaaactgcatgacttgcttatgaaaccaaaaactctctgctctgcttaacttcttaaagtcactgttcttctcacatgcagattagagattttttgaatgactcctggtttgttatcccaggatcagaataaaacttaaacagttagcatatgtacacctgtcagtgagatagagtgtcttctttgggctaaagccacggtcattctatgaactacagagaggtcagtaaattacaaccgacaggccaaatggagactgcctcccacctgttgctgtatgggctataagctaagaatggcttttacatttttaacaggttgtttaaaaacaaaaacaagacagatgcaacagtgaccataacccataaagttaaatatttactatctggtactgtacagagaaagtctgccaacctgtttgtaaacaattttgaaaaggaagagaggaactcatttgtagaaacttcacgtagtcacataggttatatacccttaatggtgcacatactataaagtgaagtaacagaaacagcttgacctaaaaattgacacatgagaataaaatcctttaagaaaaaaaaaaaaggaaatctgaagccctggaaacaattcagataaccccagaaagctacagattagaatttctcaaccacagcattattggtgctttggaccaggtaacttctggttgctggggctatgctgtacactgtaggagcttagcagcatccccgacctctagcattacatgctagtagcacccccacaggttgtgccaacatgaatacctctagacattgccaaatgttccctgggaggcaaaaatcacccttggttaagaatcactgctgtaggttactgtcctttggtccccaccttcaatattagcaaaagacactattcctcaagtagattctctctgtgcccatggagatgaaaaattaatagtaataaaaccaacaacactgacaaaagcaaaccagagatcctgtcaataaaagtactggacagtaaacctgagtattctctttcagtttagtagctgggcacaagaaccaaaccagacttacctaaaacgctgtgcctgctgagctagcggtcctggataccttctgtttggagactggtacagctgggaaaggatggcctgattggttttttggcttgggttattagcaaactttacagtgattggctccgtggcaccgggaggtttctggccatttaggcctttgatagcttcttctgcctcaattcgcttgtcaaatcgaataaaccctacaccccttgatatgcctatggtagatttgagtaaagatttggaaaagagggaacagaaggagaagggaaggagagaagaaaggacacattaatttttccttctcaagaacatgttttcacctacatataacatttcccacaaaatcacaccaggaggaaactttcccctttacttactagccattcagtttagaatcacaattttgcatttttagaaaaattcgtgtcacttacataatctgagtacccattatcacatgcattccaatcagctaagacaagaaaacacaagcatgtccatgttttctctctctcccacctccctcccgtacactcttttaatgtcaatagtgtaccggagttccatttttcaatttgtgctattggataagcagctcagaaatgagggacacagtagttcctgtccttgaaacaaggagaacagaaagaagaatttgctaaaaatgctacaaagctatgctaaaaatacatacactgtggtagaaagacatttcggttgaaattttaaataatatattcagcttaataatattgcataggatataggtcctttaggaaaaaaatgcctgaaaatgctcttccagttctctgaagctctcttgtgcttctgactagctatattttattacagaaaaatattatatggagaaaaagaaaagacgtagattttaaaaataaataaatttctagaagtaaagcatcaaagctttctgacctcagcagcatcactcctgactacagaagatcactccctgccccacattctccccagtgtgaaagacacaaatgggaaaggatagccaagaacctttccaggttatgaaaaattgtagagggaaacccagcttattccatttaattagcgtgaacaggctagtggggtgaccacagctggtcatcatgagataagcagtggcagggaaattttttttggcaagtaaatgagcactggaccatcatacttggaggagcttaaaaaaaaaaaaagaaagaaggtctacttgctttaaaattaatactgtgtaaggtcaatgactaagaattttctaatgtagacaaagcattttttccacatatgcgtatctaagacagcccctatcactttaccttttctatttaaagagcatgcattgcacattattaccacctgatggctgaataagaaaattgcagggtttcatttttcatttcaggtaaattgagtaagttcactttgaaagccttaagtatgaagaataaatagtgaaatgatagcaaatcctttcacttatctactagcgcctattaagaattaataacctctagaatttagctgttccattagaaaagcatcagattagcaaaaaaaaaaaaaaaaaaaaaaaaaaaaaacagcctctacacagctagagtcacctaaatcggtggtcctcctacttaagcatacctaagaacaacctgtggctcaccctcagagatttattcagtaggttctgaatgaagcccaataatttgcatttttagcagggttccagaagactgctgatactgcaggtgcgggacatacttgagaaccgctgactaaaacaagctaggtccacctgtgatggactagcaggtaaaagatgagacgcactttgtgtcataggtgaaacctactctcaattcacaagatctcagaatgaatgaattagaaagcacaaatgaaataaaaaatatttttgttgctttgaacaaattcatctttatttctaggcctggatttctatttaacaccattattagtctatgtgataacaacacagggtggcaatgtataagtattatgaattaactaacacaattaaggaggctgtattttatatactctcacttgactaaatagtctcatgacagcaaaatctgtaggctattctcccaggcatgcatgtagtgctagctctctctactcagaactctaaaggtggtgcttcctatgaagccaattaacaacacagaggcaggtaatatgggctcctctgattagattcagatcaactaaatggatcttcacttgatgaatgaaaaatctggctcaattttcttctgaagtcactgctttaaaagaattagacattgtaatatacaacatgcctccaaggtattattattatacgggtggcggggagagaaacaaacagtgaggagaaaagctaccttaaaaaaacaaacaaaaacaacctcacaaatcttcatgtggctgcttcagtctatggtactacagctaatatttcctcctcacaatgtttctctattttttaactgtttcctaaagaacaagtattgctttcattttattttttacttattttttgaaatggagttttgctcttgttgcccattgcccaggctggagtgcaatggcatgatctcagctcaccgtgacctccgcctctggggttcaagtgattctcctgcctcagcctcctgagtacctgggattacaggcatgcgccatcacacccagctaattttgtatttttagtagagatggggcttctctatgttggtcacgctggtcttgaactcccagcctcaggtgatccgccctccttggcctcccaaagtgcttggattataggcatgagccactgtgcctggccaagtattgcttttataatagaaaattgtatctgtattttatttttaaaattcataatcaaatctatattgctatagctttgttaactaagatttggcagaacaactcccttacattcaagagttttaatgaacattttagtcttcccatttcagttgggctaacagtgatattaggaataaaataaatttttaacattcaaaatttcaaactcttacatatgcccatacagcacagcatgaacctggaaaacagcctgaacagcaattaccagtgtggatgtagtgtaatcctcccttggagaactagctgcataccgctgcattaaacttcgctttttgacaaaagaaaggttgtttattagtactctataagcaggatgggggcttttatcacacagtggcttggaaatgaagattatagcatctataaatttattacaagccatgaaacaggcttcaatcctgcaccttcagggtggaaatgactcaagcacgctcactatactccacaatctatttttatccatgcatatttatgaacaattccagcagaaaattgcattttctggcccacatatacctttgatatgttctagaagcaagactgctacatggaaagacagaatatttcacaatctgctagtcagagacagggaaagactgtccggagtggctgtctacttaccagtgacctggtcgacaagaatacgagaagtaataatgcgtccatattgtgaaaaaagctgttccaactccttctgggtcattgtttttggaagtccgctgacatataaatttgcatctctgatagaagctgaacttgggcgagcataggaaacctggaaaaggaaaataaaattaaatgtatatgcatgctcactcacccacctccctttagaaactcaaaaactgcctcggtaactttcccatgaacagcatagaacactgaagttcaagcaagtcaggtgctaactgctttattcatttccaggaaaattctagacaaatgggtagtagtattcccattccctctcccctaggtggacagggaagagtatctgtaatatgctggactagcctactgcaagggacagaaatttcacaatatatcccatcctccagattattactaaaaatggtcaatgggtctgggatcaatttgcggaggtatagtgattcaacaactgcctgctcattttatcatttgtacccacctttagtccagttttaattcactaaaatttaaagttcttaaaacagaccagtggtgcatacagcacagtactgttcacaataataggctgtcttctgtggggccaatcccctagagcagtggtccccaacctttttggtaccagggactggttttgtggaagacaatttttccatggaccatggtgggggatgcattagattctcataaaaactgcacaatctagattccttgcatgtgcagttcaaaatagggtttgtgccctgatgagaatctaatgctgcagctaatcggacaggaggtggagcttgggcaataatgctggctcacctgctgctcacctctggctgtgtgcactggttcctaacaggccacggactggtatgggtccatggccaggggttgggaacacctgctctagaatagggatttaggcccaatcattctaagcttaaagattccaaattcatggaacatttttgttttctagcctctcacatctgtgtgggtggtagtgctacatttctaaaaaaaaattcacccttatcagtaagtatgctcttttgatatatgctgtatgattgtccataaattcccagaaatttgaatgtgtgaacaagccctcattatcctttgtctgttgtcttctcatccacaggtctttttaaccttgattttcaaaaggtcttaagtccctataattaactttgcctgccactgtatgtactttcaaaaagtttcatgtctttgagatacggtataccaaatcccacaaggacgaaagacaaaataggtctgcatgtatttgtttataatcatcattcctcatgtaaactctgtgagggaagaaaccacatcattcttggtcatcactgtatcctcaatgcctagtgagtgcctgacatgtgatagatgctaacacatttggtgagtaaagcccatccaataataccccattgatcatgcagatccacaacggcttactgaaccagagcatttaagggtcagttcaagtcatccagatctcctgccccaattgtaattgatgactctctgcctataacctatctttgccaacatttagtctcatgagctattcctgatcgcattccctttggtttagctgtaatattctggactagcctacttcaagggacagaaatttcacaatatacgccatcctcagattattactaaaaatggtcaatgtgtctgggattgatttgctgaggtaaagtgataactactgcctgctcattttattattggtacccacctttaatccagttaacaacaaactttcccaatttacactaatacttaaataacttttagtatgaagcaccaaacattttccccataatttgaattgtgcccacagctctctgttgccactttttcttggctttccagaaaaaaatataagccacattttatactactttataaagacctcgttatctttcacacccctgccccaatggtgttaacatttaatactcttctttattcaaaccgtttgctcattaacaagtgaaaatatacctgttgttccaaaggctatgtttggaagttatattagcactgtcctgttctacagaagaaacaaggaatttggaatagtggtggagaaaacatacataactattcatacgctatttgttttctctatgcctaaatacttaagaacaatgaagactggggaacttaaatgtaagtgaagaacaagtggccaatttcaagtgattaatgtaacttagatggaatcaaatcttgggattgctataaactgatgaaacaaggccaatgaattatatatgcattcagtaatatgaatcaatgaaaacttaatttcttttctcgtgtaagattctcaattatccagaaaaggtgaaacctcaccagctgggacgtgcatccctatctaggattctatggcttttttttccacaggagggagcacccaacaagtcagctgttactctgttccagatcatgtgactgaagtactcccattatgaacagccatgtcccatgggctccagggcaggcatctacacattctccaaggaggctaacttccaatgactgatcaagcaaccagcagcaggtgacaggctctgcatgagatcaagtgtcacaggaggcagtggaaatgtggttaaaggtaacagctaatcggtgtgcctgggctcaaaactaggtttaattcataaccagttctgtgaacttagaactaagttcttcaagcctattaccacaattctaccttctttatatggctattaggaataattaaataatttctaatccacatgaaaagcttcagagcctaatctatgtgacattataaatattatttacctctacatgcatctgaaaatttaggtaaatgcccagccccttaaagtagagagaaacctgggtccattacagtgttctagaacaatttactcatgcagtgacattcactgctttgtgcaattcagatgagtgtaggtggtgtgtcttaaaagtcatcctaaaatatatttaggaaaatgggtttatatttaatgcttatataaaggctttgaaaacatacctaggtcagttatgtgattttttttttccccaatgtccactcttcagtttatattgtatctttagttcccagccacattaaaaaggctccaagacaaaccttctcaaaaacagtatctttcagtgacattgtcaaagaaccattttccactaccacaggcaggacaggagtgattagattatatataaacttacgtcggtaacaatgtttaatgttaaacttacatttagggcattatgagacttcaccatttacaaggcattttcacaaactacaatattttgtctgtgcctcacaacaaccccatgaggtaggcagcatacatattagtattttatagctggggaaacaggcacagacaaggtaaataacatgcctaaggttatacacaactagtgttgaattctgggttcaaactctgatctttctctttctgtgtcctggtctcctcatccagttttccttcaataatactatggtaagtgagtgtttcagttcacttgttctgagttgggaaaaattaaatgaatcctggctgtttcttaaaggcatacacagagaaactggccacagacagaaaacaggatgttgctagaaattagttaaaagttattccactttttattattttgagacggagtctcactctgttgctcaggctggagtgcagtgggtgatctcggctcactgtaacctctgcctcccgggttcaagctattctcctgcctcagccttccaagtagctgggattacaggcatgtaccaccacactggctttttttgtattttttagagacagggtttcaccatgttggtcagcctggtctcgaatgcctgacctcaggtgatcagcccacctcggcctcccaaagtgctgggattacaggcatgagccaccacgcccggctccattaatatttttaagagtaattttttctaagaaaagagaagtggccactaattacaattaaccaaagaaactacacatcatcattagaatttttaaattaatttttgttactttctaattctcaggagtaagcaatgccattttcgttcactttcaggaaataaaggtgtaagaaagggtaattgccttctccttcctcccagaccaaggctcaaggtcctacccctatccctttatttactgttcttggaattaaaacagcttcctttcccttccactatcaaggatatcgctgtcatcaaaatcctcccttcctggaaaacatttcttctttcatctaaaaagattataaatagaaaatgtatttagacctaagtgggaagaaggctgatagtgggataaggactcacactctggagatcagttacctaaggactcacactctggagatcaaatcagttaccaaactaaattttgtatctgaccattaccagcaaccttctccattccgattttttttttttcctgtggatttagatcttacaggtgccttcatatgcacctacagaatcatacaggggctattttcagaaagtgttaagtatctttttggttctacaagactaaactcccttgaaggcccaaaagagttcgctttaaatgacaaattctatttagaaatgcttcaaaacaatggacttccagcatatgtcctactgaggtcaaaatagcctctttctccactgcaatctgttctccattttccatttgctggattaatatatgagtttggattttaaattttcactgccacttaaacaggtgaatatttaatgcatgagaagcaaggttatgaaatgtcaaaactactaagtgaaggatctaatttaagaggcagccagagagtctgcaatttaaatatttaaagatgatacagggagtacaacactgaacaccaatctactccaaagatagcaatttaaaactcaggtttattctggaatttctcacaaaagctacgagtgatataataaacaaagacaagcaatactgagattatatgagggaaggggagggacggggaggcagtaagtacttgctactacaggtaagtaaatggcccatggcttctcaaactgttcttcacaaacaagactagactagacaaaataaagatagaatatatttattgaattatgtcttgaaaatggaaccgtttgaaatatagtgtattacttgtaattaaaagctcatttcttcatcagcagctaaaactaatgatacattaaacatacaaagatgagtaacacatacactaagagtgggctatcaaacacaagttgatcaaaattatacaaagaaacaaaaccatcttatgaattagtactttattaaatgtacatagcaatgtttaaaatcccagtgcatcactatcagaagtccctctaaatgctttcgtccaaacacacaactgctctcgtttctctgattcatcaatggaaagatcagtgacagtggacattaataccaatagattaaagtgataaggtctataaatgaacaaagaagttccctcttttttaaactaaaaacatttgagaagtcacccactgctaagatcaccactgaacaacttttatcacttgtcaattactgacccaggactacaaacattaaacctgaaaattagacacttgccactttagacttttttcaaaaagctcctttcaatctctccagctgaaaggtcacagttatgcctatttaaacggacagttaattgctgttcatattttttaaagatggagtcttcgtgggactatctgaaaaatgacactataactcaataaaagttagctctaggctctaagtaagcagtagcaaaggtcttgtgacagcatcatggatatttggacaggtggctacatcggaccttccaaaatgagctcagaagtatagtacacagaagaagggggatctctaaccacaactcaggccagagacctcaaaattcacccaaaaggaagatgtgtactttgatctgcttctaaattcaaactcctaccaggaacaagtctcaaacacacatcaaggcatacatgtatcacagtccaatattaagttttcaataaggaagggcatatttcacaatgggttgaaaatgaataagcctaagataacaataagaaattaagtattagctccagcaaagttagagctaaaagaaataatcacatccaaacaggaaattttataaaaggtattaaaggttagggcagttatctttaacggatattccaaaatataggatttagaaaactatcagtggaaaatacacacagaaccttaaattttatcgtgactggatttgttgaatgttttaagactaaacaattgctttaattcaagtgagaagttcagagataccacggaatatatttgataatgtcatcctcaacttaaattacctaaagggctccctaagactttcagataaattttagaattcttattcctttatggtcagagcactggctacctcttccatacaagtatacaaaaccttcggtagtattccaagcttcctgctctcacttctctgtgttaaaaataagctgccctccttccaatcagctaaatttcagtcatttcagacacctcatgggtatcacctagtccctaaagtcaacactaatcagtcctctccactacagtctgagttgggtgcctcttacctgcacccacactgcattatatgccttgttttcttaaatactgacttaaccaaaatgtacttatctcttaaccctttcttgtgactgacttaaccccttgaaataagaaaccttgtcatcatcctactttgtacatcctggtaactaccacacactcactgtaatgaagatgatttataatcacatattaaattgagagtttatttctgaaatactgtttaaaagctaacagaagccacaatctttgtcatatacccaacattatacgcattggtactttgtgtacagactacaatgaaaattctattaatcatttcaaaaatgaaatttcatttctcaaattggggattcaagtccccagaggcgacacaatcttcaacaaagtaatatggtgctgataggaggctgtggggcggggggagtcttaattttggagcaaaaagaaaatacagtgatcatttagtccaatttctttgtatctgggaaataggaagactgaggcacagaaaggtgaagcaacttttccaaagacacaaagaaaaagagttgggtgtaggactcgcggtcttagctcttcatcacgggattttccattacatcattagctgcaacacagtcttcaaaatcataaaatcttcctgtgaaatgacagtgactgggacaataatcagacatttccaaggagacatcagaagagctattcctagaaaataagaaccttagctttgctacatagaatattttcttgtatacacataaggaaataataaaacacatcaaaaaaactgtcttaggacagttattataattcttctactagtaatgcctgagaattatttaggagatgttggagaaaaaaatctaattatttgggagttgaagagaaaaatcaaactaagaatcctgagactagtactttccaccaattaaaacgtaccaacctacaatagctagaatctttttgatagtgtctctcccttttataagattacaaaccaattaacaggaaaacagaatggcaactggctgtttacactaggggagattctcattttcatagaattttcaagttttagtgcaacatcattaaatattagtcaaggcagttgatcttagcttcaacttaaaggcgacctaggaataaataagtaatgtcataaaaataagtgatcctatgacattgttaaagacaataataaatctactgaatagccacagaaaaataaaaagtgttttggctgtaagaactgtatatcaagcaactgatcatcaactacagacttcacaaattagaccacctttttcacacatcttaaacagcctctgacaaactacactgcactgagtgtggtttattaaatgctacccaaacagttgcatccatgtgtatcaaagagggtctaaataggctgccctgacaggcatctcgtttttagtaaagtacaactggtacataacttctgcccttttattgttgtttctccttggttctagtatgaagttggttcaacaaggacatctcatactggtaaaggcaaatgggatacatggtaaagatattcttgaaatgcaacttaggccataaataccttaccatttcttaaattttttacctgcagagatacttaacagaaaataaaacaattgagcaatggtagtggatatggcatctgaggtggaggcagtgaaatcaaattcactatggtagtggcagtaggctagccattccaagtctaagcaggaacttgtcaatcaaaatgttccatgttccatttccaatcctgtatatttcacttagccttttcagactttagaaggtgattacactaaagtagtataaaaaatagatgggagttttagcgtaaccaccaaagagtctattcctaccggtagctctctgcattagaaaattgtcagtagtggttaagaatgctaactcccttacttttaacttcagaaatgagcctgcatttatttagccacataatatttataaatactaagtaatgtgaataggctgcaactgaggcaagcacgtgttagcttagcaccaggttcaaaaatatattatacaaagcagaagagaatacactgtaactggtaaagttctggccactacacagcatactatgaaactagaggttaggatggaatgtttggaccagaaccctcccatgttaaggagtaaaaacatatggtatggagtcacacagagctaggtccaggtcttggctctgttacttaccagttaatcatttccttaggtcttctatctctttatttgtaatttgatgttaatcacagtacttacctcatggaaaccttacaagtattaaatgcaacaataaaactattagcaaagagcagaggaaccataaatgttttaatcataacatcattttatatacatacataggaaacaattcagataatgatagctcctaacacttattgtttaccatgtgccagacactgttctggatatgtaacatatgttaattcaattgctcctcccaataagtttatgcagcatcatcatccccaatttatggaacaaaaactcaaggaatactattatctttgaggtcaggaaagatgacacagaggaggagacgtggcacaagaacaatgtatgcactctaacacagaaacagttcaaaaatcacatatataaatgaggcttcttccaaatccatggtgataattattaaagttaattcctgaatattccaaatattttgtaagatgacagcagatgagtgtgctgggaagcctgcagcctggatggagggaacataaggaaggagctgtcttactgacatacagagagcaaacattcaacatctataaatgggccaacagttaaggccccaaaattttatttctcccatcaagctgttacatattaaacctctcactacctcaattctcttttgtagagacctgttgaacctaagccagtaaaacgtaaaatgagcgattcttttggatagacagtagtagaaatataaatgaacttcatggaataacttctatcttgagatgaaggttatgggtatgtttctgcatgtgaaatgtgttacaagctaccatgcaatcggccacctgatgattcaatatgatttcccagttaaaaaaaaaatactgaagaggctacactctcaagtaccactataaaactttcactttagacattttcattaaatatactatgaatacattcgagagactaaaagaaaaatctcagtactcactagtcagtactcagtattttgagccttcttaaatacggccagagaactagactgcctcaaagcttcctcccaagttaacagtattaccattcaaagcttttatattactatgttttatacttctagagggagggttgaaactaagtcttatatgatgcctatctcacatagtcccacccaccaagtagggactctactacctgttgaacgtatacattccatggccttgtgcaggaggtttttcttttttgaggcagagtctcactctggagtgcagtggcacgatctcagctcactgcaagctccacctcccgggttcacaccattctcctgcctcagcctcccgagtagctgggaacacaggcgcccgccaccacgcccggctaattttgttgtatttttgtagagacggggtttcacagtgttagccagaatggtcttgatctcctgacctcgtgagccgcccgtctcggcctcccaaagcgctgggattacaggcgtgagccaccacgcccagctaggaggttgttctgaagtacctctcaagcaagatgattagaagttgtggcatttgcccaaataacttggcttttgctgcttcactgaaaacaacgcaggctaaattggcttgcagaaaatcagatatattcattcaattgttagaagcccattctccagcaatggcttcagtattctttcaagattctgaaacttgacccaatgacatctcgaacagatgccaatactatcaagataaccatggcaactttatctccaaaaatgtacttaagatataatttgtgtagtatctgaatgtctagtatgcctaagacactgtcaacagattaaaatgctgagttagaatgttaaactaaagaaggactacacactggctggcataaataaactgcaggtgtcttagaataaaaaacaaccagtaccggttggtaatgtgaaaaaagaaaaaaggttctcatcaagccaattttggtgaattaaacatcctaggactttcatacacttcttcatccatgatctgacagagagaagtacatgaaaaggagaagtggataagacaagagacgggtaggtggacattatgtagaaaatctcacataacgggatacctttacttaaatctttgtttttcaccacatgttctcactcataggtgggaagtgaacaatgagaacacttggacacagggtggggaacatcacacaccggggcctgttgtcgggttgggggaggggggagggatagcattaggagatatacctaatgtaaatgatgagttaatgggtgcagcacaccaacatggcacatgtatacatatataacaaacctgcacgttgtgcacatgtaccctagaacttaaagtataattttaaaaatatgtatatataaaaaaactttgtttttgtatgaaacaaaaaagctgttaagtcctttacatatccttcatccgaccacatcttcaatgtatagtgacacctaccaacaagttttgaaaaacacacccaaagttaaaaatggcattaaaacaaaaacaaaacaaaacgaaaaacctccaagaatctcaacttttaatttcacttaaactgtgacttttttcgtctttgagcacacagagcaggtcttcactgtctcttataagcaatagacagaagcttcctcatgcagaggttataaataaaaacattctgcaagctgctctccaaagacaaaaatcccgttgccctcagagagcagaccaccaaatagatgagaaaggaaatgtatagttaagaaatttttatccactttattaatttattttatggccaaataaaactttatcaatgacagggttagagggccatgtaggcagagaataatccaaggcaatggagaattaggcttccatactgaatgatgaagagcccagctgagccagaataaagatttctgtaggacactgacaacactagaacagtgagttgagggcagagtctagagaccttgaatgtcagggcaaaacttttatgagcagaggaatgacaatctaaatgttggtaagtattatcagacagaaatgtatggaaggagaatacagagacagtttcccatcataacgcaggtgaggagaacagtcaaaatcagtgtggtagtaaagttaaatgtaaatgccatctacagttaagtttccctttgtactataactagaagaaaaactgctttgcaacaatgttcagaaacccaagtcttctttgacctacttcatatagtaatgaaaatataatgatcctttcctctgtgtgtacactaaatactgcttagagaaacttcatcttgataccatttgtaaatacttaaatgagtcccatgggtctccacggatctttgcagagcaaggcaaatatgtttctacgagcaaattacttgatccacccaaaattcattcctattgtttctcttataaattaggtcctcactaaagggggataaatgtaaagtacagggctaggtttaatcaaattttcctgccaatcatttttgtagaaggttattacttgatagaataagtatactttatggtgttcagatgtaagcttctcctaaaaggtacacatcacgtgaaggcctctgtgcttttgaatgagacattcccttatgtgtaatacatttcttctttttccgcccaataaaacctagcttgtaaaacaccatcaactctgaaatcaacacagaggcctctagacagcaagtggcatatccattttcattgtattctgcacttactcatcatatatccaaataatggtcatataaactaagtgctgtctcccttactacacaatgacatcaaggacaaggctacctcttgtcttattttaatgctgttcaaacatttagcaaagctaactagcccacattaagcactcaaaatgtttataaaatatttaattacagatactccctgtccaacactgtatagccaagattacatggtctcagtaaaacaaaaaaacaacttgcaattaaatacttctcaaaaacttttacatttgcttatcctggccctttgttttgtgggcaaggtgagcaccatgcacatcttttaaagctactgacctttcctacaaacttggagacaggcctattagtcttgttatggttccatataatataataaagccctaaggggtgggaagtcttgaacataaagtaactacttctactaaatctttaacgtattttaaaaataggattcctcaaacacccagagaaaaattcctaacaaataatcttcctcttaaaggatgttttatgtcaacaatccccatttaaacacctgttttaaatttaaaacacaatctgcaagccctatctacattacaagtaaaccatacgctatccaagatttagtgttttgggccctgatttgacacaattatcagggatctaatgtatgtatacaggtatacatacacaaagaagttaggaagccagctcactttctttcaagggcagcctgtctttggtaatcctcaatcagtagaaactgtaccagttttttaaaaatttaaaaagcagtaacagcaaacactgcagattgcttatggcatttaacaggcagagatggaaatttgtgtaaggcacgtatgataaaggagaaagcaaggaaaaagaataacagaaatgttattaaaagccctccccacagagccaaaggaagttttacctacacatattttgtggggctgacataagttatgcaactatgaaaaatttattcaatacataaggggataacccctgaaacattagtgagtgttgttttatgactttaagtctaccaagatatttctctcacaacatgattagacattagagaataaccatagggaaagctttttttaaatgaactgatttgcaagactaatagtctcattcaaagacaatccttcattctccaagtatctattagacacctgagctgtatattccccctaacagctttaacaaaaaataattactgtattcccaaaaccctttgtgtgacagttgtgaagattttaaaagaaagagtttttaaggaaaacatggacaaccttcactgtacgcaataaagagaccatatcattgccatctatgcaacacctgcagaaatttaaagaggggcagcgaggaggggaactaccacctttatctttgttctaagacaaagtgttctcctgcttcagatctccagaagcaccttgagaatcccgtcctgagatatttaattacactgaatgatttggtaccaggccctttccctgggtcttgctgactgatagcatcaataacactcactggctgtaattaaaccgccaaatagtatcccctttgccacttggcagataaatgttctttaatactccaaagaacaaagtacaaaggtgagaggggtgtttttacccctcaccttcacagttcatctgactttgtgcaccaggatatacatatactgtagacaatgcatattttacaattcccctcagacattgcttaatgaagaacatgaagaaaaatccttggtttcttattaattcatttttgcaactctgagcagggggaaaacactgtaagccttttggcaagagtatgcactgctttcacatagctttggggcaacatttggtttacaggtcaaaagggtttctaaattaagtttgcatatagcaaaaaattttttcctttaaaaaattatagcataaaatgtgtggaagctcttataatagagcaaattcccatttattgaggccctggctagaaagctcaaatatcaagacactgggtagggaaggaagaggggtttggttggcaggctataaaaataagacaaatttttattaaattttaaaagccacttttttttttttttttttgagatgggagttttgctcttgttgctcaggttggagtataatggtgtgatctcagcttactgcaacttccgcctcccgggttcaagggattctcctgcctcagcctccccagtagctgggtttacaggcacctgctaccaaacccagctaattttttgtattttaagtagagacgtggtttcactacattgtccacgctgatctcaaactccggacctcaggtgatccacccgcctcagcctcccaaagtgctgggattacaggcgtgagccaccgcgcctggctcaaaagccactttcaaaacttaactcccaatctctataagacaccctttcaccttttttttttgagacagaatctccctctatccacccaggctagggtgcagtggtgtaatctcggctcacagcaacctccgcctcccaagttcaagtaattctccctgcctcagcctccggagtagctgggatcacaggcacccgccaccatgttcggctaatttttgtactttttagtagagatggggtttcgtcatgttggcggccaagctgatcctgaacttctgactgcccacctcagcctcccaaagtgctgggattacaggtatgaaccactgtgcctggccaagacacccattttaaatggataggccctaaagaaccatactgaaaattctccaaataccctcagaagcaaataaattatgctagcataattgtaatgttgaagtatttaatgacacacaaatgccctgaaaatgagcaaattgtgtgtgagaacgtgcattatttcttaggtaaatccagcactatattcattaaaaacacattagtgaatcccagccattcaacatatcttgatgtaaccgacaaatgaaaatcctattttttacaagtagacttgttttaaaataagcaccacagacctacccaagtgcaaatcattaagatccactgaacagtgtttctcaggtcaggccaccatctgcttaagaatcacctgtggtggctgttgaaatacaatttcctcagtctctctctgcagataatcagattcagtaagtcctggttggggtgtagaaatctgcatttttaatcaaccaccccaccccactgatcctgataaacattaaagtgttggcagtctcttgtgtaaaggcatttgaaataatcctcaaaactctgggcatattagggtttcctagatagctcataacaaccacggatgccaagcccttttccttgccatccactgatcgttagtttctaaataagacaaatgccaggtagcttgaaagcaaagcatttaggaatataaatcacctgcaaatgcaaaaatgcagacgtaaaataaagcccatgaaactcatccaaagatatttccaagaacccagactggctggatgtggctcaactgggttagcctcttcaaaaaggccactgtgcttgattctatgaagttaggagcttctctcaatgactctttctaggaatatgaatatggttatttggttaaggcaagcacaaatttctagatagacatttaacaaccaaaactagaaactgaaactttttctgaattattagtttccaggactacatgcttgttctatttttccttgcccttcctgcagctcacctgatcaagaaaccaagaacagaacacaaatccaagacttacacctccaagtcctattgcagcattcaaaagagttcttcacagaaggaagggagaggaggcaggcaagtatcagatttcctgtactgttttcaaaatacagatgaccctggaacaatatgggtttgaactgtgtgggtgcacttaatatgggattttagaccaacccctccctcttcctctgcctactcaacataaacatgacaagggggaaggatccttatgatgatccacttccacttaatgaacagtaaatatattttgtctaccttatgattctcttaaccttttcttttctctagcttactttatattgtaataacacataatatgtaatacatgaaacatacaaaatatgtgataactgtttatgttatcagtaaggcttctagtcaacagtaggctactagtagttaggtttttgaggagtcaaaagttagactttttgctatatgggggctgctacccatagcccccgaattgttcaagtgtcaactgtacagctctgtctcattgcccaaaagcagcatgtcaagacacttctggaaataaaacatccacaagtaattctaatgtagtacatgcgggtgagaacacacactaaaagtaatgataggaatggctggcagaagtgaaaataaaagaaaatgcaccatccatgcttttttaaagagtctacgcaaatttaaagagagaccaatgttaacacacatttctgtaacctttaaactagcatctacgacttacatgaacctaccagaaaaacattgtcgaagaatgcgtagctgcctaaaaaataatttcaggaagttactactataataataattttactgttcattacaactgaaataactgaatcaatgttaactcacttatctgctaagtatgacctccagatccagttttcttctcaaactgtacgtctggctgtctcaagtgctcactctgcaagagggcagagttcttcactcctaggcaaagacagctccactctctggcacctaagagatctggtccagaaagtctcaagacaaagacactcaaaggcccaaattaaggcctctctcagttggtttatttagagtggtatctgagcaaaacagtttaacatcaataatgtgaaatggaaagaaaacaacaaaagctacggcatcagccaacatgatactacatttctgatgcttattagctatttcattttgaacaaatcccttttaacctgagctttatttcatcaaagggattaagtatttgcctaccagagactactgctgtttctgcacgaattcaaaacagtaaaaagataatagtcctatgaaatttgtttcaaaagtagatacagcaaagaattaagggctccttcttgggaagttaacacaatcatcttaacttcacaagccaggtatgtggtagaacagactgaagccaaactgacctagcaccacttttcccaggtgataaatgaaagaaaagccctaccccacattccccttaaaaagcagtgggaaagtaaagcaacaagggctagcagtgtgatgttcaggtagaaaagatttttgttttcttcttgtaaatttgtttgagttcattgtagattctggtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaaggacaaaaaaccaaacaccgcatgttctcactcataggtgggaactgaacaatgagaacacacggacacaggaaggggaacaacacaccctggggactgttgtggggacgggggagggatagcattaggagatatacctaatgctgaatgaccagttaatgggtgcagcacaccagcatggcacatgtatacatatgtaactgacctgcacattgtgcacatgtaccctaaaacttaaagcataataataatttaaaaaaaaaaaagaaaagatttttggccatccagatcagtttcaatttatcttatctcactgttatcttagaaatcaaactcaaacacatttgaacatgtggttcaactattttcagtgtcttctatcatgatgcacatggtttgcttgaatctcttcctcagcctccttattattcggaaaccaattttgcacttaacattctagacctgtgagctgttataagggttctgcctcaatgactcaaatttctgataaacagtaagtttcagtgacatccccaccacatgcccctttcaattccacacgtgcacacacacacagacagcaacaatttcctaaacctatacaagttattacttctgtggctttccccctaccttacacagaagcaatactcacaaggaggcagttactcttttaattccaatggaggtcttcataaaacctgacattctccatgctggttacagaaatgaaatagccaggcttttctggtatagaccatactttgcataagtttaagcatctgccatgaggggctatgatacccctgtggagcatgcttaggtaacaaaatgatccatcaattccaataaagatgggttcagtcaactgttgagactcttctaccatcactatccactgtgtggctgacaggcaggaagtaagcaggggacactgccaccaagaaccctgttcctcatccttccctctttgtaggctctgcctctgctccaacaactgtgggaaaatctaaaggaaatccattggaagaatgcctagttattgccctttgagaattccaattaactctcactttggagttggctaaaaggaacagaagtaacacaagaggcctgaggacaggacattcaagctctggaccttacttgggctacctacccacattccctagaccacattagatgagtaagaaatttctgggctttttgtatgaaaaaaattaaagctgacaagagagcattctacaaaacacatgaagggcattatacaaataacaataaaaaagtcatctgtgacttctcacttcaaataaggactatgtaaatgggactcaatatagatagaagcattttatttaaatgtattgaagaggtgctgataatcagatgtaatatactgttaaaacttgacatgtggctgtggaaatttccagaatacaagttaacaatgaagttaggaaaacatgtactcggtcagtctgtattttttaaaaggcagaggaacaatttactcaacgtttcaatttttaccccactcctggcatatactttttcaattttttttttgtctggataaataacagttattaggctaacatctcataagtaggtcagttaatttgaggcctgttcttccaactattacttctaaattttccaaatctgctcaaggtaaaggtttttaaatgaggggtactttgtagacgatgatttataaatttctaccctttgtaccatcacaggaaataacaaactacacaagccagaaaaacactagggtgggttgaaatgctgagaaagatgtggcgtttaaatacaaaacaaaccttcctctccgaataaatactcaaggtcaatcccaacactactctgctcaaaaccctccggtgccccttcctcacctagagaacaaaacatcagcgccttcacatacatgcgcacccagaacacacttctataacgcataactcaggctcatttcccacactcgcctcccatcctgctttctttttgggcaaattctatatggttcccctatcaactgctttaaaacttccatgccctactaaagtcatgaactcccagcattatggctattagagccactcgtctcaaacacagaactgtgctgcaggtattttaacagaggacctactgggtggcaagcccttagcgtagctttacttacattcctgcctgcataccctctcctccttctttacagtgggggctggtttacacagcatctaagaatatttccttctggccagtattaacttttataaaagaacaaattataatgataaagaaaaaccaacccaatcccaataatcctgtcgcaaaaggaggttgaactagaaactcaaatccccatataaagtttacagtggctattaaactttcaagagtgaaagaagaaggcaattaaaattattctctcttcaggagaggttgctgcttttcatcaaatcattttatgcaataaacatgaatttgtttaaaaagttaacatttcttcttaatatgcaacttagcagaccatgaaaagctttttttcctctcctaaaaagcaggtaatgaaaattctcagtgatgaataaattattttaacgatataaatggaaacttaaatggttaaaagctctgtccaagattaagcagccagttaaatcattttagtaaggtaatttagacagagtaagatttcagaaatgtagttctatattcctatgttaagggtcaagctcatgctgaacagaaaaaaaaaagtataaatatgacatttactaatgaggaaaggataagctagttagaaaaaggtataaatttaacaaaaagttaatggcaatacagtagcttagaatacaggtttcttaggtttgcttaatcactctcaaactgaacacaaaaaatagataatactatttataatattctcatttttataatagaattttccaaatgtggttaaattgtggtttatttcagtataagaaatttcatgattgtataccaattaataacttttaagcaaaggtaaattttagcctggtctatagctgaatgattaaggaaaatatttctttaatcaagaccaaaatcgggcagtttttctatggtagttaattctagacagaatttttttttcttttgaggggtcagaacttaccaataacaataaaacattctattccctgagataacagctccttctttccagataaatcaaccccagtttcaggaaaaataaagcatcctaggcccattgtagaggagggaaaagctgagagagatgctgggagccacgtatccatttcactgtgttatgtgataatcacctatccagagttctttatgcagaggagggaggaagtctacacatattcttggaaatgaatgattttagtttgctaatcatgaatttaagtctgacaccgttaacctaacaagtcaaaagtattggctttaagccataaaaattccacatactatttagatttttttcaatacttaagacccctaaaaataaaatgagtagagaaagagcatgaagactgaacacagtaggtacaaccactcacttcatgaataactcaccaaaggaaggattcctttagggacctgaaggatcttggagaaaaacctctcttcttctcaccagcatacaacttgacacttccatgagattactcccccacccccatgcctgaactgtacacatatcaccttttcactaccttccctaatgagaatcttaaaacatttttgtaatattcacactttatttaccatgtcaacactggggatactgtgggcaggcttaacccaaaatagctgcctcccatgcagtacagggatgatgtcatttcaccagcaaggtatgcctctgggacatctccttaaccaggaaaaaaagtgacctttaggacaagagaacaagtatctcgagactttaacctgtatctgctactacttaaacaaacagcatcctactatgagacggatacgttgttttcaatttctatgccatgtttttttataagcaaaggctggtgaaccacgttgaactctgaatgctaaacgatcgcccagcatgctcaagaaaaaacattaatattttggttaacagaatgaaccacaggaggattattaaggtaaaatgctagaagacaaactgaactttgcacacacaaataccaaatgtatagagaaccgccaaacatctttggtgattcccaagtgctaggccttagacttgctgtcataaattacctgggaagcataataaaaaacagaacccggaatctcacctgtggacagggatcgagtagatctacagtggatcccagaaactgtatttctaactcacttcccttgggattaagatgcaaccaaagtttgggaacaaatgctttaggtcctcacagagcctgagggacttcacttcactcaccatggaaatactgaacatctgtcatttattcaacacaccaactactgcacaaaaccctactgagctaatgctattagggagccccaggagaaactgctaaataaaccacctttcacagcacttgattcactgtttcaatatcccaataaccaggaattttaccaaacgcatactaaattctaagtggcttggagtacacaaacacttgtatatactaaccaatcttctgtacctttctaaagtaaagcacagtgtcctggcaagagttttgatataacgatcagaagacaaggatttgtttgagtcgcagctctttcttcaactgcctggtcttggctaaattgtatgaccaccaagatctccactctgactgtggacagagaacagtgcttaagcctaaattacatatgggtccccctgtaattccaaaacttctgtggttcctcaagggtaaagaatatagacttcaaagaagggggaactcagcaggagctggaacaacctggaaagacagaagctgaaggacagaattcctttagatgggctccaaaagatgagatgaccacagttaaactaaaaatgagtgtgaaagggtataccaaaaagtcggagctgcaaaagcatatgcatggacgctgggagtaagatcagcttacaagtaaagagccagtctgagaacagtggagaacggcaatagcactggcatcactcctacaaaactcagccagatgatagggtaaaacagtagagaaacaccatagagttttgagtgagcagtaacacgagtaaagtggtgctgtgtaagaaagtggtgctgacagccatcaccagtatagattagacgagggaaaaagacttatttatggaatagtatcccaggaaatgaaaaggcttaactcaacttccaaaacattcttaaagctgtgaatactagaaaaacttggctcaagacattgtacaagagcacaaaatctgtctaatggaaataaataaacatagaaagaacaaacaggcaaagggggtgctatatacttgtgggaaatggtctgctttgcctcttagacaaatgtgggccaaattgaggatgccagctgttatctgatatttttacaggaaccaaataggggcggggaaagaagtagcctgctatttgcccattaccctgacccacatctcagaaaatcagaaactgatgtcacactataaaagccacaaagctttactgtgctttcttccacatattcagcccaagcagctgggccctaaagagaaaaggctggatgatgaacagtaaggaagcagctgtcatcaactgtctccttgaaggccacgggcatttctcctgtggagacctatttcccctgcatttctaccttcttctggatcttcgtgcaggaggatatttagtaaaagaactgacacactagaatgaaataagggtaattatttctagaatggagaaaaggatagttcctgggacaagccatcttgaccacctattccattttcttcccaactacaactcaggacctcagaactaggacaaattagcagcaacgctggaaatcaatataaattgaggaaaagaaacctgcaaaaatctgctgtaggataaagagcacacggtctgacggtaactgaacactggatgtctttttaaagaacacttattgttacttaatagtactagtaaaagatctctgacacagaaagtatgcagagaaatatagataacgagaaaaagcagttcagactgaaaaaacttcaaaacaaacttgtcttacactttattggaaatctcatttttcccttcacattttgataatatacagtaaccagttcattttctgattggtgaatcttttcatagaacagtttcttgctcaagaagtatctagaattcttggacctctcataccctagtatatttgggaaccactatatactttcatttagataagacagggctggtaggcatttttcttaggggccaataaatataaagactgatgtgtcaaaaccactcagggctaataaattaccttaactggtaattctaagaaaagcaactttaaagcacaaaaatgacacttcatttccagatacctgaaaaaaatgagcaaaaatcttttacacaagtctctaagcaagatggatactacagtcagccttgactaacttcccctcaccacttcaggctatagtctgagctggtttcttaaatcaagggtggaaaataggttcaaacttgagtcaattgatagaagttgtctggaacactattttgaaaaaaatatttgggagccacatctagactctgtgagaaagagtgccatgattgactggcaatgtctgcactgggcaggagagggcaaattgatggtacagctaactaagaatttgctagaggcgacatccctcttattttctaaaggaaaagaaatctatgctgtgaattagattagctccctctcaagagagaatctacataagaatttcaaagattcacaaaagcagcaaagtatgtacaaagttatttactgtacgtcttaaaaagaaaaacaacagaaaaaataacctgtgtcatgtaagttcctccagtcagtctcctcaaagcaagctgaattagctagagcaaactacaactcaagcaccacatctagcctgccacctttttgtataacccatgagctaagaatggtttttacattttttaacttggaaaaaataaaaagaatatttgtaatacataaacatcttatcaatctcaagtttcattgcccataaataaagttttattggataacggctgcatccatttgtttatgtagtggctattactgctttcatactataaaggcagagttgagaagttgtgacagaatgcatggctcgcaaaaccttgcttattcactacccagacctttatagaagaacaagtctaaggtttcctcaagttatagggcaagtaattctctataagggaaggagacttgattccgtaggcttcctataacatttatctaagagagttgttgctctgtccccctttgcgaatacatgaatgattatacatagcactcttgaacaaacagtttcttccatcttgcaacaaacaccaaaattccactatgtctcccaggtaactgtttatatgggcccaaaaggaagaaaggaaagaactacaaataaatcttaatttttttaaacttctgttccgcaagtagatataaaaaaactttaaacatacttttattgttttggtttgaagtctcaatccattcagggtgttgatagctttctctgcatccttggggtcaatgtagttcacaaagccatatcccaagctctgccctaatgaaaaggaaggggaaaaaggcatatattagttctatactgttgacagagatcaactttcattttggcatatggtcttgtcattaacaccagcatatttcctcaacagtaaaaagaactctctattaattctagaaatatacatgaagtctttatgtctcctgtctactacattttcaagttttagaactcagcaagcagtgctgtttaggaaaaaaaaaacacacatccccaaaggattccaccatccatgccctgcctgagccagagtataccatcagcaagacaaggtcagcttcataaactgtggggataaatctctgtgctatggagagggcttaacaggcaataccttttcagcttcagtttccttagccataaaaatgggaagacagaaaacatcaaccaagaatctgtcagtgttcagtaaattgtaccctgacatatttacagcctttaccaagtacaataatgtcggagtctaaaatggtgaagaaccatgtgtgggcgtgtatacatgtaagtttattttagacgagggcttatcttcaaatacactcaatcaaatttctccaaagagggttttatgatctagataagaacaggaaaatatgaacacaaaagacttacagggatgacatcgaagacaatgagaacatataggaaaagaagaaatagaacataaacaaaaataacaggagaaaaaaagtctagagtaaaagttgcttctaagtgtttgttgttgttgccaccctccccccatcatctgagccctctcactcctggttcactgatgccctagatctcagacaatgggagctatcaaaagcagttgcatcaatggaatgcaaagataactaaagtcaatcgcaatggtctcaacttttcaatgaagcaagtttctcagtttgaaatggcaagaaacattatacaggtgacaaaaatggcataagaaaagtttagtctacaaaagtcaaaacaaactaaatgacgatttcccagatgcccaaggacggtccaaatgcttttactaagtactactgttgcatcaatttcatagggaagtgaggtattttttcttgatggggcaccgtaggtgcaagtggttatcaatgtgggtttttaggacagctactctggttatcctaatgtggatacttgttaccacataaacgaaaagagaaggctaaatacagtgcccaatatgaaaactagtgattatattttgggaccacaatcagaattttggataatcactgctaatatatgtcctctatcaaaatgtattttttcctttttaaaaaagagaaaggaatagagagctaaaaactaattaggttaatttcatctcacactaaaattgaggttttattttacagttctagtaaagagtcacatgtgaagccactgtatttttaagcattcagcttttcattaattcaaaatttatcatgtgtttactgcatgcattgtgcccctcttatgaaaatgtgttgcagtcctattgtcattgagtagaattaaattggctgaatgtaacaaaatctgctcaaggaaccagcttatagtggaaagacagacttccaataccggctctggtgtttactggctcgcagttagctgtgcaactttgaagaagctacttaacacctctctgaaccacagcttccttctctctaaaacgagggtaattcctacccaactaggttgctgatgcaatgatgaaaatattcattaatgatgaaagtggatcgtcaccctagtcaaaagataacatgagaaaaaataacatgcttactgttaaagattttaagtatattcatttaaagttaaataaaaaagatgccacaaatataacagaaaaagaaaagggcaatacaaatatagttttgtcatactgctattctatgacaaaataaatcaattgtatcagcatagtctaattgccctttctactgatagatactcctcctcctgcatcttagcagcttctaaccccagtgcattctcaaacttgactgcaatggaatcatctagaaagcttaaaaaaaaaaaaaaaaaaaactaaaacaaaaaaacctgatccccgaatcccactcccaaaaatagatagatatatatacatatatgtgtgtttgtgtctgtatatatatgtgtatatgagatgagatctcactacattggctgggccatgcttgaactcctggactcaagcgatcctcccaccttgggctctgattttatcagtctgtcatgaagcattggtactagctttttaaaatcctggtgactaacgtacaaccaccatgttgagaaatcactgccttaatggtgagaacctagctggggctacaacggggctgctgggaggtctaagaaaggtcttgcagggatgactgctgtttcacagttgcgttgtttaggtacacgtggatgtgtttcttctaaaatcttcaagttacctattacttcaaagaaacagtttattggcctcctgaggtctgtctggggcacaagagtgcctactgagattagatcactgggtaaagtgaaaagcctgtcttgcttacttcctacttagctgtttcccactctagcctctgaacccttactcctggcctgctgtaggcatggaaacatttgctaaatgaaagaatgagaaacttactgatgttatttatttaaccaaaggtattatcatcatcaccaccaccaccatcagaagacccaaccatcaaatgggtcttccacctgataccctcaagcaatcatgactagctatatgagtcagtcaaatatctagtatctgttaagttgtttatactcagaaatatttatccccaaatgactttgcctccttataaaaagtttcttatttgcctagtggcattattaggatgagtgccactcagaatatgtttgaggtaagcaaaactgtattattatcctaagcaaaataatatgaaagggggtatctgctattaaaagactgcattcctaaacctaccatcgttggtgtattaaaatgttggcactataacaaaagggagttagaactttaaattactttacagtgaaaatctgtaatcaaggcagcaaatatttattggatgtttaaaatatattaagggtatcgcagatgataccaagataggcaagcctccccattctcaccttttagctacatggtattttactgtttaattgtagcttcacattaaccatgttcggtattcagattcttctcctacaaggtagaaatgatatctgaagcttggcaaggtcaatcagcttctacaaatcaaaaaggcagggaggaagtagtaaagtcaggacttgaagtcaggactttcaaatgctgtgctctactccactcaattaactagtttatacctgaactgagacttcaggcatattgcgtataagcccaggactagtttgtacccaatatgcctgaataataacgtaaccaggcacttctgacacttttaccgcaaaagttgtttcttgtttgattactatctcaaacttctgtaccttttatacaaatatcagttttactatatatgaatttcagtgccattattcattcctatgacaacataaattgcatcttatttatatagtgcatatttctggttataaatgagcgcacagtttttaaaaataaaagcagtagcaaggcaaacattacaaaaaaaaataccttacctacccttttcccactcttatattcatcagtaagtcatgggccaccagggaaggcttggaaaccaagcatcacttatccatatcatccaaacctatttttcaagtctctctgaatttagaatgtgcatactgataatccccaaactaagattcatttctttaaaaagttttataagatgctacatttaaattccaagtacaaccattatggaaaccaacatgattaaaagactattctgaccaaaatgacaaagctaaggctcttcaaaaaaaaaaaaaaaaaaaaaagcccttaagaaaaacaaatcctgtctttaaatgccaaaaaatttgcctggtaactgaacataaagaagaggctcaatgccacgtgtcctcagctattctcagaagctacctgtggtcaagtgttctaagaattttcaaaccattaattcaaatctttcttcttttgaggcaaggtctctctctctgtcatccagactggatggcagtgggcatgatctcggatcactgcaacttccacctcctgggttcaagcgattcttctgcctcggcctcccaagtagctgggattacaggcatgcatcaccacacccagctatttttttgtatttttagtagagacagggtttcgccacgttggccaggctcgtctcgaactcctggcttcaactgatctgccaacctcggcctcccaatgtgctgggattacaggcgtgagccaccgtacctggcccaaagtcttgattttaatggccttggtagggattctagaacttttgctatattctgtgctgcactgttgtgtatgaatgccttttgtttcacacgcttctttttaatctaacatacatgccacagaaaagaaacccttcttcacaagagatagaaaaatagtttataagatgctcctggcacaaggagaacagttataaacaggctggtagaaatcatggtcaagggatctataccacagagctgaagcactccagaggcctctgaagaggaccaaagactactgagagcagggttcagagcaaggagaggaaaacaggaagaaaacccgtttagtggcaaagtgctactgtgggaaacacagtaaatggcaatatatcccaaactgtgtgtaattcaaagcatcagctattcccctgccacctacattgttttaataccctactttaattaaaattttaattgcatattttaattaaaaatacacaatcttctggacctgtttcattcaaaggtcactttatttagtcttttctattttaaattactaccaatgttcagaaaaatcaaattaccccctcaggtttaaaggtaaaggcaatagactaccgtaattcttgattaaaagtatattaactttatccaaccaatattaaacaagaccctcaacacaaaattgtggaaaataaaattttgtatttaaaaaaaacaagagtcaccctacaaatttctcatctacaataagcattcaataactatgggaaccatactttttgctaggccctgagaatgcaaaggagaaaaagatctttctcataaagcctatattctgacaggaacacattctacagggtattagaagaaaatagagctaaggagaaaaaagcagcagggggtgagagtggggaggggaggagcagggctgctgtttaaatacaatggtcagagcaggccctatcctgcaggtaacatttgatccaaggcttgaaggaactagctcaagtctaacagtgaagatgtgcaagacgttccagcccaagttctgccacacccgcatcacgttctgccagtcctaccagctaaatcggccccttgtctgcgttagcattggttctctattattctggccctgatcactgctacactatcctaataggacaacccttgcttagactcccattaattccaaaaacagccatcctccaccaaaacattgtccaggagaacttcttaaaacacaaatctaaccatactctggtttccagtcactgtcagttttttgctcacttctactttcgctcatcttccaccactcctacacatacaccctaaaatgcacattcagttctctatgtctggaacacagctctccaactagccaactcccatgtatcctttgagactctctgaagtcatttcctgccacaacttgccccatccccagtgcacactgtacagtgctcctctcgactagtcctcccacagcttcttatattattccgttatctttgttatgtgtgtctggggtccatttggatgctccctcactagactgctgagcaagggcaagcagaacatagttcctgacaaggaggaccctaagacagatcattaaatgttctgtgaatgactgaatgaaaaacaaatgaaggagcagcagcatctgccttccaggagcctgtggtttaggagatagttgcccttataaacatgttcctcatgtccctacattgtaccagatggattacagaacttgtggagacaagatgctcaaatgttatagtaattctgccttcataaggaagtcatacgagttttaaatagttcatgtaaaattgttcatacgaaaaatttctacaaataccattaagatgaagtctcaattttaaaaagtgtcatctagagtaatttgatagatttacataaatctgttccacaaatcggtaagtatgaattatgggatgtcagcatataattttgttgaaagtactttttcactaatataattaagtctgctgagactattcatgtacaagtcaaataaaatgcagagtgaattctgtaaaaacctggtagttgaatcaacaataaaaggtgactacactgattgatgtgtatctattattccatttacagcagtagtaatgttttatgaaataaaagaataaaagccgtgtgaatctttttcaaatcccacagttagcagaaacaggtcactatggtcctctctgtcaaggaagacttgcaacctgaggtttaataatgcaatacttttaaaaagcaaaatggaaagattcgcttcctccaaacacagctcttgcataaaactgcatgccttaacgacaaaaaaaagcaaataatttgatttgcaaaaacaagttttcgttacaaagggggaaaatttttgtttttaataaagaccctgttgcctcctgatatccttctctctcctccctcaaacacacaataaagttgcaaatatattgtatttcttcagatggacttactgttcttgggcactcattatgtgtgtctgttcagacaggctgtgcactgcaactctggcaccaaagcaactcgcaccagacttcacaaaggagctttcttaatatctcagatctgatacacagcaaaaccatgtgggtaccacacagcagggaaaaggtttgagagaatctcagaacagagggatgcagttctctctagtcacgtttttctccacattttaattcctgacttagcctgagtctcctcaaatgtagcatgccagatgcagcaggtccttccatttaaacactcaagttaaggtgggtcaagttaaacaggtcttccttgctgccctctaatgagtaagatcaaattgtgagatggaggactggtgagatcctattactacagtccaagccagccttcctgaaagctgggagcatttctaccagcttcccaaaggacattaccagggattatcacaaggatggagaattcaacctagacactcacataatacagaaaacagatggctcactcgaagactcatcttccacccaaatgctaataaagctggcctgagactgaaaggccccaaagtttctaaatgattttcaggactttacagatacatggagctaatatagaagagtttaaatcataacttttctgctgaaatcaaagctgcaaatagtgatcatttggtaaatattacctaagcagcctaattctagagagagcggttaatgtcctcagcaccagggcattttcccttcaagttaattttaatagccatatctgtcccctgattatgcaactggtagagctctattttcctgtagttccagtcccagtaattatgaatctgctggcaatgcggcatgaccctgcttaagttggcgatactgtgggttcttaatatatcacattttcagacaacattaagaactcccacacaattcagtcttagactattgagaacagaaacagcatattaaatcctctaaattcttgccaagtattacaccgggtacacaaagatatcttgcatccaagaccaggaagatgaggaaaaattatgtgcagtaggaaaataaaccaattcctctacaacccacaggatgagactctacctgaaagcaggttctccagcctgaaagaaagtgactgagatagtgtagcacgctcagcaccacaatgaaaacaaaaggcggttctcatcacttattgatataggtagtttctctaaaagataggtcagcagttctaccttcaaacactggagctgccaccaggatagagcaaatgccaaaataccttcagatagcctgaaagtcatacctgacagttcaaaaaaggttaggacattaacaactctaggctagtccaatctactttcaattaaaagtttgggtatgctgcaactttctcatttctttgttaattataattaattctacacagatccgccaccgcccctacccccacccccacacacactaacagtcttatattatctgctttatcttgtgtttacttaaaagacaatggagttgttcaagtatataccatttgggatgaaggcaaaggaactgtattcctcaaaatagtattgtggtagaggaaaacaagttaactgtggtagtaaaaagggcatctgctgttgcttgtgcgaccagctggtgtcaatcttcacaaacatgcactcttgcctgtgcctgcacacacacacgcacacaccccccccactaagcagtccatcaagaggcagtacagcttcttaatgtgtttttctctctgtacaagatcattttttaactcagataccacaagaaacaaaaaatttaaaggccctgttttgaaactatgtcagagtccctgcaaaccaccatggagagctccccattttgtcaagaacgggaaactataaaattagactctaacaaactcaccaagtccatgtgaaacaaaaattctcgttagagataaattttcttcttgaacacatttttcttaaaaaaatcactctctcacccaaaagttaaaggttcaccagcccaaaccttccagtatgaaaaagtcagtaagtttgtcggggaaaaatgcccattcccactgccccataaatgctatgtctacctgtctggcagtcaacagtaccactgccaaactaaactatcaagcaactaggatccttacattacatatatcacatttaattctcaccacaaggctacatgtaaatacatctgtatccattttacggacataaagttggaggttcaaagatgctaagttaacttgctcaagggcacacacagctagctcaaaggagcagctgggtttccacactacaatcaacctttccaaactcagtctttcaaaagtgtacactttgttgcctttggccatgtgtggaaattactttgtggcagaatcctgtacatccaaagtttacaactttccaatcagaatatttataatctccaaatacatctgtatttttttcttgttctttgtcatgaaataaattgactggaacttcaattctttcttaatccatccaagagactatctgtgaaagaaaaaaaaaatgacctgaaagaaaaggaaggacatcctgcaggtgcacaaaccacttaagcccccaaaacaaatccatcattacaaaacagatagatgagaggtatctgcattataaaaagatccatttaaaatgggccttgatttacatactccttttccaaactcagaaagcagttcttatggctaaagccaaacatgtttgctactgccaaaacggtctcccacacaagacatttctctcctcagcagattgcattaaaatgctttcatacgcatagcatgatttcatagcggtggaaaaaagatgggatcaataccacatggtctctgccctctaagatgctcaaaaattttaagcccaacacagtaaacaagggagagaggcaggcacctaatgaacatgaaatacataaagtgcatcgcaggggtttcaggcttaaccaggaccagcttgaaaaagagaactctttagtgtgtcaaaacagagaagatgaaattcaggtgtttcctgacaaacaaattaaggtaataggaacatggagaagaacaaatttgtaaagaagtataaaagagacaagccaaaagcatactacgctgaacgtaaggcatctatgtagaggtaagcaaaccgaccccccatcctggaagcaagactggcccatgtgaaggtttacagcagacaaactgcaggatgcaccaagcactgaggcacaatgaggaaggaggcacacgagggacccagggacagtcaccttagtggcctggtataatcactgagcagatgcagatgtaagactgtaactagggacctcagtgttagaaatcacccacattctttttccttcttccctcccctctcaactctttattccttccctctctagacactcccccttaggcaatccatgcttatctacttaggctcttaagaaatcccacaggctaatcttgaaacaaaccaggaacagagtccccactgcaaaatcctcatgattaggaggagtcataattagtccaccaccactgagccaaagtcaagataatgccaattagaccttcagacacctgagagagccactgaacaagacacacagatcctgcaccacttctgcacgtctcccatacctttctccctttgaaagccctacggtaaatttttaaattgaagatggtactttagaatactagtttgccatcttctcagtttgctggctcccattaaaaatgcttttccttccaccaatccttgcctcttgtgttctggctttcaagtggcaagcagctgaacctgggttcggttacaggccttctagagtaatggccaggattgaaacctagcaactccttgtgtcccaggaggatccatacttccttggcatgataacatctggcctttgtaaaagtaactagaagggcaagaaaccttttgaaccataatacccagagattaatacaacacaccaactcagcagccttgaaagtattcttgcactataaaactaacagatatggataaccccaaccaccaaaaagctaaacccaagatgactacatcaggcagggcttacgattttctgagacctcctttacacagctgtaaaaacaagtacctcaatcctctttctgccccccgaccaagctaagctgctattatgagtggacaaagtgttaataactaccacagtaaatggggaaaaactactgcaagtgttaacaaaccttatttttaactgagtagcaactgcaaaattacacatgccttgtgaatgcacgtacatacctacgtccttcgcatacaatatggtgacatcaagttagaaaaggagtgaaagagggagggaagctgagtcattaagaagggaatattgggtagcatcacatgatcaggtgtttcaataaaaacatatttcaccttatgtgtactgatcataaagtatctgctatagaccgatatgtacaacccttccaccggggggaaaatgtccactgtaattccttttatatcaaaaagaaagagcagaattaaattagaggtatttttagcaaagacaaaggaagtaaatttccaaaggacatccatcgtccccagtcgacacaaggattaagtataaataacgtgatttttcttctctttgtacaggacatgttgcttagtttatagttaatgaagaggtagttaatcaagagggtaggaggaacatttttctttctttcctctaaacttaaaatagtcacacacagcactgatttttacatgcttaggaaaaattccaaaacagactgatggtgtttgggctggtgggggtataaatgctgagtataaaggaaacctatttaaatactacagacacagcttcacaaacctcaagaacactctctctgaagcaataaagaaaaggaatcctaatggaacacagtccccagaggaaattgagctgtacatggttaaagttgtaaaggctatgggtcagatgggaaccatggctacgaattaagtcaaagaggtaccctgacagaaataagtatcaattttgtttttgctcagggacagcttatgctacagcaaaccactctgagaccacagggcaacttgcccaccaattaacagatggctcctaaagagaagtacaaaatggtgcagctcctacgattgccacattcatatcacacataagcatttcttcccaaatcacctcatccaaaagttgaagtgattagctattgtaatcctccaaatttaaaattcacggatactttgaggaagattttgctaaaaagattttacctagacaatgattcattaggacacaaaagtaatgtggcaccatccacatcagcatggtatagtaaacgcattatcctgccgaatgagcagagcacagaggcttgtcttgtcttttaccactgactttaaagtatattaaaaacgaactatctaaatcatatacccagcaacttagtacatctgaccattgctgctaattctggatacatctttcctatgaaacaggaaaaacctaaacacaaaaataattttaacatattaccattttatcatctcaagtactcttaaatgtataacagggtagagggttaaaaaaatcttattcaacaacacttcaattttaattcatcttaaaaacttttaatgtgatgctttctttaatctgctgttactgaagttactcgatttgcttattcacatatctgagacccactcttggggaaggcgctatgtttttatggcaccagattaaacaatatgaaggaccatctgatgtgggaagtaacttctatacacagagcttctcagctatttgggccacattacatgcccacttggcaaacacattttaagattaaggctaagacaagtggatcagaagaatccatcttattaccacaaaggggtccctaaggaaaaggaggttaggagtttaaggcctccagctaactagccttatgaatttgagattgggatctcatctgtgggaaaagaaactgcactaaaggtactctctgatgctcgcccccacctattattctaccgtctccaccttaagtttcacaaatagattctgatgtgcgtgttagaatcactcttgttaaaagaggttcctacaatgtagaatgccatacaaaatgttaggtattcaattacaagtacaccactcgaagaaatgaatgttttactaaataactagtttttcagctcattccaatattcaatagcctatgctgtcaagagttttcctattttgttgctgaaaacttcttccttgctatttctaatgaaggaataaaatagttatatattataaactaatctcctttattcagggaaaaactttaaatatgtatgctgccagatcacttactagcccctgtacccaaacagaatataacctattaagtgcttattctagttatcctaattgacaacaacattattaaggattctacttagattataaactttatttttctcaagcaagagtactttctagcaagaaaacatatatatactgaaatggatcttaacacaaaagcctactatactattttgggcttctttatccttctcgcgcaccccccacgaaaaaaaataaaaataaaaataataattaaatctaatagtaaaggaattagaacttttacctcattattccctacaaagctaatttgttccttcatttgcactctctgtcattgtaatctatgacttaaagaaaatgaagcaaaaaaattcttttaaaaataaacaaaccaaaaaaacaggctgggcacagtggctcccaaataccagcacttcgggagtctgaggctagaggatcacttaagctcaggagctcaagactagcctaggcaacaatagggagaacctgtctctacaaaatatataaattagctgggcataatggcacatgtctgcggtcccagctactcgggaggccaaggtgggaagatcacttgagcttgggagcttgaggcttcagtgagctgtgatcacaccaccacactccatcctgggcagtgacagagcaagactctgtctcaagaaacaaataaaatacaaatcaaataaccaggaactatggtagatttttacaatccccaaagaagaatgttttctgaatgtataatctacagccaaattaagatattatacaaagattttctgtgtaatcctctataacctggtattatcttggccaggtcattcccctgccctacccaccaccatcttttcactttaagctacctgaacagatatcccattcaaatcctttaggtgtacacaaacatcttaataggttgcaaagaagaacacaaaattgactagattcttttttgaacaattacatttacaattcaccatcaatgacttacttgctgggaaaaaaaacatactgtaataaaggtaaaactagacttgcatcttttcaaggagaaccaaagactgtccaaaaacctaatgatgacatatactacttatcccataggacacagaaatataatgcctgtaagcatacacatgtccctacatggctggaaaccaaaagcgttaactgaagggttttaaagaaatgaccactaaataagcagaggagataaatgtaggtcattcagaggcaaatctgttttaccacaagatatatggctctccttagctactaaaagcaatgggagtcaccaaacattactgacctctgaagactaaaagctagagatgaaacattcaaaaagacctgctgtgtgaatgctactgctagtagtcatctcagtcattcttcaggttgttcttgctcacactcagtgagcaaagtagtgcccaagaaacataatcaaaagggggaggaagtcacaagagatgacttggaagggaggatcggtatcttcactgcacctactattttcaaaattaaattcaaactttgctttcctccaacactaacaaagtgacacaaatatgagtaaattgtttgaaaggcactgacaagtgactttatttacaaaatatgcatacatacatacacacctctcaaaacaaactcctttaccaatagctatggcaagttcacaacaggggcttctaaccaattacaaaagttattctcttataggtcaaattgagaccaatacaaaattaataagcttacttttgagttaaaaaacactgatagaaaaagataaaaaatatgaattacataaatattgtttcaatggagttctagattgtacactgactctacctaactggcacaaagaaacacactggaagagtcacagagcgttttcagaatgagtaagggctgggaaccagacttcaaggagttaagtagtaggaagtaaaactacccccacctcagaacagagaggtgagtcatcatcaccatcttatccttctatcacttccttgagaccctaggtcctgagataaaatgcctaattgactttacttcggttccttactggctgcttgcctataggcaggcagaaagagagaggacccacccaactggcttctggaattagctttttcccatcagcaatatactaagaaagagaattccccaatacagaaggaccctaatgaaatgtaagactgagacaagtttgtcttggatccacgaacatccttagaagtctttccatgtaaactgaaaaagaaaaaaaaaaaaaaaagcctctctcatttctgttcaaataaatgactgcatccaatattaatcatcaaatgaaataatcaacaaatcattagtggaccagactatactttacatcttcgctcaacaaaacaagcaccaatttagaacatcctgcattccaccttcacagtatgacaattccctccttctctacctcccttgaaccatgaggtataccacaagaagttccactagccgagtacagtagtcctccaccccctaccttatccttgggggttacaagaccctcagtggataactgaaaccacagatagtactgaatccaacataatatacactacttttttttttccgatctgttaagatggattctaagtgattaaaggacagggaacatgtaccagccatggataatgtggacaaagggatgattcacatcctgggcaggaaggtgcaaaatttaatcacgatactctgaatggtgagcaactcaaaacttatggattgtttatttctgggattttccatttaatattttaacactatggttgaccaccagttaactaaactgcagaaagcgaaactgttgataatgggaggactacggtatttcatggcacaggctctcttcaacagatagtcaccacttgaaatcaagaacttaacactggctgatattctccagcacacccaaagctcagacaaagactactgaacaactggttaagcttgagtcatctttaatcaagacaagaccttacagctccagaggtagaagaccttcctcatctcaatcagaggcttttggaaactccctacaaacatgagtgcaaagtaggcagtggggataagtctacacaaagcttgcattaagacttacccatgaagtattcacctttttcattattttaaactcttacaacccaggggaggctttctgttaagccccaacacaggaaattgcttttcagttgtcaatagccaacgtctgaaaataaatccagtcactaagtgtggaatgatgtacttgcagccaacatgcatttggctgatgccaacagagaaggcaggaggccaagatataagacctaaatttttttttttaaaaaaaggactgttctactcagtaacagaatctgaaataatgcaaaggcagaaataggccacaaaccacctgcctctctagcttcaacatacatcagcatctgtctcccaaggttgcttcagaaagatatttaagttttctctaactacaataattgttccagtggtctaaaaaaaagaaatggctctgtcctgtgggtttctggttgggtggttgactgttatattgatggggggcttccttgaggggtagggggaaagagtactagggaagggggagaaaaaaatggaagaactaaaactacagaagagaatttctaactcgtcgctctttgactctgattgaggaatggctttctgccaagatttccttcaagtgctcagcagagaatgaagtgaggtaacgagaagtagtctggggatgttacacactgtgtcctgtgtcccaagaccccacacggatgtttgtccctggatgctctgactctctgggagaaaagagtagaaaagtatgaaggcagagaagacttccagggagcaaaactacttgggttcttctttctgacccactgtacatacaccaactgcctcttcctccaggtaacttgccaagatggggagtgataagagattgaaggcaattttcaaaagaataaaacaagcttgaaaccaggcagaacaactgcaaagggggtaagatgaagtccctgcaagtagtcagcaatctggcaaaatattgcacaaattcagtattttaattggacgtttcttttacggggaatgtggcatgaactaaatttgaagccaggctacttatttcagggggaggggttggtccctaaagccacttggagaggaagagaaataaaacatacagaagagtctacagcccaaggggaaaaaaactagtatctcctgaaaacaattatcataatttactttcaaaatactttggtatatcaaatgttgtatgatttcatttatatggggtaccgagaataggcaaattcatagagacacagaaaatataatggttaccaaaggctgggagcaaaggaggtgggtgaggagttactgtttgatggttacagagtttctatctgggatgatgacaaggtactggaaatggataagggtgacggctgcataatactgtgaatgtgcttaatgtcactgaactgtaaacttgaaaaggttcaaatgataaattttatgttatattttgccacaataaaaacatttctttttaaagtttagaattaatctgatgacacgtgtgcaccagccatttaagctttaattctgggtggtcatctaacatactatcattaatgcacaatccaggattagttaactagtataatacaagtaggctaaaattcaagtgactagtgtaagcctacatactatccatacctaaatcaacaaccaattctctgctgattcacctaatggatgtcaaaatagggttttgttctgtaagccagttatttgttaattagcataacgagtgttagaaatggagtcttaccggtaaaattaaaggagttcaagatacgcagatgggctaaattagtttagagacacttcccaccttcgtataaacagggcacaaaatccaaggtggcataatccaaggtggttatatctttatggagagaacccctaaatgttaaatggtcctgggtttcagtctttgtttaaagggatttctttttgcatgatgcaaagtgagggtgcagaacgtgacttttgggatattgttagcctccggtgaacatttcatttaaagtgtgttcaaagcacttaaaaaagaagagagaagtgggactttaccaagctttcagaaaaggcttctccatcaatttggtcctgcttgctagatagaggtttctatgtgtggtgggatctggcctgagaccttctttcattataatctatagagcaactaacgctcacccttcctcctttggtgcctactaacaactacgcaaaattacctaagagctgttattcactatactaacaggtccatttaataaacccagtctcaaggagtcactggtcatgaacacagtggcctccaagggtactgtcttaaaaaaggaaaaaaaaaaaaaagactctttaaaagtcggttgtccaactataaaggctaggaaagaatattagacatcctccttactttgatggctatatccaaatatattgttttctataagcattcagagaactaaaatatcaaatagagtaagaaactaaccccagaagattccatattctacttttaagtagcacatcaggactagctttgtatgttctagagctggggatataatggaatgttatcacgcctttttgcaaaggctcccaatttccagcacttaaaaaaatacacatattgatataaaacacagtaacaaatcggtattaacaattctgtattttaatcctattccaatatgtataaaagggcttacccccataaaaaaaggacaacaaataataaagaatataaaggtctaaaaacaaacctggtataacattgttagattttaagatattagatcccaaatcattctacttgagaaggtagtacactgtctgcaccatataatggcaaaatcacttggcaccatgtttaaaaagagctaacctaatactcaggttcacaaaagaaaaaaaagacaattttagaggcaggatttgggaagtcatttaggagagcccttgtctacatgagaagatgtcaattgatttgatacaccatcagtctctcatttatattcaaaatgtttagatacatttaaagtagaataagagcaaactacaattcatttaaatggaatgaaaaaagctcccatggcttacttagtaccagggttaggaaaaaggattcgtacgacagtacccttggaggcaactccttaagactggatttaaagcattaaaatgtgaggaaataaaactgttctctcaggctccagtgaccttaaaaacagtgcagtgattctgatttaccagtttacacacagctatgcctcccttaaactttactttaaaaggaggatttgactttctcagtattaagtccaaaggtcaaacaggttgtaaagagtcaagggccccatcagatctactctacaaggtaataaacattcaagtctatcatccctcaccaagaaatgcaaatttttgttgagctagaggatgggagttgggggtggtggatacaggacttgtacgccatacacattttccctacaaaatcaaagcagtatgtacaaaacagagttccaacaaaaagtacaatgatgagaaaagaactcattaagagctaaaaataaactctaattcacaatatgcataaggatttaacaaaaaaggaaaacaagatgtaaaattgcatctgctaagttaaccataccctcatggaaactgccccctcccccatacacacaaactgaaatctgtaaagtctgtgatgactgaatgaagaaatgctttagatgttttcaatgaatatttcaatggaaaagaaaacaaagggatagtaatttttttcctcagccttctgatctgctaacactgcaggaatattaggtttttgaacatcccaaaacacaggtctctgtatatctagacttgaacatcatctttgataaaatgagactatttagtatagtatttacgttttatattaaacggatactcatcttaaggaagatgatgtcaataaaagtaaaaataagccgcagttggtttttatctaaccaacacttcatggctcaatttaacaacttgctgaccttcgaaagcccagtaatagctcactggaaagctcacttgagagcaccttcatattttaagtcaagctaattcattctgaaacattcacacaataccacatagagcaataattccacactccggtgctctagttcataaaggctggtgtaatatcattaatcatcattctgggctcccaagtcctgcctcgcactttctattcttactttgttccacccctggaaaatcaattatgttggtcaaatcacctagaaagcaaaggatggaggatgagctttgcattcttcccacatcatgacaaactccaagaaatctaggacaacagatctacttcaagatgtttttcaaaaactactttttacctatggggggaaaaacaaaagtctgcaactgtcacgtaactgaatgggtattaactggtaagaagaggacaggaaagagagacagtacccctgtgtgctaggtactttatgaaagaaactgacgttcagagtcaaaaagcacacacaggacacaacacaaattgagtggctaggctggaattggaacccaagtgtaacaatgttctaagctaaaagctctaagattagtgtccagtaggccacctccctagcaggaggaagcaaaggtattttgattcaaacttaatcccaagaacttgatcccaaactaagtaacaaacctagtgtacacaggggtttagtaaatcctactaccacttaagaaacttttttttgttttttttttttgagatagagtctccctctgtcatccaggctggagtgcagtggctcactgcaacctccgcctcccgggttgaagcgattctcctgtctcagcctcctgaagagctgggattacaggcacccagcaccaagtctagctaatttttgtatttttagtagagacggggtttcaccatgttggccaggctggccttgatctcctgatgtcagatgatctgcccaccttggcctcccaaagtgctggaattacaggcatgagccaccatacccagccaaggaactcttataaacacagcttaaatacttctgtcttgcttttttcccccttaaaggaggcataaggtaaatctttgttctaatttagaacaatacagaatgatcacccctcgattacataaagatgatatatggtgtcagaaattactgagtggagtctgaaaagatggttttaactgcgaatctgtttcttcacaacacttagagcagcaaatgctactctgtgatttacagcccctcaaaaaatatttgattacatttcccaacaccaataaaaggggcatccaagggttttgaaatattgacaatctaaaactttaaagagccaaaacaaataccttaaggactaaaacatgctaattaagccactgtatagacctgacaaatcgaatgacactcaaataaaatgccagaaaatatctgttaaagttgaccttttgagctggaaaagcacactctgagggtttccacagctctcaacgttcagtagcagcagtgtactcagctgaaagtcaattaacttagaacaagctcaaaagaagttggcaaattttgaagcacagttttagctccaataatcaactattctgttcaggaatatttgaaaggaaatgttccaacaggtacagaataaaagtgcttcggtctattctgaatttaaacaaagttaaaaaaaaaataaaaggctggtggccaaagctgtgtcatagttaaggtagtgaaatagaatgaaaactgtcaaaaacaggttgattttgtactacatcataaaaatggggggtataaatcattttcataccaaagaaacagaattttaaaattctataaactacaaaaaaaagaagcaacaagttcatatcacaatttaactgttttttatcttctaactgaactatttccattttagttcaccatcttcctcatcgacattttccatcattcctacgacaagcgcttaaattgagaatggtgtctcttctataccaccaatctcctgatgcaaagtaaacaaagactaccccccagaaaaggtctggaatagcaaacagcacacgtgcactcttatgctgaattataaaggggcaaatgttacaagagaatttcaactgtaattttattttctatgaatttgaatatgtttacaaagtttgtgttttctatcaaaccagcaaagcaacaaagagaaaggttactgaagactattcctaatctactggtaaggcaaatacggctattctaaaagttcctctgataagggctaggaaagcacaaaatcaaaactcctaaacctcatttacaccataggttcaactttattttcccagtaaacactctaagacagctgttggaaaactgtataactgtctcgtgggagtgacacatatttttttttacattttattctaacggaacaaaataccaagtaacacaaatatcaatatcaggaaatcagagaaacaaatctggatgattaatgaattactagagaagaatattgtttcatacttttctgtatcctcaaatagatgtttcttcatcctagcaactagccattaaaggcttcattaccacaggttatctaaagaagcagctctttgatttatgaagagatgttaactgggaattaacttactgaatggtgaaaaggtccagatttgccaccccaaaatattccactttggcattaagttttttttttttattatttttttgtgaaatggagtcttgctctgtcacacaggctgaaatgcaagtgcggtggcacgatctcagttcactgcaacctctgcctcctgggttcaagcaattctcccacctcagccttgtgagtacctgggactacaggcgtgcagcaccaccacacctggctaatttttctattttcagtacaatcagggtttcaccatgttggccatggttggtcttgaattcctgacctccggtgattcgcctgcattggccttccaaagtgctgagaatacaggcatgaatcactgcgcctggctggcatcaagtattattttaggctgaggaaaataagaagtcaacagatgcaagatgagttctctgccctccccttttctccctaaaagcagagtataaatttcccatgggaagatgtctctctgtcctgtaccagttcagaagtaagcgactcattacttgagacagtcaacatcagattgtttatgcatacagttctgtataaaccaaccttgttaaaagtgcccttatcttgtcattacttacccctacatattttctgaacgcttccccatgatttcctattccgcaaagtccaaacctttcctttgttaaaatggtatataagccccccaaccctgaccactttagttttataatacttttctgtcaactcccaaacacaaaatacgagcaaaaattgtgtgccatttctccaattaatttccaagtccccaggtactaaacaaaagaggacagaagttgtttttcctaacaatgataaagaactgtactgtatttgatttcttaaaatgttacaaatttctagtttcatcatcctgtaatctttccactaaactaatcaaggctgacactgaaaattgttctataaaaatacccaggttcaagtaaaaagtgaacctagaagaataaatgttaaagactttctccaaaattttatatgaagcttctacagtgataacaccaaattttttaaatgactgcaagacctttggcaaagaaacaagatataatgaaaaaataattaagtttaaagatacatcaatgaagatataaataaagtttctccattaccttttgcctatgagagatgttccaaaaatagaggttccacaaacttgacacaaatttcattttatacaaacttgggcactaaaatctaaaaatagattcaaatgtactgtattccacagttaacgcactgcggaccaaagcatttacccctgtgcaggcatctcctttcctacagacctaagaacacacacaacctttctgccatctttctaattaaatagcatacagagtttgcaaagtgaggtgtttattaagttaccacccacccaaccaccctgctgtttccaactactggtctgcaagaatcagaattcttgatctcttgatactatggacatttcacatgctcactgtacaactgtaactgacatacaaaatcacattttcaaattaatgttcatcaaaacagctttgtgttcactgtgattgactcataggaaataagtgctattaaatttgaaggttcccattagtctaataaaataccacttatctgtttcaatcctgaggagctaagattgtatttgtttaaaaagaagagaatcctatgccattaaaatagtttggaaatcacattattttgatagaataaagaaggatcaaaactagctgtaaaattctcagcaagcagagacacaagataaacctagctaagaacactcatattaataaaaaatattttaagatactagccctaaggcgtgctggggcatggcaggagccttatcatgcaaggcactacctactcagaggtaatcaacatctctttgggccctctggaatttatatttgggtttttgttttttccccttttgtcaaagtttctagttagcagctgatgaggtcagtacaagacctacctcaaacaactgagagtaatggtgaaatactcattacctgaggtcttccaccaactactcctctagccattcttttagaagaaaggaaaaataacagtgaaagaacaatctaccctggagtttcaaaaacctaattacacttaaacacacacacacacacatgctcgcacacgtgctttcagcaacatatcagatcagtaaggacacagcctagtgacgtaaactcaacatgtctagttctgaaagctaggaattaactcagagaccaatgctgaagaggggacagcactttaaacttaaactttccaaagaattaagtactgcaattgttaacacctcttccataacgccctaaatctagaattcaggtaaacctggaaatccctggttcaatctccctacaaaatgtttaagacattgataactcctagctaacgagtaccttccaggtccccactacagattctgattcagtaggcctggacagagcccaggaccgtgcatttctagcactcattacaagtgattccaatgcgggaatcctgtgaccatacttcatgagacacagtctgattcccaaaacttttttgggcttcaagatcacctgggaagctctctgacaacagattccaaaactcccttaggtgagtaggtgaggatgtagagccaaatttgggtaccaccgggctagaatatcaagttcacaaccatagattataatgtttctagagaagcacagatgttcttgttcatttggtgtattcgtcagtccttactgtcaaaaaccttccattctccttccagagaagacacactcgccagaagatgccctctggataactctgtaaaaatcacacatctctctataaattcatcagttggccatttgcttcatctttaaagagtgagctcttgcctccaacaagtggcaaagaggaaacatccaggtaaagcataagataatcagaattctggtccctactctaccgcttaatagctctgtggccttgaactagtcatttcacaaacctgggcctctcatcacctatgatgtttggggcaaagaagggagagggttggttaaggtcacctctagggcttttctgactgtaacactttattactcattccttgcatcataaaatccatttcgttcatctagaatgcagcatcagcaggtgtcaaggactcccaagtgcatttaaaaacgcaaagggatggactaaagtcagctaagctgtacaagcagcagaagcttctcatgatgaatgcctatagataggaaacaggctgaagcatacagctgggcagaagcccaaagagacggacctgacaaataacataataaatagaacttagtctagagagaagattattgtatttgctactgaagacatttcttaatgtacttccctaatcctcactcgatcaaaatagtgacattaatttgctaacactgacacagtctaaaagttatacactctcttcaaggacttaagaagcacacactttcctaactagatatttttgttccttagatatagtttcctgattcagcattaagaaagatttaagaaaagggaaaaggaaagatttcaaatcttcctgtagagtgactccagagttttcctgtaacccaattaacgcacatgctcctacaaaatcggaatacagaaatgggtcccaactgcttcccaggaggtagaataagctggataattagagaaggaccaaagaactctggtctgtccctaaaatacgtactgagaaactgcacaagacgggtaatgctacacaccacaggacagggtccaaagctccacaaattctttcaaaaccttgctagagatacattagtactacctcttacgaagtatgcctacttttcaaagtacaaccactcagaacccagatttagatactaccattttctagactattttactcaatagaagtattcagtaagaaactcagaaaaaaaaatatcctaaagcagtttatgcttaagttaaatgagtgagatccttctaaaagccattttaacccatattacaaatatgtcagtggtccaaatcaaaccaagattaccagaagttgagatgcctagtgttcagatttacctactccacttttgaatttattatcatatatgtttcttttaggaatcatgctcatatgttattgatgtgaacaggttaaactggtctgataaccagttaacaacaaatgatttcaaaagcttttatagcaccatgttcagtgtaatctactgtcagggagagatactcactcttcccacagtccccaaataggctctatgatcaaataaggccggggaactataattcaaacaggttttctttactgctggatttttcatagttcttaatacagtgattatcgagtatggatcttaaataaagaactacagagtgcagcacttcctaaacttgtctgtcaatataatacttatgttaagaaataattactagtatctcaccaaatgaaggttgaaaaacatctttcaatcttatacacactatcgtgggaaggcaaattaatacaccaaatacactatgaaaaatggtatgaaagttcctcaaaaaattaaaaacagaactaccgtatgatccagcatccccactactgcatgttaacccaaaagaaatgaaatcaatttgtcaaaagggatgcacgcatatccatatttattgcagcaatgtttacaacagccaaaatatggactcaacccaaatgtccatcaaccaataaatggataaagaaaatatgctatatatacaaaatgaaataccattcagccacaaaaaagaatgaaattctgtcatttccagaaacatgggtcaacttagaggacactatgttaagtgaggtgagacagccaaataccacacgatctcataggtagaatcgaaaaatgctgatctcattggaggcgagagcagaatagtgggtaccagagggtggagaagagaggaggaaggaaggagggggccagatggttaatgagtacagggtcactgttaaaagaaataagttctggtgtgctattccacagaagggtgactatggttagcaatattgtatagtatacttccaaatagctagaagagaggattttgaacactctcaaagaaattatgaatgtttgagatttggaaatgctataataccctgcttgatcattacacaatgtatatagcatcaaaacatctcactgtactccacaaatttgttcaattatgtgttaactatatacaaatatatactatatatagtagtgtacacgtaatatatatgtgtatacatcatatatagtattatatatatatatatatatatatatatatatatataatgtatagaaacgtcttacatctttagaaacatctttcaatactcatgaccattgtggaatttcttggggactctacttgcttaccaaatatttttaatagaaattttaccacagtggaaatctccattacatccttcccctcaagccactgaaaagacaacaggcaggggtcagaggtgaaggaaatggatgagaaatatttacacagttttttagtatctaggtatgtattaaagaatacccatgtgttgtgcttctattaccaccgtctaccacactaaagttagagaggcaaaggaggtgaagataaagaactcaaatttatcccattttgccacataacagctctaaagattcacaaaagagtaagattaattcaagattgactagaggtgagacgtgaggatctgtaagatgtctcctgtggcagatgcctaatatgaaagatgtatgatttgtctaatattttcatcttataaaatgataaaatgtatcatttcgtaacagtttcataacaaaacatgacttttgtgctctgttcatgcatctttctttttaatagtaaggggagctctactaagcaatcagaaattgcatcatttgtgtcatagccctcaagtcatttatcatatttttatcttttatattaaaaaggttgcaaaatccacatgtcaggggtgttgttttactttaaaaacaaaagataacatgtttaaaacatgttaaaaagatgtttaaaaacatcacgacagagacgtaagagcagccttttgttcttcacctttttcaacttattaaaaacactataaatttcacatatgcttatcacactcattttggaaaagaaattgaaaaatctcatccatctgattatcagtgttcagaaacataagaaccaccttcctaatatcatagtgaacatttaagcaacataattaaaatataatggccgtttgctatggatcaatgacaatcagtttgtacttagctttttaacttgatttcagtaagttgtctctgtgaatctcaatctgtagcttgaggaaatatgattatgagccaagtccaggggctggctctagaactcacttgcagatcttggagagaatgagccctaacgattaacggaatagctcaaagtcccatgtatgaaaaagtcaaaagtgaacttagaaatggcccagtgttaccccctttttctctgccttttaccttattttgccaatggaaaccagaagtctagggctgacttatccaatgtcacatgactaggtgagagttcagactcctggtctcattcttcacactgcctttaagtatcttttactcatttcaaatattccattttatatttttggttataagctttgtaaagcaatttggtatacactatcaatcaaatttaattaacatgaaaagtccacagagtctgtctaccttcgtatatttttagtgtttaacttcatatgtatgtctaacttcatgtatttttagtgtttgaaaacaactcctgcaggaagcattaacccttctatcccaagaacgtgctctttaaattaggttttggtttactctaaaaatttagtcaaatcttaaaaaatactaaggagattttcacctaatattcaaaatgtactataattaaggctttatctttataacaagaaggacaatcatataccatgtcctttccttgttaaggaacggaacataagatctcatcacgcttggtattatatcagtgaaaatgtttatacactgacaatgtgaacattaccatttattttatcatatataagcaaaatgattatattaacataaggaaaacacattttaagattttttcccctctcccaaacacatattgtatctcactgttgaaatgctaacttaaatacactcagggtactaaaagataaaagttaacatgacactggctatcccagatacatatacttttagaagattttccaaagatcctgtccagatcagagtacattaaagtccagttaaaatatatactgcccccaaaatagtttatgatttaaaaagaaaattttaaactaagtttcatattgctgatgtaataacagagagaaaatctagatatgtaaaattgcagcagtgaattatttacaagcagtaatcttattattttctcctatcttgagacacgatccgttaaatataaatcatctacataaaactgcttacctgttattttgtctcttacaagcttacaggactctatttcaccaatgctcccaaagagactctttagttcctcctgtgtcatgttctgaggaaggtagttgactattaagttggtcttgctgtcttctgtgttcccagagtcaactggtgacgaacagttgttgtttatggtggttggaccattggctgtgttattgcaagttggcccattagacagttgtgtttccatggcagcaattacctgctaaaaacagagaaaacaagaaatgtcagaattcatatttcacaacctattagagactccatccaagaatttaaacacttgtcactaaacacaagtcgttctaatgaaattacaacaatgcttcaacaaaaagtgtaatacctacactaattttcacttcatattaacctattcatcttaaggttacaactatattttcacatacatattccatacatgcatataagcacaatttaaatcttaaacattttctagaatcacattctgggtctattcacatatccttactcacctgcagtgtccacagatgagaaaatcaagtaccaaagggcacagaattgaaccctaactaaaaatcatactagaaaataaaagtgcttaacatgctacaaaaatgaacaaaaaaatgacctacctaactctgaagagattttcagttatcctaagaggttcaatattctaaaactgacagatagccattaacttaaaaatcaaagagcaagagtacttttaaaaatataaatttgtcaacatgtactgttttggttacatattgaaaacgtttttgatggacaatatcttatctctaccattggtaagaaaaaaacagatgctatattttagggagtggaaaggaactaactgtaaggtaacttgggaatgagctatgaatactttgtctaactggtagaatctaataggacactcctgtcaaccttggcagctaaaaattaccaacaaggtgactgatctacaacatcaaaataaaatccccaaacacttcgatatggtgtttctccttgactctgctttttaatgagaaaaaagaaaacctatccagtcaatgaaaacaacaatgtaaatatatcaacttttgcaaacagaccagcccaaggaattctcgtctgagcacataagcctgttgaaaatgcaagtaatagggtatctataaactccaaacaccagataaagaacagaattggggaaaatggcctcaaactgttcaggctactctacaaatcacttattaagcagtattaaatctagtttcctaaaaccaatcctatgcaaaagagtcacaaaccacagccccaaattttccaaaatcattttccactaactacctatctttggacagccaagactgtggtggaatctaaaaatcaacgcatcactgaaaggattatccttcatattgcatacatctctcacctccacaaagaactgcttctcaaaactgacaattctgaattgacgggatgctagttttagggaagctttaacatagaaaaggcaaagaacttgaggcaaagaaaaaaagcaaagtaaagggaaagagggttacaaggaaagagaaaaaactgtcttttaaaacacatattgcctaagaaaaataaaagggcacattagcagataaacatataggaagaaatctctactgccaggagatgtttacaaaagaaggcagtgttggacatattgagactggtcagactgaacaagaatcagtgctgtcatgataaaaaaacatgaggcaaaatccagaatagcttttgaaatatccaacaacctgtaacccctctgtgacttcatttccttgtcaaagaagtgggaatttattctacaagctgcaagctgtttctctacgtaagctaagttttctcagggaatacttaaagggatgaaggaaaataaacctttggaaatctgtatttaaaaatcttaaataattcaagatatgggttttattataattagcaaatctatttgaatttgaaaagggaagtttcagatttcctaattaaacataactgttctggtttgtagaatattagctgtgggtcactcttttcacagcaaaaattcttctggggttaacccttgcccagcagttatggaaacaatgagctacaagattaaagtggccaaagacacttaaatcactactgaaaagtttggatgggtgtagaaactacaagagacccgaatgggagattcggactaaagctcattgggatagcatttgaaatacaaagtgttcattgactgaaatcagcaagatttagaaaggacaacaaacactcctcacttaattgcacatttatttccatgttcaggtggcaagaatgagctcctaagccaacattcaagtgaacagctgcagtaggctgtgtgcgctgaaaattacagcatctctctgctataggaccatctgctcagaataaaatgatactaatgtgctatattttacaaataatgcatattccattgataggctcaacacaactgttcacagaatgcaaactctttcaacagttactgggcaaataattttcagccagatttacaatttcaactttttttttggagcataaagaattgtaaataacttcaaaatttagtaaccaaaaaaatacatagtaaacagaatgtatagaattacggtaacttagtattcagaccataccaaaactttttttgtttttttaaaaaagcttgtcactcttttgagtctgcgctaaatcctaatttagattgtaaaaaaattacatacgagagcatggttctgatgctacatacaccactacagttaaaattgcaatgtgctttaagtcctaatgatggccataccacaataggttaaatgtaagaataattagtatgccaaatgaaagattcaagtgtttggtatggcctcagcactcctccaacatgctaaaaaaaagtagcctacagaatttaagaaaaatcccacagaccccggtccaaggctctgctgcccacgaaccacttctaagcagagaagccacatcacacagtctgactgccatgttagtttggagttgccgtctgcaatatggacacaaaaagtaccgtatgttagatgagcaagataatgcaacaaatcagtttgtacaaaatttacagtgattgtattgatattcccagcacgtccatgcagtgtggcttaattgaaattgaggcaattccaatctaatctttccaaattcatttcaacatgtagttttcttgcacaaatataagcatttttaattaagagcctgattttaaaacagtattaactagttatcttggcatctattctgaagaactaatgtaaaccacacctcaaaaatttaaaaaataaagtaaaataaagcaaaatactgcaggctgtcttatctcttaaggatgtgggagaagggaggaaatgtgaatgaaattttatagtgggaaaaagtcatcatgcaattcctaagtgattggtttgcataaaagcactctttccccaaaatatcagaaagacattaagagaagctatatttgcccacactgttacattatactataaatgatccttaatcctgggacttaaaattaaaagtgaatcgaaaccctgtgaggttattttgccactacagtcaaacggtttctaacagtttcaatgagaattgctcacatatactaagaggcagtaaaccagcatctttcaattgaaataattggaccgataaataggattgtttggagtaatgctcgcataggatgtcagctttgtccctgaacgaaatcaagtgaacattttttaatatgtaaattgtaaacccagcacgatttgaaattagtgctgctatgaggcctccaatatagttaatgggccatttaccacttattgaaacttgcccaaataccaaacagagccatgatattggcacaaaagccaaagtttactttttttgccatatatgcagatgcttcaaatggtcaatataatcagaaaacttagtttctaaaaatagacagtgaataacagaagaggtccaaaaatgtcttttacttattgataattataaaaattttatcctgagaggcaatcctggctgtgatttactcttgatattagcaatgccgccagtaacgatggattccactttctggcatctatcaaaaaggattaacatacttttttacaggaagccatgaaaatattttactcttcttccgttctcccactgtaacaagagattttggtctgaccctatgttatttttcaaaaaactacttatagtttaactgaacctgtgaaaaagtgctttacacccatgaaagatttttcataagaacccaactgtagttaagactacatgagcaggaccacacccagcagggtaaagcaggcataaatgtatgtcctgaataccttcaggagttcaatctaaacattgctcactacataaaacagattttaatttaactgcctcagtcccttctatttcataggaggtggacactaatgagctaatctattgacacccctctttctgaaagccccagggaggtgaacaatcactttattgcaccaactagataggaaggctgtgtatggaaaatgattctactgcacttttacatttcaagcaccccagacagtcttctccgcttgaggcagacacatacctttatgggaagttataaataagttgctcacatggcccttacctttatgctggccaacaattcagttactaaaaatgtaaagctacttccccttcacttaaggacaggcaattctgctctactcaatctaccacagacaactgggctgtgtactatttatagattccactggctctgaaactcttcggaaagaaaaaaaaggccatattccagtgaaacagagccattaattttaaggcttaaaaaaataatgtttcaatatatattctcctcttaatttagacatcacttgtgccaattcagactgcttttcctcctgttattatccaagtaataatttacgaaaaggcactttagcatagatgaatctagaatattctaaactttcactgggctccaaggtaaaatggctgttactatggtgaaagcgtaggttttattgggaaatagaagattgtctctacttttatacacacaggtacttccaaaaagccataaagacttctaaactttttatttaaataatcctttatgaattttaacatctactgttttcacaatagtggaatttagaaaataaatgctttatatctcatatctgggaagagttaagaatttgagaagtcaaactgatccaatagtttcctggtcacatgagagaaaagcagtctatattttctaatcttacaattaaaaaattctgcaaactaaggtaatcagcttcttcactattttcaaacctcttgcagacagccactaaaccaggtagttaatcaaaagcatcttaaataggccagactcggcggctcacgtctgtaatcccagcactttgggaggctgaggtaggtggaccacttgaggtcagaagttcaagaccagcctgggcaacatggtgaaaccccacctctactaaaaatacaaaatattagctgggcgtggtctgtagtcccagctactcaggacgctgaggcaggagaatggcttgaacccaggagggggaggttgcagtcagcagagatcacaccacttcactccatcctgggtgacagtgagagactctgtctccaaaataagtaaataaatatatcctaactatattctgagagttgttattaagttcactcagtataatgttgcgaggagggaaaaaggttccatagcctagaaaccacctgatttagggaccagacttctgcgggttaaagtcatagcagggctgctgaaagggccaatacaatgacccctggtgaggctgcgcctgttgctccagccactccattgccatggtcaacatcctgacctgggctctcatcttcttcaggaccagcaaattaaagcctccaaaaggtccctctctcctcatcctaatctaccttaacaatgttcccaggtagactttctaaaccctcccacagctccctgctgcctatcaaatgaagtgtaaactactaggtatcaacagaaatcctgtacaactacttttatcagcccacttattcaagcaccttaagatctgaactactccttgtccctcaaacagtccagtaccttcactcttctagctttgtttatgcagtcccatctcccttattcaaggctccatccaaacccaccccatctccatttcaggggtttgtacaaactaagcattgaaaaagcaaagggcaagaacagtttcttaaaaattggagactgaaagagcaaatccctccctaaatgtgtacaaactaggtaacttttttttttttttttactttttacaaatacatttaaactataaattggaaacacaaataatcatgagtggctctaacttgtttttctatcccaccaagtatttcaaaccagaagtaattatgaaagcatattttcaagttttgacgcactccatcagccaccctcacccactgaaatctaaattcctattatatggtaaaaggaaaccatctacctttgtgaaaagttgtgtatttttatttcaacaatctatcacactaactacaaaaccctggaagacaagacaaatccaagcctctggccagcagggttatggatatgggcatgtggaatttgggtccaacttcaggaaaatggcaaaatcaaaggtaaatgcaggaaaattaaacagatcttgaagaaggcatttagaagcacatcatgattaagtcgtggatcaccagtgatcttcatactaactagaaaagtttaggcaaacagaaacgataacatctcttaaaagaatcatggctagaggcaaagacaagcttatctctcaggctggaaaggtccagcctaaacagagtgaacttggtctctacacttatttgcaactagaagctttgaataccctgagtattcaaacacagcacaccaggacagaatcagcccagtacaaaggccttccttctgaccacatcaaacctctccctaaatgccaagttacagatgaacagaagacatttgtctctaaagttttagagccaaacatacaaaacacaaacaaacaaacaaaaaacaaaaccaggcatcacaacctttaccacaccatcctttggggaacttgcagcagggacaaaagcactccaaaattggtgaaataagtcatatgagcttatagatgacagctgggtaggcagtcaaagggatcatctgcccgacacacaccattcctatagcaaatgctttatctttcccattcaaatcactaagtggtattttcaggatatgtttgtggtttcacttaattaagcaagagaatagtcaaccaagtgctaaaatcacaaggctaacaatgtcagttacaggaacaagccattagtttgttttctttaactctctttgctttgtgattcctaaaataaaggtttgtagctttaaatgtcaaaggatttattcaatctagaatccttgtcaattctccagcccacccacataccatgttagctgtctcactagctctacgaattcctcaaacccacattttcagccttggggctaacaacggcccaagaacttgcagagacaatgcactgaacagctgcacgcgtcataaggagaatgttctttggcagcaaacactaacgtttttctgtctcttggccctttatgacttctacggacaaagtacacagtctccttcatgccagtctttctgaggttttgtagtttcagagctggcaggttcaaaagctttgaggttagagaggtaagataatgagtttagggtcccaagtccttctcttcagtctaagtccattacaggtatccagtttgagcaatgggaaagtaaagatctggcgaaaaagatctgcttaagtttcatgttttgttcattcatccattcaacgaacatctccatgcagctcccacgaattcaggagagtcctgaggtacagcaatgaagaagcatcttggagtgctgatttgctgtggatggtgtgtgcagaacatatacaagtatgaacacatagaagaaaacagtacatcagcaataagtaagagtgctgtggaatacatatagagaagaataaggggggttgaaaatgtggagatgaagacgggtagtttccagcattaaacaagcaggcctcaatgaaaaggtgagctttgaaccaaggtttgaaggagatatgggctggctgctgtgataggaagaaaaatccccttcccctcaatgtctacatcctactcccagaagtgtgaatatgttatgttacatgacaagggggaattaagattgtagaattaaagctgctaatcagctcaccttgagaaagggagattatccttggttactgaggtgggcctaaggtaattacaaggttccttataagtgaaagaggaaggtgagactgtcagggtgatgaagcatgagaagaaatcgaaaggacattgctggctttaaatggggccaccagccaaggaatataagcagcctctaggagctgcaaaaggcaaggaaacaatctctcataaagactctgggaggaatgcagccctgccaacactttaatcttagcccactgagaaccactttggacttctgatgttcttcggaattttaagacaataaatcttgtattgttttaagccagtaaatttaaagtaatttgttagaggtctaacaggaagtaaagacagcccccatggagatatctagaagaaaagattctaggcagagacctgccagtgcaaagcttgtctgctgtgcagaatgacaaggagataacagggagagtaggaggagatgagtctaagaggtaatgaggccggaacacatagggccttgaaggccaccataacaaaaaaggaaactataaaaggttttcagcaaaagagtagcatgtggctactgtgaaaataaattgtgtgtgggtgtgcaggaagactcagtgagtttggaaacagaccagtcaagaagcaactgcagcaattcaggtgcaggatgacagtgactcccaccagggtgaagttggggagaagtcatcagattctggatatacccagaagaaaacacattattaaggtgctacattttaattacatcagtacactgttgaaatccattgtcaaaaaactggtttagatactaactgctcacattcctacaaaccaccaaaacatttactatgctctggacactaagaacacaagatgaataagcaaaggaagagattttatggacagttgtgccttaaaagaaaataaggatatatatataaatctatatatagatatatataggaaacccaacatacaaaaattttgactttataaatattaaatccagagttattcactttatggttggatattcactattcactttatatttgctactaaatgaatccactgccagcttcttaaagaatcaactgattcatttaggagcaaatataaaatcacaaatcagtagcttaaaacatgcaactactactaaacatagtatatcagaaaattgatttgtaatctatgtgagcccccttaaaactttcagaattcaaagtaaaatagctcaaagctctccccaaaagtttaaaaacaaagtggatgaagattagattaagtcacattttgtaaaatgggagtaaactttaaaatctgtatttttcaacagggtcatttatatacctctacaatagtaaaggttaagccatgagataactctgtcttggttataggctggaatacactaaatcattaccttctggtgatgaatcattccaaccccattctttcattccaacctaagtggacccaattaatttccatgccattatttggcaatagaatctaaaaagggatatgagtacaacaagaataaaatcaactactccctcagttttgtggcagaggttttgtttggtataggcagattaatctgaattgctaaattaagacagttaacatagtaatcaacacagaaattggattaacttcacattcttctacaaaagtcacagctatcaggaaccccctcagggtagtacaaattgtgaaaggctgattggaaatcctcaaattaatcccagtagttgagtgttttcattaggtaggttaaaaacatagctcctctgttggatacagacactaaaatactctgtcatgtacaaactccaaagcagaaagaatgactaatcttaaagggaaaataaaagacaaggaaggtttatggacaaaaataatgttttttaactcacaaatgttataaaggccacaacactcctcctggccagtgaggttaacattttatttttcactgttatttagcaggacttagagatagaaaaccaaatgctacactgtttaacctcaagcagcttacaccaaaaaaaaaaaaaaaaaaaaaaaggcatctaaaatgtcaaccaacaagatttatttccttagtaacattaggaggctacaaataaagggatgccatcccagggcacataaatatcttagaattcattgatgtattgtggagagcaaaacaaggagtctaaaaaccttgatcaatacagacagcttccttctgctctgaactgtggatcatctcaattactggtattcacctatgaaatgtgtttttcttttctgttgatgtgtaacgtcctgagattcccaagacatgtatacttgtgatttagagacacaactatgttttatttactatggaaatttgaggcatcttaaaaaaacaagattcacaccctaagatagtaactttatttcctttggtccacctctgcctcttgctcccccaaagacagctttctttaaaaaccgacatcccagctagaacaaaacacacctaggtacatctgtgactttttatggtaattaagttcctggttatttactacatttcaagaaaaaaaagtgggggagggggagaatttacattcaatgcaagtgttatttttattcagtgattccaaagtgaggaaagggttgctaagggcgagaagtatctcaaggaaatgtcttgttaatctgctacataagaatgtatataagagttaataatgtttttcaaaaaagttaatgctagacactatagaacaggtaaggcccttcttagcctcagaccttatccacttatatccacatcaggcacatacacccaatttcgaacaaccccctaacagagaaaggggtcaatatgcttagattgatgacctcaccatctcacccagcatagagcttcctcttactcctacttttgtcagacttcccgctttgcaagttgtcttagtatcattcaagtaaagcacatttgaaacgaacgcttaaggatctcaaaaagtaggtggggcaagtacccccatgttacagatgaaaaatgaagcaagtgtatgagcatatatgtatatgtataacctgtatatacattatacacacatattcccaagtgttgatgagaaacatctatcccccacaggctgaagaggagaagggagcacatacgcaattacaggctacattttaacaggaaattattcttaagactcaaatcacaaaagcattagcctttgaattatttccactctaggaaggaaaagagcaggtaaaggggtctgttctctttaaaagctttaattacatatacatattttgtctgataatgtcaaagcactttacaaactctaaggtgccaagtgaacagagggtattatcattattgctggacaaaacaagatgtctcttaaaatgttagcatagaaaatttgcttatctgggcctggcgcagtggctcacacttctaatccctgcactttgggaggccgaggcgggcagatcacgaggtcaggatatcgagaccaccctggctaacacggtgaaaccccatctctattaaaaatacaaaaaattagccggacttggtggcgggcgcctgtagtcccagctacacgggaggctgaggcaggacaatggcatgaacccaggaggcagagcttgcagtgagtctagatcgcaccactgcaccccaagcctgggcaaaagtgcgagagactccatctcaaaaaaaaaaaaaaaaaaaaaaaaagaaagaaagaaagaaagaaaatttgcttatctgtcttttggattaagcctgtcagtttttcttccccccacatctaaatggacagcaaggctgcagagtcgtgttgggagccttttaacatggaaaggaaagactgtggacagaaagtacagtatgcagacttttcctaatcatgactgttaattcctgtcctggactgctgaagcagatgctatgttaaactacatttagcacagtcacaaacggtgactaaggaagttaaaaatttttacttgcaatgctgcaatttttaaccccagacctccaaagactatgtttaaatatacagagtactaacagcccaagtacttcacattagaattacagccttgcctattttaatttaccttatttttaaaagtgtgtgacccccacccccctccccaactccccataaaaatacacatctcccatcctctttgagcctgcttatgctcaggctcttggaattttaataagattagaaattgctacctccttattctggctaagaactccaaagatgatccaggcatcttgtacttatattcagatttacaatacagagaaaacaagagtgtagaaatctaatccacgattataccctagaatctagattaataatgtgtacattatgagatcacatgggatcaagtttccacaattaatggatcaggcaaatgatccatgtatctacattcatacaaaatcatacactctcctatcatctttctcctatcatgatcttcaaaaatgacctgaatttaaactgtggctttaaaatcacatttaattacaagaaaaatagaaaaggaactttccgtgggatttgagtatcttttgctacagtaaagaagttcagatgatctccctgccttctggagaatccaacgaatcctacaactaaaagtaaaaataaatggcaagggaaagaaactagcaattattgattcctctttccatgccagtctcaagctagatatttacaaacaaaatcttatttaatcctcttgtggagcgggcaaggtgactcacgcttgtaattccaacactttggaaggctggaggacaccactgcactccagcttgggtggcagagcaagaccatgtctccaaaacaaatcttatgcactataagctatattacattctcttcaatttacaaatgagaatttcaaaacttcaagagttcacacaagtattaagtgagaaactgggatttgaaatcagtgctgagaccccatctagagcttcctagctgatctctctatttccaggcttgcccctttctccaatccttcctccattccacggctgtggggatctaactaaaataatgggcagcactccactactatctcttttaaagctctgctcactccacgttgcctatgaagtaacatctcagctccctagtgaggcagctgacttgaccgagctcctacctcttcatccacatgcccagcacccccgcatcatatacacaagctctaacaagctcccagtagttcttcccactcccagtgttttccagtgtcacccaacctgttttctccacctgcaacagcctacctttcttctcctgcctcatggaaacatcctcagcaccggaagagagcagacaaacctcgaggaagccttctgtgaaccactcagttggaccagataactctgtgtgctcctatatgcctgactcacctttatctccccagtaaaaaatatcaagacagatccataaagagaatgaatgccatgaattgtgattcaaggtggcaagtaaaaaacaacccccttacttatccatgtggttttatgttccctgccaagtgggaaaaatttccattgcaaccctgtatagctggaggagcagccaaagtcatctcaggttgtttataaagaggaaggtagactgtcaaggggaaaaaggggaaagtaggctgtcaagtcctaccactaacacacacatctctttccgcatatagctactaattccatattgtaagctcaaacttcaagtggaatcagcattttttaattcctagctacaagcctttgttaaaacaatataaacctcagggaggaaccagggacaggtgtgttccattgtcaccatctcacagttcaaaataagccaatctcatcaccaatgtgtaaaatcaagaggaaacctgaagtttatactctctccccaacacagccaaggtctggtgtgtagaataccaaaaagaggagtaaagaaactccccaaggctagaaaagcaacattcctgatctactgcatgtaccaagcgctgtgctcagatgctgggaaaacaaagatgtacaaaaccccactcattccacccctcacggaacttctccaaaacacacctgtgtcctaagaaggtgtccaaagaagtcaaacgcacacaaggaaacctttaagaacccgcagccagaaataatcccttctctacctgacctatgctaaatagtttgctatcaaaaaaaaaaaaaaaaaaaaaaagatggcaaaatcactgctgctatggaaactaccacttctaacttcaatatttgagtgtggacacgtatttgagaagaaatgaggcattttgcttcccagtgtttaaagtgctaaacaacaggagactgtgcacagcattgatactgaacattaaagtggacttctgcctcactaagaaaattttaaattataaagaagagcaggctgaagttttcctgatttagaattgctcagagagttttccaggtacccatttcctgttacaacttcatcctatgtaaagtacaagtttctttaaaagaactctcagtagagtagatttaacatgtaaattgcttagcagtaaatagtctttaactgttgataaaactttcaggaagtacctactaagtaccaggcaatatagtctacagcagttaggactgcaatctctttcagatcgagctaaaaagaaattctcgctatcatccactactttaatctgagatgggtatgaacaaaaagatccttaaaccactcttctaaagggaaccatgaccctgaacccaaatttttcaattcttctgtgaagagtgtagatctactcaaatgccactctatcgctctatcttagactattttaaagagttccttgacgattctgagtgccagtctctagttgagaatcactataagggaaatagatggtttagaaacgtgccctttctatacccttctgccccacccaagcatgctttttacatccatcctttgtcaggctaaaacccaggattcacaacaaagatctggagactgcaggccttggaattgagttgagtcatcaggacactattctttattctccatttctaaagagcaaaagtgggaaacggggggtatcatgaggtagaagcaagaacggtaaattaaaactgaagaaaacttccactgcactggaacagtaattagaccaaatttgcctgccatcaattaaggaagaacaactgctctgcatcgctggctaccaagacagcagttagttctcttaagtaacttcttgctctaactggaaaatgacccatacttttacttgccaagaataaagacagctggcctcctacattacaaataaccaaaatggaaacaagtgaatcttttttatccaccaaggttgactacacattaactaagacctattctaataaacatggccaacataaacagcagcagccaggtggcctactctgaacattcttcctgatacaaagtacatcatatacctaagggcatggtgaacaaaaccccccagagtggctatgaccagcaggaagaaaacattgaggggatgggagtcaaaagtctacttaaagtattaagcattcaaataaatggcagaatccgagggccagcttgcaaaaacaaaaaataaaaagccaacaatggactctgcttaaataaatcacgtgcgaggttgaaaagaaggacaaaggaaaagtggcaagggatagacaaaaacaagcagattctgtaactctcctcaacctccaggccaaagttcggactggcagctagcgggtagatttagcctgaaaacatgttacgtggtttctccaacgtccttaaaaacaaaacaaaacacaaacaaaaacagtagtgttcaacatttaaaatttcaccaatgtaacaatttcacattcataaaactatatttctgatttcgcttaataaataaagtttggcaagagtccatattcccagagctactagccagcaggttgccctataaatggggtgccttctttccagctctcccaatacagccttaatgttccggcccctgcaagggctggattttaagtaaaagagtatcatagcctaaatgtcaaatgtgctaaagagtatatgcttttctaccatgatggagaggttcagaatgtcagagtactgggggagggagggggttttccaaggtcatctaaactgaggatctttaattgtagacctaatcatctgtgaaaatattctaatgaatatgcataacaaaaaatgaggcaaaaaagcatcaagtctgtgtcactaaacatcctaatatgactgccacagacattcaaagcactctaaataactcattttggcctgtttatactactatggatttggattagaaagtcatcctgtccacaaagaattaggtatatcctgtcccttctgggggctgagtttgagacagttaattcaaacctaatcaaatattttgctatgagaaagaagaggaggggccaatgaagtgctttatccccaggatgaggcagtgagtagggcagcacacaaaaaagataaaaatcacctggcactacaccagaagcccttgaattaacattaaatttccaggttaacgctctaaaaactgtctcatgacaaaccacaaattgtattttggaggtaaaacaggaggtaagtggggaaggaactgaagggtaaataagaggtcttacttcacactttttctgctgcttttggtttaccccagtagaatcccatgaaaacctgcttcacactggcaaagtgggcagacagaggaacaaaggcaattccagggcctgcagaaagtcttcaaaggcaagggaagaaagcaacgccctgcctaaacactggctatttatagcacagcaatggaagatctgggaggtggctgagggaatatgaaagctagagagtgggtgggcgggcttccttctggcttccttagactcagaaactaatgcattcttccctgcctccaaagctgctattttgtttcctgtgtaaggtttcaaaatactgcaacactgtccctaggtgcatttgacaatatcagagcaattacagtttggttaaaatctgaaggtaatcaactcaccattctttgctattctctagaaaaagaggcctgaacaaagaggaggagacaccaccatccaattcataaggatggtctcccaaaatcccctgaactttcacagcgcggaaagtttctgtgatttcaagcagagaccaggagaaactatacttttcacctcttctcattaactaaaagccacagctaaaaataaaaagctggagcaattccaaaactgtgggttttatagggcacattaaattattccttatcaactgcaaacctttaaggttgcagagtattatgttaatgctattggctttttcttttttttccccagaatcggtgatagtgttccttaaaaaaaaaaaaaaaaaaaaaaaaaaaaaaaaaaaaaaaaaaaaaaaaaaaaaaacttcatgaacttccaagtccaatctctattgcaaagtaaagtatgggttcctaaatctgcagagaatatcatctattctacaaaacctcacacataacttaggttgattctcttttccaggactgtattataaaacattttgaactgagaacagatcaacagttggtattaatagtaaattataataatcattttacacttgtttcctaatctcatgcatgagattcaaaaataagaaagcagtctaacaacagagaattttctaaacagaatgtgaagctctcacatttattcaaatataaacactaaaaagtgtttagggttccccctggacattcaattgttattaactcttaagataaatttccaacttaataaacttggaaaatggctttttaagcatattttcaatttgttgaaagtttataatattgaatcctatgagtctttttataattattttcttagaaaatttgtggtcaatttcctgtgaccttcgtaaaacttaaacacacctcttagctcacatccataactatgttggcttataccaacattcttcttatattcttcattaatggtcaaggttaaagaaataagagtatttggtctaaactcaaatcaaatgatcatgtgtaacacacagcagcacccaaaacataagcactattttccataactaaaacatcagaacctaaggcatccatttataccaaaatgaagattttagttcagctcttcaggagagttaagacatggccaggtaaattaaggccaaaaaagggcaagtcacaacactatgtagcattcaggaaatttggagcaaatttaagctttcacataaaacagtcagggttaggagtggcctcagagaagcaattatctcattcccaagtcccaggctaacaaactaacagggatatggaaaaaaagactagaacgaaggtaaaagcctacataaagtccaaagacaatcactgctggtcctaaatctatttcttaatgattctgtgaccctcaacaagtttgttatgttcataacttccctcatctattaagaacagatttttctcactctgctagcgaacagggttattaaaagaaataagttataacaaattacagataaaagaatggcttataaaaaatttcaggcactatacaaagtagggtattgttctcaaggcactaaccttcttgagaattgttttctgctttcatgctctcctaaaaacacatctttaatttatggtaaggtcaaactgccattatcactgcaacctgagaaattcaaattaatggtcaaagatacacataaacacacacactccaggctttgctttcttctttccctcaaaaggtcatgttttcaccaaacagatcaggaattctacaatatactacgttccaagtaccaaatatttaagccaccaaaacatacagcagaatagcatatttaagaaaagtttcttttttttctttccttttttttttttttttgaagataggttctaattctgtcaccaaccaggctggagtacagtggtgtgatcacagctcactgcagcctcctgggctcaagggatcctcctacctcagcctcttgagtagctgggaccacaggtacacaccaccacaccccgctaattttttaaatctttttttgtttgttttttgagatggagtcttgctctgcaacccaggctggagtgcagtggcgggattctctgctcaccgcaaactctgcctcccgggttcacaccattctcctgcctcagcctcctgagtagccggcaaccgccaccacgcccggctaattttttgtatttttagtagagacggggtttcagcgtgttagtcaggatggtctcgatctcctgacctcgtgagccgcccgcctcggcctcccaaagtgctgggattacaggcgtgagccaccgcgcctggctaattttttaaaatcttttgtggagacgaggttttgccatgttgctcaggctggtctcaaactcctaggttcaaaggatcctcccacctcagcctctcaaagtgctagaattacaggcgtgagccaccatgcccgaccaagaagtttctttaacataaaaatgtccaagcagataaccaagtcaaaacacttttattactgaacagcagacggtgatgttttagttggcaatttaagaatcacacgctatagctattcctgaaaaattcaaaatcaaagtacatcgtaagcatttgctcagaggctagcatagtgcttaacgcagagtcttagcattctcaaaaacatgcaagaccagcctggccaacatggtgaaaccccagctctactaaaaatacaaaaattaaaaatacaaaaaattaaaaatacaaaaaaaaaaattacaggcgtgtggtagtgcacacctgtaatcccagctactcaggaggctgaggcaggagaatcacttgaatctgggaggcagaggttgcaatgagccaagatcctgccaccacactccagactgggtgacagagcaagactgtctccaaaaaacaaacaaacaaacgaaaagaaaccaaaccaaaacaaaaaaccatgcaagagcttaagccattttaaagagctgcaaccatgaactaagatttagcctgaagacaattagcgtacgttccatcccataccaagaaaaccactttatatgctcaaatacttcttggtatattctgccaatgaggcgattctacctgaatttattaataaactatttaccagcctgcttgaccaccaaggtttggtaaacagacttgggcccgatgtggaagcatagctaaggatggagaccccggggcacaagaagtgagctgaagtgaaaccaggaaggaagacaaatttctttgatagcctcttctctttccaatcccagcttcccatctcagttgctcattgtgccttcatcccctctcccatttgagagctcagctgagtctgcagatatcccaagatactaactggtaactatttggctagagtgagagcccacttcattttctatgcatccaacaaactcttatctcaaaagggcaataagcatacctggaatttactccaatacctgtgaaaggtagccaaactctactctccggaggcgtgaagtcatcatacttccagataagacattaataagcagaattatccttacctcatttgttacactttagtcctccaaattaaaaacagccaaagagaaactagcttgtaaacaaaagtaaatattcaaggtgccaagactggaagacagcaagatctcactcagctcacagtctgaagccacttaaatggagtaactccaaggaaaaccgaaagttaaactgaagaaaaacatgtaacttcagagagcatgaaaaactggtacaattctgcacaactacaaagtggccatgcactaacctgaaaacaacgaggttcattattgaataaaggcatcaggaattcttggagatggagctttcaaataaggctttagtcaccactaaaaggacacagaagaaaacagatatgcctcaaatatcaacacatttgaaggacagacatctgcattcattctaacatgcaaatcctatgtgcagggcactgtgctggataaccaagatgactcagataaggagttcccacttactgtctaagcaaagaagggaacacatgcagaaccacaacacaggacgcaatctggtaagtgtgagaaggagagattgtatctggatgacagatgaaaaaaaaaaatcaggctcagaacagagaaaagccatgtgcactaggctctctgttgtcataggttcaaataaagggcaaagtacacatagttgcaatcatttttaaaatgctgggcacaggccgggcgcggtggctcacacctgtaatcccagcactttgggaggctgaggcgcgtggatcacgaggtcaggagatcgagaccatcctggctaacacggtgaaaccccgtctctactaaaaaaaatacaaaaaaattagccgggcatggtggcgggcgcctgtaatcccagctactgaggaggctgagacaggagaatggcgtgaacctgggaggcagagcttgctgtgagccgagattgcgccacgacactccagcctggggccacagagcaagactccgtctcaaaaaacaaaaacaaaaatgctgggcacagagactatagcataaacaagacaggtactaagggaacttagtgggagagacatattaaacaagccaaagaataaagctaatgtttagaattgcagttcatgccatgaaggaaaaaaggatgctgtgggaataaaactgggacagtgatcagaagaaaagccttctgcagattaagtgacatttaagctgagatctaaagataaacatgactacatatatgtaatacttggtctttggaaggtaaaggatggtgccacacacatactaggtagtgttgggggcagtgggactggtgaataagacataatttgtaccctgaggaatgtcatcctagggatgcaattacatccaatatgtggaacccagcaggcagagttttacaattatggataaaacttaagctacagagatcttgaaacccatctatcctcaaccattcctttttatcaaatgaaggaaatgaaacccagaggctggctcagtgtttctgaactaggtaggtgcagaggtggggcacaacctgtaactcccattacatcacactgccaattaactttttaatcagaatttatgtggaatgtcagaattcagtaaattgatcatgtacaagaaacacttaatatccgtagggaaaaataagtagacttgggcctaaatgccaagtacttcactagacattgtgggaaaaatcttatttggttccaggcaaaataagaaatgtaatgagttttttgtaaagtgaaatatattcaatttctcttgtgaagttacgtgcatcctactttggggcatctaagcaaaccaggaaatgacagtgataatagataatgtgtcagatggtcttaaatgcctttccttggcaaaacagagttgacaaacctattattcccctcccacaatgtacagttttacttcttattgtacttccctgagaagtacatatatcaaggaacaactgtcacaatgagggttgaggcagtagagggagccactcccagagttcacagcagcactgttcatcaaagcacaagaaatgaaaacaaagtgtttatcaaggaagatgaacaagaaagatatgaagataaagtcatacaagttcacacaattcaatgttcttcagcagccaagtaagagcccacacatagaccaaagcatattataaaatgagaattttgatgaatttaacttagtgtcctggaggacaaaaaaggacttaggatcttttagttatcacagctgcacctacaagtcaaatataggcaaaatgaaacatttttaatcagatatctcccaaattttgcattactttaaggatagtgtgaaaacaaaaataacaagggaggaaacaatccccttcaaattgaagccactatagctcaatcctcactgtctcacgtctgttaacccaaaactcccagtatgagtacgaatcagtcacgacatagaaatctagacctattctgtcaatgagcagctgctccaggtctgcatcaatctgtaaacaggtatttccaaagcatatgaccagctccagtctgagcagaataacagatcaaaactggagaggacacacaatgggaaaagtagttgatcggtttgatagaggaagagacactgggtcccactcaaaaataaagtatctcaactttttcactgaatttacattcccaaagaatagattgtaaaataagtaagaatcccagacttttcggtacttgaaggtcactatgaggtcacctggcatagtgatctactgcaagaacagcctgactggtcttcactgatgctacattctattttgtactctgtctcaagctagctgaacttgagagacttctaagtctatccaaggacatttgaaacatttgtgataaatgcagagtatttatctctgttaacaatgaagaaaagtcaccttccagaagaattgctgtgaaagcccacatcgtgtgcactattttttaaaaagtaacatagaaaagctgtttaacataccaggaaagtcaaggagaactttaaaaaaattataaccataatacctaatttcatcaaaatgatgtaagcaacaaagatctaatttatattgagataaactatataggctcagactattcaggcaaggaaccagtaaatgcttatttcatactgaaatttacaggacatgaatgacttagcaatatatattgaccctgagctactgaaatgacaacaacccaaaggtgattactgacatatcagaagaataacaatgaaacttgagggcgagagtctctttcacactttaaaaaaaaaatgcagctcaataaaaatgtacctattaaaaatagaaagacagttatccctttcaactggtgttgatctgccctttattactggagatagactgtatcactcagaaagttaccctgaagctataagaagcttggaggaaaatattaaacttcaaggtacagataggaccaggagcctgttaagacagaaaacgaagacattaatgttcaaaaagtatataagcaggaaacctgcagtagtctcagtaacagattttagtggcaaaaaaaaaaaaaaaaaaaaaagagagagagagaaaggaaagccttttaaaaatctaagccactggaattttaaagtgacacccacatgacccagtttacttttctattcaaagaagttctgatgctgtttctctatttctctttggaagtttttcatgtccaatatattgcaaaagataaaaggtacacttttatttaagcacacaatggaataaaacatcactgaggaacttggacctgtaaataaattttaatgggaaagacaagaattcaaacatgaggaaagggcaacagatatatatacggcaaatgtgagaaagaatatgagcatttggaaaaggaagacaacattgttggacagggtaggatgacagctattaatttaatttaggatatgctaggccatgctctaagccgttttaaagggcattacccccctgtgatcctaataacttaataaaatgggtcatttcatccccattttttttttttttgagacggagtttcgctcttgtctcccaggctggagtgcaatggcatgatcttagctcactgcaaactgcctcagcctccagagtagctaggattacaggcacccgccaccatgcccagctaatttttctatttttaatagagatgggtttccaccatgttggccaggctggtctcgaactcctaacctcaggtgatccaaccgcctcagcctcctaaagtgctgggattacaggcatgagccaccacgcctggcctcatccctatttttcaaatgaggaaataggcttaaaaaaacaaaaaaaaaagattaacttttccagaactcacaaaacctgccaatgtgggtctaacaaactccagagcccatgctctttgcaccacacatcaatgaagcagctaaaataaccaatatcttgcttcaccccagaccaattaaataagaatctctcctaagggcccagatactggcatttttatcagcacccgatttgattctaatctgcaagcaaggatgagaaccactgtaaaagacttttgtaagacaagtggactatcagctaggtagtgccaaacaaacaagagtcaaataatcagagactggggaattcatccagcttttagagggcaaacagaagttcaaaaacagtggaggtgctgaggcagagctgatccagactaacttcagggaaagtctgaacacaggctttagtccaagcagtgattaaaaaggcgcaaaaaaccaggttggaatcattttgctgagagaatgaactacaggttagaaaatttttacttttaagactgtaggtaagaagggagcacaaaatgacttttacagctaatgtaaccaatgggtatgaattttaggaaaataaggaaaaaataacagttgactaacctaaagccaatggaccaggatataaaatataacaagtgagtgacaataaacagagcttgctgagcaatcggatatagcctagtagttacaactgttaactctacggtgatcccttctagcatttgccatcctaagtcttgatttcctcatttaggaaatggagaaaataatcctatcatctcattcagttattggaataaatatatgagatatggcagtcccctttttaccaggcactcaaaagccccaatagatgcctgaaacttcagatagaactgacccctaccatgttttttcctacacatacctatgataaaatttaatttctaaactgggcccagtaagacattaacaataactaagaactgctgtaacagtacactgtaataaaagttatgtatatgtgatctctcagcgtatttagttttctttaagtcgagaactttcacctttttacttaaagggaacatggagcactttaacatcctctctttggcatgtcagaactgccagcatcactactcttgtgctttggggccgctgaaagtaaaagaagggctacttgaacacgagcagtgcaatacctcgaaagtcaatcttataactgagatggctatactaagggactaacagcatggatacactagacaaagggaggattcacatcctgactggtcagcatgagggtacatcacactattcagaagtacacgcagtgtaaaacttgtgaattgtttatgcctggaattttccatttaatatttgtgaaccacagttgactgcaggtaacggaaatcatggaaagcgaaactgtgggtaaggaggaactactgccatccaagcaaaagaaaagagaccaacggcttctgtattcttatagagggcagtgtaagaatatagtcccccaattttttccttcttaccattacaactttagatggccttgttaaagactcagtaaatggggaatagaagtttggcctgcttattcagttcctattagtccctatatagagggactgcttattcagtccctatacagagggtcagtgaccctctatatcagtctaggccagtgcccagacactagacgcagccacaagaaatgcaagttttcctaaatggtaaggtggaatgtatgtcccctaaccctactgaagtgaccgtcatttcacaaatagtgaatttatatattaagtgatttattaaatttatgctacatacaaaattacgtattaaaatgcatatgtgtcctcaactgaattcttgaggcatagtattgaggaaacagttcaaaatagtaatacaattcggtaaaacttttaattatttctcaaaagaatccacacaacttaaaatctgacacctgctgaatgataaagcttggtcatctgcacaacttcctattcaactttcattttcacaaaccttattttgtcttaagatgatttccacgcactcagcagggtaatcttttagctaaatgatccgaaacccacaatctgaatggcaagaaattgcttcctaaataatgtatcgtattatacaagctatcacatatctcccttccccagaaaagtaaataaacattcttaaagacagcccagaggaaaacagtatggttgcaaaacagttagcttcttatatctttcaagactttactaaatgtcacttataaatgagaaaacatatttgaagtttttaagtgttctatgctttttaaaccctttcctgaatgtatacaggtaggacactcagaggtaaggtaaggggtaaccatgttcctaaattacattaatttctaatgcctgaaaccaaagttttcaaagggctataaatgcttgaataatccattaagatacacaaaatgacaggttgatggtaaaaaaggggaaaaaaaaaaaacaacctttcaacaaatgacaaattttctcctaaatcattctttggttagaggaccaatgtaaaagaggcaggtccgagtgctgttttgtactggaaacaaaacagatgtaacaggtgtaatgaataccagagagagatgagacagaaaatcttgaaattaaacttctgtggtagaaaaaaagagagggaatacaaaaatatatggaaatgcctggttggatgaaaggagagtagatattctaaccaaaccatttaaatccacattattagacaccccaatacccgctttcccagtctgtgactgcacaggtaaagccaaaatatattttctgctttggaatagattttctacttaggattagttacaggcatatcggctgctctgggaattcactttcaaatataatgaggccacactaaaaacttgaaggaagtgaaatagtatccttcatctcatctgtcaccataaagctcaacgtaaagaaagctaaaaggctcactgcagtccctcaagaaaaagttaaaggtttgactctctgctgattaccttgaatagacagccaaattaggctggagcaaataactataaactgactatctaatgtaactaggcattagccattcatcccagagctttaattttatgttttatatattacggttcccctggtgattttccgcatacctcattaagttctgacttgaggatgtctgctctggacgagcacacagagcaacacaacacaaaacatcctaaacctcacatctcttagtatttccaacacaaacatcgcaggtctcctgatgaacacttaacctctacatgttctctaagtacagagtgcctagagtctcagagctgcacagacaccagcagacattctgtgaaaacactgccaagaccctcttgacatctgtggcaaaaacatcctgtcttctaaatatatgttctgtttaagtggcttttaaagcataagcatggtgcctttaaaagcagtttgtaacaagaggtcaaactataaaactgaagaggttagagaagaaatcaattgtatatcaattgtcaaaactcaactttaaaaggcagaggtggtcacaaactactgtacagacagggtaaatggaaaagaaatctccaggttgaaaacggcaaatgctaatcgcaggggtgggagcaaggagtcttgaccaatcgtaaagatgagaaagcatttcccttctggaatgaaaaactaaaactgtagatcagaaattcaggggaaaagaatcatttctgttcatgcctcgagaaattaaatacccttacccctgttagagaactgaagtgtatctcccaaaattaacatgttgaaaccataatctccaacgtgactatatttgaaaacagggttgtgtagttcagtagtttcagtagaaacggtacttcaagtaactacacaaccactctgtttttcactctatttccttaattatttcaggaaataaggctaaatgaggtcataagtgtaaataattaagaataaatgaggtcacaagtatggggccctaatccaataggattggtgtccatataagaaaaggaagagacaccaatgatttctccttctttacatacccagagtaaaagctaagtgaggacacagtgagaaggtggccttctgcaagcctgaaacagtggtcttgccagaaaccaacactaccaaaaccttgatcttggtcttccagcctccagaaccatgagaaaataaatttctattgtttttgctacccaggctatggtattctgttatggcagcctaagcaaactaatacaacccccacaccaattcttaatctctcagttgtcttttcctctcattgctgccacccaatcttttcctggaatctgaaccttaggtatgcaaatagtccccaacttacatggtttgacttaacagtttctaaactttgtaatggtgcaagatcgatacacattcagtagaaacagcacttcaagtaactacaccatcattctatttttcactgtcagtattcagtaaattacatgaaacattcaacacttttattataaaacaggctttgtgttagatggttttgcccaattataggctaatgcaagtgttctaagcagatttaaggcaggctaggcgaaagctatgatgttaagcaggttaagtatgttaaatgtattttctacttatgacatcttcaacttaacttaaagatgggtttatcaggacataagccccatcataagtcagagcaccttcttgtagccactgaaccatgccccctcgcttttgaatcaacactgtcatctatccataactgctaatttaccttcactaaaatgagtgtctaccaatatctacccctcatcctccaattcccatgagaccagggcaagcctttatcatcatatacactgcttcaaatctgtctcctcctccaacatgctcatctttatataatggctagcttcaacttcccaaaaacatctcatgctatcacttgctcaaataccatcaattgtatacatacagaccttcatttaagggcctttttaactttctaatccatccctaatgttttctcccaacttctcaagccaaaaccctgcataaggtcaaaatgacccataaccatcctctgaatctgttgcattattttatttacttccttttttcatatttttcttttattttttagacacaagttcttactctgtcgcccaggatggagtacagcggtgtggtcacagctcacggtggcctccaactcctagaatcatgctatcctcccccgtcggccttccaagtatctgggactacaggcatgcatcaccacacccagttattttttattttttactttttgtagacacagggtcctcactatgttgttgagactggtcttgaactcctggcctcaagcaatccctccccgcaaggcctcccaaagtgctgggattacaggagtgaggcaccactgcctggcctgtttccttgcttttattcctattgttgtgacaatttggaatgtcctctctgcttatttcctttctaaatggcagctggaagaaagaagttctgaagaacattacacaatcacaaggggcttgttatggcaaaaccttctaccctcaactgctgctctgccacatactgattttattcaaataggcttttacctccaccaaatcatgccaggtacttacacaatatctgaaagatggtaccaatttcagctccacataaatagaaaatgggaagatctgacacaaatgaaattcagagttttcagaggctctcatctccccctaagtattatcatcctaagtaaggtctagagaccatgagacacacatatagatttgatctgagctcaatcagttcttctctcaaaccctcaactttttttctaaagctatcacctaaatcccagcaacaaaactaatagagtctctcagattttcccaattttcaacgatcccctcccctatcattcctccaaagaacatcataacaagcctcttcaacactctctttatgagagcctgagcttcgtaacctatactggatccttattgattttcatcatgtgagtgacaaaacacagtaatatactaagatttccaacaacctgaatacctggctcttgatttttacatgcccccaaaatagcctctgtcccactcagtggactttccacctccaaacttttataactattttctccactcatgatcttctccctactggttccaatttacacgcatgctcttcattataagctttgctgatcttctctaataaattttgcttacccctttaaaaacagtcctccaagagctctttcctggtaacttagcatgcactatatcatacagccatttgtaaggccccatcaatgactccacctgtatgtggtcatctttatatagaaacccaaccagaatggagacataaaattctagaagagctttagttctttcatcattgtgatctaaatcaaagggcactgcagtcagcagcacccagagatactccaatgtcactgactagcataccaacagcattcaagctgcttcatgagcttatctttccccttctaacttcagggttggtagggcaaagaaatgacaccaatgacatctacaatcagggcctggaatcaaaagcaaactgatagtgtaacattcagggacttcagtgacactttcctagaacactgagtgcccaaaagggctgggccatcagcttcccctaaagaggggaaaagaaccacccactttctacaacagattgactgttaaacacacgtacagcaggcctcttgcaggagaaaaggcaagctgtcctgccagagttcctaaaagcttctgaggacaacaatttttcttagggagtgaaaatatataccctaatccatactggatagacagcccccatttttcaaattcaaggctgaataagatacattcagttttaaacattcctagaatttgagaattccaaagtatcaaccatttttacatcaaataactacattagtcaaaccagactaattattaaaattacacaaagcttgtacaaatcaatccttaatgtttaggaaaatcatgaaaaaatttgtgtggggaaaccagtctaatcttttcagatccagtacaccaaccacttggcaatgctccctacaatctgggaagatttcctgaccaatggaatacagataaaatatggcagagtatgcattaatccttccatcttctcttgttttaataataagtagagagccaggaccatacaaattaggtatatacagctcctagaaaaataaaatttaactaaagctaaagaagatgaacacttctttaaccaaatttcccaccttattttatcttatgcacacctacaaaacatctgtatacatgccttataatagcttttgatcaactgctatcaaaacaaactaaaggagtaaaataatattactgctcttcagacattaaaaaacacatttctaagcaatattttcaaagtcaacaactttgaaaaattaagtccttatctttatagaccacaggctcattataattaagtgggtagtttgtttatattttatataagattccctaagaacctaagatcctgccagtgtctatttaagaaatggagaaaatgttgggcgtggtggctcatgcctgtaatcccagcactttgggaggctgaggtgggtgggtcacctgaggtcaggagttcgagaacagcgtggccaacatggtaaaatcccatctctactaaaaatacaaaattagcttcgtgtggtggtacatggctgtagtcccagctactcgcgaggctgtgacaggagaatcgcttgaacctgggaggcggaggctgcagtgagccgagatcacgccactgctgtccagcctgagcgagacagagcaagactccatctcaaaaaaataaaaataaaaaataaatggggaaaacaacattgtaagtactggaaaatactacgtccatagtcattgatatataaaatgtctcaaaaaataggactgtcataaaatacagaacctcttacagagaagaaattttaagttgccactattaaaatggaatttaaaatctcaagattccacatatttaagaacgaatattcctttgttcatcacaaagctgagacaaaaacaagacatttaatggcaatgtgtctcctccctgaaagttgattttattgctatttagcatttccaggaaataatttctaagagctaaacaatcatttttaatattgactcctcttcacagcccgctctgcagcaccaccaccttcttacaaaccgggggaaaaatgcataagtggatgtttaaattactttcttgatcaatattgtttcccaccagattttggaatattatgaaaacgaagtgtacccattttggtccttggaccttcaattgtttcttaatttttatgagaaacaaaaatttgaacagtaatatacttctgcaatccaaagaagaattaaaccaaaagacaaatgatgaactttctaggtcctactataaaacactagagttagaagggtgatcattgttaacatacaactctggttcaagccctggttatggggctttcactgggttattacagttcttgttatttacaaatgtggaagcttattacatataaaagctcttacttctaataacctttgggtaacttgcaatctccatttaaaaagcctcttcctcacaattactgtccatttgaagagcgatttgacccatactctgtcctttgagacatcacataaaaggactctcacctactcaaaaatcaatcttttcagtcagatgaaatcttaatgaaagctgagatcatctcgaggaaagcaaaatactgccaaaaggcaaaaacagcttcacactctaacggtaaacccacaaaattgccagattaaaattctgctgcttagtcattatgatccaaagatgcatgacttgcctcactagggcaatggctgtctataagtaagatatctagagtttacaccatccttacggagagccttgacactattattgccaaatctatacgtagagttagttccctgcacaagaagatatttaattatagctctataattttttttcaaaacagagtaatatcccaaatatgtaaaagatatcctgagaacaattgcccttgcccttcgtcctttgtataggttattctactgattcaatatcagtcatggaatatactagagaaaatagattctgacttgcttatctcttcattttaaccccattttcctcattccaaatagtaaggatgcatttgagagatagctaactataaagaatgaggacagggacaatggactgcaaagctggttgatgcagagtccaactcacaagcatgacatggtagccaatttagctaaatggacacaggttgaattaacctgacctttatgcttcaatgtcctaatttgtacaatagctaccatctgcccagctgagtcctgagcagctaacaacaggatttgaagagtttaagattcgagacaaaaatgaaccaaaatccagaatgaatcctactaattctacttaagcccaaaagtgaacctctatcctctgtttaaaagaaaaacacaggcgttttcaaaaaaatacaaccagtaaaggcactacaaaaacagcacggctttctaaatatcattaaactgatcttaaattgtaatgcatgctaagtccctagcacatcacaggaacagtgtaaatataaacacaaactaaatgaagaaatgtgtaagtcatcttcatgttatctggtaaatctcatgtatgatacacttcaataaaatcccaaaggccagctattgggaatttaaaacagaaagggtgcttggtagcaggaggggcatgggtggtagataatgacagaaataattaaaggtagggactgagaggagattttttaaaggacaccaggtgtacgatttaggtttgccataatgatatacttgagtgaataaaaagtatgggatgcgggcgtggtggcttacgcctgtaatcccagtactttgggaggctgaggcaggtggatcatctgaggtctggagtttgagaccaatctgaccaacatggagaaaaccccgcctctgctaaaaatacaaaattaggtgggcgtggtggcgcatgcctgtaatccgagctactcgggtggctgaggcaggagaatctcttgaacctgggaagcggaggttgcggtaagctgaaatcacgccattgcactccagcttgcgcaacaagagtgaaactctgtctcaaaagaaaaaaaaagaaaagaaaagaaaaaaaaagtatgggataagaattcatgggtcatgatcaagagaaaaagttatttggctagttcatgaagtaaacattgcatccggcaaagaagggagaactctgaatgcctgaaagtgtttgaaatctgttctgtaagcaatagggagccactgaaaccttcaggcaggatgacagagccaaagctgtcctttaactgtctcttacaagattctaactcaaatgtgcctaaattctgcaaggttatttatctgaggagacagttcataatattagtgcaaaaaggtcgcaacagcaaaacaggaccctttatttgattaaataatttagttctaacacctgggcagagagaattccagtatagatgttactgtgcactctgaagccagactgcgtgagttctaattccagctctgtcatttactgcatctttgggcctgtaacttaaatcactctacgtgccatttccttacctataaaatggcgggggtggggagataattataccacctacatctcagagttttgtaagaactcaagtgagtgaatccatgtagactgctgagaacagtgcctggcacagagaagcagccttcaaattatgctgacacaaccacttctatgccataccctttgacatctgataaatgttactgtaacatttcatataaagtatcagaatatggattctgcctttgtagggggtgtgtgtgggaagggagacgagggaggagtcagatttttctgttcctatccttcaaaaccacaagctaaaagctatacacctaggtgaacactttccatttccaataggccttgtccatttttcccttctcgatggtttaaaatggttcccaggcacacgtgtaattaaattcattatcttaaaaaactgcttcaggaaatgcagcaatcaaatctgccaccatctgttttttatagatagatataattacaacctaataggcatcatttaatcaagacttaacaattaggttcttaaatccaaaacttgatcattttcttccttgatatgtgtacaaaattttctcccaggtggtggtcatgtaaagtgaaggatggaagaactattaaaacccttatcataatggccttcctaaagtgctaattattacacaattaagacagacataatatgactagaaagcctaagaaaatctaatgcaatctcacagaagctttttaaaatttttttccatctctatctccaaactacctaccaaaaaacccaaaatacaaaggagtacctctcgcctatgacttcttaacaagcgaagtcaggagtagcaccaaaccttcccctggttctaacatcacctagtcagatctttagaggagaaaagcaatcctatctgttaccttgtttcccatcccgcattttaagagataagaaacccaggacctgaaaagtgagtattttcctaaggcactcagggtgaaacctggactagaacctagatgtccctccataaaaaacaagattttgtactcttactccaccccaccacgtgagtggggaaaagcagagttttgagggcctacaatcctcaagtctgatcactgggtctctcacatctaattacaatatccagccccatttccaacttaataagattaattctttgtcactgatgctcaatagtaactcttgctactcccagcagccaacaccctagtttgaaagacatgcaggtcaccagtgcatcttctattgagagcccctaattgccttaccacacccaaggtgcttcctgctagactaagcttctttacagacctaacacaccaaataagagaccacagttgggcaagaaatctattaagaattagaaaaccctgaaagggctctatttaccactgaaaagaaaaatcttaagccctttgtagtttcccattctctttcctttcccaaaagctttaagaggtctcccagcaaacctaaaccaagccctcacttttaaacacagctgtccaaggactctgtgggtgggtgcaggggacagacctaatctttccctatgcaagatttgaagagtattagagaaacaaagcattaaagaaacaaaagccttaaagtccaatatttctcctaaaataacctcattaaggcaagttttctttggtcttccaaagaatcccaattcaaaaatgagaaaagaaagtagctaataatgagggcttcaccataaagcatcacaatcaacctttcattattcccattctgtaggtcagacatcgaaggcttggataggtggagtgactttgaatagggaccccaaattctgaactggaggtgtaacaatcaagtcctaaaacagtagagttcctattcctcttctcagcttattttaacaccaaatgtgtaacccagggtatctgctcatgcaggggcctaagtgcacccttcacaacccgggatggtagtgcccaagagcagctctactaagccagaatgagcaaatggcaccatgcttacatgaggagaaggacctcacaagctgcagaacatgtccagcctagcccccttccctcttattcaaggatgaagtgaaatgcactacagccctatatgcttaagatatcagatggaaattttaagaattctttcaaagaacataggtcattatccccaactttggaaaactacttcagattacttggttttggggagtagagaatcagtatagaatgcttctcaagcaaatgaatctacaaaattagaaaatttgacttacttaaaataacttacagtaaaagtttaaaactaaactttaaatttagtttgggaaaacagatgacgtatgaaattttttattcaaatacgaatttagatctatcttcatctgatacgggtgccttcaagggcaatgagccgctttttaaatctcctcagaggatcctattcacattaaacagaagccacaggaaaactggcattaacatttccttcctgcttgttggaaagcaaggcaccttatttgagggctttccagatcaagaacacattttataccaataaactttacagctgggcccagcagagatctacaaattaaggctaattgtgaactgtacagcaactgtccttcgtcttccatttttatattttatttcaatttggagctacctaacagacacagaagccctccagactatttctcaaaactttctgtttggaagtaggtacacgcacccaggaatactgaagtatgaaataaatattaagagcctagaacaaaatacaaaaacattactggaaataggctcaatatgttttaaaataacatttaaaacttaactgctgctttatttcttttaaactcaaagaaattttctcaggtagaagattttttaaagctacaagggatttcaaaatgaaaaactaatatttcttctcttgaatgttgtgcttgaaaggaaaagttatactgtcattcattcaataaatattaagctctacgtacaggagctattggaatataaagtgtgtctttgccttcaagggctactcagttttcagacaagtaaatttcttgcaagcagaaatcccagagtatcaatgatctcaccaacagaagtgtcctagctaagggactttagttttaaacagaaatcaacatcattaagaatgctagatgtcactgttactgacatttcttgatccagttagggtgtataaaggtcaacatctgacaacagaatgttcacgcattagttatccaaactaaaatgcagaaaatgtctaaatcagcacatttgaaactagaaagaaattaattctattacaatattaaatgtggaatcatacacagaaaaataaatgggcacccttcactaccaacaccccattttgcattttaaagggggaagggactcccacagagttttcttctaacaagcgctgcaaataggaattgacaggtggagccctgattgacaatggtggttttagatgacacctcacctccctcctccttacccacctaatctcacgactaatgcgggaagctgaaataaatacagtggaagattgtttatctgtttcgttttgtttttttaagtgcagatgtgttccacaattgaagaaagaggttaagattctatacacatcctgggtaccatttagtcaatgtctacttgagcaacaaactaggacaatgaaaccaatacaggaagaagaaaatgcatggagcaggtgaactactccgaggtgcatttttagctcatgtgaccttccaacgtgctccaagtatgttgtatgtagatgtgtgggcatgtatttatagaaagggtcaagagcgctataaaaaatacattaataatgttagtgctacaagggacttccaaacgctagcccacagcctcaatttttagacagagaaagcaagccccaagacttggccaaactttctagtgatagaatttgctagtgatagaatctggtcatagcattcaagttttcaactcctgaagacaatcttacctccaaagtactccaattccacagctttattcttaaatttacccctcccctagaaagatgactgcccactcctccctacaatacagattccaagttttaagactcagatgggcctagccctgccttccaagaatccattaggctaatccagtggttctcaaagcatagcctgggaacctaagagtcctctgagacttcctcatacatccgggaagtcaagagaatgccttttcctctcataaatgtacagtagagctttctaaaggttatatgtgacacttgcttctgcattcagtctgttgcaatgagaatacagttgactagatctattaagccagacgttaaagaaatgtaaaatgtaaaactatgccagccttactttttaaaaatatacatattcctcactttaaaaatattttttaatatgtaatgggtttgctatttaaacaggtttttaaactttctcatcttaatttcttatacagtaaatatttatacacataacaaacaaaaggtcctggggtcctcaataatttaagtgtacaaagggatcctctgatcaagaactttgagaattactggtctaattcactgctacataagcatgcctttatggtgaatccctttagcccatatagataaaccttagaacagcttccaactactctccttaccttcaaagggatgttcctccagctctgggactatgtaaactacttctcatgcccagtactaccctgatttataagaaaaaaacgtgaatcatctcaactgcctttaatgtaaaatttttacataaacattgtcggggaaacatgaatataactgtatattctggttctcagaaaagatgctttataaagcataacaagctattacatgtttcatgttgcatacttacactggtttagaaaaatgcttgagtatcttatgagtctctcctacacaatacaaagcatgccagaagcagtttttcactttcatttgggggtttacaccctagtcaggaagccatgcatgctccatcttcctctcaaagccctggtgcgttcctcctcaaggcccctttagccacatcagcccatgtcttttgcttcagttttcctcacactaagccatcctgtaaaattgtcccaaggctggctctctcaaacaaaataagagaaatgttcctgtatggatttcagtgtcctctagaaacccacccatgttccaataatcaaaactttttccttacatgctaggagtacaccacacttaatcctcttctcctggggggttgcgggtggggtggggggacaagtccccctatctgtataaaagagcttcacaagtgctactacatctacctggtttcaggaaccttttcccaatgtttgcagcagacctcaccaaactcccataaactcacgttttcttcctctggactgtcaaccagacttggagaacttgagagtggcatccacatcctagtgtttctgagcacccaacgaccatgcacaacgctcagctcaaggcaggcactgaatgctaacaaacagctcatatgtaggaaaagtgcaaatctattaaaatgctctgaaaagcccaagggggatcagcttttgaagtaattagtaattctattataataatttgtgcaaattaaaaaatatatatttgatgcaaaaagataaccacagaactgtttaaaagatggatttattatttatttatttatttattttttttttgagacggcgtctcgctctgtcgcccaggcaggagtgcaatggcatgatctcggctcacagcaacctccacctcctgggttcaagcaataaaagacagaaatatttaatttcttcaaatctacacctgagaggttaacaatttcatgaacactttgaacactttcaaagaaaatacaaacatgtaatggcacaggtgaggaaaagtaaatacttaatacatagatctttttgaatgctctctgaaccttgctttttacatttcaagatcagcacatactctttatttacagatactatataatagagatatataccctgattaatttaaccaatcccctactgatgaacattccaaggttttgctatttcaaacagtgcttacaatagataccttatacagtaaagcaaaaatgtaaatttaaagatagaaattgctggtttgtagtctatttgcatttttaattacgctagtcactgccaaaaaaaacttctgaaaacttatcagtttgcagtcccaccaaagcataacctacatttttaaaaaggaaataatgcagcagtgtagagagggcactgggggaagtaaaggcaagtcgggaaccagccacaaggtcacagtcaccaaccacaatcattatacctaagactttagacaatacatcttagcatcagttctgaatgtatatgaaatgagactgctgttcaacactatgggtagggcctttccagctctaacattctctgatgtccttgaacttgttatatataagaaatgtacattaaatatgaagacagaatgcttatcctcttggactacccaaggacaacaaataaatgctgggaaagtcagctgcaacactgggaacataaatgctctgacaaacccctgctaggaatttcaaaatggaagtgaaattgagactgaagaaaaagaccacctaataggaaatataaaaagccatttcaaaaatgataaacaaaagaaagacgttaatcatttggggattttcctagtttaaaacaaaccacatctccgtaaaagaaatatggctaaatggctataacaagtaagggccaaagcaccctcatggctactaataaataaaacggtacaaacatccctttcaagtctaccatttgagagagtggatactaacaagagatatgatttgctaagctaaataaaagccttcattaacaagaagtgacaggatcacaaccctgctgctgataaactgccaacatacccaaggtcttcaatgaagggttgcccatttaacatactgcagctttaaaatgagttgctttagaacgaacagttctatgtcaaggcaggcctacaacatacaaaacagatggagctgctactgtaccttgggcttgtgtgtgtacccatgcacgagcatgagcttggcatataccacaggagaacctggcccaataacgcttcttaaagttagccatccatgattagagcatctaccttagacctcaacttctctatctgcttccaaagatactcagtgtagagcagaaaacattcttctgatagccgaagagggttccacatggctattaaatgactggcccagtggtcatccatggagacccctccttattcctggcaaacacagtcatttcagtccaaccttgaagcagccaatatcttttcaatacagcacactttgaagcggtattaacaggtcataaatacatgtaaaaagcatagtttcagcttagtcaaagtggttacagaagcatcattgtatatttttttctgggtggtccaagtaaattaaactcaccaactagactgcaaacagataccataaattcttaattattcacaggtatggatgaaaagaaatagcactttaataaagtcatcttaaaatattattcagtatccagcacttaattaccatcatatagtagtgatatctaaaaaacatagaaatgtttgctatagtttaaatattaacaatttttattaactccaattggttaaatatgtaagttatacaacttcatagcaaccaaaataccaaggccgaatacacaattaaaagaaaaaaacttgcatgtaacatttaccttcagcatatataattttaatcttcattttaaagacataggacctattagattcaagaaatcagactagccaggtgaggtggctcaggtctgtaatcccagcactttggaagtccaaagcagaaggatcccttgagcccaggatttcaagacaagcctgggtaagatggtgagaccccatctctacaaaaaaatttaaaaattagccagttgcagtaaagcatgcctatagacccaactactcaggaggctgatgctggaggatccctaaaagcccaggaattcaaagttacagttaactatgatcatgccactgcagtgagactaaatctcttaaaaaaaaaaatcagtaataagacaataagacccactatattcagaaaacaaagttataagaatcactgacatcaaagagcttccaatgtagttgaaagtaacatttaagttgtgccctgaaaatttaaaccaatataaaaagctattaaggagagaccagacaccaaaggcaatgggaagttgttaccccaagtgcccattccgtaacagctccttaactctcatacctgctgtccctgtaatgccagaagtaaaattaaaattctcctctcctgaactaaaacttggtttacttctctccaaattccatcaagagtagaggttactgtctatattttcagtagcttccttctgcacctaaggaaaaggggctgaaatctaaaagctgtgatgaaataatatccacctacaaaaaaatgctatatccatgttaaatcaaacaattataaatggtataagctaaaaggcatgcaaagtttttattatcttcctaaagaccagcttatattaaaaataaaactgtttgccagagtccacctctctgaggaaactaagagcctagtcaagtaagcttaataatctaataaggtggtcagaaagacactattttaaaatatcatatccttgccatgcattcactgtactgtttaggtctggtgatctgtgtgaatgaggaaactagccagatggaaaattcacttcctcattttccttaaccttttttccgtgtcttttccaattgcttagagtaatttcccatattctacccatctcttacgaacatacctagccctttaggattaaggaactccacagaagccactgacatttttttaaaaagtatttttcgacactcttaaacaacaaatgtcttccaaagtttctacaaaaaaaaaactgcctaagtctcttccactccaacaaatattttaaaaacaattccaattaatatggtatttccttttagttataatttaaatgaatactggaaggaacacaatatggtaaagcaatggggtgatctgtcaaagggattatctaaaaggtcattcataaacaaaccaaataatccaatcaatgacaaaacacaactgtggatgaattagtgaaattctaatttccgccaagcaaaaagcctaacaaatattcctaagttcttactgcatcaattaatacattagaaagtgttatttaaacaaatactgataatatttcaaaatccaacacattttcaaagccatgggtaaagagaataaaggatttagacaatgcagatctcactgctgggctttgcattcaccacatagctttcagagtaaaagttgccaaattacgttgtcctgcaaagaacattaaaatcggtttctcgtaaaaaatataaaaagccagatccatggtgggatagaagctgggtggcaggaatcagctctaggactcaaagttcaccatcaatttatcaaggagaatagagtttaattttaggacctctgtctatccttatgcctataaaattaaaaactagtctgtttttatgtacagtaaaaataaggtagctaggaaggaaatcaacaaatgatcttcactaatcacctcccacactgtgttataagccttaaaggttattttccttcacagcacaaatcacaattatatgtaataatttgtagaactttaacataatatctcctccaataaactctaagtttcatatcagcagggagtatactgtattcactactatagtcttaatacctaaggtagtatatgtggcatatagcaagatcacaaatatttactaaacaaatgaaaatctgcacaggaaaccaagaaatgttcacatgtaaactggcaaaataattgcttttaaagtactggggggcagaaaaggctggatcagcaaatcaaaaactgaatagaaggacaatcaaaaagagcaaaatgccattcatgtcaggaggccagacacaataaaataataaaatgttaaatgctaggaaaagagagataagtttaaagttttaaagtggctactaataaaaactttagatgtaaacatttcaaatattcataggctatttaataaactgtcatcaaattgccacatttctttgagacgataacagagaataatcacagggaatgagagagagaaagaaatgttagccataatgaaaaattccttatgggtaaagttccagaaaattccttaaggagtctgaactataacacccaaaacttaacaaagtccctggatctcttaatgcttctgaattccatagggaactggggagctacaaagcattttacccaacaaaatctctggtagtcttcgccaaatttaaggaaacacaacaaaaattaaagagaaatgatacgtattaaggtcaaagtttaaggttactatgtcctataaaatgtgatgatgagtaaaatgctattgagctttcaccctcaacaattaacttctgcttcatcctgtgatattctaaattacagctaaccagtacggagcagccttgtcaggatcccacctgactgctttgtgcatagcctgttggccaattttataccagaggcacctgcttgaaatatgtagagacaatctgatgaccttattttctcacgtttacaccagctttccatagcacaaggacaatatttatactctaggaagagtaaaatatttgcagagataagaaatcagagaacatgttggcatgaagctatttcagcttctcaattctaagacatttggactgaaagatgcacccactaacctcacagctttgggggacatagaatcaggacattaagtaaacttaagagactcaaaagtaatataaaaattgcatatctaagacatgagaaaacatgggattagttaaggcagtttttgcaaaaatttccctgtagagattgaaattctagtaagattacctatcattcatgatttacttacatatgcaaataattttcaattgattatcagtctcatgtactatattctttctttaaattattatctctattccagacttttgagttctgctgttccagtgacctccacaaattttcctgaatttctcctaaaaacacactatgtgagagatcaagtaatgaaaaagagcacatggcctctttctagggaagagcaaaaaggtcattttgaatctgtaattctttgtcatccactcccaaccaatttttctgacagtaaagttggagaaacagtaaagttggagaaatactgaaaacttactggagaaaggtgaatcaagaacaatctttactgggtgaatattttgtttattccaatttggatatcaaacatcctattgaacacttgacctgccatttttttctcagaacaaaaagtagtatttctaaaatcctgcctgattgggaacacattttttttcataaacttaacaagttcaaaaaacagcccttacagattatctactacaatgagccagggttatctcaatgtcactttcacctttttcttgattttaacagcatcctaaaaaaagcctgaagacagtgtcttcatttccttgcttacagaaaataaccaatccatactttgtatggttccaaaaagtaatcctgcaagtcaaggatgccagctggcatcagaaagtcaccagcctgtgatggaaatgcctccagaagtcacccagtcatggacctaaaataatccaaggtcagaatcctggccctgaggaacaagttgtgggcatactgctaggagtgctacagggaccacagtgaagctttaaaaaaaattataaaaataaaaaataatcctggtacaacaaccccaccactggggaaccaaacagcctctaaagcaatttaatatggaggtgagatacaattgctgctggagtcacaccattttatttcaaaacacccctaagagaagcaatacattctcaaacatgaaaactgagttgcttcttggatctgatttcagccaccttaaactacagccagcagaactaccaaaagtagaaagaacatcattctgggatccatggaaagaggtacagaactaggagtctgacctgatcctacttccccacttggttgtatccttgggcaaaccacctgacctctgagcttcattttcctcacctataaaacatcattcccagggagctgtggcaagtttctataaggacagaaaaacttggtgttaatcaccattactagaggaaatgctccgtgtctcctggttccatcaccttgtggtagttcaccatcttcaattgccaactccacgtatttttctatcttcctaatggtaagtcaacaactaaaaagtggcagatccctgctgccccatcccaatccactgctaacttgactgtccaacacaaaatttcttactgttgcattctcaagggagagtcatttggaagttaccatagaagttgtacaaaaggaaaaccaaaacagatgtcttcactcttcctgtctaggtcacaaactattattcactctaaaaccaaagatttcaccctaccatccacaaaacaatgtttataagtcagccaaactgtttgggaaaaaattttttcaaaaagtccaagaaacaagaacacaaattattccccgaacagccagttccaactgaaggaatgagcctctccactaaatcaaaaaggtaacgcagcgtacaagctgttcgatcacctttcaaggaaaaaaaaaaaaacccacgaaacagtaatgcaaatgccattaagggagaaaagcagtggccaggcctcagaacaccaagcactggcatgagaaagccatagtcagcagcccagacaacacatgctcctggaagacatggccttagccatgaagatgacgcaaggagaaggcatagatcaatgctctgaaaagcaccccagcttctgtcctgttacttgcttcttgctcctgcaactatattcccaaaagggaggaagtcaaaaaagttgtaattattttgactttttcctaggtgttttgaaaaataaatgttatacccagaggaggctgctggcacataatgttgtcaacagaataaaactctgggggaaacacccagcttcatgtagtttgaaacacaacgtgcctcagatctactcttctgggacaacagtggaattaagacagtcacagcttgtctctctctagccacaccctcaaacttgagtaggttttgcagaaatacttttcacctgtgactgagctcctggcaaactaggaaatagttactcataccataaaagaaaatcaaaggtaacaaaaacaatatgggaggaacgggggagggaaataagacataaaaagcaaaaaatagacaaaatggaccaagaaaagacacagtcctgtccctaaagcaataagcaacaacctggcctgatcccttgattcccagacaacagggatatatctctttgcttaattcctcaagcactcagtttctactattaaatgcaagagtggggagtgtgtgatttttttttaagttatcattttctgcctcatctccttaggtagagaccaaggaatatgaggtaaagggcactttatacaagtctcaacgttctcagtatccagcactcagtaatttgtgatgaaacaataagtattacacaatcttcctggcttctgaacataatctcaacacaaaacctagaagaatatttttattgatccttcaacaaactcaaaaacaaaattagattaatttggaaaagccctaagcttcaagttaactagcagcccacatatatcaaagtcattcttattgcacagtagaagctccacgggaatgactcccaatctttagggggataaaacatgcttgtttttactgatattcaattccccaccccaacccagtaactaagccaccctgaggtgccgcaatgagatgctgcagggagcatcaaaaacaagcaacacgttcacctaaaagaatcatataatcatagaatagaagatgcttggtaccaagaatttttaagtgcctctgaaaaataagttccaaatgtacctacaatgattttttaaaatcatacacagttaattcaaaattaagtttttaagtgagcatacacttatactaacactccaaatatcaaaaaaaaaaaaaaaattggctgggttgtagagtaagccaatgcttaaaactgccaacattaagctattattctgaagggttttgctaagatgttcaatacaggggcacattctgattcatcgttataactggcctagctgaagtggctgccaggagagcagggttttatgggcattgttccatcctaagaagctacattaatgctgggttgatacaacagatcttcatatctatttaccaggctgaacaaaagttaactagaaatgtaagtgcttaaagtcaccaaaaggaaggctccacactgacattttctacctacttagcattcaactatattcatctcactagacattaacacacaccaaagttgctctctgctattcaaattgtgctattatgctcaggagtagattaatattatccaccttccttattgtaaaataaaattacagcattggtccaaacatgacatgtggagcctctttctacttctgctggtgcatcagtctgctctacggcacacataggagagggccttgctaaggctgccctgctgcttctggagtgggggagaaaaggctgaagactgaaaaaaataaaggggaaagggagagaaataacacacacacataaaccacacacctggaagtctcatatcggctttttttttttttttttacaacaatcttataaatctgttgtcatttataagctcacaacatcagcaatgaggttagcaggtgggccacaggcctcttttaaacagctcataacatcctatcagtttttacagcatcaagtagcaatgttgaccccaaagcatctgaataaatagaagcaggcaactggcagggagaaatccctactcccaatggggacagttctaaaatcccagggggggaggagagaaaaggtaagttaagctgagagaagctcattttataaaaggagaaactgtttttcaaccacgggttaaggaaggagagacccaagacaaatcttctctgaagtaaaggagactataagatctaaatatgtaaggagcagtttaacatgattcaaacattatctgtaaatacaagagatcaaacgaatataaaacctttagaactactgcctttgtctttacacttaactttttaattcacgtggctttaggaagtatagcattagagacaccaaggccaggcaaacaaaccaaggtcaaagtgaaacaagccatgcttcatccttaaggcgcagtcgataaatgtggactccattgttgttgctccatccttccaagttttcaagaagcaatacatttggctccagatctttatatattaccaaaccgtaaatcaacaactcacaactatttaaaacacagttcagggcaatcaaaacacctataggccatatgaagctcacggatcacccttcaggacctgtggcacaaataatttgtccactgataccaactgctccttctggtatcagtgattcacttggtcacagaagatattcttcagtaagtaaaatgtaacaaagtgcataagagccaatgcaaaagcccaagcaggataagaaaataaagggacaagtgagcaggttgcacctgaccccaaattaccaggacctggaactaagcacaaggctaaaaggataaacaagggacagagggcaagtacagacgcatcccaaagaggggaggaaggctgtgggtagttcaaattccttgcggagactatggagaagggaagagatgaaagtcaaaagcactgatgacctcgtatttgggaaaagtccatgggtcattcagaggcacaggacagaaaagaccccaagggtttttaaacaaaataagccagcaatcagtaaatagcacctggggagatcaaaagtggtgttgaataaactcaaatagaaataggccttacctgggaacaggttataaaatcttgctccctctataataaatgttgtatatttaacacattctggatacctctgcaataaaggtggatgaccccctcacctgccatatcacctccaataaagcaatatcagtataacaagaaattcttacttttgaaaagcagctcagagaaaacaagatcaagtgctccagaaatattttcccatccttacccaattcactgaatttattttcagatacactgtgatttgctttattctgatatacacaaatgatgcctaaagaataaaaaaagtgctaaacatcctttaaaagctgaacaagtgagcaatttccaataacttacttgacagggcatccatcaatgatgttcacaccatcagcaatgaggggaaaaaaatgtatttctatgtaaactccattttgtgatgtataggaatggatccttgataagaggttaaataaaattcaaatcagagaaaacgcggactattttaatataaatggttaaatttaaaattttgatttttcactgaaaaaaatatgagaaatttaaattaagaaatttatattcctggaatgttagctggctaaattctcagtctcatatgtaatcttttagcattatttatattttcaaggaaaatgcattttaaactttccaagtcccatcatcataggtataaatatgtctatttccatactgaaatgtccaaagtcacaattctcccaaatcctccctgcagtctgggatttttcttttacttcatggcagaaataaacatatgatggtgtattataaaaaaacaaaatcactaaaaatggttcataacacattgaaagccaaaaatataaaactaatcaagcagtaaccacctactaccacctttccaattcagtcaatgtcatttcattgtcaaaaaatcttgtacttcaatatgctcatctttacgtggtccttgagatggggagggtaagattttatacacaatcaaaggttaagaaaccaaggatataagtaattaaaccaaaccagatgctgaaaacttcagacttctagcctactattttccacctggctgtgctaaattaagaatttcaacctaagtgacaaaacctactgagacaactcagcaaattggccgcacgggcacggtgatcacaagaccttatgtgtgtgattatttgtttacaaaaacagaatggattttaaaacaaactatgagacaggaaagcttagagtcagtcatccttcaaagaatgctaaaggcccacatcactaactcaacagcagacaagaacctctgaatgacttcacccagttctcactagtataagaagacaactctaattgccaaagtcctatttcccaaatggaacctcattttaacacgctttcttccaaagtgcaaaatactaaaaactgtatggaaatttcttatttgtatatatttctctaggaagagacagctacagctttcttcaaatgcttaaagagattctagcccctcaatattaacaagaacttccaattttacaatgactctaaagaaatgcaggaaagctaagaatctcaaaacaactatcattccctagtcccataaagagatgaaattagtcaagaaagtgtgtactaaaagctttcagtaaaaaaaaaaaaaaaaaaaaaaaaaaaaaggggataaaaatccatcttgaaggaatagtttattgctttgatatttataaaagatttttgtgatatcctattaacatagtctttaaagttgctgaaataatctccaataatgaacaacccacaaaaacaaaatgctggaagaaaagaacatttagaatataaatttccctttcatgataaactttttaagtcaaaggaaaaacccaaggattaaatctatcactacagatggtccccaatttatgatggttcaaacttacgatttttcaactgtatggtgatataaaagtaacacacgtttaggagaaactatattttgaattttgatcctttcccgggctagcagtctatggtaagagactctctcgatatagggcaatggtagcaagccacagctcccactcaggcaatggatcatgagagtgaaaaatggatactctgtgttgccagatgattttgcccaactataacataaatgttctgagcatgtttaaggtaggctagactaagctctgatattcagtaggttaggcgtattaaatacatttttaacttaatgccattttcaacttgcaatgggtttatcaggagcatctgtattagattggccaacggaaaaatatacaggtacatcaaactgtagataacatacctggttcaaaatataccagtgctaaagcaaaaccttcactgtgtcttaaaaaaaaaaacctatcattttactgttactgtcttacagtaagtataattttaaatttgtcaagttttttaaaatacatttttaaaagtgggaaaggggattttgcatgtcagaccttatctcctattcattttcagtcagaaactgatgtaatagatatcagtaatataaatatatactaagaaactgcaagtttatttaaaaaaaagacactgtaaggcattctataaactggtttagttttatccccattccacctattcttatgactttctgggttattttacctattttactcctcaaagcccccatccttctcttcataaagatttcttacaacgaaaacctgtatctgttgtcacacagaactattcagcaatattcaaaaaggtaccatgtcattaagcatatcaattcagttcacgcattgagagcctaactcaaagctctgagaaaagaatgctcgttgcaaaaatagttatttttattaagaccaatctctagaaacttaacattgatattaaagatgaagatgtctatgagaatgcatttagcacagcgttgctcacacaagagttaccttttgttttgttttgcacaatggaatacaagcttagagataaaaaaaattcttcccttgaaataaaaaattcttctagccttactaaaatgaaacatatgatacacatcacacaagctgaaagccaaatctgttaaatttactagtgaaaaatgtcctaagtaccccacaaaaatctaagattttattacgcaaactttgacttttaattcagactccaaaagttatcatttaaatcataataaaacacttatcttttaatatgtaaaagccttaaaataagcactgcctttcaagcttaagtgtcttctgtttccacttggcaaatttacgttatgtgaaatccttaaataattaactagcactataaaccgtctagtatctcgaaccaaataaatatacaataaatgttcttcccaaattagaacatacaaaagtgtggatttggcactgaactacaatatgtgggctctgtgcgtaaccagaaccggtgaagacttctacacctgtaaaatgaaaatggccaaagcaagaaaaaattttatgcattttatgtcctccatagtgaatttgatagtcaggtgtggcatcactagacataaagccttcaaacagttctataatatatcaacaaagcagcaatactgacagctaaatactaacaagtgggaaggcaactaaccaggaaaagctacgtaatctgtgggtcccagtgcaagatgaaaatgcagggtaaccttgtccaaaaattcttaagaatttcaagattgggtaggatgtgcaaccataccggttacaagctggaaaagcagtcctgcccataactaagtactcacgccaaaaataaaattaacctccccccacacacactcaaatgtggtagcttactatcatttttgacctgtccagctgagtagccaagaaacaaagagctgggggtagactgagatgggcaggttttccacagggtggcacaccatctagcccccttaaaatgtcaacaaaaaagtaaccaaaccaagctaagtaccacagattctagcctctctcaattccaaataaacattatgagtgataaaagtggcaataagaatgtgacgatgtgatagatttaataagacatcaaatgggagcgaaaatactgatgctaccatgcagacaagtcatcaaaaaggggaatggtaaagtcagtcttgataagaagcttaagaagctatttcagagtatctagtcctttggggaaaaagaacatgaaggctaatttgccactgtggtgctcttgtgcaatgccaataatgcctgaaaagcgtcacaggttttttaaaaaaatgtctttcagcaaagaaagaggaaaaggttgatcccagcttaaaagtcaggatattctggaaggctttgctgtgtccttaaagagaacctaagacttgcttctagaatagaagtggggtggcaggaggggaggcacattatttttaaaagataagcagggaaggctggaagagccaagagcggttggttacaaggattcagctagcagcatctgtctgtgtataaataatcaaaaggttgattcaaggaatgatggtatatgacactcacagcatcattctcccttaacctaccaggagctgagtcttaactaaaaccactgaaactgggacagaaaggctttgtttttctcttgtgaagaggcggtaaccagaacaaatcaaccaaaaaaactaaatcagagaggatctataaaaacacatcttaggcctagaaaagaaaaaaggttccatagtaaccttttgacactgagtgtcaaaagagtggtagacactgaccagcagtgggtacttgctctaaacaagaagcatatcctataactaaaattatcttgaaccacagggaaagtgtgtgagcactgaatatagctgacttgattgttcctgaaagaagacactacacaatgaaggaaacacctacagataaggaagagggaggggcttaacacctaaagttgtctttcaaaggaagaaaaaaacaactaactccctgaaaggtggcagcacaaagttacccaaataacaggcaacaaggggctggttttaaccacacaaaaataaaaatactctctcaaaaaggaaaattacaaaggaggaatcacagaaaatttaatgtaacatgtttcttcatattctaatttttcctaccccattctggcctttatcttccagatgttttcttcctcttctttctctccccatagtttgcaagcgaacttcccgtaagtatatcctccccacaaccttaagtgttgttaccttagcatccctacaaacctcctataaagaaggcccctaccacaaatgcagtaacattcgggtccactcagcaatacagtcaccatttatatatacccaaaggttactaagacaaggtagatgcaggacagcttttccacccgctcaccaaaatggaaactccaggtcagcttccacaagaaatgggaaattcaagcgactctggcgaaacgattcttgagaaaactcttcaagggcaacaaaacaatatttcaaacaaacagattttacttgagggaatggggacattacacagcaattgatattcgaatggttttaaatggactgattcgccgtaagttttgaggctgagctaaatttttatgaagaattattaggaatagggccactagaaaattaagttttaaaagcgcttttgtccttgccgaaggtattacattttggcacttctaagaaccgttctttgagggagggaataaaggagagtggacaactcgtagcaaatccttttcccatgttttcagaaaatgtagagacgataggacttgaaaatctttgtcataaagatggtctttaaaaatgcacacaattctaaatgaccatctgggcagctacaactgcatgctcatagctcgcatctagaggcatggttttacgctctggccctgaaggataacaaggaggcttttaaggaaatgccgtgagaaagactgctggctaagcattgtcacggccactggaggagcacctgccagtgaaccgacgctggctcccccagtctcaccagtgcacgcacactagtccgtgcaccccggccgccgctggcaggccctaccagccaagctggaggagcagctgccgcaaccacggcaagcgaactgaaatcccagagccggcctcgcccggcagagcgcccgcgcttcccgcgcagcgcacgcctcgcgcgcaaacccgagatgtgaccgcgagctgcgacctcgcgcggctgcgacgggcctcacctaacgcgcacgaggggatcatcattgctcctgccctgggcgcccgcggccctacaccacctccgcacacaacgcggccggtgttaagtctccaaacgccccgagagctccaaggaccgcgcgcgcgaaggcgccgtagcaagtgggcacacaccagacaccaccccggcgtgttccgcgggagaagccagtgcacacatcctcccgcaaggcggggttgccagtgcaacacaggaatcctgccctttttctagaaaagccccctcccccactttccctccaatacactcacctgcgtctcaacagtttccttcttgcgctacacgcggccgcacccgggcacgtccacgcccgtgcacgctgccaggcgcgactgtccccgctcggctcccgccgcccccaacctgcttgtgcccacgggaggggcggtgccacctcccgaggcgcccaattctctctactcccgccgcaacgggctgagctctaggaacttcgcgggcacaacctccgccgcccccaccagtgttcccgcccagagttcggactagggcgcaccacccctaccctgctagacgcagcgggggcgcgcacagaccttagcctcggcgtccaaaatggaccaggggcaaggcgcggacgccgtccccgcccccacgcccccagcacttgcctgctgtgactcgaagctgcagctactacggctcgtgccgctggccgtcagcactgccgcggaggagtcgctcggggcgagctccgcggagaggcggtggcggcggcggcggcgggaaaggggactggaagccggcggaacccccgccccacccgcgccgcgccgcgccgcgccggcaaccgccctcctcacccggccggctactgcctcagtgacgcccaggcgccgcggtcccgccgtttgtagcggggcgggaaggaggggcttgcttggaagagcgccaggaggcggggccggcggcgagttcgcggcgccgcggccgccgccggcgcgtgccctgcccgaccgcccttcgggtccgtgccggcagggagatgccgggcttcagcagctcagctccgtccctccggacttccgagtctcaccaggcttccccgacaaggtttctctggactcggtggagagcgttgagcgcccagaggaggctgattccaggtgcaagtttgcaaatcccgaggcccggggcgctaacggggagtcagagcagctaacgtgggggttactttatgtgttcataaatgtatttataaatatatataagtatacacacatatgtgtgtctcttttaaaaattctctttttccccctacttcgcagccaaggggtcctgtccctggacagaaaataaaggcttagccccctgctgcccctccctgcctctctagagagaacctgacgtttaaataagcccagagtacctgtgcggggtgctgtactctgcttcaaacgcaaagtaggaaatcctgcactcgactatgcaaacgcttgccgctagccgcatccttctatcgccccccaactcaagacccgaaatggccaactcttcaccgagggggcgtcccatcgctgccttgccttggcccgccccttcgccaagctcaatcccttttccccagaaaaacctgtgcctgtcctcagacccggccccacggctggaagtcaaaacccaccccggagccacgcggctggagcacgtttttacacctgctcggccgcttaattacgagagcacctgtagttgggatttttttcattgcaaaggcatcgattttagcccttctcctaaaatactacatttaaaaaatcacctgtcatacctacctgaaattgtaggaggtaagagaaaggaaccgagcagtgggcgacccagtcgccgcaagaacgtgaccgaggttacagcttcaagggcatgatgcaggtttgatgcagcaaggtccgctaagggcgtccagcgctccccgcccccatgcgacgggcggagcggggttggggggaagggaggggactcgtctaacccagggcgggtgtgggagaggcaaatttgccctcttgggcgaagtctaatcagcatagtgaagtagggggctcaaccaaggtcaaaagcgagataggccatcccttaatttgtgcgacccagtctggggacaccggatacagctaactgattctatatcagcatttccgtgtcaccccaaatccgatttgcaattaaatgaccttaattgactttgtgtgggttcctgggaaaactgctcaaagcgcctgcgcctctttgacctctcagtaaatagttaattataatattctcatcccaggcacgcgggattgctaaaaatgcctatttccaaaacgttaggcgaaaatgggcctacttaatttgtcaatccaaacctaaaactcttagaatgccctacgccctacttcctgacgctgactaaattatgggagagctctcagaagagttccccaagtcttccaaaccacttcttcctacaaccgtagcgttttttgtgaagagctccagaacaggttagctttatgaagcggggtgcccaagcacttggttaaaagagggaacggggaagaagtgcctgctgtaagacacattcaggcaatgacagcaataagtaagggcgagagttaaaaaataaaatgttaaccccataacaacttcgaaactctcaacatatttttttgcgggcttatctgttcatagtctgacaaatctttcagatgtcccatttaagaagccattttacaaggaagtcttaaggcccaaacacatttcctacccttctgttccccaaaacacgaacaccctttttctgacctttagaaactgattttcaatttggaaaataatttctttagttactattgtctgctgtgtactttctaaaaattttcattgtaagtctacgttttataggttgcagttaatagtgtaggcctgggaaataaaacattaatctccctcccacccccagaggatgggtataataaataggggtgcggagaacggctgaaggtttagaatcttaaccaactggagtgtttgtacatgagagggggaagggacagaatccgtgcatttcggggagaaagtacagagacctccatccctgtccagcagtgttaacagtaaatactaaatggttggctatttctctcaccctcgccataataaaaccagacctgcagccggtaattacgagaaaatacccagtctcgccatcagttttgctaaccggtacttgaaaatgggaaacggggaacttatccaacctccaatttgtcacagttgtatagctttcgtattaattctgtacagacgtgaaataggtgggtacgtagcaacgtgctgggcataaattaagcaacaatggccacgcgaggtctcgtccgccgcggagctccagtggtgggcactgccaccttgccatccctagcccccaccgcccttcgcagagtccagtccgggaggctgacggtgcgctggctttcccagccggtagagtgggtggggtgaggagcaacgagacgttaaccccagccggctttgtagctttttcccatcctctgcctctcgagcaccacatgagcgctctcacgcacacactcacccacaccccctcgtgccaataatttaaacttctcttaggaaagccagcagcttgttccaccaccaccaccccttccgccctccccggcccacgaacatcctccccctttcccacatctaccctggatcctctctttggcagtagaaagccaaatgatttctcctaaaccctgagaaatcacaaaagttaaaatgaagcgtgtgcctatctgcccagcttgtcatccccaaccatctttctcctggcgtcaatttaacaatagctattcgaggaagtgggggcggtaaggagggggtgagggctacgtggccgagttggctcctggggtggctgcgaagcctcgcggctgcagaggggttccccctctccccgaaggcgaagtcagccgcgtaggaccaaggacagggcttggaatccacttcccagcgcccagcacagcgaggctcccaagcagccggcacttcatagacacagctccaaggatcttatttacgcttttctgaacaaagggaatctcatatccggtacaggcttaagaattcagccccaaattggctatcttcttttaaaactgaattatgataattggagtccgtgaatcagagcccgcatacaatgatgagttctgacagcttctaacaaccctagcctcagcccagccccagccccagccctcaggcggcatgtacttttttcagtcaactacaactcgctgcctggtgcagcatctaaattccatctggcaatcccatctccccagcacatgctatctggttaatgcaattaagcctgtggttttcgctggtctaatctgccagtccaggcttctgattccccttaatgattgtaaagcctctcccgtccttccgttgctgagccaaagtagaggcatgcatccccaacacccaagttatcactctctccccacgaaatgaacttccgatctcaatcttgaagctcactccacatctaacctcccattgtacccctactcccccctggccacatttaccacttaagtttctgccatggacatttacgaatattcagtacgctaagcatgcgtccaccgtcttttagtctagctctttaaaattaaaaaagcagaacagtagctttgaaatgagacaaacatgtgcaattaacttcatattctgtattccgctcacttacaggttttctgggtttgccagcgcatcgctgcaactaatgattaaagaaaccaaaccgaaacttacctttctcccttaaggtttttgtgtatgtgtgtttttaaagtaacggtgcagttctcccaataaggatgagcaagaagctgctggatagttctcttaagacagcacgaaacctaaactgtgctcggcttaaaagaagcaaataaaaagaaacgctttcgaccccaaagtccaatgctaaaagaaatggcgaaaaaaaatatgaaaggggaggggaaacttaaaaaagagtttaaaaagacggagagactaccctcctattgccgttcaactaaacaaaaaggggcaagaaaaacaaaccaaggaacaaagaaaagagacgaaagaacgttttttcaaaaagacgatgtctttctccttgttgctttttagtaggtcgctacaggagtaagctgctgcatctctaactaagaacagaaataggggggaggacgtcttaaaagggaggtggactggaccacagatttatagcaccgtatcaccaaccccttctctgcctccgcactgccgtgtgtgcagctgctctgccaggctcctatcccgggcagcacgcgcggaagtatacgccgaatcgcgccacaacgtaacttgctcatcgccccaggatcctgattggtccacacgcttccattgaggccgcccaggcggggccgcgtgagacgattggctatgggcttgtgtcactctcgagagctcaatggagtcccgtttcaaggtaagttgtgcggggaggtacactcttaacactggcggcgaagggaaatgcaagaagcaaaaagaaatgtggagagagcaacgtgggagggttggaactgtactatcagagtttgcgatatggcacgatctcctttcctcttaaatctttctgcttcagaaagattcatttcctttgccatcactgctgcatctgtggcatatttctttataacatttaactctgtccggtatgtatgagtcattgagagctccctctctttgatctgagtgaaagggatgaatgtacatccattatttgcccgcatgccttttttcgatttgtgttcagtactgtattttgtattagatgttaggtaattgtatgtctttattttaatatacgcatatttcagatttatgtgtccccatgaacccctttttaaagcatccttttaagataaagatgaagtcagaaatgctctcaaataaagctgcacggtttgaattggctttcacttcatgttagaatagaaaagtgtaggataaatatcctatccagaaaaagaggtattgagtagagctaaggtccttcacttcgaggtgtctaatgattctcaaaaagagcagctgtatataaaactggaacaagccactcctctgcatttgcagacaggtacagtccttggaccacacatgtattgctgacagcaaagatagttgaacctttatcagggctctttctgtgaggatttaagaagtttaaccagaagaccaagtgctatcaatgcttctgcttcatagaggaagactactttattacaaccccatattttaacagcattcaggagaccaaaatacagttttatgcatgataattgtttcttcctctaagtgaaagtgaggtcctcaggatcgtctggatgtataagtagacacaatattcatttgacctacgttcttttccagccagcatttctcttttcaatcttgaaagatagcaccaacttcctagacagtttttaccattcttaccagaatgtgtaaatgtaatgtacacattacattacacatgtaatgtgtcttaaccagaggcacatgcctttttgaaagggattcctttacatatttacaactagtcgctatctttgagaatgccggaaaaagaagacacaggtaagagttagagattgcaaaagggtagggtgtcatggaggggaatgggacagaagatcccaaagcaaaatgactttgaagtgaggaatacagtaaatcagtgttctttgagagtgtccttgagtgttgataaatgattaatggtgaaaaacagacctgtttatctcccgtgtagcctgtataacaatatacgagttctgttactttgcatgacaatacctggggcttgagaaagaaggcctgaatctatgttatcttataattagtgtttataaaatcatgccttaacctccacccccagtttttgtataacaacctctggagtcttaatttcaacttaaaactattctctagacctgggtgaaactcacagcaagaagaaagaaaagcactttgaagaaatggagtcaagggggaaaaggaagactccaccccatctagactagatgtatgaataacagaagattgggtttgtagtcatcttccttcaacccctccccttgtccccagctccatacagagaaataacctttaaatgaatacaatttggggaaagtataatactgtttgatttcatcagacttacctaggcagtgaattgtctttcctcctttttaccatgctcgtaggttaatattgaattagttgcatatgcccatataatttcagtacattgaagtaaatctttaccattataattatataagtgccttctaactaggtggaaactaatactttttttggtgcatgtttatatccacaaaaaaagacttgtagataactgtgatatctgtagataacccaaaatgatagggacaggtgtgaaaagctgggagtgatatggagtaataaaaatctagcatgtgtattatgtaaagaaattacatggaaaatagtaaacttgttcattcaaatgaaaaatgctaaattctgtagattcagtatttatggttttttttcagcttgggcatagtgacaaaatattattcaaagtattgtcatccctaacatgttgtctttttatgtaggtgagatggacttaaattatttaaaaagtgaaagtatcttaaaatattattttacttcctcattaaaacagatgtttttacattttaaaacttttaaatggatagatgtattataagcaacatgtactttttcaacttttaaaaataaaaaatattgattacagcctctttaaaacaagtgatatctggatgtagatttcactttgaaattcatgtctcatagcttgaaacattaacaaatacatactatcctatgattaattaatgaagcctatgtgcaaacatctcacttaagaataagcaaaaaatgcaatcaaccccttttcactcatagtttggtaaaagaattatccacaacatctgaatttgcattagaaagtatttaaaagacatttgaatatgattaagttatatgaactctgacatatcttccaagttcctggcattattttgaattgcagcagaaaagggagagatgaagggaatgactgcgaacttggagcaaaagtgtgaggtggataaagttgcaaaagaatagttctcaaaaccgaaaaagtcatgaatttaattattttactgaagtttctatataagagaacatttattcataagaatatgcaaagctgttgtggaaaatgtcttttaggataaataactcccttacactagaggtcctgggagcaagggaaggagtgattttacattttgtaataaaagttactgtaaactacttgtaacgttttgtaagtaaataaagaagttaaactattaaaattagtttacaatgtttggcttaaggcagtaatttccaacagtaaaccttcttagatgaataaaaatgttatgtgttagtatggtggagtagggggttatggttcatactattggaaatatgatagtttaatgtctgcatgagaaatacagatatcatatatcttgctgattactcttttatttattcttcctaaagtagtatgtggacttgcctttcaccgaaaggggggaaaagttgtgaaaattgacaccagtgtgaatttataccgtggcaaccacgcaagagaaagaggcaggaattagcaccatggacagagacgagcagccctcaaattaagatttgcaaagcttgagacggtgttttctgtccctttctgtgagacacggaaactgcgtgtcttgggaatgttttattccacgggactttgcggaaaagactgtcctactccacagaaactcatttattttgaattaggctggcatttcttaggactcagccatcatgacaaactgtcaggagacttagagccccgaactcgctgtgcaccttccactgtcctgttttacatacactcccttgccggcgtgagctcgcctttcttcagagtgttcatgaaaaataaatgcaaatccaggtagtcttcgaaaagtctggtaaacctgctccagagtttttaatcctcgaatatcccagctggaattgcagcaaaaatgcctgcctgctcacccttgctccctccccccgttcttctccctgctccctccaccccctagcaaaggggtaaagccttttactggaaggtgagtgactcccaagactattttgcgaaagattctttacattgcaaacactttcgttagggacagtgccaggggcggcagtgagcgggatctcaaacatcctttactttctctttacattgtgtctgtaaactcctgttcaagggggaaagactgtaaagtaagagagcacactcaaggaatattccccccgaatcctgaggttgctgtttacacttaaagacacatgaattgttcatttaaatgttcttttaaaaaatgtaactagtgtcgcggtaaatctttgagaccagcctaggttggttctcccttcccagccccccacttacacacacacacacacacacacaccttttttttttttttcctggaccaatgtatgaggttcattctcctttagatgatttgcctgcagatattcagactaagatctgttgcacatgtcccagagtgtctaggaaaatatatttgcagcctcagatcgacgattattttatgtagacgctcccacaaatgtccccagatttccttcccctcttttactcaatagcaacttttaggaggataaactcacgtttttcctgagcataaaaagggaaaatctaggcgactaggcgagggtgaaggaaaaaaaaccccaaaaaacccggaggtgaaaaagggcaaatcagagacttatgtccgtttctttcagggatactaacagccttctttaagcttccccctggagccgatacatctcatgcaaaattaatacaagcaattaaaaataacagtttccaaagttaaaggaaaccatctgtctcagctgatagtaatcagtcttttctctggcccctttaccgggacctgggaagaaacggtttttatgcttccgatgctcggaggctctttcttatattgaagatttatgtttccacttgtgtgcgatgcacgtctaatttgaaataataaaaccgggctgagcaaccagtcaatcagagccatccagggcgctccgcacgccgccctgccccccacctccctccggtctctaactctttccctcctcctccccctctcactctcctggccctccccgtcttccttcctccctcctcggctctcacacgcgctcacacttttacccccacgtgtgttcagatcaaacccttgtcccacagagcaagtgccggcaccgggccacggtgacaaaggcggagtttgtatcagaagaagactgaggcccggggagacacagcggctagagaaacagctgtcttatcagcccgctgcagagatggagatggcttgagaggtcctcaacagataatcacttgaataggtttgcaatgcgccaaacttcacgcttgataaggccaacccaatgtagagagaagcccagatcctgctccattctatctgggctgtaaattaagaaattgaaattcaggtggcagaggcagcagtctgctgatagaccgctgaagtaaactgcattaaaatgctttcggcaggcagagggggcgcctggaatggaatattgtttaaaaaaaaaaaatgtagtgggagggggcagtgagagagaagaaaaagcccacggggcttaaaaattatttggggaagggaagctgtgaggagaagtggaaaagggacacagcatctggccatgattcctaatcatagctactatgaataaacaatttgaaaagtacagtatggagttgtgtaaagtttggtgtgataagagatcaaggaacaatttaaaccaatctggtataaaagggaattccgtctttatctgagcaggggtgagaggaagtggatatcaaatggactgtaaagttttcctttcattgtaagaaaagcagatcaaccggatacagaggagttaccataaattgaagttaacctggccttttggctgaagtgatagggccacgggagagattccagaatgatttttagaatagcctaagaagttgtcatccacaggaaagaatctacatagctacttacaggaataacagttatttttcaactccctcctccctttacccaggtaattactataggataatacaggaaacaaaaaaaaatcccaggtatgtactctaacacatacctgattcttaccgcacactttatatctacatttttctgtctgctcttttggatatgaggtttgaaattttatgcattatttaaatagatttttttcacaaatatttaatatatgtaatgaccagcatatagccagtgacactgtcatcttgattcactaatgtcttagtgttgtaccttgttctttgtgtcttaagtgaattgcaagttcgttggtgtccatttatgaggtggatagcaagtatgagaagatacatggcattttccacaagggcatttacattttaagtcttagaaacatttataaaaagttaccttcagccgacaacacatagttaatacagctttagaaaatgaatcaatttttattttgtttaacttcaaaaatgtgatcgatctcagaatgcatttaactgacaatataaaggcttatatcactttaggataagcaaaaataaaaaatgaacttgttggaaaaagtgagaaaaattttaacatgctatcataaattttagcaactattaaactacttgaattaaaaacaattataaacttggaaattgttatttgattattcataggttagtaagcaaataaatataggtcatgaaatctcaaagacatttctgttgaattgttacatgcaaaaatccttcatatctaacaaaaaaagaggtgtttgcgttttttttattcttttaaatttaagtgtatggatgaattagtgctttgtgtatcctttaatgagagagaaatttatggttatgtaagctaacttttcctttccataccattattttccataaagttatattggtttaaataatggctactatatatgtatattaagaaatattattttaatgaattccagcattttaggcagtattatattatctccaataatcccataacaagatatttttctgcttgttagaaaacaagtttgaattaccagctttaataagccccttaagctatgatttttatttttttcttaatcaaattgaaaatatgcacacaatggacagcttaaactgttctttaatacagataagacttttttaagatgttaatttgcatacagatgaaaagatacactgtcaccaagtttgaaatgtgaaaaaagatattttataaatttaaattatagcatttcaaaactaagataattttaagaagtgacattttcattatgaacataaaatcttttagcatgaaattagtataaaaataatcttgtttttttataaatttttgtcacaaaatgaatgctacatatggtttctaaaggcatagcaattcattataaatgatgaaaaataaaaaataaccaaaaatgtgaagttagttttttaaatgattttcaattattaatccccctctgtgagaaatggcatattatatttttaaagcaaacaatcttcctatgatgtattaaggcaaaaatgttggaagcttttgaaatatccaaaagtcttcatgtttttgtttaatgactgattataattctattaccaaaaatatcacacataactaattatgtccttccagatataacatttatcatcaggtaagagtgaaatgagcaatacataatcacttcctatttctaaatatttttcctaatctttgacaaaaggcccatttcaatttggttcagcatcctttgagtgcctagcatgtgccagaataacaaaattagattagagacaataaatgcttgaaggaaatcagattatattttacgaaatgatagtaaatggaaaacttgaggggtttaaataactcagttaatatgttgcataatacatattcacaatgtgtctggtttatgttgttgttattgtttatccttataaatttttgtacaatatcactttttaaaataatataacttgtcaaaaaattactcctttatataggaacatcatagaagggatattatccttctaggagctacagttttgcaaattgttaatggcttgggttttgacttcagacacatggatttgaacctgatttcacgggtccttggacaagttactttattgcttctaaaccttgattttctaatctataaaattgtgataataatgcctaatttagaatcactgtgaggttagatgtaatcataagtataaaatactcaaaacttcctgacatggaggaagcagtcaatagatggtaactacaattatgagaacaaaaatggtaacctatcacatttatttgatggagccagaattagaattcctgcctttgcatactgtctcttaaatattttcattagctctcattaatgtcccaactgacatatttcatgataaatattctctcacatttctaattgcaaccaagtttaaaaggcgccaaaaggcataaaatcatctatctgccctgttatgtgacttcaatatatttcccaatacaatttcatgattcacccataaaaagttgtgggtcttcaaaatggaactgagtctgagatcccatttgactgatataataataaaaacaccttagatttttatagtaccttttatcacaaaaagctcaatgtacttttacatatttatcattgtaaccccaggaggtatagaaggacataaagtatttctcattttcagggggcataacagaggcattaggaatttaggtaacatttctaaggttcatagagatagttttcccggatgtcagtctttctgcaatctgttactctctctggcattaattatggctattgttactttagttaggctcaaacattagtgtttggcattaagtatagcttataattcagttaatcacttgatgaaatcaatgagtcaaatatataccatcacagtctaatcaaatgaaaatattttgattttatgttgagacacttttattattcaattttatatatgcatacattattcttatttatcattctgtgttaatttctaagggaagattttaaaggttattactcatttatggccttgaaaggaaccagttccaatctacttatcactcacctctccctaggctcattcttccatctccacttatatttttataggctattatctttattccatttacataggctaacagtattttctgctctagttttctatttagattgtgcttgaaaaatctatcaaaataaatatctaaaggaatatagaggtagactatataaagggctttttataatgtattgttttgaataaaacaaaatgtataactaatgtctacttgacattataaaacatagaatatcagaagaacactaaaacttgcttatggtttatagttttgcagttccctcctgggcttacattgctatgaattcatatagatggagctatagctgtggtctttcagtgagtaagtgaaatggaaggaaacaacattttgcagtctgataaaagaatgaaccttaaacttttagagatctaaattcattgtaggtaacaatagaaaacagacttaatgtttttatttcaagcttcaataggcgtctgtctgcatcttaaatgtatcatataatttgataaaattgacccactcaaggtcaagcccagtcatctgactgccagacttctatgagcaagtgtaattagcaccaagaagaaacacatatgcataaacacagaacagccagtgctgctgtttattgccatttcacactaacccctcttaactcttcatgttgatgtgattaaatacaaaatccatttctctgatggagcattatgtatgtgtattttaaggctgaagatactgtcgtaatagaaataatattttatacctttggtcattgtcattctagtatgagaaattagagaatatggttgcttgaaatgtcagtttttgtaaacatgagttggaagatgtcacataaatgaatggcattacagactgtttaagctgtatgagtaacaaatagacatttccttgaattattttcacacaatttactgtgaattttttcctgtagatgatatttctaggttccttgtgcaaacaataaaaaactttcttttatgtcagtgcttattatttaacttatagagtactgatgtattctagaatactaatatttctagatataaaatgaatgtgaagatacatgtgtctccatattagtcatatcaaaaggatacatgaaagtttgagcctctttgtaaggtttgtataaaagaggaaaatattcatatatattacagtgttcagtcctcgcttttaaaagatctttatataaatctcaattgggtgtgtgtgcatgcatgtgtgtgtgtgtgtttgtgtgggtgtggtttagagcaaataaaaggaggttgagaggtgaaaattacaggaatttgttggagtataccagcctgtctataatagaggaagtgggctacaaagcataggaaatcaggttggttgggtattgtggtaccacattatgctggctttgaaagccagtagagggaagtacagatatacaactattagaaacaggatacacctattgacaactgtgaattttagaaaatgccagacagaaagatacccaaaggtagaggaattagaaccaacacataagcagggttaagaagctttcgtcgaaaattcaagactccttgcaatgaggaggcagggtcagactataatatatatgaggacaagactgacaggtatagaagaagagttcatgacactgacaataatgaaagtgttttgatggccaaaatatttccatcagcactgggaaagagatagggctctcagcatataatgtttctgagccaatgagcccacggaagctgtgagggagagaaaccagagacaagagcctgtcaggctgctgctctgcgtagcccaggacgcctctaagatacctttgtgcctaagggagggctttaaaaacactgctgggaaagtacgcactgtggcactaagcaaagatctctagatgtggagcaaggaggcatgagtcctagtattatttatcccgctaactagctgattctcttcagaaagtcactctgactaaacttcatgattcccaggagaagactagattagtaataatagtgtatgctaggtggcattctaatcctctacatgcattaaatcagttaactctcacaagaatctcatcattttacagataaggaaactgaggaagttaagtaatttgcccaagataacacagctagaaattaaaagagctgggatttcgccctaaataggctgtttctagagcccaagtccttagccactatttattggagtacctttaaggtacttccagatgtacaattttgtaattttaaagaaatacaacagaaattacagatgacataacacttgcaagagaacaaaagcctctagaaaacagatattacgatgaacataaacagataaagctctacttttcatttcagaaataatcatactcttataccttgccgtgctctctactgctgacaaatagaagagagagaaaatttatagttggatgatttattcctttaaaaagattcaggtcaaatataataggattttgagaaatattttatataagatgtccttggctgttccaaccagcgggtaacattgttttgcagtttaattatttagcttttacatattttaagcagtctcctccataaacatatagtaaacagttataaagccattaaaaatagtgtttattatttaatgaaatgtgaagatatttatgaaatattattaagcatattaaacatcacataaaggatgtttactagaacattaaacaatggctattttgaggtaatgggagttggatttatagttacttttttttttacattttctgcattattgggtttgtaaaaattttgagcacgcattctttttcataagtcagaaaaacaggtagtttattgtttcagaaagaaaaaactctacagctcaagcttgagggcctatagccaccaggtgggaacaggtgctagatgctggatggtaaggaccagtgacctcttaaaagacaacttagataaagagagaggtcagaataataccccttgagcttttcagtttataaacaaaataatattcacttctaaaaaattgagatttaatacacatgaaaaatagatatgacaaaaatctcagaaattgctctaccatttttttagacaacaatatcaggtataactatcctgtccaattaaaattgcctaatattaattatatacaataacataaagtgtttccttcccttactgactatctgtattatggccaaggaatgttcttcttttcgatgaattaatcatttctttttccctattaaatcctttctcaaattgctcaagaatctcataaaatgaatcttcattcccagccagcaaaacccttaaagtgatttgcttatatttctatggcatataagtaagtgaaaaccataatacagtaaataattataatgagattgaacaaaaactggcttccggacaggtaccattagtgaattgctatttcagtgtcctaaacagtcacctgagttaattcaattttcatattctttaatttttgtctttaaaatcactattcagagaatggaaaactggctcaatgtctcaactgtgactgatggcagtctctgaacattcttacttattttgttttgctatttagaaatagtctaataccatgaccaagaatctaacaagagctatctaacaagtattatttatcttattagatttatgacattggtagaactggaaaagaaggtactaagaaaaaataccaaaataacagaaacttattttttaatatgatgtattttaatgtgttctgttatcttttaagttttataaaccacagacatatattaattttcagatatgaatgacgactgttttgaaaaaaaaaaacttatttgtcatatatagaggacataaagtgccgctgccctcactcatgcactcatttgactcatggcgcagtcctgaataattttaaaccaaacatgactgcggcaatcaattttcgtccaatttattgggcatgagttaaagccaattaaaaaaccatttttggtgcaattcaagaggaaaactgtataaacccatgaaaaacaaatttcagtcctagacatgagtcatcactattctaaatattggtgtcagtcccaaatcaacaagaacaaatcctaaaattgcacagtccacactggaaactgcatttatcagcaatgattttacacaattattaattttttataagaaactgacctgaaaggaaaatcatgctcttctgtctcatatctgaatcatttttgcaatgaaattaataggtagtttatagcagctccttgagtttctgaattaaaaactgaggtagaaagtcatctgtgacctttatataaagaaagcaaaacattttacctataattttaaagtatcttttacctattagaccatgtcttctttcacatgaatatagtggctctcttttaaggccataaaatgaaacaatccctgtatgctccagatattcttagggtaatcaaagcagcaaaattgaagcttctaggttggaaattacagctataaaatacagctatacattttcaatctgtatattaaaaaggcctttcaagttcagggttgtcttggttaaaagtattcacgcagacctgaattctggttctgcctctcctgtgtccttggtatatgactttgggcaagttgcccaacctctctaagcctcaactttctcattcttaaaatgggcattaaaaataacctaccttttagggctgttgtgagcattaagtgactaaagtatttgtcaagtgcctggcacagagtcaatcttcattagacgacagaactggataaaggaaagcccagtgattctcacacatggctgtgcaacacaatctacctgtgaggtttttttcttttcaagtacagatgcctcccctttacctcaagagatttcactgtaattctgaggtgtaatctaagcacatatgtgtatgaaaagctccacaggtgattctgatgaacaactgatttagagcaaaaatcagtacaggtttttcagtggtgcagttaacatggagttaaacagtggcttgagctattttggttccgttatctctgctgagcagattaattggactaattgccaattttatactttgtgttatactgaaaaagatttaactaggatatctttaaaagattttacttacattcatattgctatgaggtcacagaataagtgtgattttctacaacttcccgttagtaaaatgaaacaacatgtgagataaccccgggaaattgcagtcattccactggcatagatatattttagtgtttgttatgtttgttacttctatttaataaacataggcaaataagccaaaattacttaatcagttttttcagagttatattttccttttgagttagttcatttctaactgtcctacttcaagtatgcactctcctcaatgacagagatcaggtggtgccatgctgttaagaaaaaaaactatcagaaaaatatacacgttggactgacatgaccaccccacaagttactcaccatgattgtctaacagaaacacgtgcattttccctgagagtcaattttaaatattaacagaaatcaggactctccttaatatcttcccattagtggagattaatttattagatgaacaacctgttaccttgaaagggaaagagatatgtcctagtagatctggggtattagcaatgtcagtagaggtggcagcgtaagcctaggggaacaaaggacagccaggtcctaaaagtatcaagagaagatgatgaggaggtgaggaaaccaatcaagatagtttccaccatttgtgcctagggcaagtctgggtgcagctggtacattctcagacttacagcttttataggccttcttggtaggaaaccagagtgatttataccctggcatatctctatacaggaattcagagaaattccaatgctgctacaccaccagacagagtttttactttagagtttctagagaaactctctctctaggtttaagaattgttataccctctctctaggtttaagaatgcaaaccgcatagattacctaagggctcattgagacaatacttactctctgaggactccctaccctcggggtttagaaatgactctgcaatgtaaatataattcaacatcatgtattggcaagctgttggtagatcaaggagatgttgatcaagatgtcaatgagagagttggaatgcccagattctagtttttaaactttttgagaatcactatgtatctatgtataaagtgaatgatagtgtttgcttgttttactttgtagggttattgtaaagctaaaagaaaagtaaatctatgaacactggaaaattttctattggcatgagaaactagaggaaaataatttttaatgtatttaactttctagtaaattatacaaatgcctgtcaggaacatatttccttttttaaaattaagtaaactttttctttttcaatatgattctcgaaagtttcaaaatcaactcatcagataacaactctatgttaaaacttcaaaaagtgaaattgcctgacacttgctgaaatatcatggaacatgaaaatgaaaatctacagaaaatgcagaaccttccatttcgttttttgtttatgaatataatgttttatctaagtctcaccttagacaattggtttccaaaacgtggctctttgaaatttcagagaggagagagccccttcagagtttttcgtttaaccagcagagaattgcattctcacagctggaagctgaacagctgttgactctgacatttttctgttcccctgagtgagagttcaaggaccctctctgccatcaggaggacagccagtaaaggggtcagaaacatgttccagtgcaactcaactccaaggccaccctagaggactggagaacagataactcagagccactgttgcccaaatggtagagatagtctccctgttgcagaaaaccagcctccctgagaatctactttctgactcatggccagatctcaaggcttaagtgacctgaagcacccttgatactggccagtcttaggaatttggtgtccttttagaatttatcaatatatatctctttttttcatatatataggaaatttccttttcactcaaagtgcatttctgagtgcttcttagtggatactaaatagctaactccattttgattttataggaagaaaaacaaacaaaaagaatatttcagaatagctgtcactgcagcactatttattgtatccactagaggactcctctcagaataactcaaaatctctcccttctcattctctatggcctctggcatttgatgctcaactgactcttgagttgggccactggctacatatcagtgttagaatgaaaacattccccctactttaacacctcctgctagttcaataaagcgatgtttaaataactgaactggcttcaatgaactgtacttgccattttttcctgcttcttagctagataaaatggagataattaggaagtggatgagcaggtttaatgaaagccagtttcttttggtatactcctgaagcagcaatcatcatctgtttggcttttgaagagcaacaattataatcacttaaacccccaaggggaacaaaaatagaatttacattagcatataaaatatacagctggattgggcaagcctacaaaattctggggaaatcattctaatctgaatgctattcaaactcacaagtaaaatgagttcaagagtattttacatacttccttcctataaaataatacttataacaatgttgagaggattttcctaaaaatgaacacagggaaataaaaaattgttgccaggagagaatcccagagggaataagctaaactgtattgtcaagatatcacagagcaaaatgcataatgatattcacacaaagtactaatcactctgaagtgaagactttttacagtaaaactacacacatttaggagtttaagaaacaaattttgttctgatcactggtactacttactaataaggaaaatttcagattaatagtacttcccttctcctccattgcaaatgtgaaagtaatacaaaggaaagtgaaattgcttaaattgataatctattattataaaacagaactctgtttcctattttaaaatattttcatatcatttcctctcaaacaatctctttcttacacccccctttctaattgtagcccagatcacaggcaatctccctcatcatttacattatttaattacttctgcttttgtgtgcctttcacagtttacaagatacttttttttcttttttggtagagcacagaagaatgaaaatggggcctttgctttatccattatgctactagcaacaaaacactaacataatcaatatattaaaggctttcccggctgtgcacatttgtcaaaggcagtgtatctgagaaattacactaatgaatcttgaacaactcagcatcctacacagaaaacttgttctctctcatcataagtacatatcaatatgtaaagacaagaaaaatatatacttcatctttctatatattatttgaaaagccactgttacatttctttaaaatggaaaaaaagtcagtaagcaaaattccacctccactgagaagccttcctgaataccacactaaagtcaaccacaggcatattagcgatagcttcctctgtgctcctaaaagtactttttacatatctctgataccaattatctcactacgttataaccatctgttgacatctctatctcttacacagagtatgcattacttgacagcacagccattttttccagccaagtattatcaggttctagcacggtgcctaacccagtaagcatgtaatgatgtctgttgagtgaagtgtatcattcactgcattctaagacatcaaaatgttgtggtattcatggtaggaatcaaacatatattaatatcatctctgcaacaatatcagatttaatgataaattaagcactaagaaattagaaattcaaaagtctagatttctgtagcaatcttagctctaattatctttaacaaaggatcgtggtagtattttagattttgttaaatatttataatgttaatcagctctttaaactacctatcccatagttaattatttttactgaaaacacctaaaaagctgagttcttagttcttaatggtaatgacctcaggtttcattaactttataatctctatttttaaaaaattaaaagcattaacattgccttctcagcctttgtcaatgtctgtcaagcgaggcggtatgtagcttatattactctgccctttctataatgctctgagaggctttgaaaatctacaacagataactttactttgaacacaaaatgtgatgacttcatattcaaaaggatttacagggataattgtggtgcatagcttgaaggattccaggacctatgcaggaactttcttaagatcctttgtttttttcttactttaaacatagttcacatttttcctaccagttttccaagtgaaatgatcattttgtacagttatgacaaaacaataatggagaggtaaaagaaaatagactccagaatttatcctaaaatactcctggatttttagttagtaatagttaatattattatcattagataaaattatgttttgaggagttaattataccataaatttaaaactgaaacaactaataactttcccttttagcttcatattgctataaccataacttttatatgtataattacatatattcattatttatatagacagatttgtgcacttcaatgaatttgaatggaaagaaaaattgtatagacggttgtatgattttagtacataatcatgtaatataaatttccacatcaagggatgaaacagaaaattatataaacattttattagctactaaaaaaacttggcctgaattttatttaaaattagaccagtaactaaaattagttttgagaggggtaaaaattcaggggtttttccaaaatcaaagtgaaacagagttgagtggttgaatgctagaatactgtgggttgaaatgctcaagcctcataattctccccttaataacctggttcttaaaattccaaaattatctgacttaaaaaaaaaatctactagtactctcatagtaatgaggtttaaacatgattaatttcgatggtttcactttataaaaaattgaaacttacaaaatggatgtatcaatttttttaagttattcacttaacaagatcattaattcaaatactattttaatgtgtgagctctctgcatttaaaaaaaaagtaaggcaattttttaaaaaaaagatttacacaaaacaactcaggagaccatttattgcataaagtgcagatagagttattctgagtgctatcatttcttctcaggtgaaaagtgaaatattgagcagttttctgttgaatgtcaatgatgtccttaaacattttttcattgttacttaaagaggcttgaatgaattaccttgataaaatcttaacatctctactccacatctaagctaataaacccaagaataggcaatatttatgtcccaatctctcaagtccaaagattttataaacaaaaaagatcaaaattagagcattttgatgggaaaggatgttttctctgcatttattagagagtctatcatctttaatacttcaaaaggaatcatatagtagggccctatttaaaacttttaattttctatatcacttacaggtttctttagttcacaaaatgagggcagtttaaaaaatcccccttaatcactgtgattagaagttaattgattaagtatatcaaagtaaactctagcttagaaaatacatattatcgtaaaaaaatcaaatgatttgctacctataaaaatcatataacattttatgacattaccaaatgtaagtgtaatcaaaattttaaaagtcttgaaaatgaaaaattaaatcccattttagtcattaagatttttaaaatcactctgcttatttaagttcccttttaaggaaaattgggtacagttaggtcttcctcttatttagtaggtatttttgctatttattttaaaatacttttgtcactataactgagttaatttttctctccttttgtttttggaacagaattgagaatataataaattctccataattaatatcccaaaagagaaataaccagacaaaccaggctaatgtatccaaacccaatgtgggtacagttaaaaatatttcagtgaaacttttttcttcaaaaatgttgtattgcaaaagtgccaagattgacaggcaatccctaccctcagaatatgtggcaattacatgagctttatatgaaggccttttaaaatctagtatctttctattatttgattgtcattttgtttgattttggatccaattttggagtcagatagatttttgattcacatcctcactttatggttcataagctgtcttgccttaggtactcagtttctaggtgaaataaaagctaccacctaaagtgttttgaagattaactgagatactgcatataaggcacttacatatatgattaaatccatgactgagtcatagcaggtagacaatacatgttaactattaaaagttaacttctttgagattttagattgtatatttgacataggatacatactacatttaataccaattagaaacaataaatgaagattatttttgcatttttaaaactctaatgtcacttcagccattcttttttgcctttatgcttgcaggtacattgcatgccctggatatggtacaaaggacaaaacctgcaatgtacccattagataacctggctgccatccaccgccacttcctacatctcacttttctcttttatgcatgaatactttttcacttaaagtgagtcactgtcattggaatcaatgactttctatgagagtattgcttagttcacaaaacttaagaattttgtgcttatgaacattataagctttctgctatttgtaaaacttattctaataaactgaggttcaagaaaaatatcggaacatgaccactgtatttccaatgtgccaataacataaatagaacacttataattttggtataaaggcaattatactgaaaataaaaatgtttgtattttgtagaaaaaaattggtaagtgtacttttacattttaaatttgcacattaagaatatttagcaaacctaaaattggcacagaattatggtgagggaaagtatgaggaatatatagcattaaatatatagcattaaagagtttaaatattttaaaggcagttaaactacatgcactattaattatcatttagaagataattttcaattacccagcttattttaaataataatttttaatgaattacttcaactaaaacagtattttcagtgtttaggtaaaaactaagtaaatctgatggcttctttgagattatgactatgattaaaataactctgaataaagttgtttttctccacatgtcaaagtaatttaattttacatatatacaggacatatatttatttataaatatctatacctcagtagtagataatgaattatttctttgtttagcactgtatacatatagttcaaagtgtttattttaaaaccccaggtagtgttagtatagttcaggattaattataaatttaaatcctatgatagttgagtaatatgatctaaaattaattatatagttaagaacattgctagcttactacctgtggtctatggatattagtgggtagaagaaggagatttctcaactgaaattcttgctaatacaaagacataaaatactatattctaatctaaactcttcttttttcacaaatgttactaaattgattcctcttgtaccaacaaattagtagtttaaccattttggtgttttagctctcaaatgaaaactgttttaaggatggttattgcaaacagctagactaaaatcaatattgatgactttggaagctgactgcataaggtatcactttcctgtggtagttactgttgaactacagtaacttcatgtagaataggcaaaaaataagtcagttgttaaaaataagttattaaaatatatgcccgctaaaatacattaagctttattgcaatacaatcattttttaagttattttctgtgtttcctatgatcacaggaagtttataatttaaaaatctttatttcagaataggtcttgagaaatgtaggcacatgcaattatatctacacacatataaatgaaaattaagaatggactcaacaaaacaattcctttcagtgggtatttctgtttccatcccaaccttcaaatgagaaaacttagatggccttgcctcatcagaaaatgggcaggtccattccaatttagggcatcccagttctctccatggcaacagccctggataagctaaaaggcaactgaaagtttttaagactactgagcactattaatcctttttttaaaagtgcaaaacaggccaaacaatgtagaattctccagagcaaaggctgtcttttaccaaacttagaactgtttacattgtcacaaatactgtgttgatacctattcttggaaaatgaatgagaaaaaggggcaaaacccggaagtccatccatggaatatacctcctatttaaaaacaaaagggattaggaaaggatgctgaagaaggactcttaaatgaatgaatctgtaacactttaaaaagtgggatgaatgggaagagggaggagaggagagggcagtgggaaggagggttaataagcaattcctttctccagcctcaaaccttttaagaccacaactttgcaaatgtattatttcatcatcatttagtatttaaaatttgtctaagaatgatggcttcaaatgttgctacctgaggaagtgtgaggaagaatggtctaactgcaggagaggacacagagatagttgtagtagctgaggatgaccccattgtttcttttcttcttcaggattttgatcaggagtgacccggctaatgtgccgagttcaggaagtcagagctgcaaggttcttttgaaaccagacaataacgtagttcccttcgcctcccttccctgcacctctcccctgcttactgccaactcccacccactttaaatgcatcaagcctattaccatcccaagagtatcaaacatataaatacagaacttgtccactgaccatagtagagagaaaaacaaaattagcactactggtttgtacgggtttctttttgttgttgtttaacgaccccctcctcccagcccccaaccctttgtgtgtgaggattccccttcaaaccacccacagaccgagcagacgagaagaaatggtaattttcggtttaaaagttcacttaccacggcaacctcatattgctttgtcatgctttttgcacttaaattttcaaaactgcttgtgctgggcgcagaactgggaaggcagggctaaagtatctctagtaatcacaacaaaaaggagagaacattcaccaatcagaattacatttaaatatacaatcaaaccccagagcaagacgcacggttcagaacataccggggagggggtgggggtggaaaaagccaaactaacaaaacaaaaggtaaaggggagagttgagtggttggaggggaaattgatccaagccgccttttgaccgtggactggcttaaaaccaccaccaccaccaccccccccgcccccagcacccccgcgattacccgagtgactgcacttgcctccagccagctcaactgcaggagaggaaagccccatctaagttcactagccctgccacagtcttccactgcctgatgggttccttcaggaaaacacttccagaggcattcatccacttgaggtctggggttggctgctgctgcgaggctgctgcagccgaggctcccgcgagcagctgctaggatccttgccgtctcgttcctgcctctttcgagctgcacaatagccccggctgggtgcacctcattaagccagccgagagccccaggagcagggcaagccgtgtgacagcgctacctctttgtaatgactgtatgatggatgcaaccgaagggtggggtctgggtgggtcaacactgttaatgacagtatgtatcattctgtccgtcctccaggagaggggagggaagccccctgccctcccctcaggtcttgggctcgctttctctctctctctctctctctcgctctctctctctctctctctctctctctctccctctcttcctctccctctctctcctatctctcgtctctgtcccctgtcactcgcgcgcacacacacacacacgcacacacactttcctccctcttcccccacctccctatgccattttctgcagtcagcgttcaaaaaaagtacgaaaaccatcgggtaatttccaactgaaccgattacggacggcgaatttatccaaacacttaagcaaggagaggatcctaaaatcgaaaaacgaaggcggaaggggcgagaagaacggggtggagttgggtggcggagcgagtgggacgttaactggccaatagtttgcaactgccggtcaacacgcgcagcctactcagcgctgctccggaggcgcgggacgccgcctccacgtgagccgcgctcctcccagtgcccgggacggtgtcgggggcgggctgcacggcgagaagggcaaaataaaaccagcccgagaggccctggctggggttgagactgcaggagtaacttctgcaccgaggcagcgcgcagccagtcggggaagaactctgcaacctgaccgaaagaaagtccgaccctctcgggagggctgccaggatgctggagcgagtgtcagggtccgagactcccaagtcgggcgagggctcctgcccctggccattgggtacccccctccgaccaacacccccgtcccgcttcagagcgtcggccccacaggtgcgcagcgaagtcaccacgttggggactagcccccgcctctctctcttccctttctctcccgacccttcatcctcttcacttctcactccactctgagtcttgcctgtgctggccaggctgccccagggaggcaaaaaaagaaaagaaaatatctctcctttctccccctttaaggggagccttggatctttgtttcactaccacaccactgacaccatcccattgatatttttaccccctttcagttttgttaatggtcccaagaacccagttcccaggcaccggtttttcttctataggaaagccttacagaatgatttttattgccctgtgtggacaagtacacttattttacactcagcctcccgtttccaacttaactgtgatgctgtacactcttcatgtggctacaaagcaccttccagacatcctgagcgatttctctagaaccgtgcggatgctatttatttatatttattagagtttatggagcaccatttctctgactctgtgtaatagacttctatgtttttatcattgatgtcttatagcagctaagagaaagcaagaagcatagagaaaacagggtatttatggcaatgaagcatctctccatttttatgtcagccatttatttattaattagttaaaatttgtgtaggttgtgcagcctgctctacgccgtgggatagcactaaagattttatgccactcctcaaagagcttctgatccacggggaaggcaaaataaccttcagctcttaattgcttctaacaaaaaaccacttttaattgatgggaaggagagaccttgtcagaaagctttcagcaaagtaaaggaacactatggtgttgacctcagtggttctttcaggtcataaacctgcaaggcctcagaagtctccccttcattttttatttttattttttgttgaagcaattgctttccccccaccaccttttttttttttttgagacggattctcactgttgcccaggctggagtgcagtggcccgatctcggctcactgcaagctccgcctcccgggttcacaccattctcctgactcagcctcccgagtagctgagattataggtgcctgccaccatgcctggctaattttttatgtatttttagtggagatggggtttcactgtgttagccaggatggtctcaatctcctgacctttgtgatccaccggcctcggcctcccaaagtgctgttattgcaggcgtgagccaccgcactgggccgcttttcccacctttttacaattgtatgttttgaaggtagtaccagacttctgttcacatatttcctagaattaaatataaaggcaagggtagggggcaagagaaggccagtgggaattagtgagaaatctaaattaattgactaattaattaatttactaactgtaacaccaacgtaagcttgcctaaaagaagtcattagtgatataacttaatgagtaaaaataaaaattatagataattatatatgatgtataattgtataaaattagcaaaataattgtttttatgtaaatagttctttgtaagggcatctgaaaactgttcagacatttcctcttacattgttttagtaataaacttgcataatgaaaaagataagtataaaatagttgggagttgagaaagttaattgattttgtagtacgttattaattgtgatcataacaaaagtttattattaaagttctccatttctttaagacctagatgggcaagataccaaatacttttcttggaatacatcatcttgattgaaaactactaggatatttttgaaaaaatagctcattagctggctgggtaagtttgtttgtttacaatggacttttcaatgatggtggtaggcatcctggaagatagccactgtactaagttcatttttctctgttcttggctgctcctctaaccttgaactttatttagtcagggaaaatggaaggaatgggaatgctaactaatggaagaaagatattttctttgacctttgaaaaacagacttaagtaattgaaccataaatttagaaaccgggcttttaacaaatgaaaattttaagatgtataaaaacagctcccataagtatatgcaccaaatgtattaaccttgtgatatataagattgcacctaggaaaagttaacaccgttggagattattaagacttaccaactcattcagctttaataagcagaacttgagccaagtgcggaacacacttgtaccaaattggcaagaattatacacttaaatgtaaatacatttttttctgcgaggtaaagctattaagccccccaaaacaccttagatatattttttgaaaactgtcctgcaaaaatgtttgtcctaccaaaagtttctagcctatttcacaataacctatatgacagttagtacgacttggaaaagatgtttaatatctgaacaaggtaatatgttctatttcctatttttgttaatgggattgtagatgtgatgtatttcaggctctgtgttatctatggcaggaaaaaattgagggcaaaagagtttctttggcatacatcaagaactacattgtaatcaatacaagcaaaccaagtctggaaaatatataagcaaggtattaaataagtaattcactgtctataaatctcctaccagtgggtgaatgttgagagtcatataagggcttcagtgactaatggaatacagttgctcatcccaagcaaccttggctatccttttagaaacttctcaacaagttctgctgcatgtaagaacaagatcatgtctaagaatccagtaaggattttaaagattgtcttgcatgctacctttgaaaagcaagttcagtactcagtttttcagaaagcatttatttgcatgctgttaagatttctttacccaagttagacagtggagtttctaaagtcatatagaaattggttccgatgcttataaactgggtgacttgtacaattctcttaattactctggatcatacttccttctttagtaaaattaaaagaacaaggaccaactcctacagttgtgatgatttaatgatacaaagtgtaaaaacatgctgcctagtaaaatgtcagtcctattgaaacagacattgtaatttgcctcactcaacatgaattcttaacctccaccctccttgtcttactctaacttagagactggaaatttcaatatttcatttcccagttttctttgcatctagtagtggctgtttgacatagttatggcaaactaaatgtaaatacggctgggcgccgtggctcacgcctgtaatcccagcattttgggaggctgaggcaagcagatcacctgaggtcggaagttcaagaccagcctggccaacatggcaaaaacccatctctactaaaaaatacaaaaattaaccaggcacagtggcacatacctgtaatcccaactactcaggaggctgagacaggagaatcacctgaacccaggaggcagaggttgtagtgacccgagatcacgcctctgcaccccagcctggacgacagcatgagactctgtctcaaagaaagaaaaaatgtaaatacatattggctgagaaaccttctgaaaatgcttttgttttcctgatgaaagactaatagtgaccactgccacaactttttgccccatttgtcctacctgcttcttcctatgtggtatatgtgatttctggagctagagcagccatcttgcagttatgaaccacttgaagaccaatctctgaaagatggtgaaggaagataggaagaacccgggtttctgataggaaacttgacttgctcaattagtcctggactgttgacttttagacatcttgttgtatatgaaaaaataaactgctctttagttaagccatatttagctgaatgttctgaatattatgatactgaaatatctgccacgattgttgtggttttctgcttttaaataaaatctgccttgattatatgactctgaatgtcagccatgttgaagaatttcaggtaaaaaacttttctgagactccacccatgcacctatgactaggtcaccgttttgggtttggatgatctgctcaaagtattgaacctggagtgggtttgtaaggacctttttttttttttaaagtcccacaactgacaattctttttggggaagccccatcattgtactaaaagagacagaatctaacatttatattgtctaaataccttttctctttcctttcataatgtattgttgcttttgttttcaaataaacatactgggatgtgtttatttttgaatatgtttatattgaaatattcagaatattcactttggaaaacgataaatacttatttaattgatgatcctagtttgctgccatagctccacacatttttttttttaatacaaggtcttgctctgttgttcaaactagagtgcaacggtgcgatcatagctcactgtaactccagactcccagcctcaatctatcgtctattctcagcctcccaaactgctgggattataggcatgacccgacccaccatgagtggtttctacataatttaaaatgtcctctttaggagtcatgtttacaatgtgagtcacaattcaggagaatgtcagcaatgtgacaatagtatgttctctgaaggttggatttaatctaggaaaatacctaaaatgttgttcagaatcaaatcaagtaaattaagtgaggaatcacttaaaaactggataatacaggatttttcattgctgttacaaaaaaactaggtatatacacaaaataataagatctaaaacatgtctaaaatgtgttatagcaaggaaggcatccttcacataagcatctatcttcctaagggacagctttggaggcccacacacttggtcacatgtgttagctaaacacgtcagtctcatagctattttcagttgtaatttctttgaataagccagatgtttccttttcacctttccccttccattctgtcataaatttcttattctgaaacagactcagtgttcaattgattcaaagctatttttgtagtaccatcactttagttgattaaaaaaaaaatgtacaagtagcaagacagaacagtgccacggatacgatattaagactttgaatcaaactgaattttatttgagctccaaacttacttcttactagctgtgtgatttgagcggttatttaatcatttcagtctgttttttatctgtaaaatgaagataaaaatagtgtgtatcttagagagttgtcatgaatattaaataggataataaatatggggtttgtgtataatgctgtgtatgtagtaagtgattaataagcattacttatgataaaaccatgttaggcaaatagcaaggtctttgaaatacttaaaatgtaaagaatattagaccatttataggcgttgctaccagtaactgcaagtctaaaaataattcagctaattatgagttaatcatggatagttaacataggctgatccggatatttatctatcattttgtttgatgcagtagaaaaaatttggtcctttaaaataaataggcctaattccagtgtgtgataataggtaaatctctgcctatctaagtctcattttccacagtataatgtaactaaggaccgttttcccagggaaatgttcttaaaaaataggtaagaacctggtaattacttctctctctctctcttgctagtaaagaatagaaacccggatgtattttctaagaaccaggaaatcacaattaactttgagtttacaaaagatctccagagatatttcattacttggagaactaagatcagagtagaaggtagattactattgatttaggtcatatatgtttatgatgtatcaaccagatgattaaacaaaaaattagtattttggtgcaagttactcaactcctctgagcctgttacttcatctatgcaatgagtaagtagactatgaatgtagctttcagttgttcaattatttctagttaatttgtttctagttaattttaacaaaatataaaagacaattttctcatttgattcaacaataccttccccttactggcctaattgtattaatcatggagggggatagaatgtaggcatggggagagatgaaataaaatcattcagtggtttctgattgattagagttgattatgtgtttaaggtagaatattaaaaagaatatttttttcaggaaaaagggaaagtcaaagtcctctaaaaagtatttagatttttaaaatttcatattttactaggagagaaatatatcatgaataatatatgttaagctatgccagaaataaagttaacctagaaataaaattatgtatgttagtttttttctttttgtaagagacagggtctctgttgcccaggctggagtgcactggtgaaatcacagcccactatagctttgacttcctgggctcagctaatcctcccacctcagcctcccaagtagcatgccaccatacctggataattgtttttaatttttttgtagagaaatacaaaagtgctcatcctcctgcctcatcctcccaaagttctgggattacaggtgtgagccatggaacacagccttatatgttaaagtttaatttaatctttttacatacagtagaagagtctattgtagagcaatggttctcaaagtgtgatccacagctggcaccattgtcacctgggaaattgttagaaatgcacattactgggcttcatccaagacttactgaataagaaactcaggtggacccatcaacctatgttttatcaatagcaagaccttcaggttatactgatgcaagctaagatttgaaaaccactgctgtaggcttcagcaaaggagtacgtcttttgtaattgagattgcagtttctcccatccagagaaggagtctctatctgcattcctggaatctggcctcgttttgtaaagtgctttgaccaacagaatgttgtagtggtaatgacatgccagtctggaaccttggcctcaagagtccttcacttttcctctcccttggtaccctggtaccaccatgtaaatggtcctaaagtagcctggtaaaacatgagagatcatacggagaagagtccagttgtcctagctgcagccaaccaaaccagcctagagctagccaattcctaaacatgtgagacagcccagccaaatcaggagagctgacccataggcccatgagcaatagtaaatgtttattgatttaagccactggtgcagttgatattggaacctatatccttttggttccaaagtccctgttactactctcccacactgaggaactgggaggactataaatacctttcaatgtaaacctcttatttctcaggtaatgaaaccaaagaagtgtagtaataacttgtctaaactcatttacaatgtgaagttttcaatctttgtaatgccaaattctcacctctgattatgaaaatggagaccctgagcaacaatgtcagagttgttttgacctgggtagataattttcatttttaaatgagtgtaataggtgattctgctccagatgggtcataaattatcccggaatgtctaagtcaaattagttgtggagccagggctcaaaatctggtcttctgattcccagtgaggctagctttaaactacaccaatgatttcatcagggtaggtagatggattccctctggtgatgcaggattggcaggaggtggcatgtaacagaatcaccctaaggagctttttcaaaccaccccttcattgtccgagaacccctttcaaagtcccctcaaatgggaacccttgctatggtaaactactattactgatgggtttatgttatcttctccagccttcaggtattcaggggttaaaaacaagagcagtccggccaggtgtggtggctcacgcctgtaatcccagtactttgggaagcggaggcaggcagatcatgaggtcaggagatcgagaccatcctggctaacacggtgaaaccccatctctactaaaaatacaaaaaattagccgggcgtggtggcgggcccctgtagtcccagctactcgggaggctgaggcaagagaatggcgtgaacccaggaggcggagcttgcagtaagcggagatcgcgccactgcactccagcctgggcgacacagtgagattccgtctcaaacaaacagacaaaaaaccaagagcagcccaaggaaggttgagaagttacttctgtactgagtggtgcttcctcaatttgtttatctggataaatttactctcacccagtattatctaataaataaaggcttcagtgagaatgggactcagaagtattatgttttgacaacagtaattatataatgactagcttggatcctgcttatatagctttataccattccctaatggggcatttaactgcaaccctacatttagatgacacctatctctgggtaataacaatatatgaatctttatgttggaagttttcagcctagcattgactcagcctaaaggtttttctgctttgaccataattttctggtgtgcagtctcctgcctttttctccttttggtttgctaatgagtatttgattcgtgtacattaacctactggtatccccatgcacagatattattcatcacctgtcctacagctcaatactgcctttcagtttatctgatattaaaccaccatctatatgtctggatatctgctaattttttgctacaggatttacttgccagctgtgtttgtatctagtctgctcctcttcctttccccccgacatccttcccactcaccaggaaaaaagattgaaaccttccctggaatgttctatcctttggataatgaacctcttgccctcttgcatggtttctatgttcagacatcctgtctttattgtatactataggctgtctcattgtggctgtcacccacaccactgaggcctcagaaatgaatggcaacagatgggaaatgatggaaacatggccatgtgcatggtccttggaagacagggcaatgcaggtatcctgagggcagcggctttttcagttttggaattctatggctttttttttcttttttaaaattgcactttaagttctgggatacatgtgcagaacgtacaggtttgttacataggtatacacgtgccatggtggtttgctgcacccatcaacccatcatctgatttaggtatttctcctaatgctatccctcccctgacctcccaacccctgacaggccctggtgtgtgttgttcccctccctgtgtccatgtgttctcattgttcaactcccacttatgagtgagaacatgcgttgcttggttttctgttcctgtgttagtttgctgagaatgatgatttccagcttcatccatgtccctacaaaggacatgaactcatcctttttttatggctgcatagtattccatggtgtatatgtgccacattttctttatccagtctatcattgataggcatttgggtgggttccaagtctatgcttttgtgaatagtgctgcaataaacatttgtgtgcatgtgtctttctagtagaatgatttataatcctttgggtatatacccagtaatgggattgctgggtcaaatggtatttctggttctagatccttgaggaattgacacactgttgtccacaatggttgaactaatttacactctcaccaacactgtaaaagaattcctgtttctccacatcctctccagcatctgttgtttcctgactttttaatgattgtcatctaactggcatgagatggtatctcactgtggttttgatttgcatttctctaatgaccagcgataatgagctttttatcatgtgtttattggccgcataaatgtcttttgagaagtgtctgttcatatcctttgcccactttttgatggggttgtttttttcttgtgaatttgttgaagtgccttgtagattctggatattagccctttgtcagatggagagattgcaaaaattttctcccattctgtaggttgcctgttcactctgatgatagttgcttttgctgtgtggaagctctttagtttaattagatctcatttgtcaattttggcttttgttcccattgcttttggtgttttagtcatgaagcctttgcccatgcctatgttgtgaatggcattgcctaggttttcttctagggtttttatggttttaggtcttacatttaagtttttaatccatcttgagttaatttgtctgtaaggtgtaaggaaggagttcagtttttgttttctgcatatggctagccagttttcccgacaccatttattaaatatggaatcctttccccattgatggtttttgtcaggtttgtcaaagatcaactggttgtcgatgtgtggtgttatttctgaggactctgttctgttccactggtgtatatagctgttttggtaccagtatcatgctgttttggttactgtagccttgtagtatagcttgaagtcaggtagcatgatgcctccagctttgttctttttgcttagaattgtcatggctatatggctcttttttgattccatttgaaatttaaagtagttttttctaattctggggagaaagtcattggtagcttgatggggatagcattgaatctataaattattttgggcagtatggccattttcaccatattgattcttcctatccatgagcatggaatgttttttcatttctttgtgtcctttcttatttgcttgagcagtggtttgtagttctccttgaagaggtccatcacatcccttgtaagttttattcctaggtattgtattctctttgtagcaattgtgaatgggagttcactcatgatttggctctctgtttgtgtgttattggtgtataggaatgcttgtgatttttgcacattgattttgtgtcctgagaatttgctgaagttgtttatcagcttaaggagatttttggctgagatgatggggctttctaaatatacaatcacgtcatctgcatatagagacaatttgacttcctctcttcctatatgaatacgctttatttctttctcttgcctgattgccctggctagaacttcctatactttgttgaataggagtggtgagagagggcatccttgtcttgtgccggttttcaaagggaattcttccagtttttgcccattcagtaagatattggctgtgggtttgtcataaatagctcttattattttgagatacgttgtatcagtacctagtttattgagagtttttagcatgaagggttgttgaattttatcgaagaccttttctgcatctattgagataatcatgtggttttgtcgttggttctgtttatgtgatggattatgtttattgattttcatatgttgaaccagccttgcatcccagggatgaagcccacttgatcgtggtggataacctttttgatatgctgctggatttggtttgccagtattttttgaggatttttgcatcaatattcatcaaggatattggcctgaaattttctttttttgctgtgtctctgccaggctttggtatcagaatgacgctggcctcataaaatgagttagggaggagtccctctttttctgttgattggaatagtttcagaaggaatggtaccagctcctctttgtacctctgatagaattcagctgtgagtccgtctggtcctgggctgtttttggttggtaggctattaattactgcctcaatttcagaacttgttattgttctgttcagggatttgacttcttcctggcttagtcttgggaaggtgtgtatgtccaagaatttattcatttcttctagatttttgtagtttatttgcatagaggtgtttacagtattctctgatggtagtttgaacttctgtggaatcagtggtgatatcccctttatcactttttttattgtgtctatttgtttcatctctcctttcttcattagtctggctagcagtctatctattttgttaacctttccaaaaaatcagctcctggattcattgatttgttttttgaagggtttttcgtgtctctacctcctccatttctgctctgatcttagttacgtcttgtcttctgctagcttttgaatttgtttgctcttgcttttctagttctttcaattgtgatgttagggtgtcaattttagatctttcacactttctcctctgggaatttaatgctataaatttccctctaaacactgcattagctgtgtcccagagattccggtacattttgtctttgttgtcattggtttcaaagaacttattatttctgccttaatttctttatttatccagtagtcatttaggagcaggttgttctgtttccacatggttgtgcagttttgagtgagtttcataattctgagtgctaattcgattgcactgtggtctgagagactgtttgatatgatttccattgtttggcatttgctgaggagtgttttacttccaattatgcagtcaattttagaataagtgctatgtggtactgagaagaatgtatattctgtttatttggggtggagagttctgtagatgtctattaggtctactttgtccagagctgagttcaactcctgaatatccttgttaattttctgtctcgttgatctgtctaatattgacagtagggtgttaaagtctcccactattattgtgtgggagtctaagtctctttgtaggtctctaagaacttgctttatgaatctggttgctcctgtatttggttcatatatatttaggatagttagctcttcttgttgcatttatttctttaccattatgtaatgccctcctttgtcttttttgatctttgttaatttaaagtctgttttatcagagactaggattgcaacccctgctttttatttcctttccatttgcttgataaatactgctccatccttttattttaagcctatgtgtgtctttgcatgtgagataggtctcctgaatacagcatattgggtcctgactctttatccaattttccagtctgtgtgttttaattggggcatttagcacatttatatttaaggttaatattgttatgtgtgaatttgatcctgtcattatgatgcttgctggttactttgcctgttagttgatgcagttttttaatagtgttgatggtctttacaatttgtcacgtttttgcagtggctggaacaggtttttcctttccatatttagtgcttccttcaggagctcttgtaaggcaggcctggtggtgacaaaatctctcagcatttgcttgtctgtaaaggattttatttctcctttgcttatgaagattagtttggctggatatgaaattttgggttgaaaattcatttttttaagattgttgaatgttggcccccactcacttctggcttgtagggtttctgcagagagatccgccgttagtctgatgggcttcattttgtgggtaaccagacctttctttctggctgcccttaacattttttccttcatttcaaccttggtgaatctgacaattatgtgtcttggggttgctgttctcaaggagtatctttgtggtgttctctgtatttcctgaatttgaatgttggcctgttttgctgggttggggaaattctcctggataatatcctgaagagtgttttccaccttggttccattctccccatcactttcaggtacaccaatcaaacgcaggtttggtcttttcacatagtcccatatttcttggaggttttgttcattgtttttattcttttttctctaatcttgtcttcacgctttatttcattaacttaatctacagtctctgatatcctttcttccacttgatcgatttgcctattgatacttgggtatgcttcacgaagttctcatgctttctttttcagctccatcaggtcatttatgttcttctctaaactggttattctagttagcaattagtctaaccttttatcaaggtgcttagcttccttacattgggttataacaagctgctttagctcaaaggagtttgttattacccaccttctgaagcctatttctgtcagttcatcaaactcattctccatccagttttgttcccttcctggcaagaaattgtgatcctttggagaagaggcagtctggtttttggaattttcagcctttttgcactggtttttcctcatcttcgtgaatttatctacctttggtctttgatgttggtgacctttggatggggtttttgtgtggacgtccttttcgttgatgttgatgatatcactttctgtgggttttccttttaacagtcacgcccctctgctgtaggtctgctggagtttgctggaggtccacttcagaccccgtttgcctgggtatcaccagtggaggctgcagaacagcaaagattgctgcctgttccttcctcgggaagttttgtcccagaggggcacctgccagatgccagccagagttctcctatatgagttgtctgtcaacccctgctgggaggtgtctcccagtcagggggcatgggggtcagggacccacttgagggggcagtctctcccttagcagagctcaagtgctttgctgaaagatccgctgctctcttcagagctgcaggcaggaacatgtaagtctgctaaagttgcgtccacagccgcccgttcccccaggtgctctgtcccagggagatgggagttttatctgtaagcccctgactgaggctgctgcgtttctgtcagagataccctgcccagagaggaggaatctagagaggcagtctgactacagcagatttgcagagcggcggtgggctcagcccagtttcaacttcccagtgactttgtttacgctgtgaggggaaaactgcctactcaagccttagtaatggtggacacccttacccccatcaagctccagcatctccagtcaattttagactgctgtgctgggtaaacgaattttaagccagtggatcttagcttgctgggctccatgggggtgggatccgctgagctagaccacttggttccctgtattcagccccctctgcatggcagtgaagggttgtgtcattggcattccaggcaccactggggtatgaaaaaaaaactcctgcagctagctcagtgtctgcccaaacagccgcccaattttttccttgaaacccagtaccctgttggtgtaggcacctgagggaatctcctggtctgtgggttgtgaaggctatggggaaagtatagtatgtgggccagaatgcaccattcctcacggcacagtccctcatggcttcccatggctagccagttccctgaccccctgtgcttcacaggtgaggcaatgccccaccctgctttggcttaccctctgtgggctacactcactgtctaaccagtcccaatgagatgagccgggttcctcagttggaactgcagaaatcacctgccttctgcattgatatggctgggagctgcagactggaactattcctattcagccatcttgccatagaattctgtggtttctatgaagcaaagctacccagaaggagcagtaaggtgttgacagggaacaagtggcccaagacagcaactttaagtttttcctaagcgataccctgtatttatgcacatccagaaacatggtccaaggaggaacactgtgcctcgttttaacctttactgtattgtctattgctgatctaacaaactaccataaactttctggcttaaaacaatacaattcagcaacacaaagttttgaaggccagaaattcaaatttggtcttactaggctaagagtcttctgttaacaatagagaagaatctgtttccttgccttttccagcttctagagggcagtcgcattccttggcttctggccccttttcatcttcaacaccagaagtggcaggttgaatctttcttatattgcatcactctgacactgactctcctgccttcctcttgcacttataaggaccctcatggttaccttgagtctgcacagataattcaggataatctccctatctatagctgatctgattaactacaataattccatctacaaccttaattctcctatgccatataaaaatttacaaattctgagggttagaatgtggacatcttgtgtgggagcgttattcttccttccacatctatgtagtgaggaaacaaattctcatggtaaacatgtatttgtaaaaatatctattctctaggattcacaaagacaaaatacaaataaaaatgtgtcaggctctttgaccttagggaattcatataatgtagtgaaaattctaagtagattgaggagggaattactatgcagtagcctgtatgaatataccttttaaaaagtgtatgtggttctgtagttcatgttctgtatctattggttttcacgcttaatgtgtatgaggaaagcattaataaaaacccgacctccataccccaaatgaagaaatggtgatcaactcaaatgaaatgggtacaggtataaacacaaggaactgatcaaaagatgcctttatgaaaagtaaaagcaggtttttgcattcttattatcatgtaataatttttagtctcaaaccttcatcatttcctctggctccaaccctggataacatctatgctgctgatttagcagccaagtcagtaatttaagtactaggacttattctgcatgctaaattatgtttacagaatcaaaggattttcaaatggaagggcttatctggaatttggagatgagatctatccaagtgcagagaaaaatcttaagtctgagaaataattaaattacaacactgtttttattaagctcacaatcagtttgttgaaaaatgtctctctgattttatctttcttgttcatttttaaaacaaaaattactattgattttgtaaatataacacttgctcattataatgagttcaagtcatgcagaaaagtaaaaaggggtttaaaaaaatcactccaaatctgatttttttaccattattaacatataatacatgctatttttataaataagtattgaagtagaaagaagccaaatgaagctgaaatgaattggaatggaattctgtacttcaaataaatgttttatttagtacagaatgtagtattttctaagcgatccctctaaaagttaagaagagattattgaaaacattaaaatattgaaattatagctctaaaatttacatatgttaattgctatggcatcaattgttttcctgttctgaaagaaaaaagacattggccttttccttttcccctcttccacctcttgatcttgttatttataatatttatttatatattgccaaggtttacacatttatattctgttctataattatttaaatatattctcaatggatttgatgttcactcaagaccttttatgcatttcctcattttcttacctttcaggaatttcttaagtagctggatttcattatcaagtaatgtgtacttatctgatttttagtttggttggttttagtggagaagggtgcatgtttgcagacatctataagctctatctattgcagttttatatcttatatacatggatattttgtataccttgaaggtttgtgatgttgcattatatttcttttccttcaaaatttcttagatattttccagtggctactgttatgaatgttactgtgggatgatatgaaaccaattaatgacttatctcagggttgagagtttgtgtcaagtttccttggaatatatgttccttttcaatctgaagattagatttttgcttcgtttcagagaaagtttcttcattagttttgttttttaaattatctctttggatacattgatttgttcctctgtgtggttttgtttttttttaacctaagatacattgctgtgtggcacagaatttgtcagttttccagttctgtgagctttttgctggttgtttaatttcatcctttttttaaaaaaaaaaatctgtatttgctattactatctcaattcttccttgcttttgaaatttattattagttctttaatgatattgtttccatctcatatttccttaagtttgcaatccctcttttctccattcttctgtttttaaattcattaagcttcgtaaatgaaggagagttaaagtctttttcagacaaacaaatgctgacagaatttgccactaccaaaccagcatgacaagaaatgctaaagggagttctaaatcttgaaacaaaacctcaaaatacaccaaaatagaacctccttaaaatagaaatctcacaagatgtataaaacaataacacaatgaaaaaataaaacaaggtattcaggcaacaactagccagatgaatacaacattacctcacacctcaatactgatgttgaatgtaaatggcctaagtgttccacttaaaagatagagtggcagagtggataaatatctaccaaccaagtatctgcagtcttcaagagagtcacctagcacacatgggcttacataaacttatggtaatggggtggaaaaagatattccattcaaatggaaaccaaaagtgatcaggagtagctattcttatatcagacaaaacagactttaaagtaagaacagtttaaaaagacaaagagggacattatataatgatacaaggagtagtccaacaggaaaatgtcatagtcctaagtatatatgcacctaacagtggagttcccaaatttataaaacatttaccactggacctatgaaatgagatagatggcaacacgataatagtgggggacttcagtactccactgacagaactagacaagtcatcaagatcaaaacaatggacttatactatactataaaacaaattgacttaacagatatttacagaacattctacccaacaactgcagaaaatacattctattattttttgatttttaaattatggaacattcttcaagatagactatatgataaactacaaaacaagtctcaacaaattttaagaaaatcgaaattatatcaagtactctctcagaacacagtggaataaaattggaaatcaaagaatcatcaaaactatacaaatacatggaaattaaataatcgctcctgaatgatgttgggtcaacaatgaaatcaagttggaaatttaaaaattatttaaactgaatgataatagtgacacaacctatcaaaatctctgtgctacagcaaaaacagtgctaaaaggaaagttcataacattaaatgcctgcatgaaaaagtctgaaagaacacaaatagacaattgaagctcacacctcagggaactagagaaacgagaacaaaccaaaatgaaacgcagcagaagaaaagaaataacaaagagcagaagtaaatgaaattgaaacaaaaaaatacaaaaaacaaatgaatcaaatcttgttctttgaaaagaaaaacaaaattgataaagcattagcaagattaactaagaaaagaagatagaacatccaaagctcaattagaaaagaaatggaagatattacagccaataccacagaaatgtaaaagatcatttaaggccactatgagcacctttatgtacacaaactagaaaacctagaggagatggatacattcctggaaatatacaaacctcctagattaaaccaggaagaagtagaaattctgaatggactgataacaagaagtgtggttgaaacagtaataaaatattgccaacaacaaaaaaactccaggaccagatagattcacaacttaattttattagacattcaaagaagaattggtatcaaccctactgaaatgatttcaaaagataaagaaggaattctccctaaatcattctatgaagccattattatcctaataccaaaatctggaaagaatataacaaaatgaaaactaaagaacaatattcctgattaacagagatacaaaaatactcaataaaatactagttaactggatcaaacagcatatcaaaaagataatacacatgttcaagtgggtttcataccagggatgcagggttggtttaacatgggcaagtccataaatgtgatacaccacataaacagaattaaaaatgaaaatcatataatcgtctcgagacactgaaaaagcatttaacaaaatccagcatccctttttgattaaaaccctcagcaaaattggcataaaagggacatactttaaggtaataaaagccatctatgacaaacccacagccaacattatgctgaacagggaaaatttgaaagcaatcccctgagaattgaaagaagacagggatgttcacttttaccacttctagtcaacatagtactggaagtccgagccagagcaatcagacaagagaaagaaataaagggcatccaaattggtaatctatctatcactgttcaccaatgatatgataatttacctagaaaaccctaaagactcattgaaaaagcttctaggttggataaatgaattcattaaagtttcaggatacaaaatcaatgtacacaaatgaggagcactgctatacaccaacagcgaccaaactgagaatcaaataaagaactcaatttttatgagagctacaaaaaacaaaaacttagaaatatacctaatcaagaaggtgaaagatctctacaaagaaaactagataactgttgaaagaaattacagatgacacaaataaatggaaacacatctcatgctcataaatagaattaatattgtaaaattgcattaatgaagaattaacattgtgaaaatgccaaaagcaatctacaaattcagtacaattcccatcaaaatatgaccatcattcttcatagaactagaaataacaatcctaaaattcatatggatcccaaaaagagcatgcatagacaaagcaatagtaagaaaaaaacaaaaacaaaaacaaaaaaaaccactagaggtatcacattacctgacttcaaatatactacaagactatagtaaacaacatgataccggtataaaaacaggcacatagaacaacggaacacaatagagaaccagaaataaacccaaatacttacagccaactgatcttcaacaaaacatacaaaaacataaattggggaaaggacaccctattcaataaatagtgctgggaagtcacatgtggaagaatgaaactggatcctcatctctcaccttaaacaaaaatcaactcaagatggatcaaagacttaaatctaagacctgagtccataaaaattatagaagataacattggaaaaactcttctaggcattggcttaggcaaagatttcatggccaagcaaccaaaagcaaatgcaacaaaaacaaagataaatagatgggacttaaactaaaaaacatatgcactgcaaaatacataatcagtggagtaaacagacagcccacaaagtgggagcaaatctttgcaaactatgcattcaacaaaagactaatatccggaatctacagggaactaaaacaaatcagcaagaaaaattagaataatcccatcaaaagtggtctaaagacatgaacagacaattcccataagaagatatacaaatggccaacagacctatgaaaaaatgttcaacatcactaattatcagggaaattcaaatcaaaaccagaatgcaataccaccttactcctgcaagaatggccataatttaaaaatcaaataataatagatattggcatggatgtggtgaaaagggaacacttttacactgctggtgggaacataaactagtataactgctatggaaaatagtatagagattccttaaaagaactgaaagtacaactaccattgaatgcagcaatcccactcctggttatctacttagagaaaaagaagtcattatatgaaaaagacacatgcacacacgtttatagcagcataatttgcaattgtaaatatatggaaccagcctaagtgcccatcaccgaatgagtggataaagaaaatgtgatacacacacacacaccctagaatactaagccataaaaaggaacaaaataatgttttttgcatcaacctggatggagttggagacgattattttaagtgaagttaactcaggaatggataaccaaacatcatatgttctcacttataagtgggagctaagatacacaaaggcataataagtatataatggtctctggggactcagggggaagtttgtgagatggtgagggattaaaaaactatatattgtgttcagtgtacattgcttgagtgatgggtgtaccaaggtatcagagatcagcactgaataacttattcatgtaaccaaacagcacttgttcccgcaaaagctatggaaataaaaaaaaaaaaagaaagagtgcccatcccaaactagcaagattgcagagaggaattggcataccatatatgtactgctgatagtatcgacaatgttttattcttctataaagcaatttgtggtaaaagccaaaaaaaggtaattcatttattaaaagaatacggttgaatagttttagtattttctaagagttttcagccatcagaattttagaacattttaatcaccccattaaaaagcatatcagcaaccactccccttttttcttatctcacccccagcctaggcaacctgtactctattttctgtcactattgatatagccaagaaaaatttctacatgaatgtttatagcagcactatacataataatcaaagatagtccccttaagttttgccattgtacctgtttcttccttgagcttcaagaaggaacattcctcattcttttcctttatgtcagtgcagcatttctctccaaggaaattgcttcacaaaatcctccctctttgcatactctgagctatttttatatccttgatccagctgagacattcactagtcttgaaactggttccaaataggcaaagagaaggtagtataggttagcattttgagacatggattcaagaaataaacgagcccattcacattctgcctgatatggttagactttgttgtccccacccaaatctcatcttgaattgtaatccccatgtgtcaaaggtaggaggtgattggatcatgggggcagtttcctgcatgttgttctcatgttagtgagtgagttcttacaaaatctggtggttttataatgcagttttccctgctcttgttcccttctctctctcctgctgccttgtgaaaatgtgcttgcttccccttttaccatgattgtaagtttcctgaggtcttcccagctatgcagaactgtgagtcaattaaacctcttttctttataaatcacccagtctcaggcagttctttataacgatgtgagaatacactaatactccacctttgccagttacaagagaaattacttaagctttctgaaattccgttttctcttctgtaaaactgataatagcataatgttctcatagatttgtaacatttaaatgaatcaattcatgtaaagtgcttgtagtgataccaaatattcaaaaagtaaaatgtgttagtgattttatatttttaatttttgtgttgtgtaaaaagcacatatcataacagttaccatcttaaccatttttacatgtacagttcagtagtgtttacgtttatactgttgcaatataaatctctagaacttttttgtccctcagaactgaaacttcttaaaacaactataaccccatagtcccctttcctcagtacctgataatcaccattttacttttgacatctaggaatttgactactttggataattcatataaatggaatcatatttgtcctttttggatgccttatttaacttagcataatgttcttaagatttatccatattgtaccatgtaacagaatttcctgccttttaaagtctgcatagaattccattttatctttataccacattctgtttatccattaaactgtcaatggacatacgggttattttcacctcttggctattgtaaatagtgctgctataaacatggttgtgcaaatacctcttaaagtccttgctttcaaatttttggaatacatacccagaagtgggattgctagatcatcatatggttgttctatttgtaagttttttaagaatcatacttttttccgtagatgttgcaccatgttacaatctcaccaacagtgtacaagggttccgccttccctacatctctgctaataccggttattttctgtttttaaattgtagtcaccctaatgggtatgaggaaatacctcattgtggtttgatttgcatttctcttatgattagtgatgttgagcatcttttcttattggccatttgtacatcatctttggagaaatgtctccttaagtcttttgcccatttttattttttatttttaaattttatttcaatactttctggggtacaagaggtttttggttacatgggtaagttctttagtggtgatttctgagattttagtgcacccatcacctatacagtgtacactgtaccgaatatgtagtcttttatgtctcactacctcccaagcttcccccactacattccccaaagacaattatatcattcttatacctctgtgtcctcacagtttagctcccacttataagtgagagcatacaatatttggttttccattcctgagttacttcacttagaataatggcctccagctccatccaagtcgctgcaaaaaacattactttgtagatatatatctatagatatatatacacaccctgtgatatatatatcacaatttctttatccactcattgggtgatgggcacttaggttgttttcatatctttgcaattgtgaattgtgttgctataatcatgcatttgcatgtgtctgtttcatataatgacttctttttgtttgggtagatactcagtagtgggattgctggattgaatggtagttgtacttttagttctttaagaaatctccatactgttttccatagtggttgtactggtttacattcccaccagcagagtaaaagtgttcccttttcatcacatctatgccagcatctattgttttttgacttttaaattatggccattcttgcaggagtaaggtggtaccgcattgtggttttgatttgcatgtccctgataattagtgatgttgagcattttttcctaagtttgttggctgcttgtatagcttcttatggttaattgtctatttatgcccttagaccattttttgatgtgattgtttcttgctgatttgagttccttgcagattctgaatcttagtctttgcgggacgcatagtttgccaatattttcttgttatctgtttattgtcctgattattttgctgtgcagaagctttttagtttaattagctccatttatttctggttttgttgcatttacttttgggtttttggtcattaattctttgccttagcccatgtctggaagagtttttccagtattctagaaattttatggattcaggtcttagatttaagtctttgatctatcttgagttgatttttgtataaggtgagagatgaggatccagatacattctcctacacgtggcttgccagttttcccagcactgtttattgaatagggtgtcctttccccaatttatgttttgctttgttatttatgttatgctttgttgaagatcagttggctgtaagtatttgggtttatttctgggttcattgttatgttttattggtctatgtgcctatttttatagtagtaccttgctgttttggtaactataaccttgtagtataattttaagtcaggtaacgtgatgcctccagatatttttcattttgcttactattgctttgtctatgcatgttcttttggggttccatattaattttaggattcttttttccagttctgtgaagaatgataatggtattttgaagggaattgcattggatttatagattgcttttgacagtatggttatcttcacaatgttgattcttcccatccatgagcatcagatgtgttttcacttttttttttttttttgcagctgtagtaaaaaggattgagttcttgatttgattctcatcttggttgttgctggtgtatagcagtactcctgatttatgtacattgattttgtatcctgagactttattgaatttgtttatcagctctaggagctttttggatgagtctttagagttttctaggtatatgatcatatcattggcaaacagcaacaattttattttatacttcctgttttccagtttggatgccctttctttctttctcttgtctgattgctgcgatttgcccattttacaattaggttatttgatttcttattgctgcattgtagttctatatgaattctggatattaagaacttatgtaataactgatatatgatttgcaaatactttctcccattacatgggattttttttactttgttgattttttttgttgttgaacagaagttttaaagtttgatatagtgattatttttaaaatgtgctctgtaaattctatgtataacagtctatctttggaacttcatgtatgtctcaggagaaacttctaacttaatgccctgtaatatatgtatagttggttccttactgacaggcatttaagattttctaatattttgctatcaccaacatttcagtacttctctttacatgtgccatttttcatttgtatgacaacatctgtaggaaaaatacctagaggtagaattgcttaataaaatgatttatattttaaaatgttgacaacatatgtcaatttacattcctactgacaaattatgaaaatgcttattttctgacaaacagaaaaatataatacagtgtgtaagcaaacatcctgatttgccaaccaggtaaataaaaaattgtatcatattgttggaattgtatctcattttccttttcaattgcatttctcacattccaagggaaagtgaaatcatttcagaatttgagggccattttttttctataaagtgcttatatgtcttttgtctatttttggagattagctttctaaaaaattaaaaaatatttttttttctgtattaaagaaatcaactgattatagcatgagtggtaataatgttttctaaatgtgtttatctttgacttgttctaggctattgataattatttagaaaattttgagtttgttagttaatttacatattcttaacgaacctctttgtaaaaatcatacatagaaaggctttcctcactttaagatcttttatgaccttctgttttcacaatacatttttttatccaactagtatttacttcagtatgaagtatgcaacacagatccaaagctgtgttgtccaggtatgtatttgcacactacttatgaaagaagccaatcttcaccacccccctaccccaatgtttaatgctttctttatcatttgttgtgttaccatatatattttggtctattaatatttcattggtatatacatttttgaattatattcatatgtacacacccatatgcatacatatgttcatacaccaaaattctatactctctaaaaattctttttatcttattgaagtataattgataaataagaattgtatatattgaaggtatatcttttcttctttatatttagtatagtatactttaaaaaagttgacatatattatttgtacatatttatgtggtacatagtgatgtttcaatacatataatgtatagtgatcagatcaagataattactacatctatcatcttgaacatttatgatttatttgtattgggaacattcaatatccttcttttagttatttgaaactatacactatattattgttaactataattatcctacagtgctatagaaaacaagaacttattcctgtatctggatagaattttgtatcctttaacaaatctatccctattccctcctttccctgaccttcccaccctctaatatcctttgttctactttttacttctttaagataaacttttttaagctttcacatatgaatgaaaatatacagtgtttaattttctgttcctggtttattttactcaacataatgtctcccagttccattcatgttgctataaatgacaggattttgttcttttttatgactgaatagtatttcattgtgtatatataccatattttctttatccattcatctgctgtgggacaccaagggtgattccatatcttggctattgtgaatagtgctgcaataaacatgagggtggagatgtgtcttcgatatattgatttcctttcctttggataaatgcccagcagtggattgctggatcatatgatagttctatttgtagtttttttgaggcatctccatgctgtttcccataatggctgtactaatttacattccaaccgacagcgtactaacattctcctttctctgcattctcaccagcatttgttattttttgtctttttgataataaccccttaattggggtgagatgatatctcattgtggttttgatttgcatttttctgattattagtgatattgagtattttttcatatatttgttgcatttctccgacgattagtgatgttgagcactttttcatatatttgttggccatttttttatgtcttcttttatgaaatgtctattaagctaatttgcccgtttaaagtcagattttttttgttttttgcttttgaggtgtttgagttccttatatcttctagtttttaatcccttgtcagacagataatttggaaatattttctcccattctgtaaattgtgtcttccctctgttgattgtttcctttgctgtgcagaagcttttcagcttaatgtaatcccatttgtctatttttgctgctgtggcctgtccttttgaaatcttacacaaaaaatatgcccagaacaatgtcctgaggcatttcctcaaagaatttttctggtagtttcataatttcaggtcttacatttaagtctttaatccattttgatttggctttgtatacggcaaaagatagtggtctaggtgcattcttttgcatgtagatatcccattttcccaccaccatttattaaagagactattcttcacccaatatatgtcttggcacctttgttcaaaatgggttggctgtatatgtgtagattcatttctgggttcccttttctgttccattggtctctgtgtctgtttttatgctattacaatactattttgactactatagttttagagtatattttgaagtttggtagtgtgatatctgcagctttcttctttttgctcaggattgctttggttctttggagtcttctgtgattccatacaaatcttgggatttttttttctatttctgtaaagaatgttgttggtattttgatagggattacgttgaacctgtatatctctttggattttatggacattttaaaaatattaattcttccaatccatgagaatgaaatatctttccaatttttgtgtgttctcttcaatttctttcatcagtgttttatagttttcctcatagagatcttttactttattggctaaattgattcctaggtttttgctaggaattgattcctaggtctattgctcttgtaataaaagggattgatttcttgatttatttttccaattttttactattagcatatagaaatgctactgattttttgttgattttgtatcctgtaaatttaccaaattcactgatcaattctaagagttttttggtagagtcttcaagtttttctaaatataagatcatatcatctgtgagcaaggctaatttgactcatacctttccaatttgcatgccctttatttccttctcttgtctgactgctctggctgggacttccaggattttgttgaataaaagtggtgaacgtgggcatccttgtcttgttccagatcttagacaaaagactttcaattatttttccatttagtattctgttagttgtggttttgttgtatatggcctttattgttttgaggtctgtttcttgtttgctttgtttgtttgtttttgtgtatgcatgtgtattagtccattctcacacttctaataaagacataccacagatggggtaatttacaaagaaaaagaggtttaatgaactcacatttccatatggctggggaggcctcacaatcattgcagaaggcaaaggaggagcagggcatgtcttacatggcagcaggcaagagagcatgtgcagggaactgctctttataaaaccatcaagtctgatgacatttattcactaccatgagaatagcataggaaaagcccaccccatgatttaattacctcccattgggtccccctgatgacacttggggattatgggagctgcagttcaagttgagatttggttggggacacggccaatccatatcattccactcctggctcctcccaaatcatttttgtcctcacatttcaaaaccaatcatgccttcctgcagttccctaaagtcttaactcatttcagcattaagtcaaaagtccacagtccaaagtctcatctgagacaaggcaagccccttccacccatgagcctgtaaaatcaaaagcaagttagttacttcctagatacaatgggggtgcaggcatcaggtaaatacagccattccaaatgggagagactggccaaaaaaggggctacaggatccatgcaagtctgaaatccagtagggcagttattaaaccttaaacttccaaaatgatctcctttgactccatgtctcacgtccaggtcacgatgatgcaagaagtgggcccctatggccttgggcagctctgtcccgttggctttgcatggtatatcccccatcccagctgctttcatgggttgatgttgagtgtttgcagcttttccaggtgcgcagtgcgagatgttgatggatctaacattctggggtctggaggatgatggccctcttctcacagctccactaggaagtgccccagtggggactctgtggcagctccaaccccacatttcacttctgcactgtcctagcagaggttctctatgagggccccacccctgcagcaaacttctgcctggacatctaggcatttctatccatcctctgaaatctagccagaagttcccaaacctcaattcatgacttctgtgcacctgcaggctcaatatcacattgaagctgccaaggtttggggcttgcatcctctgaagccatggcctgagctgtaccttgccaccttttagccatggctggagcagctgggatgcagggcaccaagtccctaggctgcacatagcaggggggccctggacctggtccgggaaaccattttttcccttctaggcctctgggcctatgatgggaggggctgccatgaaggtctctgacatgtcctggagaaattttccccattgtcttggtgattaacattcaactccttgttacttatgaaaatttctgcagcaggcttgaatttcttcccagaaaatgggtttttattttctattgcattgtcaggctgcaaattttcacaacttttatgctctacttcctcttgaatgctttgatgcttaggaatttcttctgccaaataccctaaatcatcattctcaagttcaaagtttcacagatctctagtgcaggggcaaaatgccaccagtctctttgcatagcaagagtgacctttactccagttcccaacaagtttcttatctttatctgagaccacctcagcctggatcttattgtccatatcactatatgcatattaatcaaagccattcagcaggaccctaggaagttccaaactttcctacatcttcctgtcttctgagccctccaagtctctgggaagttccaaactttcccacattttaatcttctgagccctccaaactgttccaatctctgcctgttacccagttccaaaatcgcttccacatttttgggtatctttacagcagcactccactacccagtaccaatttactgtattagttcgttctcacaccgctgataaagatatacccgaggctgggtaatttataaagaaaaagaggttttctttttccttttttttaaaccaatgagtttaatatcttcggatgtttccttgttacattttagtgtccatttctttaagtttaaagaatgcccttgtaattttttgtaagacaagcctggtattggggaatttcctcagcttttgtttgtcttggagactctttatttcttcttcatgtttaaaggttagctttgctaggtgtagtattcttggtgagtagttctttcttttttccccttggctttgaatatagcatcccactgtctcctggcctgcagggtttctgctgagaaacctgctgaaagccatatttgggtgtcattgaatgtgatatatttctttttctactgcttgagtaatccctctttgtgtttgatttttgctaatttgattatgattgtttttcttgaagatttcttctttggattgaatttgattgatgatatccaagcttcctatacctgaatgggggtgttgttttccagatttgggaaattttcagccattattttcttaaatatttttctctctcctgtcctttgaaatttactattatgcagatgttagtttgcttaatgtagtctcacatttgatgtgtcatcttgactgtcccaagggatgtccaggtagcttgaaaacattatttctgtgtgtatgtgtgggtgttttcagaagaaattagcatttaaattgaagtgagtaagatcgacttcgcaaacatgggtgggcatcatccattttattgaaagcccatataggtcaaaaggtggaggaagggcaaatttcttatctcttctatagctaagacatccatcttctcttgccctaaaccatcagcatttctgattttgaagcctttgtccttgtactgggtcttacactattggcttctctgtgtctcaggtctctgtgatttaactggattacaccaccagctttccttagcctccagtctacagacagcagattatggaattttttagcttccataattgcatgaaccaatccctcataaaaaatctctttccctttctctctatatatcctataggttctgtttctctagagaattttgattaatgcaggagtttattccatttacatttaactaattattatttataaggacagatttactaatttgttgactgttttgtttttcttctaattcttttatccctctttttctctcttgctgtcatagtgtatgttctgccttttttttttttttgagacagggtctcactctgtcatcctggctggagcgcagcattggcatgatcatgctcactgcagccttcaagatctgggctcaagtaattctcttgcctcagcctccaaggcagctaggacaacaggcatgtgccaccacacctggttaatttttaattttaatttttatagagacagagtattaccatgttttgcaggctggtctcaaactcctggtttcaagtgttcctcccacctttgtgtcccaaagtggtggaattacaggtgtgagccactgtgcccagctgttgttttatttttctcttacttgataggctttgattcgtgtctctcttttcttttctgtaacttttatagatattttctttggtatgcttacacaaaatatattatagttttggctggctgtggtgctttacacctgtaatctcagcattttgggaagccaaagtgggaggagtgcatgaggctaagagtttgatacatccatctctacagaaaagaaaagtaagccagtgtaacgtagtgagaccttgtctacacaaatatatatatatatattagatatatatatatatatatattttaaaaatagctgatcatgatcatgtgtggctgttttattagctgcttgggaggctgaagaataattgcttgactccaggaatttgaggctgcagtgacctatgatgatgccattgatgctaccatattacagcctgggtgacagagcaagaacccatctctattaaaatatttacataggccgggtgctgtggctcatgcctataatcccagcgctttgggaggccaaggtgggtggatcacttgtggtcaggagtttgagtacagcctggccaacatggtaaaacccgatctctactaataatacaaaaattagccaggcatggtggtactcgcctgtgatcccagctactcaggaggctaaagttggagaattgcttgaacctgggaggcagaggtcgcagtgagccaagatcatgccactgcactctagactaggcaacacagcaaagctccatctcccccacccccgcaaaaatatatatacatatatatatttgtatatataatggttttactgtgtattttaagacattaacaactcagcatcatttgcatataaaaactgtacatttttgcctcttcaccttgatggctcattgtgtactattaatgtcacaatttacgtctatttatattgtgtatccattcatataatttagttatagttatttttaatatttttttaatttttatgctattattaaaagtgtttttccatcaccattacgatgatataatattctgattttgcctatagatttatctttaccaatgagttttatactatcctatgatctcatgctgccacttagtgtcctttcactttaatttgaagaacatcttttagcatttcttgtaaggcaggtcttgtgatgaactcccccagcttttgtttgcctggaaaaatctttatgtctccttcgtttctaaagagagttttgctaagtatggcatttttagttggcagattttttttttctttcagcacttaagtatatcatcttattcccttctgttctgcaaggtttctgctgaaaattctgctagtagttttacaaagattctcctatacatgtcatttttttcttgatgctttcaaaattttctttgtctttaatttttgacaatttgattatgatttgtctctgcttgggtcattttaggttcatctgacttgatgttctttatgtttcctggatttggatgtctatttctttctctgggtttgggatgttttcagccaatatttctttgaataattgttttcccctttctctttgtcttctccttcaggaactcccatactatgtacagtagcctgctttcttgtatcctttaaggtccttaagctatcttcactcctttttattcttttctctttttgcttctgtcagtcagtgatttccaataacctgtgttttagtttgctgatccttccttctgcatcatctaatgttcttttgaaacctctgtattgaatttttcagtttggttattgtatccttcagctgtatgatttttgtttggtactttaaattattttctgtctctttgttgaaattctcactgtgttaaacccttgctctcctagccttggcaagcctctttatgagaatttaaaaaaattctccatcagattaatcatacacctctatttcattagagttggtttctgtagatttattttaacttttatttgaaggatgtttccttgtttttttcattttctttgactctcatgttggcttctgggtattagataaatcagccacctttctcagtgtattagtccattctttcactgccgtaaagaagttcctgagactgggtaatttataaagaaaagaggtttaattggctcatggttctaccgactgtagagaaaaattagcagtttctgtttctggagagatctcaagaagtttccaatcatgagggaaagcaaagggagagcaaggtgtctcatatgtcaggagcaggagcaagagtaattgaagggggaggtgcttcatacttttaaacagcctgctttcatgagaactcactatcatgagaacagcatcaagggtatggtgctttaccattcaggagaaatccaccccaacgatgcaaccacctcccaccagttcccacctccaatattggggactacaatttgacaggagatcttttgggggacagatatccaaaccacatcactgcatcttcacatactggcctaataggggagatgaccctcttcagcctgaccagagatgctcagtacttactgaagctttttgctctcccaaacccacgatatttgttcttatcaacccccaggaaactagagcatgctatgtcctgtcagtggcctaaaacagatgagttgcaagccacactgtcaggcagcagttggaaaagttaaggtggggagaggccagatgggtagtatttcaaatctttctaagtagaagctgaagacttctgttttattgttggagcaatccagggggatgagccacagagtgcttacatactcattcacactcttaagaggattagcgattgccttccctatagctactaaagataaagacaggctagttagaaaccaactttgggcagcagccagaaaagttaatacattagatgtgtagtctaatttctttgaggaagaagctgggagctggaatttattgtctatttgctctgcattgagccaggaggaagtgctacaagaagtgttcgtgcatccattctaaactacctcttttttctttgttggttgaggggactaatgaatgctaggctgctaggtcacagagacaggtgagttaggaaccagttgctcaggcctcagctggaaaagttggggcacgagatgtgacttgcaaactcattcctcttcagttggaatttagtagttccctcctaattgtatggcactgtgctatggatggggtttatggcaagagtgtgactcagcttttcccatctgttttgatatcactgtcctctcagtcaccccatgtgcaggagtctctcaattagtttctgtatatttcacagaggaaattgatctatgtgtactgtttattcaatatgtctgtaggttgagggaaagtatgaagccacgtattctgccaccttgatgatgtctctctctctctctctctcattctaatttaactattgtagtttttcaatgtcgtaatacctggaattggaaacattctctactcctacttcagtacctttatttttcagaatttcctggctactcttttttgattatttttatatgaaatttagaagcagcttctgaaattcaaaaaatattgtctaactatttttattgggataaagttaaaatttaaaaattaaagaatattaaactatttacaaactttaatttttctttccagggacatgatatgtctttctacataattgcctcctgttttgtatccatcagtggcattttaaggttttactcatatcaagctaatatattttgtattatatttattcctgatatttgttattattttaaattgttattttaaattggatattttttcattacatctgctaaactgttgtttgaatatataaagcctatttatttgtatattagtattatactggttgtcttgctggtgtctgaaatagctttttagctgattctcttgcattttctagataaacaattttagtatctactaataatgataatctattttttccattccaatttttatagtgcttactctttctgataatgtgtttgcattggctaatgtcttcacaataatgattcccctccatatgttgccatgatttgctctcttacttgctttaagtctctacccaaatgttatcttaacagagacgatactcccgatcactgtatataaaataacgatgttacaccctttactccaatttatctcattccatctctattaccctgctttatttttcgtccatagctgtttttcccatctagtatttgtttatgtatttattggttttttcttaatactgtagtctctatgaatgtggggtaattgtttttatacaaagatttgtcttctctgactaacatgatggttagcaccagttggttctaaataaatatttggtgaatgaatgcctgagtgttaaacaataatggtggtaaagaatatcttttacttattcctggattaatgggaatgtgtctgttgtttctctattgagtccaacgctagtagttcatatttaatgtttatataaaacatattttctttaatctcagtaaaaaattctcaaaattgaccttcattttaaattcactggtttattttttaaattaaacttttttttttcctggcatttagtcccacttacccacgttcacagactgatattagtatgtgagccttaaaaatttgataattgaagtttgcggtttggctttgagtcttactagtatatcattgctttgtgagcttaaccttttttatcaatacttttttgttttgctccattttgaatgtaacacatgtaaagagaagtgcacaaggtataaatgtatagctcaatgactgaacacaaaacaaaactcataaaaccactgtccaggtcaaaaaaatagagcactgccaaaatgctaccagtatggattatatcccttcccaatcattactgcctctgcacactgtcttgatttccaatgctgtaatttagttatatttgttttagaactttatagaaataaaaccatacaatatgtatttttgcactgtgttcttttactcaagatgatgcaattctttataaaatttattcatgtttttacttattgctctagtttcttcatttttatggttgtattacgatattgcatcgtgggaataggctacttccagaattaccaaacccctctccctacaccttcaacagggataattcttacttgctgttagttcctttttcctttccccttagagagttttctggctttttccccctgttcactctaattattgcttcttacttttcttttattattaacttttcaaggcccgtttaaaatatccttagcctttctgctcttaatcaccctgtccttgttccattttcttctccacaaatcccgccacctcactcagaaaaattgaacacataatattatgaagaaggagaaatcacagcaatcacagtctaaagtagtatataaataaactgttaattttcatttttttaatttactgagaattttttcacaggaatatcttagatttaaaatggtgtttgtttttctatgactttatttttgagtgacacgggttagctctttttagcttcattcttctaagtttgctcaccaaagttgtgtgtttggttttttttgagaaggagtctcactcttttggccataatggagtgcagtggtgcaatctcatctcattgcagcctccgccttccgggttcaagcaagtctcctgcctctgcctcctgagtagctgggattacaggtgtgtgccactatgtctgcctaatttttatattttttagtaaagatggggtttctctatgttggccaggctggtcttgaactcctggcctcaagttttatcctgcctcagcctcccaaagttctgggattacagatctgagccactgtgccctgcccccaccatagtttttaataaaaatatttctgatgatttaggagaattaaaagcaatttagaaagtaaaactatcttacttagatatgtataattagatatttaaagctttgagtcacataagttattcctctaggggcatatcttattttttcattgatgcttaaactgaaaataaataactcaaaatacatttgttactatgagagtggcactaacttcaaatattatctcaaattttctgatcaattttaatattgctctcttttagcagcaggaataacttgaagtgttaatctaaatttagatattaacaatacttatctacaacaaacattttaattaacctacttattctactaatagcatcactcaattttgctttaaaaatgagagttctctctgacaaaaatttgctggagtaattttctgtagcaaatggatagaaaactgctagccctatttggttggtgccaggttttgaagtaatttaattggggttgttcttaagtttaacctgtcaataatatgcagggaagattctctagtatctcaaataaacaaagataagaaaatcagtcctctcttaaatagcaaatggactctcagagcaatagcatttacattaatctacaacttagttataaagtgtgtttcaaaaacaaatagaaacaaagttattcaccatctgcacacctgaagaatattcaaaagtaaatgacaaagcaatattttttataatactatattttgaaatgagaaaacaaactgcttttcgggaaggagagttgatctttgatttttttttaaattctataatattttatttcttcattttgctttgttttgttggtattttttcttatatataatagttgtgcgtattttttgggtacatgtgatatttcaacacatgtatacaatgtaaaatgactagattagggtaattggggtatccatcacctcaaacgtttattctttgtgttgaacatattacaattcttctcttctagctattttgaaatatacaataaattattgttaaatataaattccctactgttctattgaatactagaacctaatctatctgtgtaaatgtactcttatacctatgaaccaaatcagtcttttatttatttttattttcttttaattttttgaattggagttttgttctgttgctcaggctggagtgcagtggtgcgatctcagctcactgcaacctccgcctctcaggttcattcgactttcctgcctcagcttccctagctgggattataggcacccaccaccacgcctggctaatttttatatatttagcagagacagggtttcaccatgttggccaggctgatcttgaactcctgacctcaggtgatccacccctccatggcctcccaaactgctgggattataggcgtgagccacagtacccagcctaaattagtcttttagatgtcactactattggttgatttattttgatgttacaacacagataaaataacttgaaaatttctttcttattgagtcataacataaatctataaactaaattaattctttaaaaagatatatataatttaaattattaacttaaaaattataaacagttatttttccttttgctcatcataaaacaaaataatttttcagtgtgcactaaagtgttttaattgtgtgtataaatctatgcttttatacaaatacatatatgtaaatgtaagtatttcgtaggaaaactagctgtgaaatgtttcacgtgcaaaaattaaacactatacatattctagttaaatctctttggagtggataaatcacaagacgcctttctttttttctttctttctttttttttttttgaggtggaatcttgctctatcgcccagtctggagtgcagtggcgcaatcttggctcactgcaagctctgccacaagaggcctttcttaatacagctattgaggtgagaaattttgagaagctttcatttaaataaacccattgaaagcatatttgtctgtgtactctcctaagattacattaaaatcatagacaagaatttagagataaaaattcacaaggaaaaatagaatgagagggagacaacttatttattaatgttgcaattgttattttgggcatttttgttttaaatttagagttgccatacttagtgagactgggagacaagcattatttttggatgaatttaagcggttggaactacctgcaaaatggaataagcttccacctaacacatagtttccttttcccgttattcctcagcaattaatcagagatggaatcttcacttatgcaaatgctgtttacagggcattcgattagtatttgtgtttgtgtgtgtatgttatggagcatggattggagctgggggttttgagggaccagatgatgttgtacctttttatcccattgagtatctgtgattcaaaaactttacaacccctttcttatttacaaacctagtatattctgtggtgttattattttaaaaatctgaactatcatctttatgataattaatagcaactaggaaatttaagaaaaattttgagtaactactattttttatttattattttgtctcttatagaagcagtacaatttgatgattgtttcaaatgaaaacaagacactttcaattaacttacataggtacttgaattgtgttggatttagtgctgcagctttcagtttactagcaaatgcttgtgctgtacttttatttttttattttactttttgcaatttttttttattatactttaagttctagggtacatgtgcacaacgtgcaggtttgttacatatgtatacacgtgccatgttggtgtgccgcacccattaacttgtcatttacattaggtatatctctaatgctatcccttccccctccccccacctcacaacaggccctagtgtgtgatgctccccttcctgtgtccatgtgttctcattgttcaattcctacctgtgagtgagaacatgtggtgtttggttttctgtccttgtgacagtttgctgagaatgatggtttccagcttcatccatgtccctacaaaggacacgaactcatcattttttatggctgcatagtattccatggtgtatatgtgccacattttcttaatccagtctatcattgatggacatttgggttggttccaagtctttgctattgtgaatagtgccacaataaacatacatgtgcatgtgtctttatagcagcatgatttataatcctttgggtatatacccagtaatgggacggctgggtcaaatggtatttctagttctagatccctgaggaattgccacactgtgttccacaatggttgaactagtttacagtcccaccaacagtgtaaaagtgtttctatttctccacatcctctctagcacctgttgtttcctgactttttaatgatcaccattctaactggtgtgagatggtatctcattgtggttttgatttgcatttctctgatggccagtgatgatgaacattttttcatgtgtcttttggctgcataaatgtcttcttttgagaagtgtctgttcatatccttcacccactttttgatggggtttttttttttttcttgtaaatttgtttgagttcattgtagattctggatattagccctttgtcagatgagtagattgcaaaaattttctcccattctgtagttgcgtgttcactctgatgggagtttcttttgctgtgtggaagctctttagtttaattagatcccatttgtctattttggcttttgttgccattgcttttggtgttttagacatgaggtccttgctcatgcctatgtcctgaatggtattgcctaggttttcttctagggtttttatggttttaggtctaacatttaagtctttaagccatcttgaattaatttttgtataaggtgtaagcaaggcatccaattttagatttctacgtatggctagccagttttcccagcaccatttattaaatagggaatcctttccccatttcttgtttttgtcaggtttgtcaaagatgagatggttgtagatgtgtggtattacttctgagggctctgttgagttccattggtctatatctctgttttggtaccagtaccatgctgttttggttactgtagccttgtagtatagttcgaggtcaggtagcatgatgcctccagctttgttcttttggcttaggattatcttggcaatgcgggctcttttttgattccatatgaactttaaagtagttttttcctattctgtgaagaaagtcattggtagcttgatggggatggcattgaatctataaattacctagggtagtatggccattttcacgatattgattctttctgtccatgagcatgaaatgttcttccatttgtttgtgtcctcttttatttcgttgagcagtggtttgtagttctccttgaagagatgtgctctacttttaaacagaaggcacaaaataaaaaagaaaaagtcagtattttaaaagctagaaaattaactagggtgattttctgtttagagttggttaaacctagtttgaatcccaagtttgctattttccagttgtattaccgttagcacattgtttatccttttttcagtctcaggttctttttctgtaaaacgaagaaatgaagtagaagtagaatctactgaagggcttttatgaatatttaatgagattaagcatgtgaaggatttaccacattgccttgtaaatgcttaattatcattggccattaataataggatgatgttaacattgtagacagtcagccccatgcataacagatgtgacctatgataagtcatataacataccttaataaaggtctagagctaagaaccatccggaaaatctcattcaatagactttccatggaattctgtaaaaacgtgggtaacaatcagtttctcacttttcccaggaaaatgccaaatagattaaacatgtaaagataatgtttcctattttgacattgtcctagagaggctaggtaagaggcagtgtctgttctagaaaacctgtttttctatatccattcagttatgtaagtagctattgttagtttacatcactgtgcaggggtttggctggcataacaagatgctgaagtgttttaaatgcatgagcctggtattcctgtgtgactaagtgcattgtttactaatgacattaagtgtagggtagctcatttaaaaattggtgtattgtataaaatgaacccgatttaaaataagaccatgtattttatttaatccaaaaattaatgttcctgaagaaaatgcaaaccaattttaacagttactatgtaattctgataaaaatatctggcaaaaatgatcagcaattacttactgttaagcctattctacttgtactgaatggagagagatttaaaaaaattttaatttaaggaatatgtaatagtaggagcccagaatcataatgttcacagagagtaatggtttattaactacaattcatatatcctgagactagatgtgatttccttttgagctttgacataaaaaaagcaacaagcagtgctagtttgcttgaaaagaaactgacttctgttgtaactcgctgctgtaaaacatttttttttccagttaggcaaaaaaagtaggaataatctagcaaatggtttcaaaaggagaaaaaagtaccaatacttagagctgttaatgttcagcctcacctcagacatcaagttttctgattatatgtaatgcaaaaagcatattcatagaaataaaacaaagaggagggggaaatcaattatttcttcatatacctttttaatcttgcaagcttaactaatgacacactcagaaagagcattcttcataatgggtataaaaatggcctaatttgagagacaatgtatctggcatgcatacccagtaggtattcagcaaactcttgaggtttcatgttaacataataaaatattgtactgttcagcaaactcttgaggtttcatggtaacataatgaaatattgtactgttccttgtaggctaaatttttctttaccttttacaatccgtagcctaataatattttgttcaactgtacctgcgtctaaatttgaaattactttgctgaaaattgtagatgtactgttctgaagccactaaacttttccttttccttctcatcacaacctcatccaaatcttttattattagtttttagaatacacaccataaacattaataaaactcacttaggcatagctattttattcaggtgtcaggaaaggtgtccacctttgttacagtgttgacaatttggtttaacttcttcagcctcttcaataaggaaatgttggaatcaaatgtgattatacttgtgttagcctggtaatcactctgaggtgtgtggcttaatttaatttaaaaataagttgttgtgtgtataggggaagggcatttgggacagactcttgatgatttttcacaaaagtcaatgtaatatatatttataaacctataacttaaattcttaaatttgtatatctgaaggattcataaattttacattctcagatcctcacctaatgatatagtatttttcagattatatttaagtttttaatatgaaaaatttcaaacacaaaaaagtagaagagtaaaataaatcctcacatatttatcactcaattttaacagttactgagactttcccgagattgcttcaacattttacttggtagaagtattttacataaacttttcttttctttttttttttttctgaagaataacaaatataggaaaagtcccatataccataagaacataccagtataagcatctacatcaagaagcagaacatcagcaaaacgccaggatttctaatgccccttttgggactgttaaaaacgttagacagactccgggcacagaggctcacgcctgtaatcccagcactttgggaggccaaggtggatggatcacgaggcaggagatcgagaccatcctggctaacacagtgaaaccccatctctacttaaaaaaaaaaaaaaaaaaattagcccggcgtggtggcgggtgcctgtggtcccagctactcgggaggctgaggcaggagaacagggaggtggagcttgcagtgagcagagatcgcaccactgcactccagcctgggcaacagggcgagattccgtctcgaaaaaaaaaaaaaccaaaaacaaaaaaacaccttagagaaactaaatttaacagaccttcattgaacaaagaatgactcgtggattgggcagccccccgaacctgttttcacttcagagagattccggtgctatcgtgtgtggtcaaagaagatttatggctagaaaaaggaaagagacatacagaaaatagaagtaaggtacagaaacagtcagattggttacagatcagagtttgccttatttgaacctagcttgaagagttggctacctttgattggctgaaactcggtgattggcacaagagtaggttacagtctgtttacacgtgcagttaggttatagaaacctttaaatgaaagagacagctttatgttaaacttaatttaacaggctcagaaaacaatacataaaaacatggcacttttacatgctgaactaaagcggcagcctcaatgtctctatgaccttgccccgatcttctgtctctcaattttctccttcccaaaccacaggacgaaacccttctctgaaattcccttatctacctaaaaactggacccaccaaatagcaacgcatttgccttcgatcccctccctgaaatttcattagatggagaagaataaaactcatatttcagaggaagagactaagcattaaacagcacacccagggcccacacaaactttgtccaaaactattacctgttctctggtcccattcaatttccaaagagaatcacttacttaaaattgtttgagcattgggctcgttcattttccctgaaaatcatttactacctctcccaattgcctaaactctccatttctgtctcctctacgaagagtgtatgtaagcctcaaccatctggcccttcttggagtctcatctttgcaggaatccatgtccatatgtatgttaataaatttgtatgcctttttctttttaaaatctgtctattgtcagtaattgtaacagatcttcagtgggtggagaagaagctttctctccatccttacacccccctcaccatttaactccatccagatacctccatcactattcccaacttcaggagtaaccagtattatgacctctatcaaagcagattagttttacctgttttggaaattgtatataaattaaattatatagtatataattttgcatctgtcttgattcgctcaacattatgtttatgagactcactcagctgtagtttgttcattctgttgtagtatagtattcaattgaatatatagaccaccgttgatccattttaaatctgttgaacatttggattatttcctgtctttggtattagaaattgtgctgccgttaacattcttgtgtgtgtctttggtgaaaatatgtatgcatttctggtctgtattcatttgctaaagtagcttacagcaagttccagacattgttattttattcttacacatgagcatattttagtatgcatccaagaagtatgacatcttctcacataaccataattgcttgttaccatctgatgccttgtcctttattatttaaaatgcactattaaatggggaaatctcttttcttcagcatagcttttgaatatagcaagctgaaaatattgaagttgaaatactccgaagctgacagtagttttctttagctttgatagacaggtcagtcaaataatcaacaagtatttattgagctcctttttggtggatcaactaagtcatgttcttagctctattcacactcctcaatacactgacagaccaaatggaatttaagcggagaaaaccattccttttgataaattgttagtcatataattgtttatattaggtactacaaaataataattcaactcataaagaaaatggactgtggagcatattttaataaagagtgactttaatgaagagtgacttaagtgacatttttcctgtagtgaatgttatagctatatgattcctggcaaatatttagaataattagatattatattacataagatgtataaatataacaatattaatttaagtataaattaaagttaatatgttattataattaaataattaataatgaaaacatttaaggggttttcttatgcagatcctgcgtttgattttattttatgaacataatatcaattgtaagaggtgattttttcgcttgggatctatgacgaatcaaataatttgaaatatctttgcttgtattctcttggtttacgttctcagatgggacaactcttttgttaatagaaaacagtttttttgcctccaattttctacataattttttattctaaacactgaaaattgtctcacagacctggccttaagttctgattttccagcgtactagctctgtgatcaagatcaagcagcaacttctctgaggcccaatttccttatctaaatcatatggtgataattccttcctctgttttttgcatatttatttataaatgttttactatatattaagaagtttcttctagaggctcacaatgtgtataagaattcttttttctttcttttttttttttttagatggtctcactatgtcacccaggctggagtgcaatggcaaaatcatagccaaagaatcctcccacttcagcctccagagtagctgtgactacaggcactaagcctggctagtttaaacaatttttttttttttaagatgccggatctcactttgttgcccaggcttgtcagcataagaattcttagcatgatactttaatagctacaatttcaaaaatcaaaagaatagcaaaactacagaaggactagtcaaactttctgctttcggtttgaatcttttttcttggacttttggtcactcaaaacaacagaagcaatgacaacaacagctatgatttactgaagctcactatataccaagtactatattcattattttgtgtaaaatatttataattttcacaacaatgctgtaaatggtatggcaataattaataatagtaacttataccttgattacaaatgaagacaccaaggcttagagaatataaataattttttcattgtcacatagctggtaaatagcagaagcagtttccaattccttttacttttatttgactaggtcaagatttcttttatacaaagtaaattcacttttcactattatctttgcaaatagaattataagctctatgatgtagttatgttaactttcagtaaatttttaaagaaatgccagtaaataatgctgttttaccaacagcattttaccaacagtgccatttcactccgtgagtagtttcagattgtaaaaaattaatattcttcctattaatgtttgtaaagagagcctaaacaatttagaaaaattttatattaaatataaaatgtgtatattttcaggaaattatttttacaaggtaatagctttaaaatatagctacaaaataattggtttaatattaactaacttgattcatcttttgtgatacattggggcattaattagatgcacagaaggcgtcaagaaccttgactaactgctatgccacattttatatggagttatcaatgtacaggatcttagcattcattttaaagaaaagtatcattaaaggctctgttgcaaaatgtctgcttacgtaatgaggagtcatgtgatctgcctattcagaaatcacattgttatttatctatattctcatcagtctaatatcaaattatatttcatccttcccactttcttagatgcattcaatataaagaatgatggaacaactcaaaatgcttgaaaacagttgccactttgccttatacattataattatagctctagtctcttttctgattaaatattgagtttatagctaaacacagtggcaccagtatctaatcccagctactcaggaggctgagatgggaagttcaagaccagcctgggcaacatagcaaaagtccctcaacaaagaaaaaaacaataaactgaaaattacttacttctcatgtgttcaataaaatattagtattctaaacttaataaagattaccatgtggaaaccatattatttcttggaggaacaattaatgttttctagccctgcttgtctgcttccttgccatggtcagtgctttcaaaggtccccaagaggttggactgtgtgtgttgtgtgtgtggtgtgagggatgtgtgtgtgactatttttgtttgtgggaggtaaggggtaggatggagtggggatgaggatgtgataatttgaagtggctgttaattttaacttgactgcattaagaaatatctagagaactgatgaagcattacttctgggtgtgtctgtgagggtgtttccagaggacattggcacatgaatcagtggaccaagtctggaaaatctgccctcaatgtgagcagataccatccaattggctgggggcctggacagaacaaatgggatgagaaagaatttcctctccctttctgcctctctctctctcctggagtttaaacactctccccctcctacctctggacattgaagctccagactccagcattgggacttcaggccttacaccagcacccactgggttctcagatctttggtctcaggctgagaaacatactcttgtcttccctgattgtggtgctttagaacttggggtgagccatgtacccagcaccccaggctctctaccttgcagacggcctcttgtgggacttctcaatctccatagttgtgtgaggcaattcccctaataaatcctctacctatctatcatctatctatttatttaaacatatatcatattggttctgtctctctggagaaccctgactaatacagagtgtttttgtgggaaagaagtgagagaaaaacagaatacatcaaagacaggaactttcaaattagtgttgctaagtgtacagaggtacttcttctgaggtaaaactttcccatcatcagaaacttgaaagcctaaagaactttgctcaatatattgtgtaggggatttggatatttggatttaatatcaaggccacttacacatgtaagagtctaggaattcatgattctaaatgataggaaactacttagaggtctttggctggcaattatgaattagattaagttcaaagagggaaggtttttatttttcttcttgcatggctacaagagcagtttcaaacacatgataataacagttctttgtcttacaagatgaaagtttgattctactctccattctctattatcaagagtaattcaattaaaattttatttcaagctcatcttctatcagagttttgtctttggtatgcttgcattctaatatatcctatataagtcattcaaactggtgagcatctcatttggcaaaaagaatgcagttgtgtttttcataaacagcagtttggaaaactgggtacagagaacaaactgttcacttagcattgcagttactttgttctatttctctgtgatatgctctaattttattaccataaacaaatgataggcatagggatagaaagtggagtacaggccatatcctgaattggctttcaattgtgacttgttctgaatccattcgtacattcaagaatggctattctgaaattaaatttgcttggcatatctaggctatcattttcttttgttttatggagcttatcttcgttctgtgggatgatataattcaggtctagttggtcactctatcatttcagttggtgaagcttttcctcatggagattttattatgtttaggaactcattttctctttagctatgggatgaatgtctgtcattaacatcagtttttcctcaattttcatctttgtgtgacctgcatcagcatcacctgggatcattgttataatacagatttcaaaacagacatatggaataaaaaatgcagatatcttgatttttaactaattgcccaggtaattcttatttaacctaacatttaaaaccttgttcttctaacttattacatatattctcccaatttcactagtttctcaaagaaaggtccactacttttacatagcctggctcctttccctcagtcacaggttttcctcactgaggcaagtccccttgttgcaccataaatctttcctcctagttgccaggtctagaatctaatgtctcaaaagaatactttgatggttacaattattgatcaacttggctaggctatggcacccaattgtttgctcaaacattagtctagatattagtcaatggaagtattttgtagatgtgctgaagatctataatcaggtgactttcagtagattgacctagataatgtgggtgtgcctcatccaattagttgccttgaaagcaaaacctgaggtttcccagagaagaagaaattctgcctcacgatggacatagaaatcttggctgggtttctagcctgccctatggatttcaaatttcagacttgccagtcagtcacataaggtaaagcaattcctttttatttttttaaaatagagattgggtctttctatgttgctcaggctgttctcgaattccctttctatgttgcccaggctggtcttgaactctgggctacaagtgatcctccctctttggcctcccaaagtgctgggattacaggcaagccattgcacccatctgtaaggcaattccttaagctccatctctctttctttctttcactagaaaaccttggttggtacaaatactttcagttgtccatgtgacgctcatatttaggagcccatatcctcaagaactcctttgcaggtccctcagtatgtgtttatataaccaatagatctgtcttctgtcttgaatcttaaattattggttgcctcccctcagctggtctctaacacaaagccttatggagaacaatgaattccttccagttcatctaattgctaattattgtttgctacctgtactacttcattctgatctccgtttaatagattgagatcaccaaagctgtacatgtaggaaatggcattattcacttgactctacctttataatgaaggtagtatccccaggaccttagttattttagaatacaggtatttcagattctctctgctccccacccttttcccttgtcttctctgattttcccaagcagatcattatgccttgactctgagcactgatttatcaatataaatatccttagtgtgatcaaatagttatattgttattatttatttgtatgtttattattaccttgttccatgtcaaatttatgtctcaagttttaaaaaaaattaaatgtaatgagatgagatagtgagatgagaaaacattttatcttaacaattattggcctcagaattcttctcacagtgagaagagtttcagggtaaaaagctcatttgtgacaaattgtactttgtggcaaggatttggcagttgccaaaaccatatgttatagtggtaggcagtattacatagtggctcaaaggacaggctctagaatcagaccgtatgggttcaaatctcagctctgccactaattagctgtgtgaatgtggaagaatcactagatcttctagtttcctcatcagtaataaacacaataatattaacagttacttcctagggttgttgtgaaaaataaatatgataatacttgtaaaacaacacagtgtcggaagcacatgaagtactcaataaatgttagctattatttttttcattatcagaagagggaaagttgctctgcacaagacagagaagagaaggggagaggaaggcagggattctggagagttggggaaaacctgtaattatattacaatagtaaagtggcaaaagagcactcaaaaatagttcaggcttaatattctttgggaaattgaatagctgagatagaagctatttcctatctcctccttcaaagtctactaaactcatgaatgctttatgccatctgtgcgtgtgtatgtgtacattgaagagagtgatgagtttcatatctagattcaagctttgtgtaatattgtatacatggcagtgcaaccaggatggcaaaagtggttctgagaacatcaacccttcaagaatttgttgtaatttttggaagtgtttttatgggttagaaatcagattgtaagcagatacggaggttcttcagctgactgtaggaattcatccaccttgagcaatctacctgctttatagcatcctatcctacaggctgtcggttttcaagccctgtgtggtatgtgtccacctagtcagttgaaaccagttcctgacagacccatttatacatgaacctgagtgaactttcctcattgccatgctaaagtttccatcccaggaccagctgtggcttcattaccataacatgtgacctatgtgctggcatgatgactcaatgcacctgtgcaagtgggacccctcctctctatgcaacgatgcaccctctttcccgctccattgtcccataaaaccctcctgtcacttcccctcagagagacactgctttggagaatagttccagtgctctccttacttttgacaactaataaaactattcatcaaaacccatgttcttgtgatgagtcacttgttaacaggagaaagaaccttggttctttttgggtaacaagatcaagccaagtttgctcagttcaggacgggggacccccagataatatcttggttaaattcatatttttaaaattgttatcgtaaaaataggacatgctccttgtagtgctccatattagtcttcgaagggtgtcataaattagcaaagactagcactgtaaggttagctactactgcaacagtcactaaaaagtaattttaatatttacttgcatctatagaccaaaaatgaggatcaaatttatattcccaaactatactttctaaaataccttttttttaaattttactttaagttctgggatacatgtgcagaacgtgccaaataggtacacatgtgccatggtggtttgctgcacctcttattgaccttgttatttctctgaagactcttaggaaactcccaaaaccttcccagaaacccagatctttggatcacttatctccccctcccaggtctttgttatgtgttaggttggtgcaaaagtaattgtggtttttgtcattactttcaatggcaagtaagtagcatagcctctatagctaaggaagctctccattctctcattcttacacttttgcatcacaaaagaacaggtccagcaaggaaggaatcctcatgagaaagtaggaatggagaatccaaatgggcaatgacaaaactatctttcgtaggaaaagagaaaaggagagaaaaacagaatacactctcacataaaaaaccctttttttcctggtgatatcaaaaaatgtaaaagaaaaagaatcacctggaatctaatcacctatgtattttaagtttcttgagagggtctgagcttcacgcattaacatggattaatgttaatcattgtttgatagtatgttaatattaaatatataatgtaagccatattttaagatactaaaatcttaaaggatactaacaaaattgggccattaatatgctaagaaggacagcataagaaaaagcaattacaggacaatttctctaatacacatatatcatatatgagattatgctagcctcattaaataatatagggattataacctctatttctattctctggaagacttggatatgattggaatgatttattccttgaatgactggaagtcttcattcgtgatgttatttgggtctggagttttccatgtggcaagatgtttcatttcggattcaatttctttcatagcataagactacgcaggtcattttatttttgcctaaatcagtcttataatttgtactttctagaaaattttcatactcatctaaattttcaaatgttttggcatgaagttgtttataatatactcataagtttttggaatctgcattatctttaataattcccttaactgtgtcttaatagtagcaatttctactagtttattgttcctatctatttaattctggaatagaaagggaacagaattcaggtagcatgatgcctccagctttgttcttttggcttaggattgactttgcaatgcgggctcttttttgcttccatacgaactttagttttttccaattctgtgaagaaagtcattggtagcttgatgggaatggcattgaatctataaattaccttgggcagtacggccattttcacgatattgattcttcctatccatgagcatggaatgttcttctatttgtttgtgtcctcttttatttcattgagcagtggtttgtagttctccttgaagaggtccttcacatcccttgtaagttggattcctaggtattttattctctttgaagcaattgtgaatgggaattcactcatgatttggctctctgtttgtctgttactggtgtgtaagaatgtttgtgatgtttgcacattgattttgtatcatgagacttcgctgaattgcttatcagcttaaggagattttgggctgagatgatggagttttctaaagatacaatcatgtcatctgcaaacagggacaatttgacttcctcttttcctaactgaataccctttatttctttctcctgactgattaccctggccataacttctaacactatattgaataggagtggtgagagagggcagccctgtcttgtgccagttttcaaagggaatgcttccagtttttgctggaggcatcacactacctgacttcaaactatactacaaggctacagtaaccaaaacagcatggtactggtaccaaaacagagatatagaccaatggaacagaacagagccctcagaattaataccacacatctacaaccatctcatctttgacaaacctgacaaaaacaagaaatggggaaaggattccctatttaataaatggtgctgggaaaactggctagccatatgtagaaagctaaaattggatcccttgtttacaccttatacaaaaattaattcaagatggcttaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactcaagaacttctgcatggcaaaagaaactcccatcagagtgaacaggcaacctacagaatgggagaaaatttttgcaatctactcatctgacaaagggctagtatccagaatctacaaagaactcaaacaaatttacaagaaaaaaacaaccccatcaaaaagtgggtgaaggatatgaacagacacttctcaaaagaagacatttatgcagccaaaagacacatgaaaaaatgctcatcatcactggccatcagagaaatacaaatcaaaaccacaatgagataccatctcacaccagttagaatggtgatcattaaaaagtcagaaaacaacaggtgctagagaggatgtggagaaatagaaacacttttacactgttggtgggactgtaaactagttcaaccattgtggaagacagtgtggtgattcctcaaggatctagaactagaaataccatttgacccaggcatcccattactgggtatatacccaaaggattataaatcatgctgctataaagacacatgcacacgtatgtttattgtggcactattcacaatagcaaagacttggaaccaaccctaatgtccatcaatgatagactggattaaggaaatgtggtacatatacaccatggaattctatgcagccataaaaaatgatgagttcatgtcctttgtaaggacatggatgaagctggaaaccatcattctcagcaaactgtcacaaggacagaaaaccaaacactgcatgttctcactcataggtgggaattgaacaatgagaacacttgaacacagtatgggaaacatcacacactggggcctgtcatggggtgggaggaggggggagggatagcattaggagatatacctaatgtaatgatgagttaatgggtgcagcacaccaacatggcacatgtatacatatgtaacaaacctgcacgttgtgcacatgtaccctagaacttaaggcatatatatatatatagtcatcttaaaaaaaaaaagggaacagaatttcctttctttctttcataccactctgtaaaatgtctactgccttttaccctgagaatggcatggtggattaaagatgaacatattgccaggtgcagtggcatgtgcctgtagtcccagctacttggaaggctgagacaggaggcttgcttgagcccgtgagttcaaggctgtattgtcctaccatcatgcttgtgaatagccactgcattctagcctggggagctgactgagaccccatctcttaaaaaaaaaagatgaccatacatttcttgatatttctcccatgaagtgaggggtctagctccccccatctttgttaaaatatgccccgagctgacagatgaaatgaactcttggggccaaaatgaggcacaccagaaatagaatcaagtggccatatcagggagaagggttgggcatatacccctatattactagctgccataacatcttctgtcctgtaattgaacagaaactaaccctcaaaaaaacattgttaaaacagctgctgggagtttcccagctgcccgatcctactggattgcctaacaccagtcactggcaactggactcactacacagcccctctgccccctccccacctcccaccagcagctctgagttgacaatagacctactgtgtgaactgtgtttcctgataaacacccacagaccttaagccagtttcaccaggtttacagaacctgttcacggaatgtttttgtgccccacagaacatttttatgcccttcagttcaccttttggtgtaaagagccaaattttacctcattttaacattaaaatttcaccctaaaatgagcctaaaatatatattacaaatatgtttactcattgcatatatgcttgactttccttgtaaatattcacaaactttccccaagcctgctaaatatgcaccttagacagactgaaagatgtaaatgcctcttttcctctctccttctttgaccatactttcattttacattggaggctatgtcttcccatctatagattttttaaaaaatagaaaataagactctcccattttcctccacagatttcatggtcttgtgttaacatttcaaatctggtttggacagtgagtgcattgacacatagtgtatggcaggggggcccctggccagtactggttcatgtcttaagaggaatgagggctcctaaaatccttggaatctctgaagtgataagtgtcttttataaatatttgattatataacaatccctgttgattgctcatttgaagatgctactacttgtgttctccagaacacatgttggtaaatgatgctttaaatttgttaggttttgatgtggactacaaaatcattaaattctggttctagtaattgccaaggatcttgtattagaataatcatcctgcatataacaattgtaaactgtggatttggttaaaactgcacacacttgaagtcatggagtttaatcaaaagcagggaaaataatagtaagaacaacaacagcacctgaaaaaaacttgattcttgaaaggagagactgccctgagtgagattcaccttgatacagacttttccccggatacatttcctaagttggtgcagtgcagggcagctagacttgaatgaagagccacagaattattggcttgagatgtcagaggacggagttcagggctaccagaacagcttgaaaataataggcataaatctcataaactggagtgccacagtgtggagagcccccaactttatatataatctctcctcaaatccttgactagcctttgaactgggcatgcatgagaaagactgtaaacagttaagtggatatcaagttggaaacctgaaaaaagatgagcagagatttcagctgctgcccatcacaagggagggagagacagtttggagtttgggtcctaccaagttactttatgctagaacaacaaactcaaagctcttcagaggaaaggaacaaaattccgtgtctaaaatttgtcattcacaatgtccaatatacaatactaccttttctaatcatgcaaaacaaacaaacaaaaaaacaaaaacgggaaaatgtgaccttctagttcaggggaaaaaaaaaagtaacaaatgaaaaccgaacctgagatagtacaaagcttttcatgctttaattaaaagacagagattctcagactggataaaaagcacaactacattcagtcaacaatagatgcactttaaatataaaggcataaattgaaagtaagaaactgtggctaggtgcagtggctcatgcctgtaatccaagcactttaggaggccaaggtgagtggatcacttgagcccaggagtttgagaccagcctgtgcaacataatgagactcccatctctacaaaaaataaacaaaaataagccaggtgttgtggtgtgagcctgtagtcctagttactcaggagactgaggtagaaggatcacttgaacctgggaggctgaggctacagtgattcgagatccagccactgcattcctgcctgggtgaaagagcaggatcctatctcaaaaataaataaataaatagaattttaaaaaagaaaaaaagtaaaaaactggaaaaaggtatacaatgcaaacaataaatataagaaatattggcatagctaggttaatgtcagacaaagaaaacatcaaaaaagtaattattagaggtaaacagaaatttctagataaaaggtcaattcaacctaagatataatcataaatatatatacctaaaacagagactcaagataaatgaaacaaaatcaaagccaagatagaaataggcaatatcacaaacatagatagggattttaatacagaactctcagaaattgatagaacaaatacaaaatcagtaagaatccagaagatccaaatgacactgtgtccggaattggtgggttcttggtctcactgacttctagaataaagccgcggaccctcgcggtgagtgttaccattcttaaaggcggcttgtccagagtttgttccttctgatgttcggttgtgttcggagtttcttccttctggtgggtttgtggtcttgctggctcaggagtgaagctgcagaccctcgcggtgagtgttacagctcttaaggcggcacgtctggagttgttcgttcctcccggtgggttcgtggtctcgctggctcaggagtgaagctgcagaccttcgcggtgagtgttacagctcttaaggcggcacgtctggagttgttcgttcctcccggtgggttcgtggtctcgctggcttcaggagtgaagctgcagaccttcgtggtgagttttacagttcataaatgcagtgtggacccaaagagtgagcagtagcaagatttattgcaaagagctgaagaacaaagcttccacagtgtggaaggggaccggagcaggttgccactgctggcttgggcagcctgcttttattctcttatctggccccacccacatcctgctgattggtccattttacagagagctgattggtccgttttgacagggtgctgattggtgcgtttacaatccctgagctagacacaaaagttctccatgtccccactagattagctaaatacagagtgtcgacacaaaggttctccaagtccccaccagagtagctagaaacagagtgtcgattggtgcattcacaaaccctgagctagacacagggtgctgatttgtgtgtttacaaaccttgagattgatagagagtgccgattggtgtatttacaatcccttagctagacataaaggttctccaagtccccaacagactcaggagcccagctggcttcacccagtggatcccgcactggggccgcaggtggagctgcctgccagtcccgcaccatgcacctgcactcctcagcccttgggtggtcgatgggactgggtgctgtggagcagggggaggtgctcatcagggaggctcgggctgcacaggagcccatggttggggagagggtcaggcatggtgggctgcaggtcccgaaccctgccccgtggggagacagctaaggcccagtgagaagtagagcacagcagctgctggcccaggtgctaagtccctcactgcccgaggccagcagggctggctggctgctccgagggtgggcccaccaagcccatgtccacctggaacttgtgctggcctgcaagcaccgtgtgcagccccggttcccacctgcgcctctctgtctacacctccccacaagctgagggagccggctccggcctcggccagcccaagaaggggctcccacagtgcagtggtgggctgaagggctccttaagtgctgccatagtgggagcccaggcagaggaggcactgagagcgagcgaaggctgcgagggctgccagcacgctgtcacctctcaacaccatctacacagcaactggtagaactaataaatgaatagaacagtcacaagagttaagttcaatatacaaaaatgaattgtatttctgtattaatataaaccatttttttaaaaaaaattcagtttgcaaaagcaccagaaaacataatatacttaggaacaaatttaataaaatatatgtaggacctctatgctgacaacttaggaaacagtgctgggaaaaaataaagacctaaataaatagtttaaagactcgctattgctaaaattacaattctacacaaattatctatagatttaacgccttaccaataaaaatcttgtctattttgagacactgacaaattgattctaaaattgacatacaaattcaaaagatctagaatggccaaaacaattttttaaaaaaataaaacaggtagggaatttacattacttggtttaataatctactttaaaactatagtagtcaaaccaatatagtattagcgtaataatagacattataaatcaaaatagtctaaaaatagatccacatatgtacagttagttgattttcaacaaagattcagtaatgtgtgcttactcattcaagaatattaaatcttctgtagaacggggaatgggaatctttttgttaaagggccacagagtaaatattcaagacttgctggctatactgtctctgctgcaactattatactcagttcagcctttgtagcaggaatgcagctatagataatatgtccatgaaaggttacaggtgtgttaaacaaaacattatttataaaaaccgatagtgagcctgcaggtcatagtttgcttatctctgctatagaacatgggaaaaacaaatacagtggataaatgaagctaaatatggtaataaccctatgtgtccatgggttcaatcaactttggattgaaaatattaggaaaaatactgcatcagtactgaacatgttcagacatttttccttgttattattccctaaacaatatagcataacaactatttaataactaatctagagatgatttaaagtacaggggaggaagtgcatagcttatatgcaagtactatgccattttatatctaggacttgagcatctttgggttttggtgtctgcaggagtttcttagatccaatcttccacaggtactgagggatgacaaagcaagtggcttgtgagacatgttaacacaaataaagtaagtggactggaacatctgtgttttgtttatacataaaaggatagaagagctcagaaggaccacatgggtactgaatattcgtaatgtgtctggaattggttccttccagtgggttcttggtctggctgatttcaagaatgaagccacggaccctcgcagtgagtgttacagttcttaaagatggtgtgtccagagtttgttccttcagatgtttgtagtcttgctgacttcaggagttaagctgcagaccttcacagtgagtgttacagctcttaaaggtggcacgtccggagtcgttcattcctcctggtgagttcatagttttgctgacttcaggagtgaagctgcagaccttcgtggtgagtgttacagcacataaagttagtgcggacctaaagagtgagcagcagcaagatttattgcaaagagcaaaacaacaaagcttccacagggtggaaggggacccaagtgggttgctgctgctggctcgggggcctgcttttattcccttatttggccccactcacatcctgcttagtccgttttacagagtgctgattggtccgttttacagagtgctgattggtccatttttacagagtactgattggtacatttacaaacctttagctggacacagaacactgtggtgcatttacaatcctttagctagacagaaaagttctccatgtctcctaccttattagctagacacagagcgctgattggtgcatttacaatcctacatagctagccagaaaagttctccaagtcccctacccgatgcagaagcccagcaggcttcacctctcaatcccccctctaaacaggacaccccaactgctgttgggaatttgcccagtgaccgctctagctacttcctgctggataggggcgaagtagcggccctgcagttgtagtgtcctccagaggggaactctttaggccagtggaagggccagtgggtcggtccaggggtcctcagtagaagttgttagttgaactcatttggggttccatttgtaagatcgtctgtagcttgatggcctccattctagaggaaacaaatttgacaacaaggttaaaaataaagggcccaaaggcgagtaataacaagatggctgccacgggacctagaaaggggagaagccatgttgcccaactccagaggttggtataatagtttgaaaggcgttgtctgatttcagaagccttttcctgtaaatgccaggtggcatctcttactatccctgactagttagtgtagaaacaacactcttcccctaagaaggtgcagagtcctcctgtctcagcagtgaggaggtctaggcctcagcggttttggagcatcactgctgacaaagagtctgtttgggactgtaaagtaaggataggtttcgttatttcttgcaaactgtctgagaaatcctttgagagtgtgtggtaataggataatgaagtggataaactggctattctggttcctgtagcagtagccattcctaaccctgtaagtaggggcattagttgtatggctctgtgctgacggacttgagctttgaggggtactaataaggtctgatttcctggggcaatgttaatgttggcacttagaaagactaaggtgcaagtgcctgtccagttagtggggaggcatatataggtcgatgttccacataagaagaatataccttgactggtatataccttgaacgggttgtgtatgttaaaaagatgaaaaggtgtgtgaatttgttgttttcattttcccataccttagagtacttgctaaggtagctccagtgaatggctggaaaggggtgttgggagtgaactgagtggctccctgtgttctgttttcccattggagaaaaaactgttttgtatctagtaggaaccattcgagagagtgattgaaagaggggatgagaaggcattcactaatgatggaggtgctgctgcaggggatccaggggtgaatggtcatgcagggagtatgtttgccattttaaaacctggactgtttgttaagcagggaggagatgatgatttttggggaccctgagaagcagacaagccatctgaatggagctgtttgggtgactcagaagttactatgatcagctggggtttgaagttgtagggtgtagttacactgatggggtagtaggtgccccaggggcaggcctgataacaggttgcattggatgcataaaggggcttggaaagttaagatggtattcgtagttacaggaccgtgtatgggcttttcattgcttttgtaataggtgaggttggaaatgtaagaacgtaaaagttggattgcacatcccgttagggtaattttggtcctatcagagatggggaagttggctaatgattgcatatttagaagttggaaagggtcttttccttctaacgaggatagtaggttaaattggtaaagatccagttttttgtgggaatgggagtggcaacgtaagcagaggttgatagagagataaaaagccaacagtcatttgccagggaaggattggactggtttaacagagagtgggttaagttgagagtcttgtagaggtaataaggagctaggggaaggcgagaggtgattgtatgaagtatccaaggaagcaggaggggtagataggcaaagagtaaataggaaggtaaagagggtactctggaagacgagatcattttatacaggctgagttaaaggtaggagtaaattgctgtcagaaggaaggaagatagaaagaaggttgatgtgattaggattttcatcgcagcaggagctacagtatatagtcctatcacaaagagtatagttagtatgctgcttaataatacgatgaaatagtaaaaggattccattaaaggggcaagcagaggtgttaaagataaagattatgtaggttttcacttatcttttttaaggagtaaggggtttttcttcaggatcagtgttacgagcctttttagtctgggatgtttccttctgaaataggagatgcaagtcctccaatggtttgcaggagtatcgaggctggtctgactgatcttgggactcctgaactgatggtcccgcaggttccttaggggatgtccaaaatttaactcaggtgtggtgaatccaagattctactcctgccaccttaactgcagtggggatagagaggaatattgagtatggccctttccacagagtccataggtggggaggaaaaggggagagatttgaccaacactagatctcctggttgaaacaactctgttcccttttctctgtgacatccttcaggtaggtttttaaggtttagttgatattttgccaaagaagttatatctttgaccaagttggctatttcctgatcaagtaggaggtcatttctgagaaaaggtcatccatacatcatttcatatggaccgagctctgttttgtgaggagaatttcagattctcaacaaggccatgggcaaaagagtaggccatgggagatgagtttcttgtgttagtttcctaaagtgcctcttgagtgtttcatttgcctgctcaaccttccatgtggattgtggccgccaggcacatgaaggtgatattgtatccctagagccctggaaattccctgagttatcgtggctttaaaagccggaccattgtcactctgtaagctttgaggaagcccaaatctaggaattatttcatgaattagggcttcaatcacttcctgagccttctctgtcttgcagggggaagcttctaaccaatttgtaaaggtatcaacacagaccaacaagtattgaaatccctttgacttaggcatatgagtgaagtctaactgccagtcctcaccaggatagtgacctattctttgttaccccaaaggggccttatgatggaccgagggaatattcctttggcacacctcacaggctttgactacctgttggatggtctggagaagatttggccctgtaaatagggatttggccatttgatgagtgttttcaatacccatatggaaagtttggtggagggttttaagtattttccactggctggcttcgggtataagtacctttccttcttctgtcattaaccaccctgaggagagaaaactctgcccccatgaaagtccccattctgtttcagttggggaatactggggcttaatctcttggagggggttgttccataccaagggtccttccataggtatttctaatgggagcttctgcctggcagcagttttggcctcagcatctgcccagcggtttccttctgccttttctccttcacctttctgatggctttggcagtgtaagactgccacctccttgggtttttgcattgcatgcaataactccgtaatttccttgtggtatttaatgggggttcccccagaggttaggaactccctttctttccatattgcagcatgggcatgtaggattagataagtatacttgctatctgtatacacatttattctttttccctttcccagttctaaggcttgggtaagtgccactagttctgctaactggatgctggtccctgggggaagaggcttactttcaagtatggttatatcactaactatggcataacatgccctttgtatcccattctccacaaatgaacttccactggtatatagattaaggtcaggattagctaaagggacttctaagagatcatctcgggcagcataagtcaggactataatttgttggcagtcatgctcgattggttccccatcctcttggagaaaatggcagggttgagggccacacacatatgtatttgaagaaccagtccctcaaggagtagctcctggtatctaagtaggcagttgtctgatagccataaacttcctttggcacctagtatgccatttacatcatgagtagtccagacagtgagatcgtttccttgtattattttgatagcctctgacactaagttagctgccaccacaactactcttaaacagtgaggccagccttttgctactacatcaatttccttacttaggtatgccactagttgtggggttgtcccatgagtctgagtaaggactccaagagctatccctgctctctctgtgatgtataaagagaagttttgtcctgtgggaagacttaaagctggagcttgtactagggcctgctttaagggtttgaaggctgtttctgcctctggttcccattctacttgatgagtatttgccctctgaatctccttgattagagtatagaggggcctggctatctcactgtatccggggatctgtagttggcaaaagccggtgattccaaggaaccctcacagctgttttaatgtcttagggtgaggataagccagtataggctgtattttttccttgctgagggtcctggtccctctggctatgattaagcctagatatttgacctgctgtaggcaaagctgggccttcgacgtagacggtttttacccttgattagctagaaagttcaagagatctagagtagcctgctggcatgaggcttctgaactggtagccaaaagtaaatcatccacatactgaagtaccagagtgcctggacttgagaagtggcctagatcttgggctagtgcctgaccaaagagatgagggctatccctacacccctggggcaagacggtccacataagttgggacatgtggtctgtgggatcctcaaagtcaaagagaaactgggagtcagagtgcaggggaataaagaagaaggcatccttgaggtccagaacagtgaaccactatgctttctctggtatttgagagagcagggtataggggttgggtacaactggatatagaggaattactgcctcatcgctgtgagtctaagatcttgcactagtctccactgaccgttcagtttttgtactcctagaattggggtgttgcagggactgctgcatttccttactaagccttgagcttttaaatgtttaacaatatcctgtaatcctttatgagcttcaggccttaagggatattgcctttgataaggaaaagtggtgggatcttttagcctgatttggactgggcaggcactttttgcccttccaaattgtccttccaatgcccagacttcagggttggttccctcttcaagtaggggacaacaaatgggtaacttgttccccatattcatgtagataatagctccagctttggctaatatatccctccctaagaagggtgtgagactttcaggcatgacaagaaaagcatgtgaaaagagcaaagtctcccaattacaactgaggaggtgggagaaatacctggttacaggctgtcccaggattccttacatggtaatggaccttgaggacagtcatccaggacaggagattaacactgagaaggccgcaccagtgtccaggaggaagtcaatttcctggccctcaatggttaaatgtacccagggctcagtgagggtgatgacatgagctggtgcttgccccgggcaccctcagtcctgttgttgaattgtctggttggggacttctgacccagagaacctttgtcctctggggcagtgcaccttccagtgattgcctcagcatagcagacatggacgagggggcagcttgtttcttgttggacaatcttttttaaaatgtccttgtaaaccacactgataaaaaaccctaccaggtgattggcctgctccattttctgtcctctctgaaccaccaaagtttgtctgagggccatgattaagggtgcagcctttctctgatctcgcttttccttttgggcctgctcctcttggtccctgttatagaacaccaagattgctaggtttaataatgcctccagattgtgttcagggcccagggcttgcttttggaactttctcctgatatctgcagctgattgggttataaacgtatctttgaaatcaattgacccttgagtgatttgggtgaaaggagagtgtattttcttaaggcctcctgtagctactcaaggaaggcagaaggattttcttcctttccctgagttatggtggacatcattgaataattcatgggctttttcctaattctccttagtacttctagaacagaggtcaacagatatttacgactccagtccccatgatctgatttgaggtctcaggggggattcatactggggacggcttgctgactggaagggaatttgtccctttcttcagctgtcattctatcatttacttgactaagataccaggtatctccaaactctcaggctgcagctaaagccacattcttttcattaaaggccagggtttggtctaccaatagcatgacatctctccaagtgagatagaaggtttcccctagactctgttggacatctgtgtgcctatctggatcatctgaaaacttccccaggtctgccttgatcttctttaaatcagagaagggaaaagggacatgtacctgggttgggccaaattcccctccccctaaagcttgaaggggacataactaatagccttggggtttttgtggtcctttgaagatgtctttgattatttccttctgggcaggggagattagaggaggcttatcattactaggaaggggagctatagggaggataggatacaggggtaagctgagaggtcctcctgggggatgtaaattgcaagctttgcctcattgtgtattctccttcaatgaaaagaaagcttggacataaggtatttctctccatttgccttccctcttacagaaaaggtcaagctgcaggatagtattataatttatacttccctcaggtggccatttttccccatcagggagagaatattggggccaagccatagtgcagaaaaaaatgagctgcctctttttcaggttttttgggtcaaattggtctcaatgccttaggatgcatttctcaagggtgagcctgttgatgcctgagtgtttcccatctgaaagacaaaaccacccacggtttttgtttgtttgtttctacccctgcccaagaacctgcaagagtccctggaccctgctgatcagaatagttgtgctcattgacgcggtagcagaaacaccccctgcccaagaacccacagtgtccctggaccctgctgattggaatagttgtgctcaccaacgtagcagcagaaatgctaattttcctcctagaccacaaggaggaccaaggaaggtcagatttagtggcccttaccgacacattctagaaaacctgcacccttgcctgtcctcctagaccacaaagaggaccgagaaaaatcggatttatttggcccttaccgatgcattcttgaaaacctgttagagtcctaagtgttcttctgttaatactgggacgttacccccatcctataaagatgttattccccaaaaatgaagtagagggccataccctgagggagggaagggatctccagagttggaagaatgatgtcttttgtcctcacttatgtgaataggaaggctacaatttctgaggctccccatatcctagcttcaggaatagcttttgttaggcctgcttgtctgaggagggatcctaaaattccagatagtacccccctacaacggggctttgggcaaaaattatgtctttctgattggtgagaccgggtgcctacagaaggtaacagagtcctagagtttatactagaaatcattcttacaggagaaactagaaaagcaccagagacaaggagtggtttttagaagcgggactagccttggagaagagaggtgagaggaagtttgtatgacaggcattcgaacccaggaggcaaaggtcaggatggataggatagatgggcgagtcttgcttgggtaacatgacgttgagagttctgctcatggccacagggtcaaccaacttgttgtcgggaccccgtatctgaatggctttcctctctgtcgatcctaagctcggcctggatttacaggaaaagcagaagctggttccaggcaaaccaacgctcccaagtccaaagagttgggggttgttagccctttcccagaaagcctgacacccgagtctttagtccagtggctgtgctagttgcttttaactggccaacaggtgcccggtatttggcccctgaattctaaggaaaaataggacagaatagcaagcgaaaggggtccaatggtactcaacacttggtgataatcaagtatcccatctggggcaccgaaatgtgtctggaattggttccttccggtgggttcttggtcttgctgacttcaagaatgaagccgcggaccctcatggtgagtgttacagttcttaaagatgggtgttcagaatttgttccttcagatgtttgtagtctcgctgacttcaggagtgaagctgcagaccttcacagtgagtgttacagctcttaaaggtggcatgtccagagttgttcattcttcctggtgggttcttggtcttgctgacttcaggagtgaagctgcaagcctttgcagtgagtgttatagctcttaaaggtggcacatccagggttgtttgttcctcctcgtgggttcgtggtctcgctaacttcaggagtgaagctgcagaccttcgcagtgagtgttacagctcataaaggtagtgtggacccaaagagtgagcagcagcaagatttattgcaaaagaacaaagcttccacagcatggaaggggaccccagagggttgccactgctggctcgggtgacctgcttttattcccttgtttggccccactcacatcctgctgattggtccattttatagaaagctgattggtccattttacagagtgctcactggtccgttttatggagtgctgattggtctgtttttacagagtgctgatttgtgcgtttacaaacctttagctagacacagagtgctgattggtgcatttacaatcctttagctagatagaatagttctccaagtcccctacccaattagctagacacagagcactgattggtgcatttacaaacctttagctagacacagagcactgactggtgaatttacaatcctttagctagacagaaaacttctccaagtccactacccaattagctagacacagagcactgattggtgcatttgcaaacctttagctagacagagagcactgactggtgcatttacaatcctttagctagccagaaaagttctccaagtcccctacccaacccagaagcccagccagcttcacctcttagtagcacactaaataaacatgagccacatgagtctcccaatattcatgaggatttaaataggtcacttattgatgatgcctcctctagcctcaatgttcttacccagtaacacaagttaaatttgtagctgctcatcaccttaactggtgaaccctgactgtggtcagttgtactttccccaaagtctctctagcataactgtgtatgtagctggctctagacaccttccatctgctgagtcctgtttttcaaatctcaaacaaaccatcagctgaaaactctgataaggcagagagattgagctataggacatataaatacagtataagctgagattcaggtattctaagtgtattaatatactcacctctttctttttgtgtctttattttacacttattccttaagccatgtgtttttagtacaaccttaatttagtctgtggacatttctgtttttctgacctggaaggtggctttgctggtagggtatctggaggctatcattacatcgaggtaatttcctgcatgacatgtaccaggcaattaaatgggaaagagaaaagccttctcaacaaatgatcctggaacaactagataaacaagtggaataaataaactttactgcctaagtctacactgttccctaaaatgaatttcagatagctcatagatggaaatgtaaaagataagcatataaagcttctagaatgtaatgtgggaaaatatctttgtgaacttgtggaagggaaagcttcttaaaaaggataaaaatttactaatcacaaaataaaataagttgaaataataaaaattaagttttgttcatcaaaagacactcttaaaaaatgaaaagacaagttacagatggaaagaaaaagttcaggaaatatatctgataaaggtattacagtaagaatttacaaaaatgtataccaaccaaaaaacacataacccaacataaaaatgggcagaagacttgaacaggcatttcataaaataagatatataaatgaatggacaataacatcaaatattgttagtcattagggaaatgcaaattaaaattgcaatgagtttttttttctttcttttagagatggggtctcactctattgcctaggctaaagtgcagtggtgtaatctcagctcactgcaacctctgcctctcaggttcaagcaattcttgtgcctcaggcttctgagaagctgagactacagacatgcactaccatgcctggctattttttctatttttagtagagatggggttttgccatgttggtcaggctggtcttgaactcctgacctcaagcaatccacccacctcagcctcccaaagtgttgggattaacaggtgtgagccactgtgtctggcacaatgagatgttaatatatttcaaactcatagaaaggcaaaaattaaatttaatttcaaagtttaatttaataaaattaaaataaatataaaagaggctacttttatgtgctacttggatacagacctgacaaagaagaaactgcataaaaaatgtcaggcagatcaggcaggaaaatactatgggtgatttctaggactgttacaagagaactttattttatcttttatttatttaatttttttatttttataggtacacagtatgtgtatatatttatggggtacatgagatactttgataaaggcatacaatgctcaataatcacaattgggtaaatggggtatctgtcacctcaagcatttatcctttctttgtgttataaacattccagttatactcctttagttattttaaaatatacccaacaaaattataattgactgtagtcaccatattgtgctatcaaatactagatcttactcattctattcattctaactatatttttgtactctttaaccctgcccactctccccttccctgactacccttcccagcctctgatagtcatcattctaccatctatcaccatgagttcagttgtttggatttttagcctgcattcatgagtgagaacatgtgaagtttgtttttcctacaaatgggtgagaatataagaagaaaggacaaagtgccttatttcacttaagaaaatgtggtacacatgcacaatggagtatgattcagtcataacaaagaatgagatcctgtcatttgcaacaacatgtatggaactggaggacagtttgttacaagaaaacttttaagagaaacttatgtggccccagaaaaagtgtgtatgtggtattaggagagacaaatatactaattgaaaggaaatttcttaatgctatattctcttagatatatatcctgtgcacaatctgaaaacatactagtaaggttctcttgaataaacaatcttattaggaaggcaaaattatttcaggaaggaataaggatgagaaaaaggatagggagaaggtacaaattatagtgtgtctgggcccaaaaggggaccatgactactttacatgtcagtacaatattttttaacttgtctgcctttgcttgagggatacttgaatgtcccccttccccactttcccaaccttggggtgaatgcccaatcttagcagccttgggaagaagtctggatgatttaatcaaacacatttacttatgcttcattaactttggaagatgagctgagagaatagtaaagtgtggagatttgcatactaatgaattcacttcaggtgatgccatagatatttatgatggaagaacataaaaaaaaggaaatgcttctgatcttttggtgggcagaatgttatataatgaacctctcaaatatgtcaacatttaccgtaagcttcatccatagaaggattgtgagcaaaagagactaaaaagaaaaaagaaggaggagaagacagacatacatttggaaagatatcttatgtaattactttttgataaaaataagtacagtatagtgattgagatacaaaggatataaaaattcttgcctatgttggaaagaaaccctatctgtctatagtttttaagagctcctagtgggcatgagttggaggtctttgttacttatagaggctgagaggaaaagaggagagaatccaggaggatccaagtcttctatctttacttcaaccagagatgctgcgcttttatctattttctctcattgtacttgcgtgtaaaattgtgtttgaagatagtttccatggcaaaacatcatttttttaagaagctaccttcttacacccttgctgtcaaagtaggttgtaaatttactgtgagcagagagaacttctctactcttgagaagtgattagtatcttgctttcacatgggaggcaagtaaatacataagtaaaaataatacataatgggcaaacatcatcaacagatgagtaaccaaagaacaaatatagttagttaatttatgaaaacatctttaactttcatcaacagagaaatgcaaattaaaacaaaatactattttttcctgtaccaaattatctgagattctgaataaaggaggttttaaaatgttaatgccatgaaatacaatacatatagtgtaatttatgcaatgtactcttaaacatttcagaaaaaaattatatctatattcacagagagagaaaaagagataaagtgaaggcaaatgtaataaaatgctaacattcagggaatcgggtgaagggtattgggggaattctttgtgttattcttgtttctttcatgttactcttacattacgtcaataaatacattctccaaaaataagaaaaagataatatggcattagagatatatatagttaagaaaatgattaaagtcaatgagtaagtactaagaaaaaaatacaaaattttgactatcagtgaggatgccatgaaagagtcaatgttacatactgctagtagaagtagaagttgggacaaccctttgcaaaatatttgatgatgtatatttaaattctttgacaatgttcatttcattttatttgattcatttcatttatttcatattcatttcatttatctggaaatctcctaaggaaataacataaaatagcttcctgtacaaaacatgtcaaatctagtattatttataaagctgaaatatgtaaggaacctcattgtctttcagtaatcagatgattatatctattatggtagagccttatgattgggtattatataatactaaatataatgatgaagatggtagctaccatatgctgacatatagttactgtgtatcatgagctatactatgtccttttcaagcctatctcatgtagttcttgtaacagtcttcaaattgacattcattaacagtttattttattatgaaaaacattgcagggtgttaaatgtaacattttaggcaatagttatgtgctaatttgatactaaaatataataaaataaaaactttttttttttttgagatggagtctcactctgtcaaccaggttggagtgcagtggcatggtctcggctcactgcaacctctgccccctgggttcaagcgattctcctgcctcagcctcccaagtagctgggattacaggcgcatgccaccgcgcccggctaattttttttttaataatatttttggtagagatggggtttctccatgttggccaggctggtctcaaactgacctcaagtgatccacccaccttgacctcccaaagtaaacatttaataaggaaaagctatagtagaaatgattttagtagaagtctagacatagtttttatttgaaataccataaagttaaaaacatttttgtaagtatcagcagattaattaagaaatgtgtagttggtgtttatatttaatcctaattgatttctgaagacaaaaaattaatatatttttataacaacagcaacgtacattataataattggtctgagaatatttgatgcctagataagcttaaatagtagattttctctgtttttatctgcactgtactataatcaaaataaacatataatttgaaagacttgtttctgataaaacaaaaacaaagtaaatgtaaattatggtatagtataaatgtagtagaaaaatgcggtataaaaaagatggtgttcccagaattttaaagaatatacatttttagatgtaaaagttagtaaattacattttaaaagaaattttaacttaaaaaacctacagttgttatagatacattaaatacattacatgagaactggaatttctcaatgggataatgatattggctattacaataatgcaaatgttgagtgaaatatcttccgatttgaaatcaagactaagtatcataatgaacataacacagaaatgaaaatatcttttccaaaaaatatttacattaaaattaagtccacaagtataatacattttctaattctttgtagccaagaatcatggatagattcagaaaatagttttaaatattttatagagctactaggtattttatatcttctgcacaaattctaagtagatttaggctaatttttattacataccataaagttaaaaacaaaaggtaaagaatgtaaccaactgatgtcaataaatagaaaacctagcatggatgttcataaagttgtactgttgaaattatctatcccagcatcttcattgtctgcatgaaaatttgagatcctaaaagattaatgttttacagtgcaccccttttactacaaaggggtgtctccatgaacagtcaaaatctttatcaaaggtacatcgttaacattgtatctattacccagattctctttcctaagagaaaatagtggatggttaggagaaaaggatatggtatccatacttcctagtttttatgtgacacttctttttatacctattatcttggtgtagttattaacagctctctctttcatactcaaatctatcactcttggtttggacaccctaagttattgggtgtattgagtttttaatttggttaaactatgctgatggggtaaagtgaagcagaaatgggaaaaggtggagtggctgttttcttttgcttacattcttccagctagtccaagaaattttttacagacagggtctcattgggtcacccaggctggagagctgtggcaggtcctcactgcaggagctcactgcagcctccaactcctggtctcaagcaatcctcttgcttcagcctccacagctgaggattacaggtgtgtgcctctgcagtgagctccaagagatatttggaaagagaatgattgaacggctttcccaggattgcataaagttagaagcccaatgttttatcacattaatttttatttcaattgaacaattgtgtattatactgcataattgacagacttgggttaagtctcattccattgctcaggttggagtgcagtgcagtggcactatcatggctcaagcaatcctcttacctcagcctcttaagtagctgggacttcaggcgagcaccactgtgcctggctaattaaaagaaaaaaattttttttttgtagcaacaaggtctcaccatgtttcctaggattgggttaatcttgttgtaagccagtgtttggctttcctgctcaagaacactaataattggacacgtacttattctgagaatgttaatatattttagtctttgcttctatcttctttccattataagctatgaacttagaagatctggtcaggcattgaggaaaaaagaagaaaaaaaatcaagaaatgactttctactgggaagcaataatttaaattactgtgtttaagttactgtttagaaggggaggtacaaataaattggcacatgcaaattatatgcaaacacattttgtcttctcaatttaaggtcccataatttgaattaaaatgttcttttaaagacgattgtgtagtcctaatgttctgtaacagcaaaccaaaatttggattctgtaaggagaaacttagcgttataaacaaaattccatacttgggattttgctaaagtttgcactaaacaagttgcatcttatgtagttgatatgtgaaatgtttgtgttttgatgataaactcaatgcgatttttggtgttaaaattggtgtttcatggtggtcatagtaatgagtcatagtttctgagtagacttaacttttactttcattttggcaaacaaatggttatagatttacagttatgtgaatagattgttctcatgctaagtgcaaagggagtaatacttgaagaaaatctttgcctaatttatatatgtaatattttatacatatctaatatatataaaaaacccatcaaggctggatgaatatcaaaaaattcttctgacttacactttgttaaaatatacataaatttatcagcagcttccatattcttcctctaccccttcaataaaaggggcattgaagggattatattaaactggcttctgtttcctaaagagaaaggtatattgtaaagaaatgaaattggttgttgttcatttctctattgagaaaagtaacttgaggccacaactgaagtgaattaatgctgttattattgtggagcttgcattacttcttattgctaagtctgagtgaggaaagtgggaagcaatgcctttcacaaaagcataaaagtaaaatgtgactatatgtaaaaaaaagaataggctgaggggcaaaccaaaaaaaaaatcacaaagattcattcatttatatgacttactaagctgacaatttgtaatgggtattggcattagtatgtgcaattacttctttacttccaccaaactgaaactattccccccacaggaaggtttagaggaaggtgtttcagggtgggggagtggaagtggtgaaaaaaagacaaaagagcttatcctgaatctattagctctaatgaacaggtactaagaagcagacactgccacataacataaattacaatctaaatgagatatccatatttacataagcagttccttaggcgctctaagctaagttcatgggaagaaagttttccaaatgccattcataccaccagggataattgcagcactagaaagaagcatccatgccattgctggggaaacagagaatggggttttaattttcagtttgacttacatgctgttgtcatatcatggagactacagttgcagttttacagcatggtttttcttggcttattttagaatcacagaaagagtaagcttgcaaatcttttaataaggcaattacattcagacaaagattagatctcagtggcacaatagatttttgctatattattcagtatctttttgatattccactgtcactagacaaagctgtgaatagtaatgtgacaagtctattcagaagacaacaatgagggtttccttaattgtgttcacttgcatgccacacaaaccctcacttaatttttttttgcctgttttgaaaaagcagaaagaaaataccatttaggtcacaaaaaacactgttgaatctatctttgaaatctgcattttgtatttgtaagattaaaatgttgagatagtcaatcatttaattttttatttggtaaaaatatctaatgattcaaaatgtcagtcttaatatagaaatgaattacttggtataaaaagaacaaaaatccataagaatctaaagacttgtttcaaaataagtgctttggatgatgtgggatgtgaaaatggaaaatccatgtgttagtttctaatggttgctaatgaagagaaacttaaaatgaatgtaattattttatttattttcttaaaggcttgtccttccccctcacaacttaaaattccataaaatatattactatagaaatataagctatatggttatgtttagaaaatgcaattttacattaatgtatcagtttgtgagaaggaaatcatgtttatatgagctagcattttgttaattttataaattattattcatatatttattttaaaaaattggatataatggcacctattttaattttcccaagttgaaattcattagctaaaacttcatttaacttacagttcattgtttgaaactaatgagtttatagaggtaattatccttaaatgctaactcaagcaggacaaatggagactgatctaatgaagaaagaattgagttctaatcttgatcctacaagtaaattttacatcttggtttcatttaatctttttgtatctatttcctcaagagtaaaacaggggaaatgtctgatgtgaggatagaatagaaaactaataagaaaattcctgcatatataaaagcgctacactaaggtcctataatattaggatagatatagaagatcctggaaggtcctatattcacaaatttgggagattcacctactgaatcatggaaataaataagaaggagaataagattgtacaccaatggttactctcaaagagacagaaataaaaaaatgactctaaaattttctaatgtcttagaaaataattgttaaattatatgatgaaatagaacttaattattctgagcagcatttaccatttttaaacacttttaaaaagttaatttgatattactagcagaagtgatcgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtacattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatcgtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcctctagattttctagtttatttgcgtagaggtgtttgtagtattctctgatggtagtttgtatttctgtgggatcggtggtgatatcccctttatcattttttattgtgtctacttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaattgccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttctttagcagaagtgatcaataaaactttctggtcactgaaaagcactgcaaggcattttggtgtttttgcataaaaactaaagagaatacttagagcaaatgtaataagtaagatatgaattaactttttctaattaattgagatgtttgcacaaacactaattgcaatgattagatgtcttgagaactatataccttgatattgctacagaaatctgcccttctatgtgcttaccaacagtttatcattttaatgagcttgtccaatagagctcagatcacaatatagacttacatttggtgcttccaaaaattattaagaaaataaaaacaatactttatgattgttaattatgtgggcaaattaatattcacaatcctgcaaatccaaatattgagtttttaaaaagtgtttccctattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcacttataggtgggaattgaacaatgagatcacatggacacaggaaggggaatatcacactctggggactgttgtggggtgggggcaggggggagggatagcatcgggagagatacctaatgctagatgacgagttagtgggtgcagcgcaccagcatggcacatgtatacatatgtaactaacctgcacaatgtgcacgtgtaccctaaaacttaaaaaaaaaaaaaaaaaaaagtgtttccctaatgtaattcaggtcatccaaaacagtccctcacaagatctaagtttatcttgctggtgttcttaatacagatttgtcatggacattaaaatcccacacaaaatgtttgatacttactatggaaaatcttaaatgtgatttttcagcattatattctacctctacagattctaatgaatgaataaattctttattgactttggctcaagtggcaaggctatgtgactcagggaataaccaagtgttggcagaacaaaagtgaaaaatcaatagcaattgattatttaaactcggaatttcagggtactcaggcaggatttattctaagccaagccccagtaggaacactctttgaatctatctgatttgtaaactgtctccaatactttttcctatatagttaatttgcaatcagaattgctgttttaaactagggcatctaatgtattggtgaatgttatatagttcctgtaatttatttatttttgttcatatatgtgtcagtgtctacctatgtcccattactttttttccttttgacttctgacccttctcttgagatgtttcttctttatattattttatttcagaaactgctagaattccttcaggactccagtacccctgtggtgttgtcatatcgaattgtcagggcgggggtggggggtgttacccatctgatctcagccaaatcaggatgggacatcattcaactgaaagccaagagggacacaattggaaagcagtgcaccatgctttttgtatattgcacctgtctcttgggtggcatgctaaaagtagcagcactttcagaaagagaaaagctggcagatgttggcggtgattaaagggatgattaaaaactggcacactctctccatgaaagtgtgtctgtgtttattcaactacacttagaacttggcaggtcttggagatctggccagactggcaaagctctggcaggaccactgttactcatagtttcttcttccaagatacaaggatcagatactaagcaattaaatttaccaaaataatatataatgtcataaatataatttttgtatgaactaagtagtatataaggaagttactttcacaatatggttattgaatattacaaacactaatacttagagatgtagaattctatgataccattaattcataggtttgtaaatatttgggtgtttgcatggaaacaatttttgtgtataaaataatttaaaattgaaaatgcataagtaaaatatttggcttcttacaatcatgattacactttttttctaggagaatctgccgttaatatagccattatagagattttcaacacaattatccatgagacactttgttaaggcaaatgagaaacaagatatgtactgaccgttctgaaaacataaaatgaaacggcttacaaaagtttgcaagaatgattcatcaatagatagttttgggttttcaattattattgggagtataaaggcacataaagtataagcaaattctttatgtgaacttgtgaattactaatagtaaattagaagttgatgagtcactttacaaatatctaattggggagaaataatatattattgccacatacatgattgccagtgaaaaatatagactaatattattattgaatgcaaagggatctttgaattcaacctttcttccaatttttgaattctttatccaacatccttgataaatagtcatttaatatttttgctgtcagctatgttttttttttttttgccacctccagccatgaaacccattggatttctctattgccaacacatttctatgcctttggcctactgtttctcctgtctggacttctttcctcccctgcaatttccaaaatattatttgcctggcaatatgaaatgcttccttctccgtgaagaggctttcccagttctgtcaaggtagctaaaaacatcttttgttctctactgttgttatggcatttgccatactatattgctattataatgtacacacacataaaaatatttgtaactctcactttaaaatgcttgtggtcagcaatggtaaaattcatttgtatatttttggaacttagcttatagtcccctcccaataagtatttttttgactacacgtgtgaattaatgaataattttaattggaccagaaagaacagtcacaaaattacataagcaagaattaaaataaaatacttgagctcataagatttagaaaaggtactgacatagatgagctattgctgaaacaaccagtattatctcattttcattttttaaaagagctatattaaccaatgatggccccaggtaactgagtgaagtgagcctagagacaagtataatgaagagttttcacattgctgagaagaatcaaaagtggacaagaaacaaatgttgatgtcctgtagcatgctgttgaaattcatgtcttttgtcatgctggtaccctctcagcaaatgataaaatcctcaaaatgataaaacttggatttctggcaagcacccattgtttgccattattgtccatcttgataatagaaataaagctgtaagatttcgctgaaatcagtatattattactttttccaacgtagctataagtggaacgaaggttaatacatttgctaagtttctttcattgtgaagttattagagtatgttcattttgtaactgttgttttataacaaaacaaacacataggaacacatacaaaggattttttgctccttagttcagctaaaatctgggttcttgtctcatgaccaggaaaagttaggcacatggacgcactgaagggtgaggagagcagaatttattaaaataaagctgtctgtgaaaaaaacggcatcctgccagcaagctcccacctcacagatagaataccagaccaccacacatgagctgaagcggctgggatcctcctgctgcataaggcacaagttccctgtggctccaccccattctcccagtgcacaggcaggcccttattctgagtcactccacactggtttacttctcttactgcacatgtgttaagggatggaatttttcaccttgggcatgtttaggcaagccccctgtgcagaatgaccccgtgtggcatttggctgtctcctgcctctatcattcccctctctaaataagtacatctaactgccattagaacaaggataaggttataagggcaaataccaatcgtaactgattcctgctgacagggatgctgttttgtgaaaacagtagtcagatctccttcagaagcctatttaagggttcccagcaaaaggagccactgtctgagactccgttgcatgactgtttggagtttgatggtctgaaggcaagaagagataaattgggttattagaaaacatgtatcaaaaatcctaaagccttttactagtttgcatggagagagggaggccaaaagcctgactggtaaaaacaaacaaacaaacaacaacaacaacaacaacaacaacaacaaaaactttgcccttttgacagcatgttgggcttctggccccgagcccaatcctaagacaaccagtttaaggtttgggaaattaacttttcccagtttgaaggatgcatctgatgggagtgtcctgtagtacagagacacaactacctatctgtgaagagaggaaagaggaggaaaaaggaaaaaagaaggcattattttcaaaggcatcacagtggttcaggatgcattcaaaaggggtacagactgaagatgaatggctactcatctagaaagggggtggcggggcatcccaggttcccttctcttcctagcaaatacccaaggtacatgagggagagaaagtgaggcatccctctttctttcttccatccttatatccctgagtcccagcaaccacaacagggtaccacccatgggtgtcaaagcagctttcacccatgtcaacaagggggcatagggggtgggaatatccactcttactcatttatgccctatctctcctgctgtcagtagcctttgagttccctagaactcatttttaccatggatactagcatgacctttatccatgaaatgagaggcttggcttaatcggcaggaattagtgatgctcacctgcactgtgccttttaacttcattattgtctgcctctgcatccctcagatccagttttctttcctagggcttcaactaaaagcttggaattgagtttgggaccaaaaatctgtcttggggaggtttcttggactccttatcataagctgaatgctaaagtgaagctgtggaattaagtcctcctccaacaagggacccaaaaaggaaacatttgggcatcctatttatttccatcacccaggaggatttgcaggataattgcccagaactagaatattgatccagagtttttcattttccatcccctcttactcttttttttttttttttttttttgagatgaattctcactctgtcacccaggctggagtgcagtggcaccatctcagctcactgcaacctctgcctcccgagttcaagcaattctcatgcctcagcctcccaagtagctgaggttacaggcatgcacctccacacccatctaatttttgtatttttagtagagaagggatttcaccaagttggccaggctggtcttgaactcttgacctctcaggtgatccacctgccttggcctcccaaagtgttgggattacaggcatgaaccactgtgcccagccctcccttttgttccttctgagctgtagacagagatcgcagattggttcataggaataagcagggttagtctataatgtaggcaaaaacttaaaaacaactaagcagtctagaatttaatgataataagttttgaaacataatttctctagtcatttttgttaaaaaaatcatgataggactgagttgcttgcaaaatagactttagtcttatacttagcctgattatttacataaagtgcagcaagaataattagttttacatatgccttttagattggctttgatggaactctgttccacaaggagtctcagataggactttctaaagccgagcccacccatgggtttgtaccctcaaacatctgtgagtgggtaaactcttttcttgaggtcccaagagcatggggttcttgggcctgttagaaagtgacattctttacttaccacaggttaggaacccagtatgaagactgtgtagacaaggtatgaggccagttttcccaagggacttttattggctctgcaagttgagcttgactccttaaagggaagcataccttttcatcaaagccttggtaaaacaaccagtttctccaactgcatccttttgcaaaagaaaatgggttgttattgcactgatgcaagcaactatattgccataagttaagaatactcaactagtttctaaattctgcagaagccagggagagagagagaaaaaaaaatgttccaaattttgttcacagaagtatatcttactcaattattaaaggctgtaaatagctcaaaataaatttccttgactctgaaaaacagaacaaggatcagcaatgttccaagcaaaaatcaaaaaattacttcagctttctattagttcagtctgtttagttaactgttgttttgcttaatatttatgaacatatcagctcttcatgagtcctgtacatttttttctctattccaatgtcacagtctccaaagttatcagaaacctgcatttgagagcacttgtcaaagttctatagctggttataaaccatcttttgaagaggatcaaaacaatacaattgtgaataacaaaatgtctggggtagttacagtcagagacatgattgacaaagaaagttggttatctgtatggtttaaaataacataacaaccctaattgtgattgatagcatatattcagccataagaattttagaaatcccatacaattttggaacatacattattattccctaaaatataacctgatgaagattaaacatcattttggcaatcccatgtacctaaacacgtcagacagtcctgtttacctctcttctggatgctccagaggccctctgaagcatccaaaagctagggttcaggaaagacaacctcgaagctaaaatgtaattttgggaagcctgttaaatgttagaggtttaaaacacttgatgttatgaaatagaatcccagattaccataagttattttgccaaaatgataactcaaaaatttaaaaaagcaaaaagcttttataacacttttgaatttagtcaatgttcacacacagaatttctttggcaaggttaattatttagaaaccttccacaacttctttgagcgtttggctttatcttatctaattcaaaccaatcctttaaccctaggcaaaaatttatattttgactacatctgcattttactaataatctttaaggctttttatttctcagagattaaaatcttgtaaaccaaaagatatcacagcttttatgttctctttaaaaaatatttgatttaagcatttatttttctttcaagccagttaattagagctcttttttgtagacatcacacacaacacatatataactacacaaactcacagaagaagatcgaagagctataagagtttttttatttgctaatctcctaactggactattggcctctgggtggagacctgtaagagcaaatctaggaaagcatgcactctctagggcctgctaaacaggtatagctgaaacacaaaaacagattttgagagggatccatctgcctccaattcgtgggactccctgaggaaaacagaggtctctctcaaaatggaatctgtggtggcttttctgttttttttcaaggagtcccaagccatcagaaattatcttagggccccttatgcttgcatttagagtgacaagatgaaatggagaaaaataattcagttgactgagaaaaaaatccttcttccagcaaaacaagatccaagaagggaaaacataaaggccttttaaatatacctataacttggatatccacttttaattaagctgaacactctttaagaaaattcttttaaatcccttgttacatgactttagctgcaccaagcagccagtatttctggctttcaaactttactgaaggtaaccacccaggtactcagagaaaggaaaattcaaggcagttcatggagtagaagagaataaacaaatggcaaaggtcacacagatatcaaaccacaaaggactcattccctaagccaggattgaacccaggccaccattgtaaaatagtggaggctaaaacaaagcattgccacatggttctcccaaggacgtaaaacaagatagaagcttgcagcaaagtttgctactgaccagttagccaggctggcttgaacagtgggtctatggagtcctaggcccacatcccatccttagatacccctctttctgacagaaccatactaaagccatccaaagcatcgccagattggctacagcttaagaccaatctcacaaatccatttttgtaagtaaaactttacaaagaatgtaaacagtgatagttgggttcctggcctagtaaaacgtccttgaaaaggaaagaatagcctcttgcataaaagttagctcctgacctaatggagaaaaggaaaagaaaaacagcttaaatgcagggctagaaagataccttggggaagaacctcttattcttatgcaaatgggtttttccaacagggagagaaacttttaattgccattggatggagatggactcctcggctggaggaggggaaggcaccatgcatgcgtggcagggaatgctggccagccagccaagcggggacttgggccatgcgccatagccccaggtaggagggtaggggggtgggagtcaccactcgcctgtctatccagtgtgcgtgactgcagccactggggtggggttagaacacccccaatattgtaaaggaaaaaatagatgccatacagtcccaacaggaaagatagaaaatgccacagaaaagactgggttggattgaggccgacattcctgaatccgaagagtgacagtagggggttggtggggtggggtgcagtttcctctaccctcagaagaagtctgaggacaggaaggctcagaaacgagggataaagattttttggtctgcattttactcacctttcctcgttccccaaacaggctaccaaaatgatgcaggatttttttttttttgcttctcagctcagctaaaatctgagttcctgtctcatgaccaggaaaaattaggcacacagacaaattgaaagttgaggagagtagaatttattaaaagaaagctctcagcaaagaaagggggtcctgccaacaggctctcacctcacatattgaatatcagaccaccacacaggagctgaagaggacaggcttctccctgcataaagagtgaattcctggtgtctccaccctgttctcccagtgtacatacaggtgggtccttagtctgagccattccacattgatttatttcccttactgcatatgtgttaggaaatgaaatttttcaccttgggtatgtttaagcaagcctcctgtgcacagtgccctggttggcatttggctgtctcccgtctctctcgcaagcacacacgatgacttgagatgatgcatatattcaaggaatggatattataaaaataaaaattattaatctgggccatgttcacacttctgttgctctttatttccttgactgggggaagttttcttaattttatttcagccattatggcctttcatgcatttcaattttgagcctaatacttttaatgaatgttctatcttggttaatattttcacagaatgctgttttcagtaaattttacataatgcagcttatcagctaatgtttcaaaatataacatttttgttatattgctatcattgagtgggtaccactcaagaattttaaacaggagataaatttactgctatttattttctctgtcttttttttttttttttttttttttgagacgaagtcttgctctgttgctaggctggagtgcagtggcacgatcttgactcactgaaatctctgactccctgggtcaaatgattctcctgcctcagtctcccaagcagctgggattacaggcacctgccaccacacccagctaatttttgtatttttagtagagacggggtttcaccatgttagccaggatggtctctatttcttgacctcatgatctgcccaccttggcttcccaaagtgctgggattacaggcattagccactgcacctggcctcttttagacagcactagtttacagatcaagatctattctcaaatatctaactatatgtttatatatttatactgtttgtgtatttatattttcaagtagtttttccaggaatattgaagcagagagaaataattatgtaatgaatctctgaggttcagttgaaaaacaaaagtaagagaaagcatctttatgattttaaaaaatgatctttatctcaagagcaagtgaatgagactgtagtcatgaataaaatgtaaaatttcaaaaagatttataaataaaataaatgttggaatttggaattctaagggatggaaagaataacaaataatgaaaataaaaatttcaataaaatgtcaacaaatgggaagtaatagatagtattaggtaaaaagaatttcaaggaacatttagaaaatcacacacatacacaaatatatgaggttgcataggagacattcaggggtactgctagttgaatcaaaattttaaaaccttgaaaaatgagacatgtataagaattataccaaagcaggatgacttgaaggacttaaactcagaaagtcaaaattagaaggtagctgcaactaataactgacaagatgtcaaggtatggagtaattaacctctagagatatcttccaattcaaccaatagctattttttttaaatactataaaggtccttgttcactgaatgtcgtgtgttattatgaataaatctgacacagttctgtagaactcaagaggtttttgtgttgtttttgtttttgagacagagtctcgctctgtcacccaggctggagtgcagtggcatgatctcagctctctgcaatctccacctcctggattcaagcacttcctgtgcctcagcctcctgagtagctgggattacaggcatgcaccaccatgccagcctaatttttgtatttttattagagactgggttttgctatgttggccaggctggtcccaaactcctgagctgaagtgatcctcccacctcggcctcccaaaatactgagattagaggtgtgagccaccacccctagcctaagaggtgttttttaaacactcttcaaaatacagtcgacaggcttcttcttaaaaataaaatagattatagatgtattctttaaggaagcaggagagatctagtgcttatttccacaactgcattcctgctatgtctactctcttttgaaagaatgtgtgcagtgagttagattttgtgctagaaatgccaaaggtgaaaaatagaaaaatattatacaagttaaggattatatgtatatattcatttcttcaacaatgatttattaaataactatttcttccaggcactgttctaggcattgaagatacagaagtaacctaaatggatattaacttttctcatggtgttccggtgtgggaagacagacaataataatacaaaagagtgaatatgtgtcagagtgtgaagagagttttggagaaaaaagacagagttggtagatagtactggggttgctattttagacaggatgatcaggaaaaatctctttaatttggtgaaaattaagcaaacaccaaaatgcaatgaggtggctatgttggggaaaatgtaaattacaatttataaaatgcattacaaagtgtattattttatttgagttctacaacaactgtaggaagctagatatatattattatcattcttaatcttgtggaaactacagttaagagagggcaagggagttgaagttacctgcctagtagagaggggtgttatatttaatccaagtcaaatattactagttcagcaacaggtcttgacaaaattgcttactttctctaagcctcagtcacctaattattaagatggggataatagtaatagtgaccccatagagttgtgacaattgtaagatgatctgtataaatcaatttagtgtttggcataggcgtctgacaagccttgactctagatcaggggtcagcaaactattgccctcaggccatagccggtctgctgtctgtttttgtaaaacatgcgagctaagaatggtttttacattttaaatggttggaaaaaccaaaagaacattatgtggacttcaaatatcattgtccataaataaagttttattggaacacagtcattctcattcatttatgtttgtctaaagctgttttatgctacaacagcaaaattgaggagttataacagagaccatatagctggcaaagctgaaaatttgctaactgaccctttacagaaaaattttactgatccctactctggatagaagtgctcaactttgctgcccaagctatgtgttgtttctttttatttcatttatttttatattattttatttttaataagcatataataattttacatattttgggggtacctagttatgttgtgatatgtaccacgcacagtgatcagatcagggtaactggcgtatccatcatctcaaacatttattgtttctttgtgttgggataattcaatatcctccttctagctatttaaaactatatattattgttaactataattgtcctatagtgctatagaacactataaattattcctcctacttgtctgtaaatttgtattcttcaacaaatctcttcctatccccaactcccaccacccttcccagcctctagtatcctttgttctactttttacccctttgagatcaacatttttttttagctcccacatgtgaatgagaacatatagtgtttaaatttctgttcctggcttattttacttaacaaaatgcctcccagtaccatacaagttgccacaaatgacaggatttcattcttttttatggctaaatagaattccattgtgtttatataccaccttttctttgtccattcatctgtggttggacacctacctcaaggctgattccatatcttgattattgtgaatagtgctggaataaacatgggagtgtgtatatctcttggatatactgatctcctttctttcggataaatgcccagtagtgggattgttagatcatatggtagttcaacttgtagtttcttaagaaacctccatatgtttcttcatagtggttgtactagtttacatcacatcaacagtgtataagagttcccttttctttgcatatgtcttgccctttcaagtctgcaaagaggtctgcctataccacctaatctaaagtagttccttccatcccaatctcacctcttaatttctttccattgctatgttttattttcatcaatgcactcactagtgtctgaaattatcctatttattttgtgcttgtttatcagtttccttcccacttgatgaaatgctctgcttgtgtaaaaaatccatctgacatcttgtcagttagagttttaggatatatttatgttttgcctatatgtctttggtcttatttctcagtttcctatgaactctgaatggtaaagaggtgttgttgatagattctgctcaaaatctctagaaacatgtatagattgtttcttttgaagaatgggactatactctagatcttatttgactttattttctctctttattttaccttgtttgtacatataactccctatttttttttttttttttttgacacagaatctcactctgtcactcaggctggagtgcagaggcacaatcacaattcactatagcctctacctcctggctcaagtgatcctcccacgttagcctctccagtagctaggattacaggtatgtgccactgttccccactaatttttgtattttttgtagagacagggtttcaccatgttacgcaggctggaacttcctattattttaataactccaatatatagataaaattagtttaactattatcatttggatggaaatttgtaataatttattattacaaacagtgatacaatgagtattttgttattttgttcatttgtgcaagtatttctgcagaatagtattatatgtaaatattatctcaagaaatatgcctattttaaagtttatagatgttgaaaaattgctttctaaagagctgtgtgaatttttatgctccttaacagcacctcttccccatatcttaactaacactggatattgtaaagatttttcatttcaggccaatctggtatgtaaaatgtgatactgcattactattttaattttttcattgaatatatatgactggacatatttgcttaggtgtggtggtcatttgtattcctttttctgtaaattaccattcatatcattactcctcaaaaatgttgaattgtcctttgttaaaattgatttttatgagttctttaaaaaattttgacattatttctttttaatctcatgtatgttttaaatatttcccatttgtctattaattatctttgagttttgcttctggtgtcttgtagccaaatctatcagctttttctttgtggctgttagattttaagccttgaagaacttcttcactcaaaaattataaaaatatttctccatattttcttctagtaattttataaatttttaatgttcagctctttcatctatccaattttgcctaatgtaattgatctaaattaaattttcccttaatagttatctgccgcaatattatttactgagttgccattttttaaaaactacttatttgaaatgttaacatctaaaaacatatgcagttattccttgattatatttttttaagtaaaaaaattaaaattaaagaacggaataaatacaaaagtacacaaattgtgaacaaaaacttgattaatttacaaagcaaacacaccatgtaactatcagctatgtcaaggaatgaaattattactatctcagaaaactgtattctgtaggtagtccattgtatcttcaaatattgataattctgtcttttagaaatatattttaattttgctcctactatgttaggaaggtctccagaaatatacaaggacctctttctcttgttcctgctttaaatggggaatgcttttgatcttttattattaaacatgagatttcctgtaggttcttggtagattctccccaataaagtacagaaaaatgtttttgtattccaaatttataaagataaaaaaacatgcataggagctgaatttttgtaaggcaacaatcagaattgcctgaaggtgaccttataggctcaggctggcttgcttgaacatcaggctagctgggacaacaacatttctcctacaacagtaggagaaaattcactgaaattcagctttcaccctctctctgccccacctttgaaggagaaactaaaacatctcacctcactaatatctttactaagacaggtagctgacctactcaggcaattcctctaaactgcttttgctccaaatccagaaaaccggatgctaggcagcctgagtgctctccccacccacaagattgactctcatgattgaattatcaggaggagagatgagggtgtggaggtgatagtagaggctggcagtagacctctgggtctactgggttagcaatgctctggcttggtttgtcttcctgtgtcatgttgaaaggattaggggttaccacttacgccgtctcttcatttctggttcctggcatttataaattctccctttcccaaaaagtgtattcttcaataggtgtaacattgtagaattcatctgatactttgtgcgtagagatggtactcactcaggttagagccaccagctggggaaattacatgaatagcatctgtcatgattatcacattttaaagccaatttgttaatgaattgcattatattaatagatatattactgcttaacttttctttcttgtgataaacgctaacatgatttaatgctagtctgattcaccagtatttatttatcattataaaaatctctattaatgagtaggaggactttatagttttttttgtaaataattttgacacaattttggggaggcttttcatctttatttctgtgctccgaataaatttaaataacaaggagttatctgttctttttgaatttagcaaaactgactagtaaaactgggtatgtgcattttgtagagagggtagatattgatatgctttcaatatgttttttcactactgtctaatttaggcttcctatttttaaactcaaaattagtagtttaagctttcctgggaaattttctataattatccacttcatctaatttccccttcccccaacccattacaatatatatatttttttttttttgagaaggagtctcgctcagttgcccaggttggagtgcagtggcacaatctcggctctctgcaagctccgcctcctgggttcatgccattctcctgcctcagcctcccaagtagctgggactataggtgccggccaccacgcccggctagttttttgtatttttagtagagatggggtttcaccatgttagccaggatggtcttgatctcctgacctggtgatctgcccacctcggcctcccaaagtgctgggattacaggcgtgagccactagaataaatttttatgttattgtctttaactttaaaaaatatgacccaatattccctttcttgttctgaatttattattaatagcttttgtataaaaagactttccaaagtttctgtttctaaagaactagtttaggaatttgtttttataggcatgctttattttgttgaatttcgtagatgttgcgttttttatacagtgaaggattgaggcacttctgcatctagcaggtctattggcatcatttctgcaacagcgtgtactcacttgtgtctctgtgtcacatttggtatgctatggtgatctgtgatcagtgatctttgatgttattgcaattattttggggtgccatgaaccattcccatgtagtatggtgaacttaattaataaatgtgtgtgttctgactgctccactaactggctgtttctctgtttctcttcctccccttgggcctttctattccttgagacacaataatattgaaattagaccaattaataaccctgcaatggcctctcggtgttcaagagaaaggaagagttatacatctctcccttgatattgaaagctggaaataatgaaccttggtgaggaaggcatgttaaatggctgagataggctgaaagctaggtcactcatgccaaagagttagctaagttgtaaatgcaaaggaaaattcttagatgaaaattaaaagtgctagtctaatgaacagatgaatgataagaaagtgaaacaaccttgttgctaatatggagaaagttttagtggtctggatagaagatcaaatcagcacagcattcacttaagccaaagtctaatccagagcaggaacctaagtctcttcaattctgtgaagactgagagggtaaggaagctgtagaggaaaagtttgaagttagcagaggttggctcatgaggtttaaggaaagaagccatgtccataacataaaagtgcaaggagaaacagcaagtgcttttttgtagaagctgccataagttatccagaagatttagctaagatcattgatgaaggtggctgcatacactaaacaacagaatttcaaagtagacgaaacagccttctattggaagaagatgctatccagcactttgatagctagagaggagaagtcaatgtgtggcttcaaagcttcaaaggataggctgactctcttgttaggggataatgtagctggtgacatcaagttgaagccattgctaactgaccattctgaaaatcctaaagcccttaagaattatgctaaatctactctactgtgccctataaatggaacaacaaagcctggatgacagcacatctgtttaccatgacttgtttatttaataaagtccactgttgagacctgatgctcagaaaataggattccttttaaagtattactgctcatttgaatgtgcttggtcacccaagtactctgatgaaaatgtgtaaggagactgatgttttcctacctgataacacaacatccattttgcagcccgtgaattaaggagtaatttcaacttttaagtcttttgatttaagaaatacatttcataaggctatagctgccatagatagtgattcctctgatggatctgggcaaagtaaattgaaaacctgctggaaaggattcataattctagattccattaagaacatttgtgttaggaatgtggcaagtcatttacttcttccagtgtccttcaaggccatgaaaggactcatactgaagaacctgaggaatgtaagaaatgtggtgaagccttcggttgttccagttccctttgaaagcatgaaatttcttatatgtggttttaaaaaaccctatgaatgtaagaaatgtgttaaagctttcagatgttctaatttcactagaacacatgaaaaaactcacactggagaaaaacccaacaaatataaggaatatgagaatgtatgcaatttccccagttccctttaaaaacagaagaacctatactaggaagaaaacctcataaatgcacaaaagtggtaaagcattccattttccctgttgctttcaggtacatacaagaattcacaatagagatataccttgtaattttcagaaatgtggtaaagcctttagtttttttatttttcttgaaatcatggaaggacttagtggagaaaagccgtatgaatgtaaacatttggtaagtcctttagttgttcctgttccatttgaagatatgaaagaactcatttctgagactaaccctataaatgtatacagtgtgggaatgcttttatttctctgatatttattcaaaggtgcatgataacatatactggagattgaccttacaaataaaagcatgctgagataaaaccccagtagtttggaaaatacagggaagttttcaattgtaacaattactttaaaagttatgtgaaaactcccacgggaatggaatctcataaatataggttaattggaacttgtgatgcaaagtaattactgcataatgctaaaaatgcacataaattctatactcatcacaaatgtatcgtatttgtcagtggttcattgttgaagagggactctatacttttgattttcacttgttttgcaaggaatcatggaggtgagaattctgtagatactctataagccatagtacatgaatttaataggcagtggttttattctcatcagttaataaaatgtttgtgtatccacttaaaagtgtgttagacccctaggtgagttgaaatgcatttctaatatgtaggcgtctttaattttcacgtagttgtttaattgttctgtaattaatgggccatggaaaaatgagttcttgttaattgtttgaattttcttagtggttttatgtgtcaagttttagctagtacttacccattatatatatataatatacattatatataatatataattatatatttatagatttgatttatatatataattctatatatcatatatatgatatatatatcccaccattttaatgggaaagactattttttggccgtaaaggatgtttcttcaattttctttgctaataaagagttgtgatcaattttcaaaaaaaaaaagaacactagtgattcatgggaagaggtaaaaatatgcacattaataggagtttggaacaggttgattccagctctcatggatacctttgaggggctcaatgcttcagtggaggaagtaaatgcagatgttctggaaataacaagagaactagagttcaatgttgaagcctggagatgtgactgtgactgaattgctacaatttcattataaagtttgcatgaatgaggagttgcttcttatggatgaccaaataaagtagtttcttgtgatggaatctgaagctggtgaagatactatgaacattgttgaaacgatgacaaagagcttagaaggttacctaacttatttgataattcattggcagtgtttaagagaattgactacaaatttgaaaaaagttatatgagtgaaatgctatcaaacagcatcgcaggcttcttgtattaaatgcttggtttatttattttcaactctttcttttcagttaatacctgtatttaagttgatttttttgctaagtgcttctttgctcatcacatagactttgtcagtaattccttaataattctaatttcctttttgatttcctctttaatgtaagtaatttaggagggtatttttaatctttaaagagacagattttcatttgatgtattgagtaacttgttatttgatttataatatgattctatttttctcccaagtcagtacattaagttctgcctcgttttcttaaaagttgcattgcattaagttttatagatgtatcgtaatttattaaaccagtatcatataggtagagatttagagcctttagaattttagcttgtacaaagagtgctacaaaatatttttatcaacgcttatgtgcaggtatttcttcaggaaagcaccctagaattgaaatcatagggtcaaaaacttatgtatattttacattagacagataccactcaattgggtttcaaagacttttacatatgtaccaacaacaatactgtttcctttcatcctcatcataagtaggtgtggtcaaacttctaattttctttgtgccaatcaaattatggtatggagaacaatggtccccaaagatgtccatgccctagttctgggaacatggcaaatgggactttgttgatatgattaagatatggacctttagatgggagattgtcctcattatcctatccagtagggcccaaaataatcacacaagctcttagaagcagaagagagagtcagaagaaggggtgagagaaatacagcataagaagacttgacccacaattgcaggttttaaagatggaagaaagaggctatgagccaagggatgtgctggcttctagaagctgggaatgacccctggcttacagtgagtgagaaaatcaagaccccagtcctataactacgagaaactgaaatctgccaacagcctgaataaagacaaaacatgcttccctagaataaacaggaaacatgcttccctagagcctccagaaaggaaggcagcctgccatcatcttgagagtatattgagacccatttcagacttctgatctacagaactgtaaggtaatatatttgtgttattgtaagctactaaaatgtgatgatttgttatgctagcaatggaaaatgaatacattgatgctttaattttctttccaagataagaagtaaattggagcatttaattttttatttacagtgttattgaattgtgattagaaaatgtgatctgtttgtttttgtttttaaattttatcaatatttcctatgggccctaatatgctaatgtagtttttatctcctgacaggaccctgattaacattctagtgtatgtaaatatctcaatttttatttgaaaataatacacattcaccatttatcgggtataaaatgcaacgttgctatgtggaactattaaataaaacttagttatttaaatcctttatatttttacttaatttttttcaatcacctgatctcttaaattctgaaagattttctaaattcttctataatgattgcaaatttgaaaatttatcattgtgttttttctaattgaaatgatgaaatatttgatgctaatgaaaatttcaaagcatataaatgaatagctatgactgttggttgatcttatgaactagaacattaccaactgataggctttggttgtgtccccacccaaatctcatcttgaattcccatgtgttttgggagggaccaagtgggaggtaattgaatcatgggggcaggtgtttcccttgctgttctcatgatagtgaacaagtctcacaagatctgatggttttaaaaaagggagtttccctgcacaagctctcttctcttgtctgttgccatgtgagtcatgcctttcactttgcaacatgattgtgagccctcttcagccacgtgtagctgtaaatctataaacctcattcttttgtaaattgcccagtctcaggtatgtctttatcagcagcatgaaaacggactaatataccaatactttgcaacacctctgtgacttcctgtatcttattcgtcttctttccttaagagttaatcaactattctgaatttagttttcatcatttccttgcttaaaaaaaattctatcatatatgcatttctattcctagacaatatattactcaagttttgtttgcctttgagctttaaaaactgttgtatagtcgtttctccagaaaaacagaaccaataggatatacagttgacccttgaagaagccacatataactccccatgcagttgaaaatccacacataacttttgactttgaaaaatttgggctaggtgcagtggctcatgcctgtaatcccagcactttgggaggctgaggtgggcagatcacaaggtcaggagatcgagaccatcctggctaacatggtgaaaccccctctctactaaaaatacaaaaaattagctgggcatggtggcacatgcctgtagttccagctacttggaaggctgaggcaggggaatctcttgaacctgggaggtggaggttgcagtgagctgagattgtgcccctgaactccagcatgggcgacagagtgagacttcccctccaaaataaaaaaaaaaaattgactactaatagcctaacatttatcagagccttactgaaaacatagacagtcaatgaacatatgttatgtatgttatatgtattatatagtatatcttattataaagtaagctagagaaaagaaagttttattaagaaaattataagaagagaatatgtattgactattcattaagtggaactggattgttgtattgttcttcattcttatcatcttcacattgagaaagctaaggaggaggaggagaaagctaaggaggaaagctaaggatgaggaggggacctgcacagttaaaacctgttgttcagttgtttctgaagtggttgtaatttacctctttaacagcagttgtctaacaatatatttctgtcagttcactttcttaacattcagtgtcctgaatggtattgctgaggctttcttctagggttcttatggttttaggccttacatttaagtctttaatccatcttgagctaatttttgtataaggtgtaaggaaggggtccagtttcagttttctacatatggctagccagttttccaaacaccatttattaaatagagaatcctttccccattggctgtttttgtcaggtttgtcaaaggtcagatggttgtagatgtgtggtgttatttctgaggcctctgttctgttccattgacctatatatctttttttggtaccagtaccatgctgttttggctactgtaaccttgtagtatagtttgaagtcaggtagcatgatgcctccagctttgttctttttgcttaggattgtcttggctatgcgggctcttttttggttccatatgaactttaaagtagttttttccaattctgtgaagaaagtcaatggtagcttgatggggatagcattgaatctataaattactttgggcaatatggccattttcacaatattgatttttcctacccatgagcatggaatgttttctcatttgtttgtgtcctctcttattttttgagcagtggtttgtaattcttcttgaagaggtccatcacatcccttttaagttgcttcctaggtattttattctctttgcagcaattgtgaaagggagttcactcatgatttggctctctttttgtctattattggtgtataggaatgcttgtggtttttgcacattgattttgtatcctgagacttttctgaagttgtttatcagcttaaggagattttgggctgagacaatggggttttataaatatacaatcagtcattggcaaacagagacaatttgacttcttcttttcctatgtgaatcactttatttctttctcttgctggattgccctggccagaacttccaacactatgttgaataggagtggtgtgttgcaggaagtcagggaccccaaacagagggactggctgaagccgcggcagaagtacataaatcgtgaagatttgacggacgtttattagttccccaaattaatacttttataatttcttatgcctgtctttactgcagtctctgaacataaattatgaagatttcatggacatttattacttccccaatcaataatcttataattccctacgcctgtctttactttaatctcttaatcccgtcatcttcgtaaactgaggatgtatgtcacctcaggaccatgtgatgattgtgttatctgtacaaattgtttgtaaaacgtgtgtgtttgaacaatatgaaatctgggcatcctaaaaaaagaacaggataacagtgattttcagggaacgagggagataaccataaggtctgactgcctgcggggccaggcagaacagagtcatatttctcttattgcagaaaacaaataggagaaatatcgctgaattcttttccaaggaataaccctaggaaaggaatgcattcccagcggtgggtctatggatgtctgctctgggagtgtctgtcttatgtggttgaggattagggatgaaatgcaccctggtctcctgcagtgccctcaggcttactaggattgggaaattccagcctggtgaattctagtcagaccagttgtctgctctcaaacactgtttcctgttaagatgtttatcaatgacaatgcatgcccagtgggacatggacctcatcagtaattctaattttgccctggccttgagatcttgctctgcctctctgcccttgtggtcttttattgccctttcaagcatgtgatctttgtgacttactccctgttcatacccccctccccttttgaaatccctaataaaaacttgctagttttgcagctcaaggggcatcacagaacctaccaataggtgatgtcacccctgggggcccagctgtaaaatttctctctcttgtactctttatttctcagactggccgacacttagggaaaatagaaaagaacctacattgaaatattggtggctggttcccccgatagtgccgagaaagggcctccttgtcttgtgccagttttcaaagggaatgcttccagcttttgcccatttagtgtgatattggctgtgggtttcttataaatagctgttattattttgagatactttccatcaatacctagtttattgagactttttagcatgaaggggcattggattttatcaaaggtcctttctgcatccattgagatgatcatgtggtttttgtcattggttctgtttatgtgatggattatgtttattgattgttgtatgttgaaccagccttgcatcccagggatgaagctgacttgatcgtggtggataacctttttgatgtgccgctagatttggtttgccagtattttattgaagattttcacatcaattttcatcagggatattggcctgaaattttctttttttgttgtgtctttgtcaggtttttgtatcaggatgatgctggcctcataaaatgagttagtgaggagtccctcttttcccactgtttggaatagtttcagaaggaatggtaccagcttctctttgtacctctggtagaattcagctgtgatccatctggtcctgggcttcttttttgttggtagtctaataattactgcctcaatttaggaacttgttattgttctattcagggattcaacttcttcctggtttagtcttgggagggtggatttgtccaggaatttatccatttcttctagattttgtagtttacttgcatagaggtgtttatagtattctctgatggtagtttgtatttctgtgggatcagtggtgatatcccctttatcattttttattgtgtttatttgattcttttctcttttcttctttattagtctggctagcaatctattttgttgatcttttcaaaaaaccagcttctggatttattgatttttagaagggttttcatgtctctagctccttcagttcggctctgatcttagttatttcttgtcttctgctagcttttgagtttgtttgctcttgcttctctagttcttttaattgtgatgttagggtgtcaattttaggtcttttctgctttctcctgtgggcattcagtgctataaatttccctctaaacactgctttagctgtatccaagagattttcatatgttgtatctttgttctcattggtttcaaagaacatatttatttctgccgtaatttctttatttacccagtagtcattcaggagcacgttgttcagtttccgtgtagttgtggggttttgagtgagtttcctaatcctgaattgtaatttgattgcactggggcctgagagactgtttgttatgatttctgttcttttgcatttgctgaggagtgttttacttccagttatttggtcaattttagaataagtgcagtgtggtgctgagaagaatgtacatttcgttgattggggtggagaggtctgcagatacctactatgtccactaggtccagagctgagttcaagtcctgaatattcttgttaattttctctcatcgatctgtctaatattgacagtggtttgttaaagtctctcagtgttattgtgcgggagtctatgtctctttgtaggtctccatgaccttgctttatgaatctgggtgctcctgtattgggcgcataaatatttaggatagttagctcttcttgttgaatcgatccctttaccattatataatggcctgctttgtctcttttgatctttgctggtttaaagtctgttttatcagagacaaggattgcaacccctgctttatttggctttccatttgcttggtaaatactcctccattcttttattttgagcctatatatgtccttgtatgtgagatgggtctcctgaataccacatcaatgggtcttgactctatccaattttccagtctgtgtcttttaattgggacatttagcccatttatatttaaggttaatattgttatgtgtgaatttgattctgtcattatgatgctagctggttattttgcctgttagttgatgtagtttcttcatagtgtcaatggtctttataatttggtacatttttgcagtgacagatactggttgttcctttccatgtttagtgcttccttcaggagctcttgtaaggcaggcctggtggtgacaaaatctctcagcatttgcttgtctgtaaaggattttatttgtccttcacttatgaagcttagttttgctggatatgaaattctgggttgaaaattctttaagaatggtgaatattggcccccactctcttctgtcttgtagggtttctgccaagagatccactgttagtctgatgggcttccctttgtgggtaacccgacctttctctctggctgcccttaacattttttcctttatatcaaccttggtgaatctgacgattatgtgtcttggggttgctgttctcaaggagtatctttgtggtgttctctgtatctcctgaatttgaacactggcctgccttgctaggttggggaagttctcctggatatcatcctgaagagtgttttctaatttgtttccattctccccctcattttcaagaacaccaatcaaatataggtttggccttttaacatagttccctatttcttggagactttgtttgttccttttcattctttctcctctcatgttttctttatgctttattttgttaagttgatcttcaatctctgatatcctttcttctggggctattgattctgttatgcttcacgaagttctcgtgctgtgtttttcagctccatcaggtcatttatgttcttctctaaactggttattctagttagcaattcctctaaccttttttcaaggttcttagcttctttacattgggttagaacatgctcctttagctcagaggagtttgttattacccaccttctgtcagtttgtcaaactcattctccatccagttttgttcccttgctgggaggagttgtgataatttggaggagaagaggttttctggttgttagaattttcagcctttttgtgctggcttttcctcatctttgtggatttatctacctttgttctttgatgttggtgaccttcagatgggtttttgtgtggacatcctttttgttgatgttgatgctattcctttctgtttgttagttttccttctaacagtcaggcccctctgctgtagatctgctgcagtttgctggtggtccactgcagaccctgtctgtctggtattacccgtggaggctgcagaacagcaagattgctacctgttccttcctctgggagctttgtcccagaggggcacccgccagatgccagctggagctctcttgtatgaggtgcctgttgacttctgctgggaaatgtctcccagtcaggtggcatgggggtcggtgacccacttgaggagtcagtctttcctttagcaaagctcaagcgctttgctgggatatctcttcagagcaggcaggcaggaacatttaagtctgctcaaacttcacccacagcctacccttcccccaggtgttctgtcccagggagatgggagttttatctataagcccctgactggggctgctgcctttctctcagagatgccctgcccaagaggaggaatctcgagaattagtctggctacagcagctttgctgagctgtggtttgctgcccagtttgaacttctatgtggctttgtttacactgtgaggggaaaaccgcctactcaagcctcagtaatggcagatgcccctccccccaccaaggttgagcatcccagggtgacttcagattgctgagctggcagcgagaatttcaagcccgtagatgttagcttgttgagctctgtgggggtgggatccactgagctagaccacttggctccctggcttcagcccccttcataggaaagtgaacggttctgtctcactggcactccaagtgccactggggtatgaaaataaaaactgcagctagctcggtatctgctcagttggttgaccagttttgtgcttgaaacccagtgccctggtggcataggcatctgagggaatctcctggtctgcgggttgcgaagaccatgaggaaagcatagtatcttggccggaatgcactgttcctcatggcacagtccctcagggattcccttggccaggggagggattttcctgacgccttgcgcttcccaggtcaggtgatgccttagtctgctttggcttgccctctgtgggctgcacccactgtctaaccagtcccaatgagatgagccgggtacctcagttggaaatgcagaaatcacccaccttcttcgttgatcttgctgggggttacagactggagctcttcctatttggccatcttgccagccaccccctatcttattattttcttgcgtttccttttctttctttttttcattcttaagacacagtcttgccctgttgcccaggctggagtgctatggcatgatctcagctcactgcaacctccgcttcctgggttcaagcgattctcctgcctcagccgcccaagtagctgggactacaggcacgtaccaccacgcccagctaattttttggtatttttagtagagatagggtttcaccatgttggccaggctggtcttgaactcctgacctcctgatccacccgcctcagcctcccaaagtgctgggattacaggcgtgagccgccatgcccagctctttattttcttgattgttaatgagctgagaatcttttcttgtttattggccattgatatttcctttctgcgaaatgtgttttatgcattttttccaatttcctgttgggattttggtcattgtctttctttctttttttatttatataaatttaaagggtacaattgcagttttgttacatggatatattgcatagtgtttaattctgggctttgagcgtttctattagtggaataatgtatattgtactcattaagtaatctctcattacccaccaccccaacctcccatcctctgagtctccagtgtctattattcaacactctatggccatgtgtactcattatttagctcccacttctaagtgacacacggtatttgacttttcatttctgagttgtctcacttaagataatggcctccagtttcatccacgttgctgctgaagtcataatttcattcttttttttgaccgaatagtactgcattatgtatgttattttcttacagaatttaaggtattatttatgtattttttttttctctctgtatgtattttttgctctgttgcccaggctggagtacagtggtgtgatgatggctccctgcagccttgatctcctgggttgaagccatcctcttgcctcaatctcctaagtagctgggactacaggaacgtgccacgacacgtggctaattttttaattttatttttgtagagatggggtcttgctatgttgcctaggctagcctcaaactgctgggctcaagcaatactcccaccatggcctcccaaagtgctggaatataggagtgagccactgttcacagctggtctccatatttaatattttgtttctcttaagtgtggcaaatctctttcccagtttgtgatttggactttgttttttgtttaatttattcatcttttataatttactttttaaagtcttatttcaataatcattccctacctccagatcataaaagtattctgctttatttccccccatcaaacattgataattaatttttgcaaatggtttaatcctatttcatttattttttgatatggacaatcattttttcagtaccactttttgaacagttagttttttccaggtgactgcaaagacacttctgtcaaatatcaagttttcattttttgagggtctgcttctggacaatgtattctattagactgtctatttgcccatcagagttcctatgccactctgtattaattattctagtttcaatataagttctaatatatactagggcaacactctctgcttccttctttttccttcagtctttgtccttgtcctctttcttgtcctccttttcatttttttttggttattcttaggttttaatattttcatgtaaattttaaactctatttcaagagcttttcaaattcctttaaaaatttaaaaaatcttcctggaacttgactgaaattgcattgaatcaatagataactctgtagagaattgacatcttgatgacattgagtcatgctatcctattatggaatatgatatctctatttaggtcatatttaattaaaatggtctgtataaaatattaataataactgctgtagaccgtcacatagaagtttttgtgcagacacatgtgtccagttctcttgagaatatacacaggtaagaaattgctggtccatatggcttaactatgtttaactttgagaaaccgccaaactgtttcctaagcagctgcaccattttgcactcctaccagctacgtatgaggcttttaatttctccacatggttgtcaacatttattgttatcttcttttagatcatagtcattctagtgagtgggaagtggtacatcattgtggttttaatttgtgtttacttgatgactaattttgagtatcttttgagtatatatagatatatatataacatctatatgtatatatagatatatatataacatctatatgtatatatagatatacataacatatctacatatagatatacataatatatataactgtatagatatataacagctataatatatagttgtatataacacataaatgcacacatatagacatatatatatatatatatatatgatttgcaaatgtcttctcccattctatggcttttttttttactttcttgatcacattctttgtagtataaaaaattttaatattgatggagtccacttacctatttttattaggttgtttgttcttttggtgtcatatcaaatacactattgcctaagccaagatcacaaagatttactcctgtgctttcttctaagagttttatagctttatttcctatatttataagaaatataaagttctatgatgtatactgagttaatttttatatctggtgtgaagtaggaacaatttttatcatactttaactctttagataaattttaaaaaattattttaacataatagctgatttaaaatctgtttctaatatgtctacaatctgggcttttgtagaaatagtttctgttaattattttcccccctgtgtattgctcatactttcctgcttctttgggtgccttaaatttttttggtgaaactgaacatctaaaataaataatgtggtaagtctggaaatgatagccccccatttccagggcttgttcttattggtatttgttgctgttagtttagtgacattcctgcactaattctgtagcctgtgttttttcttttaactgaccactggtgtctctgcctggtaagactgatggtcagctcatgattgaatagagatttcctaaaatgtcctgtatcagaagtctcccagcctttgctgatgggctgtgtgtgtgtgtgtttgtgtgtgtgtgttgcaaaatgtcttgaatgctccaatttgcagtctacaattctggcttagctttatctttcttcttgtgcagggactcaaagtgagccagaggtgagaaattacatgttcttaggtctttcttgggcatgtacagaaccctgcaaatatatgtggttttctagatcccagtaatatgtcagaacttttaaagctccctatgaatactttgtttcccattttttattccttttcaattttttggtcatcctcttgttagcccaactggtaaccctgccttagttagccatgaagttgaataattgccagtgatttttttttttttttgacaaataccgtgggataggtcagtttgcaaagactgacctctgagttaagtgaaataatgataaaccctgaaaatggtgcttttcaaatgctgctggtcaggtcaaatatattctttagggttagatctttagggagctccaaacctattctcccttctctaatggctactaggctgaaggttttcacagttaccatcattgtgaggctgttggtttttaaagctactgcaatgctagaaaaaggagataggattagggcaagttaaagtgccacaaaatttgctcttcttactgaattttagctgctttccttgaatgaacattcattgaattgctgcggtttttaatttacagcattttgaaaaagttgattttgataatttttgcaagtgttctttctcattgcttttatgaagagatggattttcagagttccttactctatcattctgatgacagagtatctgatatactaaatgttgatgtatttttaaatttgttgtttttgttatactcttaattttgaaaacaattaacaatgaagataatagagattgacataaataaatatgagagacatcaatatacctagcttttataattaaccaatgttaatcttcttatcattgttgtactctgttgaaatctactaataatacaaggttgtcatgattcaattatttggttgtttctgtcctaaaaagttacctatcttaagaagcacttggatcaggcgtagtggctcatgcctataatctgaatgctttgggaggctgaggcaggtagatcacgaggtcaggagttcaagatcagcctggccaagatggtgaaacccagtctttactaaaaatacaaaaactagcctggcgtggtggtgggcgcctgtaatcccagctacatgtttttaatgtccctgactttcaatcttctaatttataaaatagcaaccataacatacacctcatagggttatgttgaagattaaatgacacaatgtatgtaatgctctttcttcaatacatagtgcctataattatttaaaattgaagcagtagtttggatataatttcagttggaggaaattagcaggtgagacggtttattcatgtcagaaatttaacatcctcccacctctttcagttggttactttgaaattttccatacttcctcttcagctgtgattcttttgagggggcatcatttatttatatatttcagttccaaagcacaggaaaatatcctgttgacagcatcttcaatcaattgcacagtctacttctttcctagggccaggaagccttgggtaggttacttcttaatccaacttgagcagtagtgggcttactacttcgtgtaacatatcaattttacaaatttaccttgcatgtcagggataaacataggtgtttcacagaatgttatgtatctttccctaagtttctgtaaccactaatagatagcagtaacatcaaatgtcaaaatattaattgcttttttattccccaacatcagactgtgcagttacttagtaattggtgttaaatttatctggtagataaaatgaaaaagatattgatgttatatttcaaggggtgcttacagaaataatgaataacaaaaattaaattaagcaaaatgtacatgcaaacatttaaatcactttcgcaaatagaatttaaaacatttcacgtgatcttgctttgggattcacaataaataaatgctcagatattttacttagctatttttgaaatcctttctgtgtacttgagcaaatatttatgataaaatcacaatctttgctactcatctttaaattgccacgtgcaaaatttgggtggagtaggatacacagagaatatctatttttaaagaaagtaagaaagtgtgtggattttgttagtctaaatgttatttttcttcccaatgatgagggcatctccttagtctagccctgtgggttctggtgatgatcattcatgttatatatatatgtgtgatttgattccttggtccagtggccatttttagaagttatcaatttccctgtgttcttactttactccccatctccatttagttagtgatttaaagaaagagttattttctatcatattttttatggccgatttgaagaattttataagatccaaaatgttactgtttcttcccccaaggctgaagaaattagaatgtgagcccagaatatgtgtagaaaagaagctaattggagtagagcaccagactcaaatatcgtaggccagaatgctcacatatctgggtctataattatttggcaagtggcatctacagtgctttcactaggaaccaaagagattttgcccccaaatgtaaatgggagtgagggtaatatttgtatagggactacagtagttcagatatattgaggaaaagttcttcacatgttacttaaattttactccactcctgagactcagccattactatttttctttttttttcagacgagaacattttttttcttagagaggttaaatattttctcataagtcatatcactagtaaggatagagccaacctaggtctaccaaatacctaattccgtgtcatttttgatatattttctctttctttctttctttctttttttttttgtggtatggagtcttggtctgtcgcccaggctggagtgcagtggcacaatctcggctcactgcaacgtctgcctcctgaattcaagcgattctcctgcctcggcctcctgagtagctgggactacaggcaggctactatacctggctaatttttgtatttttagtggagatggggtttcaccatgttggccaggctggtcttgaactccagatctcagatgatccacttgcctcagcctcccaaagtgctgggattacaggtgtgagccactgcacccagcccatttttgatatattttcttgagagtagtgtaattaatgtcagattaaggaggtaaattaacacttttataaaatgaaaaatgttaagaatacttatgcattttttagcatacaagtatgtggttcagatagcgacagtgatatttttaccaaatgttcataggtaaggaaataaaattcaaacagtgctgcttttccctaattctacttcctccagtcttcaaatgtaaagaatttgatgtaatatttagttggctataaaacaaaaatccctaaatatatgttctatttctgctatgtagaatgcctgtgtttccaaatgtaaagagcctattgaacatctaacttaataagaagaaatttttttcttcatgaggacatttataattctcatgattttacagttcatttcccctacagatccagagttctcttggagtaactattgaacaagtatagtacatttatcgagtatctgcttatgcttgataatttatttgtctcatccagatccgctctacactcttctctctcttgttctgtgtcctgggaggctaacctttttataaagtgcatcagtaggatctcctgctctgtggcttcttgtgggaatttcccagtggcagtcactatcaggagaatggaggcctagagaagagtaagattggggtatttttttatttgatttgttttttgtcatggctccacagggttgtttgaatcttgcctataacagaccactgctcctagagctatagttactctattaagattccagaaacttctccctccacctttttatgcataattgcataatagcaattataacttgtaggtttcccttacaactgtccatacttttgtaaatcgtccttttattatccaatttgagtgcacaatctgtttcctaccagaagcctgactggtacacagctacatactgaaaaatgtattagcctctgtactctagacagaacagaggggtaattcttaggggagagacattactaaaaagcaaagaacagataccaggcatacgcaatgaaacataccatacaaattaacatggccaacagttccaacaattgactgtggagatggaaaaaagaaaaactggagttagtgagatttattgaatcttcaaaagtacacatttggtagagtaaaactaaatattggtagagtaaagctaaatattaaaaaatattggccaggcgtggtggctcacgcctgtaatcccagcactttgggaggccgaggcgggcggatcacgaggtcaggagatggagaccatcctggctaacacggtgaaaccccatctctactaaaaatgcaaaaaaatcagccgggcgtggtggcgggcacctgtagtcccagctactcgggaggctgaggcaggagaatggtgtgaacccgggaggcagagcttggggtgagctgagattgcaccactacactccagtctgggcgacagagtgcgactctgtctcgaaaacaacaacaacaacaacaacaacaacaacaacgaaatattgccctcagtgtacattctaagcaatttggttctcaagatataagacattccctgaaaagaatgacagaattggatcagctttgatataagcgttcagtaattgctcttagagtataatacatgggagttatttctctccctgagatactgagtgatatgatactcacggaatttgctatttgggtggtatagctttcatggaacttgacctttgagtggtactctgctttggaagtttaattctgggcgatacagcctttatagaatttaacctttgggtggtgcgttcttcgggaatttgaccctgagtggtacagttcttgtctaatttgacctgtaaagtcactggatgaattttaaatgggatatgcattacaatatatgacaaagtcacagctcaaatctaaaaaagcacttgaactccgagtttataaagaaatttaaaataataagatatacaatccaatttaaaacatagacaacaagttaaatagtttgccaaaggtgtaccaatgcaaacagggacatgaaaagatgctcaacatcattggttattagaaaaatgcaaattaaagccatattgagataccgccatagacctgctagaatgggtaaaattaaaaagattgagaataacaagtgatcgtgaggttgtgatacaactgaaagcctcttatgttggtgtccaagaatgctaaaatgatacagccactttgaaaaacagcattggcagtcttttttcttataaagataaacatatttatcatatgatttaacaattccacttctaagtatttaccaaaataaatacaaacaggtttaaacaaagacctgaactcaaatgttcagagaagctttattcataacaacccaaacctggaaacaaacgtaatgttcatcaaataacgaatggataaatactttaatattcatataatggaatgctacccagcggtaaaaaggagtgtactgcaaataccggagacaacatcataaatttcaaaagtatgatgctaagtgaataaagtcaggtataagacatcacatactgtatgattccatttatattacattctataaagacaaacttatagggaaagcaaacaaattagtgattaccagaggctagggagttgggggagcaggtgttgaccacaaaggaaaataaaggaacttttctagatgataaaaatgttctgattcttgatgatggtggttacatgactgtatatatttatcaaaactcatcaaactgtacatttaaaatagtgggccttattgtatgtaattatacttcaataaacgtgaccaaaaaaaggtagaaagttagtcagtttactctatgatagtaggtaagtgttcagttcctctctgaagttgttgatggtatattttgatattgggcatatttcagtgcaattcagcttatttgaaatttgaagcactgaaggagataagattatttacactctaaatggtatgttattggaaaagtacagtatgtgaatagagtttatttcttttgctaaaaaccttacttatttgctcttatgcaatgaaaatacctgtgtatattatgaatgatggattaagatgaagtagagaaattctaagagaggaccaaagactgagtcaagggtccatgaaaatggtaatttccaattaaggaaaataagcaattcaaacaactatatccaacaaagaccattttgcataaatttaggccaatcagacttaagagttccttttggagttacctggaagggctcggaaggcaccctcacgatgaccagattaaatttgtatttgtcctccatactccatacaatcagaggtaactaaaactaccttttttttcttaatggtgttggaggaattaatatcaaaatatcaaagaaatccttctaaggatattttttaaacagtggaaattttgaagaaaggaaacatcacaattttaaaaagataacctgcacaacgtgcacgtgtaccctaaaacttaaagtataataaaaaaaaaaaaaaagaaaagtaaaaaaaaaaaaaaaagataacctttctgcattcctgacttgtatctcacaatgccattgtgaccttattactacctaaaatcaatcctgaatagttcatttttatattttactttagtgttttacttaaagactgtcatttcccccctcgttatctgacttggtatttcttgcataaatttgttgcttgtattttatcgtcttccaggctgtttgttttgcggctagcgagttatacatttgtttcaaatgcataatgagtattttggtgtctgatctcatttcttagaaatattaaattatcttatttttgtactccatatactctatctgtgggttctctctgtggtggcattaaaacaaatgttcttaaattttgtgtgaactctgtgcgctccaaaaaggggtagtgtctccctgggcattcaaggagtttttaaggagccagttttctcagtcaagagtagttggttgtgatctaaaacatatccccacagtcaaatgtgatagtactcttgcttttcaaatgctagcattattttagaagttctaagcattagtgtttcacatgcaaatgaagattacattttatgaacgagaactcctgtgttttgaatgcctactgttgctcacatattggcacttcccctgtgtttcttgatcttcctcaaaattatatgagataggtagagaaatctaaggttgacatgtaaagtgactagcccaaatttacataacttaggaacagaggtaacgttgaacccacccctatcagactttaaacacaaggcattttcaactatatcctacagaaaatagaaaagaaaaagggaaattttcaaagtaaaagaagactatatgaaatttaagtttcctgggttgttactcttccaggattccataaaaacttttaaaagaaattaaaatcacataccttcgtacccatttgtttttaccttatatcatacccgcttcaatggatagaagaaacaacgtttcgtaaagtaagaagttctggagactttttagtggataattagtttcaaagttgcagctgaattaaaacaagattttcctgttggtaatctctctgtgtccaaaaagatgttgtgatttttatttttgatttttatgttgttttcttatatgcttccagcctttttgaaacaatagcaaacatgttgttatgcttgtatatgatcagggaaattacaaatatgtattttgctgtagtcatattctcacttatatcagtttgaagtgccttttctagtctgtgatggttataggtagtctgatcaggtcctataactattacttactgagtctagttctacatttacaccaaatatttctatgaaaagtaatgtatccaacttttgttttggttctttcttttttttttttttttgtttgttttttgagagagggtctcactctgttgcccaggttgaagtgcagtggcatgatctctgctcactgcagcctccacctcccagactgaggtgatcctcctacctcagcttcccaagtagctgagactacaggtatgtgccaccacccctggccaatttttgtatttttttgtaaaggtggggttttgccatgttgcccaggttggtcccaacttctgggctcaagtgatctccccacctctgcctcccaaagtgctggaattataggcatgaaccacagcacccaatctattttggttatttctgcaaaaccagaaacatctattaatcagaatatttttgatgttatctggcactatctactaaattacataaagaaaaactgaatttcatatcactgagaagtgggtgtattaaatgccatagattttttggatgatcatttaaagtggttgaaagcctgctgacagaatccaaaaggaacttggcaggaagatataatcttggcagattttattaaagggcacttccctcccttctttctttctccagtcaatgatataattgttacaggagagatggagattgatccacggactacctaagtagtcctttgatttatgggcttctgattacacgtagggttaaatatgtttgaaggatagtctcaaaaataaattaatgacacttctggctatttggaagagtttgaatatattcattcattcattcattcattattaagcattcacacacatattttatcttccttcaaagagtttgtaatttaatggtgagagtaagacataaatgaaaataaaaggcagaagaatagttcagtgaaagaggcatccataaatttgttaagtcagaaagaagcataacttctcagggtagagactacggaaggctttctggaagaagtcgcatttggactatgcctaacagatgataatggtggaacagggaagggtattcaagtaggagggaacagactgactgacaacatagatagcttttgggtatgtatggagaatggggagtagtgtgatttggcttgaaacaggataataaaatgggaaaataaggtgggacacttgggaagtgttgaaattctggatggagtgtgtgacaggctaaggaatttggcttttattccacaggcagttgagaaaccaattggcactaatgcagccactggagaactcagtgtaccacaaggaatttcaatagtcttgcgagaggtgttaagaagtcatttaacaaaatttatacttttttcccttgtttttttctcccctcctttttttttttcccactgatgtgctatctactgtgtcaaaagcaaactttccaagattttcaagttacatataatggcaactctaatcaattcaacataattatttactgagtttcccttatatgcaagacccattgtgtcaattttaagactttacttctcaaaacttttttacctaaaaatcccaaatgcagagaataaaacctcttaccctcaaggttttggggatagaactcccaaacaacccacagacataacattatttgaagttttttgctttatcttacgtgtgatttttcattgaactttaaactatgtaaacataatcttaaattcttgctgtaatagtattaaaggtaaggaattcctattattcctactaaaagtccttgagtaaaattgacacttaaggaagatgaacaaaatttataagtggttacttaacttttcttaaaatgtcaatttagctattggagataatcattagtcagtgattaattgaaaactgaccagacagaaaataaggacattggagtcctgaggagggaaaaaacacataacctctgcatttgtatttgaaatcccaatgctaatgtacaattatactttccattttaaaagaaaatagattttattaatactctgaatacaaatatcttgaaaattaaaatattattttgaaagggttaaagattgacatatgctaccatattaaaaagattttaatcagattgccaataaaaatttaaaagtttagtttgtaaatacaaacataaacgcattttcaccaattcttttttctagtagatctttgatttctgtccttcctgatgtcagtttctttttcagaaaaactctcttcaattttcttaatattcaaatagtattttaaaatgtttacgacagatggaactgcccctcgactttaattttagttatgaccatttactgcagttgttcccaaacttgtatttaaattgtgataagttttaatataaaactttaattattaacatggaagtgtaatcaaaacataatgtggcacaggaaagcagtttgtaggtattatatactagtatgccatttttgtttaaaatgtattgcaaatatttgggaggagtatataataaattattaacagtggttattagcatatattttctgttttttaatgagcaaaacaattttaatcactgaaacaagaaaagtatttaaaatagcacctagaatagtattttgctatgctctggtgttaggatgtttacttttgaggattttgatttcaggtgctcctatctttggagcactgatgttagattcgacctatcttcttcgtatctcctactttcaactcctttgcaaatatgtacttaggttagtattaagcttgggatttgaggggaagaacttcagcttttaaaacaaccgaactccatttgaaagaagtttgccattaatgtctccccttggttttatttatgtttacagggatgtggtcacttagcacatgtatatagggtaaatgcaaaccataatataatactagggcagatgtatgctactaccacaattcagtggaggaagttctgtgttcatagtaagtttctttcttcagaaactcaaacccttgctgtctgtccattgataagaactgataggctagtttaggtaacctaagacatacagatgcactttatttctctgaatattattttcctctttcttttcacttttaaggctcaatcctatgcctctggaatcctagtataattcctcctgtatttgtttctcaatttgttcttttgcagtagtctatccattcatgtggatgaacgtcactctggatagaggaagggcaatcccaggcaatcatacacataaaatcaaatgtccttcattttttccagagggattctggattttccacagaggatcaatgctacttctttggcatcttgttcacccaggaatgtatagcctgtgtttgctagtgatttacaaaaataaaaacaaagttttgtcccacatttcctacaaataacgttttattggttatgctttttcaaagcattgatctccttactgtgtaatgctcaactcaattcagttgaaatattacagagtttcacactctaactacctctaaatatcaatttgagggtaaaggaaaataatgaaagaatcacaatgtagtgaaaagagcacaggctttagggtcagacagatctgggtctgagttacctctcttgttcactgtatgactgtggtcaaatcatatgacccacctgagcctcagtttcctcatctgcaaagggcagattgtgataccatctacagtgaggattgacagtgcatgcagaatatctgacacatgatatggtagctactattggaatttatgaatatgaaagtattttataatttaccaagtgctttataagtgaggagttaagactctccttcttctgaaaactttccatctcgattcttctcagattcatatgcctgaagcaccaaactgcttggcatttaccaagatccataatcttgtcccctttcctttcatttattttggaactgtagttactgacttctcctcttcttttctccccacctcggcaccccggtggagctccttgtctgaattctgcttgagcactctgtatttgtttccatgcacagatgtatatgtttaagtgtgtatcttttctccccagccagcacttaacacagtatgttgctcatgatgctttgctccttactgcatgttgatactgggattcaacagaaaatatatggtccatagactttggcttggatatactggccgtcatgagggacttggaatgaacttgagagttcaatctggtttgagttctggcactgacattgaccgtctctggggacttgcttaatatctcagatttttttttttaactccagaggacacaaattagattatggttgagagaattgttaaagatctgccttgggacagagtattttcttacatatgttaatttggattcctctctgtaacctcctccccagagtagatctttctttttatattatattttaattttcttccatggtagcataacccttgtcacttgcctcacttttttctacccactcaagtgtcagcacctcacacaatttaaaaatagagatgttggggctgtttatttttatgcttgtgtgttttaggggcaagtgggtgggaacactgcatcctaaattgtcacatttcaaagaaagtcttagtgaatgtatacaagttgtaaaataaagtttttattttcctgtagtggacactatgattgcctatccggcattcattgtcccctttccttttccataaggataccctcaaattttcaggtagctgcccttccatcacatattagtctgttctcatgctgctaataaagacattcctgggactgggtaatttataaaggaaagaggtttaatggactcacggttccacatggctggcgaggcctcacatcatggcagaagacaaataaagagcaaaagggcatcttacatggcagcaggcaagagagagcatgtgcgggggaactctgctgtataaaaccatcagatctcgtgagacttattcactatcacaagcacagcatggaaaagaccgacccgcatgatttaattacctcccactgggtccctcccatgacacatgggaaatatgggagctaccattcaagatgacatttgggtggggacacagccaaaccatatcatatcacgttgtccgagtgcttgagacagggtactacaaccagactcctcggagaaggttgtgtttggtctaaggctcgtcaagctcacccttttaaaaagaattgttcaggaatataggcctagccaggcagcctgaatcagttcctccgtcaggcagggatatgggatatatatggggttggtgaatgcaatggagcagggttgtttggaactttaaggaattagttttctgacccagaagagatctgggtcttcttttagatttcaagttgtgtgaaataaagctgaaaaatgtcatagccatttttttctgtcaccaaggaagctattttgaaccaactcagaggagggaatagtgaaggggagtccagagaaataaaactgaaatactgggttcagcctaacctgaggcctaacgtgcctcatggcttgcacttaagagagcctaagccttgttatttcagtcagtttgagtcagggtttgtaatatatgcatctaaaagcttcttaacatgatatacaattttaaaactgaggtttttccctagagataaaaatgtgatctagatcagtactgtccaatactactttctgagatgatataaatgttccgtataagtgtagacactattcaaatgtagctatagaacaattaaaaagtggctagtacaattcaggaactaaatttctaattttatttagttcttcccattttattaattttattttttgttgatacataatagatgtacatatttttggatacatgtgaatatttaatacattcatgtagtttgtaaagatcaaatcagtgtaattggatagtatcaccttaaatatttgtctttatgctagaaacatttcaattactctcttctagctgttttgaaatatacaatagattactgtaaactatgcttatcctactgatctatcaaatactgtcttatttcttctatcaaactatatgtttgtacctattaatcaacctctcctcacccctcctctcctctaccctttctaacctctgataaccaccaatttactcctatcttcatgagatttgatattttagctttcctgtatcattgggaatgtgcaatatttgtctttctgtgtctggcttatttcgctttacaaccaccatttccttccatgttactgtcagtgacagaattccatactttttatggctaaataatattccgttgtgtacatataccacatattctttatccattagtccatcaatggacacttaggttgattctatattttgactgttgtgaataattctgcattaactgtgggagtgcagatatctcttagatacactgatttcctttcttttagatatataagtggtagtggaattgctagatcatatgtagatcaatttttaggtttttgagaaacctctgtactattcttcatagttgtagtaatttacattcccaccaacagtgtacaagggttcccttttttccacattctcaccagcatctgttattccctgcctttttgatacatactattttaactggttgagttgatatctcataatggttttggttttcatttcactgacggttagtgatgttgagtatttttcatgtcttctctttgagaactatctattcatcccttttgcttatttttaaaatagattggacagacataggggctcacgcctgtaatcccaacactttgggaggctgaggtgggaagatcatgaggtcaagagatcgagaccatcctggccaacatggtgaaactctgtctctactaaaaatacaaaaaattagctgggcgtggtggcatgtgcctgtagtcccagctactcaggaggttgaggcaggagaattgcttgaacccaggaggcggaggttgcagtgagctgagatcatgccactgccctccagcctggcgacagagtctcaaacaaacaaacaaacaaacaaaaaatatatatatatttatatatatataatttttattatcttttgctattgagttgtttgggttccttatacattctggttattaatcccttgtcatatgaatagtttgaaaatgttttcttgcattctgtggtggtttctttactttgctgattgtgtccattgctgtgcagaagcctttaagcttgatatgatcccatttatctatgtttgctttggttgcctgtgctttgagatcttgcccaaacagtctttgcctatatcaatgtcctggagcacttcttaatgtttctcctagtagttttatagtttaaggtattggatttaagtgtttaatccattttgatttgatttttgtgtatggtgagagatagggatttagtttcattcttctacatattgttatgcagtttctcattacatttagtgaagagactgtcctttccccattgtatgttcttggcacttttgttgaaaatgagttggctgtagtggagagaggcagagcaagatggaggaaaagaatgctccactgatcgttccctacacaaggacaacaatttatctacacgaaaaacaaaacaaacaaaacagacagacaaacaaaaaaacacctttagaagaaccagaagttagatgagccctcacagtagctagttttatctttgtatcactgagagaggcactgaagagataagaaaaacagacctgaactgccacccctccccgacccctgcagcagcagtatggtgcagagagcacagaaattgtgaggccatgaactcagtgctatcctgttagagcagaaagaaaaacctggaccaaactcagctgacgtctgcccatggagagagcattgtaacaattcctagccagaggggaatcccagcagttggaacttgagttcctgcaaaccttgccactgagggatacagtcctctctgtctgtaaatgaatttgaaaggcagtctaggacattaaatctgcaaaacttaggtgagtcctagtcctgaactaggcccagagccagtggacagtgacatactgagacagtagctgaggcggctaagggggtgctgttgtcacctcccctaacctcaggctgcacagttcagggctccaaaagcgacctcttctttttgcttgaggagaggagcgagaatactggggaggactttgtctcgagtcttggataccagctcagctacagctggatagggcaccagttagagttgcgaggcctgtgttccaaggccttgctcttgggtgacatttgtagacacaccctaggccagaagggaacatgctgtcttgaaggaaaggacccagtcatggcaacattcatcacctgcttgctaaagaatccttgtgccctgaataacaagcatcaatacccaggtactacatcaagggccttgggtgagcctctgagacttgctggcttcaggtgagactcagcacattaccagctatggtggctatggggcaaaactcctgctttggaaaagcagagggaaaagtgaaagggactttgtcttgcatcttagataccatcatgggcacagggagtagctcttggggtccccaatcccaggacttgactcttggatgacagttctggacttgccctgggccggagggaagcccactgccctgaagggtgagtcccaggccaggcagcatttaccacaagctgacttaagagtctttgggccttaaggaacatcagagggaggtagtctggcagttcttctgtggcctaaggtggtgttcactatggaatgaggctcctctgcctttggaaaggggagggaagaatgggaaggactacatcttttagcttgagtgtcagctcagtggcagtataacagaacaccaggtagagttctaaggtttttgactctagtccccgactcctggatggtacctctggacctccctggggcctgggagacctcaccatcctgaagggaaagacacaggcctgcctggctttgccaacagctaattgtggggccccagggccttgagcaaacatggaaagtagccagggagtggttacagcaagctttgggcaagacccagcgctgtgcttgcttcaggtcttacccagtggaatcatagtggtgttggccacagggatacttgttactccaccctcagatttaggtggctcaaaacagagagagagagagagagagagagagagagagagagagagactgactctatgtttgggagaaagtaagggaagaaaacaagagtttctgcctgattatcaagatagttcttctggatcttgtccaagactatcaaggtggcgcctctactagtctgcaagaaccacagtgctactgggcttggggtatcccctagagcaattatagtttggatcacaacacctaagtcatttcaaatatctggaaagccattccaagaaggatggatacaaataaacccagacagtgaagactacaataaatacctaactcttcaatgcccagacaccaaagaacatttacaagcatcaacaccatccaggaaaacatgaccttatgagatgaactaaataagagactagggaccaatcttggagaaacagatatgtgaattttcagacaaaaaattcaagtagtgttatggatgaatctcaaagataaattcaagataacacagagaaggaattcagaattctattagataaatgtaacaaagagattgaaatagttaagcagaattaagcagaaattctggagctaaacaatgcaactggcatgctgaataatgcttcagaatcctttaagagtagaatggatcaagcagaagagagaattagtgagcttgaagataagctattggaaaatacagtcagaggagacaaaaggtaaaataataaaaatcaatgatgcactcctacaggatctagaaaatagcctcaaaagggcaaatctgaattattggccttaaagaggaggtagagaaacagataggggtagaaagtttattcagagggataatatagcagagaacttcccaaacctagagaaagatatcaatatcaaagttcaacctcaaaaaagactacctcaaggcatttaataatcaaactctcaaaggtcaaggataaagaaaggatacttaaagcagcaagagaaaagaaacaaataacataaaatggagctccagtatgtctggcagcagacttttcagtggaacctttacatgccgggagagaaagttatgacatatttaaagtgctgaaggaaacaagactttcaccctagaatagtatatttggtaaaaaatatccttcatacatgaaagagaaataaagacatttccagacaaacaaatgctgagggattacatcaacaccagacctgtcctacaagaaatgcctaagggagtactttaatcagacaaaaagaagaacattaatgagcaataagtaatcacctgaaggtacaaaactcactgggaatagtaagtacagagaaaaacagaatattataacactgtaactgtgtagaaagactaaatgatgaaccaataaaaataataactagaacaacttttcaagacaaagtacaaagggtatcaattaaaaaaccaaaaagattaaaagaagaggaatgaaattaaggcatagaagttttactagttttctttttgcttgtttgtttatgtaaatagtgctgttatcaggttaaaataatcggttataagatagtattcacaagccttataatcacctcaaaccaaaaaacacaatgaagacacaaaaaataaaaggcaagaaactaaattacatcaccacagaaaatcacctttactaaaggaaaacaggaaggaaagaaagaaagaagagaagaccacaaaacaaccagaaaaaaaatcataaaatggcaggagtaagtccttacttattaatagtaacattgaatgtaaatggactaaaggtttgaatcaaaagacatagaatagctgaatgattgaaaaaacaagacccattgatctgttccctatgagaaacacacttcacctataaaaacacacactgactgaaaataaagggatggaaaaagatattccatttcaatgaaaaccaaaaaagagcaggagtcactatacttatattagacaaaatagatttcaagaccaaaactataaaaagaggactataaaaaggagaagtcactatacaatgataaaggggtcaattcagcaaggggatataacaatttaaaatacatatgcacccaacacaagcacccagatataggaagcaaatattattaaatctaaagagagaaataggccccaatacaataatatctggagactttgattccctactttcagcattggacagatcttccaggtggaaaatcatcaagaaatatccaacttattctgcactatagatcaaatggatctaatcgatatttacagaatattgtatccgatggctgcaaaatacaaattcttttccacagcacatggatcattctcaaggatagaccatatgttaggtaacaaaacaaatcttaaaacattcaacaaaattgaagtaatatcaagcgtcttctctggccacagtggaaagtaactagaaattaataacaagaggaattttggaaactatacaaatacatggaaattcaacaatatgctcctggatgaccagtgggacaatgaaggaattaagaagcaaagtgaaaaaatttttaaacaaatgataatggaaacacaacatacccaatcctatgggatacagcaaaagcagtactaaaagggaagtttatggctgtaagtgcctatatcaaaaaagaggaaacattttaaacaaacagtctagcagtgaaacttaaagaactagaaaagcaagagcaacccaaaccaaactgaaatttagtagaagaaaataaataaaaaagatcagagcagaaatcgatgaaattgaaatgaaagaaacaatacaaaagatcaattaaacaaaacgtcagttttttgaaatgctaaacaaaattgacaaaccttttgccagactaacatggacaaaagagagaagacccaaatatataaaatcagaaatcaaaaaggagacattacaaactgatactgcagaaattcaaaggatcattagtggctactatgagcaaccatatgccaataaattggaaaatctagaagaaatggacaaatttttagacacataaaacctaccaagattgaaccaggaagaaatccaaaacctaaacaggccaataactattaatgagattgaagccataataaagtctccagtaaagacacgcctgggacccaatagcttcactgatgaattgtaccaaacatttaaagaagaactactaccaatcctactcaaactcttctgaaaaatacaggaggaggggacacttccaaactcattctacaaggcattattaccctgataccaaaacaagacagacagaaaaaaaagaaaggaaaaagaaaactatatgccagaatctctgatgaatattgatgcaaacatcttcaacaaaatactaacacatcaaattcagcaatacataaggaagatcattcatcatgaccaagtgggatttatccctgggatgcaagaatggttcaacatatgcaaatcaatcaatgtaatacatcctatcaacagaatgaaggataaaaaacatatgatcatttctattgatactggaaaagcatttgataaatttcaatatctcttcatgataaaaaccctaaaaaattgggcaatgaagaaacatacctcaacataataaaagccatacatgacagacccacagctagtactgtactgaatgaggaaaaactgaaggccttgatggatgcccaccatcaccactgttgcttaacactgtattggaagtcataggtagagcagtcagacaacagaaatacgtaaagggcatccaaattagaaaggaaggagtcaaattatccttgtttgctgatgatatgatcttatatttggaaaaacctaaagactccacaataaaactattacaaattataaattcagtaaagttgcaggatgcaaactcaacatacaaaaatcagtagcagtttccgtccaagatggctgaatacaaagagctctggtctgcagctctcagcgtgatcggtgcagaagatgggtgattttggcatttccaactgaggtacctagttcatctcattgggactggttggacactgggagcagcccacaagggtgggccaaagcagggcagggcatcacctcacctgggaaatgcaaggggccgggatatttccctttcctagccaaggaagccgtgacagactgtacctggaaaaatgggacacttctgcccaaatactgtgcttttcccatggtcttagcaaccagcagaccaggagattttctcccatgcctggctcgtcgggtcccatgcccacagagccttgctcactgctagcacagtagtctgagatcaacttgcgaggctgcagcctggctgggggaggggcatccgccattgttgatgcttaaataggtgaacaaaatggccaggaagctcaaactgggcagagcccaccacagctcagcaaggcttactgcttctatagactccacctgtgtgggcagggcatagctgaacaaaaggcatcgcagaaacttctgtagacttaaatatccctgtctgacagctctaaagagggcagtggttctcccagcacagtgtttgagttctgagaacagagagacagcctcctcaagtgggtccctgaaccccgtctagcctaactgggagacacttcccagcagaggcctacagacacctcatacaggtgggtgcccctctgggacaaagcttccagaggaaggatcaggcagcaatatttgctgttctgcaatatttgctgttctgcagcctctgctggtgatacccaggcaaacagggtctggaatggacctccagcacactccaaaagacctgcagctgagggacctgactgttagaagaaaaactaacaaatagaaaggaacagcatcaacgtcaacaaaaaggacatctacacaaaaccccatctgtaggtcaccaacatcaaagacaaaaggtagatggtaccacaaagatggagaaaccagagcagaaaagccgaaaattctaaaaaacagagcgcctcttctcctccaaaggattgcagctcctctccagcaacagaacaaagctggacagagaatgactttgatgagttgacagaagtatgcttcagaaggtcagcaataacaaacttctccgagctaaaggagcatgttctaacccatcgcaaggaggcttaaaaccttgcaaaaaggttagacaaacagctaaatagaataaacagagtaaagaagaccttaaatgacctggtggagctgaaaaccatggcacgagaactttgggacacatgcagaagtttcaatagccgatttgatgaagtggaagaaagggtatcagtgattgaagttcaaattaatgaaataaagtgagaagacaagtttagagaaaaaagagtaaaaagaaacaaacaaagccttcaagaaatatgggactatatgaaaagaccaaatctacatttgattggtgtatctgaaagtgatagggagaatggaacccagttggaaaacactcttcaggatattatccaggagaacttccccaatgtaacaaggcaggccaacattcaaattcaggaaatacagagaacaccacaaagatacgcctcgagaagagcaaccccaagaacataactgtcagattcaccaaggttgaaatgaaggaaaaaatgttaagtgcagccagagagaaaggttgggttacccacaaagggaaacccatcagactaacagcagatctctcagcagaaaccctgcaagccagaggagagtgagggccaatattcaacattcttaaagaaaagaattttcaacccagaatttcatatccagccaaactaagcttcataagtgaaggagaaataaaatcctttacagacaagcaaatgctgagacattttgtcaccaccaggcctgccttacaagagctcctgaaggaagcactaaacatggaaaggaacaatcggtaccagccactgcaaaaacatgccaaattgtaaagacctttgatgctaggaagaaactgcatcaattaacagacaaaataaccagctaacatcataatgacaggatcaaattcatacataataatattaaccttaaatgtaaatgggctaaatgccccagttaaaagacacagactggaaaattggataaagagtcaagacccattggtgtgctgtattcaggaaacccatctcacgtgcagagacacacataggctcaaaataaagggatggaggaagatctatcaagcaaatggaaagcaaaaaaaagcagggctcgcaatcctagtctctgataaaacagactttcaaccaacaaagatcaaaagagacaaagaaggccattacataatgataaagggatcaattcaacaagaagagctaactatcctaaatatatatgcacccaatacaggagcacccagattcagaaagcaagtccttagagacctacaaagagacttagactcccacacaataataatgggagactttaacaccccactgtcaatgttagacagatcaacaagacagaagtttaacaaggatatccagtacttgaactcagctctgcaccaagcggacctaatagacatctacggaactctccaccccaaatcaacaaaatatacattcttctcagcaccacatcacacttattctaaaattgaccacataattggaagtaaagcactcctcagcaaatgtaaaagaacagaaatcacaacaaactgtctctcagaccacagtgcaatcaaattataactcaggattaagaaactcattcaaaaccacacaactacatggaaactgagcaacctgctcctgaataactactgggtaaataacgaaatgaaggcagaagtaaagatgttctttgaaaccaacgagaacaaagacacaacacaccagaatctctgggacacatttaaagcagtgtgtagagggaaatttatagcactaaatgcccaccagagaaagcaggaaagatctaaaattgatgtcctaacatcacaattaaaagaactagagaagcaagagtaaacacattcaaaagctagcagaaggcaagaaataactaagatcagaaaagaactgaaggagatagagacaaaaaacccttcaaaaaatcaatgaatccaggagctggttttttgaaaagatcgacaaaattgatagactgctagcaagactaataaagaagaaaagagagaagaatcaaatagatgcaataaaaaatgataaaggggatatcaccaccaatcccacaaaaatacaaactaccatcagagaatactataaacacctctatgcaaataagctagaaaatctagaagaaatggataaatttctggaaatgtacaccgtcccaagactaaaccaggaagaagttgaatctctgaatagaccaataacaggctctgaaattgaggcaataattaatagcctaccaaccaaaaaaagtccgggacgagatggattcacagccgaattctactagaggtacaaggaggagctggtacaattccttctgaaactattccaatcaatagaaaaagagggaatcctccctaactcattttatgaggccagcatcatcctgataccaaagcctggcagagacacaacagaaaagagaattttagaccaatatccctgatgaacattgatgtgaaaatcctcaataaaatactggtaaaccaaacacagcaacacatcaaaaagcctatccaccacgatcaagttggcttcatccctaggaagcaaggctggttcaacatacccaaatcaataaatataatccatcacataaactgaaccaatgacaaaaaccccatgactatctcaatagatgcagaaaagaccttcaacaaaattcaacagccctttatgctaaaaactctcaataaactaaggattgatggaacgtatctcaaaataataagagctatttatgacaaactcacagccaatatcacactgaatgggcaaaaactggaagcattccctttgaaagccagcacaagacaaggatgccctctctcaccactcgtatttaacatagtgttgaaagttctggcaaggacaatcaggcaagagaaagaaataaagagtattcaattaggaaaagagaaagtcaaattgtccctgtttgcagaagacatgattgtatgtttagaaagccccatcatctcagcccaaaatctccttaacctgataagcaacttcagcaaagactcaggatacaaaatcaatgtgcaaaaatcacaagcattcctatacactaatagcagacaaagagcaaaatcatgagtgaactcccattcacaatttctacaaagggaataaaatacctaggaatccaacttacaagggatgtgaagttcctcttcaaagagaactacaaacctctgctcaatgaaataaaagaggacacaaatggaagaacattccatgctcatggacaggaagaatcaatatcatgaaaatggccatacttcccaaggtaatttatagattcaatgtcatccccatcattgctaccaatgagtttcttctcagaattggaaaaaactactttaaagttcacatggatccgaaaaagagcctgcattgccaagacaagcctaagccaaaagaacaaagctggaggcatcatgctatctgacttcaaagtatactacaaggctgcagtaaccaaaacagcatggtagtggtaccaaaacagatatatatatatatagaccaatggaacagaacagtggcctcagaaataacaccacacatctacaaccatctgatctttgacaaacatgacaaaaataagatatggggaaaggattccctatttatgatgcttggaaaacaggctagccatatgtagaaaactgaaactggatccctttcttacaccctatacaaaaattaattcaagatggattaaagacttaaatgatagacctaaaatgatagaaaccctagaagaaaacctaggcaataccattcaggacataggcatgggcaaggacttcatgactaaaacaccaaaagcaatggcaacaaaagccaaaattgacaaatgggatctaattaaactaaagaacttctgcacagcaaaagaaactaccagcagagtgaactggcaacctacagaatgggagaaaatttttgtaatctacccatctgacaaagggctaatatctagaatccacaaagaacttaaacaaatttacaagaaaaaaaaacccatcaaaaagtgggcaaaagatatgaacagacacttctcaaaagaagacatttatgcagccaacagacacatgaaaaaatgctcatcatcactgttcataagagaaatgcaaatcaaaaccacaatgagataccatctcatgccagttagaatggcaatcattaaaaagtcaggaaacaacagatgctggagaggatgtggagaaataggaatgcttttacactgttggtgggggtgtaaattagttcaaccattgtggaagacagtgtggtgattcctcaaggatctagaactagaaataccagttgaccttgtgatccctttactgagtatataccgaaaggattataaatcctgctactataaagacacatgcacatgtatgttgggcactattcacaatagcaaagacttggagccaacccaaatctccatcaatgatagactggattaagaaagtatggcacatatatactatggaatactatgcagctataaaaaaggatgagttcatgtcctttgcatggacatggttgaagctggaaaccatcattctcagcaaactatcagaaggacagaaaaccaaataccgcacattctcactcataggtgggaattgaacaatgagaacaaggcagggaacatcacacaccagggtcagttgggggttggggggctggggtagggatagcattaggagaattagaagaaatacctaatgtaaatgatgagttgatgggtgcagcaaacaaacatggcacatgtatacctatgtaacaaacctgcatgttgtgcatatgtaccctagaacttaaagtataaaaaaagtagtatttctgtatgccaataatgaaaaatctaaaaaagaaataaaaaagtaatcccatttataatagccacacatgaaattaaatacctaggaattaactcaactagagaagtgaaagatttctatatgcatactataaaacactaatgaaagaaattgaagaggacaccccaaaatgaaaagtatttcatgtttatgaattgtaagaataaatatgttaaaatatccatactacccaaagcagattgcatcaaatctatatctatatatttcaattctgtcaaaacaccaatgaaattcctcacagaaatagaaaaaaaaatcctaaaatttatagagaatcacagaatatctagaatagcataagctatcctaagcaaaaagaacaaaactggagttatcacactacttgacttcaaattatgcacagtacccaaacaacatggtaccggcataaaaacagacacatagaccaaccagtggaatagaatccacacacctatagtgcactcatttttgacaaatgtgccaagaacatacactggggacaagacagtctcttcaataacagaaaactggatatccatttgcagaagaatgaaactggtgctgggaaaactggatatccatttgcagaagaatgaaactagatccctatctctcatcaggtacaacaaaatcaaatgaaaatagtttaaagacttaaatctaagatctctaactatgaaactactacatgaaaacataagggaaaatctcaaggacattggtctgggcaaatatttctcaaggaataccccacaagcacatgcaaccaaagcaaaaatggaaaataggatcacatcaaattgaaaagcttctgcacagcaaaggaaacaatcaacaatttgaagagacaacccacagaatgggagacaatatttgcaaactatccatctgacaagggcttaatagcccatatataaggagcttaaacaactttataggaaaaaatctaataatccagtcaaaaatgggaaaaagatttgaatggatatttctcaaaagaagacatacaaatggcaaacaggcatgttaaaggtgctcaatatcattgatcatcagagaaatgcagatcaaaattacagtgagatatcatctcaccccagttaaaatggcttatatccaaaacacaggcactaatgaatgctggtgaggatgtggagaaaagggaaccctttttccacaactcattgttggtgaaaatgtaaattagtacaactattatagagaacagtttggaggttcctcaaaaaactaaaaattgagctattataattcagcaatcccactgctgggtatataccaaagaaagttagtgtatcaatgagatagctgcactcctgtgtttgttgcagcactgtttacaatagctaagatatggaagcagcctaagtgtccatcaacagatgaatggataaagaaaatgtggtacatatacacaatggagtactattcagccataaaaaagaatgagatccagtcatttgcaacaacatggatggaactggagatcaatgtatttagtgaaataagggagacacaggacaaacatcttatgttctcacttatttataggatcaaaaaatcaaaacaattgaactcatggacatagagaatagaaggacagctaccagagcctgggaagggtagtagtggtggtggaggaggtggggatagttaattggtgcaaaaggtagttagaaagaatgagtaagacctactatgtaatagcataatagagtgactatagttaataatagcttaattgtacattttaaaataacttaaagggtgtaattgggttgtttgtaactcagaggataaatgcttgagaagatggatacccaattctccgtgatgtgcttattttactttgcatgcctgtattaaaacatctcatataccccataaatatatatacctactatatacccataaaaattaaaaataagaaaaagaaaaaaagaaaatgagttggctgtatacgtgtaaatttatttccgtgttctctgttctcttccattcgtctctgtgtctgtttttatgccaataccctgctgatgtgtttactatagctttgtagtatattgtgaagtcaagcagtgtgatatctccagctctgttccttttgcttatgattgttttggctatttggagtctttatggtttcatgtacatcttggcattattttttctacttttgtggttacttatttttgttgttattgttttgtttttgaaatggagtttcgctcttgtttccgaggctggagtgcaatggcatgattttggctcaccacaacctctgcctcccgggttcaagtgattctcctggctcagcctcccaagtagcttggattacaggcatgcgccaccacacccggctaattttgtgtttttagtagagacagggtttctccatgttggtcaggctggtctcaaactcccagcctcaggtgatctgcccacctcagcctcccaaagtgctgggattacagatgtgagccactgtgcccagcccatattggtgttttaatagagattgcattgaatctgtaatttgctttaggtagaattgtcattttaacaatattatttcttccaatctattagcatgtaatatttttcaatttttttgtgtcctcttcaatttcattcatcagtgttttatagttttccttgtataggccttatagttcttcagttaaattgattgctaggtattttatattttttgtgggtattgtaaatggtatggctttcttgatttctttttcagattgtttgcccttggtatttataaatgctgatttttgtctattgattttctatcctgcaactttactaaatttgtttaccaattctaacagttttttttggtgttgtctttacatttttctaagtataagattatgttatctgtaaacaaggctaatttgacttctttgtttccaatttaggtgccctttatttatttctcttccctaattgtctggccttatttaatttttattaattaaaagttaaatagcttcatatgtctagtggctaccatactggatagtacagatctagaccgatcaaacttcagatggttgggatcaatctgtaccatccctcctaagcttcgtcttcaaatgatcactaataactcttctgaattctgttttggatttcagtaagttattccaaaaccaaatgaagctctagtttaattagaccgaagtgtcagttgcacaggtgtgtgtgtgtgtatgtgtgtattcaaagttttcaatttgctcacatttgtatttcctgtaattggttctataagaagataagcatgtacctattcattgccaaacaacttaagataaacacatacaaaaacaaacctgagaaatacagagcaatacataattatgtatctgtctttaaaagctaagagacagaaggataaagattgagaatacttctttcactaactctagccactgttagagtggcttcctaaagaagacgacaagacacttacgttgcactctgtgcaaaattagccatttctcctctgaagagggcccagcttttatattaaaaaatagattggttattttaaatacagaatattataaaaaatattcagcaatcatcaggtggatattcagcaaattattaacttccaagtatagcatttcaaatgttttattggttaaatgattataataatatcatctttttaatttaacttcaagtttattatgagggtaaacatatctgtaaatatttctgatgttaaatgtgtaatgtaagcacagtatactgttttagggattacaacctaggaagaaaataatacaacaaactacaaagcaaaaatgtttggctaccggctaaattttcagaattctagaggaaaagaaatggaactcaaaataaaaaagttaccctgcacaagaaagtatacaacagtttgaatgatctaacagacaaacgccgcttcccctaaacaataaaaaagcaacctaggtgttaacgaagttctggcagcttgtctgtgcaggctactcaacaaggcagacaaccttcagaaggaagatactcgctgtcaggttcatccagctataattggagtatatattgactttggtcagtttggcaaagagaatatcaacttacaaagtgctagctacgatggagatgcgataactggagatcattgttaagatgtctgccactttcaaaaagatttgtctttagaagctaataggaattttaaattgctacagcaattgcatgtcaacatgagctatttattggctgttaaccataaatgtataatatattaatgtgtttgaatatactctttctgtcattaaattcaattaaaattgaataattataaacatataagtccctagagcctaaaatcaccaattttcaaggaaaaaaaagaagataagaaattattcatattcaatcacattttgccatcaaatttatttttcagatgaaatatttgcaacaaataaagacttaaaattgggtgccgtaatagaatgattaatagatccttacttccagataaaatgattaatgcttccattatgtatattatgtagcgttcgagttaaatatgtcaatatgttattgtattcagtgaatagttcaattgatctttcctctcttaaattaaagcaaatcattttataaaggaatatgtatttcagaagtacatagttccataaataatatgtttgaaagcatgaaatagataatgccttggtttgatagaccccaaaactgaaactgaaattacagtcatttgggataactaacctattgttttacatagttttgtttcaagcttaccagtgaacagaaagaaaaaaaaactaatcaaattattttcaatggggctacaaagcattgcattgtaacctgaaatccaaagcttacattggcttgaaaatttgaccaggcttacttagctgaaagagtccttttagactataaacttttgctaattttgtaccagaaaaactgggttcaaagattttattcttcattctcctttaaatcatatatatatatatatatatatatatatatatatatatatatatgattttaaaatattttttaaaagagtaattcagaaaaaggataaggaaactcaattgtcctgatcacgtaagcaaaactactttgagattagcgtttagaaccaccctttttccctcaatctggttcctagttcaggaaaggtcattttatataccagaataaatgaaaaaaattatttctgccctactgcattggactagtgtcctcactaggagttcatgaaacagtttcaataaaaatgcaattacaataaggtattttaaatcatattaatatgattaccttagactcacattgaaaatacagagaatgtttaatttttagaaaatgttaaacactttagtttagtaaatcctatcatgttttccagtaatgctaaaaggtgcacaatactttttcattttaggtgccctgtgactagagacttggcacttgatggctgcaggggaatcactaatgagctacaaagcctttacacctctaggtcaggagtttggcttagacctaggttgggagtgacagaaagtcgttaccatctcatgatagttcagtggtttatatgaaggaaattcagtgtttcaggccactttctaatgaacaagcatccaccttacaaaaagtcaccactgcttttgaaagtaattggcaacaacctagagaatgaaaaatttaaccaagatttgtgttccttccatgctatgactaccgtattcaagtaaggagtttttaatggaaaaagacacagtacattgcagatatgcctatgaaaagtaaggctagggaagaaaaggggggggagaataatgaagagaaaagagagagtcatccagaatagagtaaatcaaaatgcagttaagacatgtcatcaaaaacctttacttacagtttatatagcaaaggtatttaattcagaaaagacatgcacctattatgtttctctttagtaaaattttaataattttacctgaggcctttagattagggcatcaaaaagatgatacatgcctggaaatggtgtttccttagcagagagttgtcactacacatgtcgttattatcttctttaggaagccatagtggctagagttagtgaaagaaggcttctcaatcttctttcttccaagtcttttagtttctacagacacagacacataattatgtattgctctgttttattcagggttgtttttgcatgtgtttgccttaagttgtttggcaagaaataggcacaggtttattcttcttacagcactcattacaggaaatacaagtctgagcaaatgaaaaacttagaatatgcacatagacgcatgtgcgtgcacacacacacacacacacacacacacctgtaccattgatgttttcatttaatgaaatctgagctttgtttggttttgaaattatttaataaaatctaaaatgttactaatgatcttttgaagacagaagcataggaaggatgtggcagagtgtttccaaccatctgaggtttgatcagtcaggatctatgctatccagtatggtagccactagaaaaatgaggctatttaaattaaattagtgaacacttaataaaattggaaattaagttcctgagttgcactagccacatttcaattgttctgtagccacatgtggatagtatctaagttatctgaacatttttatcatctcagtaagttctattgaacagtagggcccagaccaccttttcatccctatgcttaatgtttttatattaaaatataatattttatgtaataataaaaatcaaaagaaataattggaaagtaatagtgaaacctaaggaaaaacaatgaaaaaatgcattggagttggaagcttatataatgcatggtctataataatatcccactaattattatattgaatgaatgcatttttcattttttcaatttaagatacttgaagattttgattttcaagagatacgagaacttgatgccttcttttttctttgcaaagaagatgatattaataatttgttataggctggccctggtggctcactcctgtaatcccagccctttaaaaggctgaggtgggaggatcgcttgaggccaggtgttcaagaccaccctgggcaacatggtgagcccctctctctaaaaaaaagtaaaaaattggctgggcgtgttgttgtgcacctgtagtcccagctactcagaaggctgaagtggtgggaggattgcttgagcccaggaggtggaggttgcagtcagtggtaactgtgacactgtaccccagcataggtgacagaatgagactgtgtctcaaaataataataaaaataaataataataataatttggtgttatttttataccttgaatttacttaataggaagaaatatatcaattagagggtactggaatcccttggacttattttttctttttcaatgaatgatatgtttgcctgcacaagcccaaaaccataaaccgatctagaagatgaggacacacaaatacttctctaatatcccagaggtgaagttcacctgcatgtcagatattagcactgagaggggatattcctatttgggaacatttctgtctaaaatattaccctctacattattttataaatgatgaactaactaaagaaaaagtttgagaatgttggtggatgggaaaggagcaactgttgacaagtttaatttcattttaagccattatcacaggggatatgtgtatactatcttagaatctgccaatttttcagcttattcataacagtcaaaggaaagatgttatctctatgcttatagtgaaaagctttggaagtcagaaagcaaatcttttattaaattcttgtccagggttcatctgtcaggtctagaaatgactagttattgttaccgtgtacaccaagatcatctatgagtgatatggaaaaatgaaacattttaaaagaattcgagaagcagtgggtccctgttcttgcctatcaattttgtaatgaaacaacaattccttgtatttacctggacagttcttccaatgcaagtcagatctatttaaagtagcaggtttgtaggaaaaggggtatcagagaagcaggtaagattacacgaagagttaaagaataatgttgctgtaatgttaacaatcatatttataggaatacaaccagggaaattcttcaacatattggtcaaagataaattaataaaatttcctgttcaaatatacagttagattgctcaagtatactgagcattggaactttttataaaatggatccttcggagtcttaaattagtctaataatggcttaaaaaagtgattgaaatgcagcagctttggtgtcctgttgtaactttagtgaaaatactaattctggatgtttataaacaatttctacttctactttctctagagaatttcaccccctgacacccacatcacaggagataacacaagaatttatttacaataaattcaagtttccctgaaaaatatggtacggtaacctgagagaagattaacagattattttctcatcctaagtgtctgctattttagatattgaccatatgagagaatgagttttaaaaaaacttttaatttttaatttttgtaggtacatagtaggtgtatatatttatgggatacatgaaatgttgtgatacaggcatgcaatgtgaaataaacacatcatggagaatgggatattaattccctcaagcgtttatcctttgtgttacaaacaatccaataacagtcctgtagttatttttaaatgtacaattattattaactatagtcaccgtgttgtgctatcaaataataggtgttatttattatattttattttcgtacctagagtattttcttacatgaataaaagataatgatattccataccatcttgggaatggaatcccttgatcccaggtgcctgtggaaatgttcacacttttcacgggtgaggataagtgaggaaagaataagagcagaagggccctagagggaaaccttaaagaacccgagagtagagaatggatggaagtaggtgatgttgctttttcttccttcctcactgctctcccttctgcaaaggtgaatgtcttcttgcctcagctttatttttcaaattgtaatcaagaccaaaacaagtcagaccattgagactcatttgttttctttccgagtgaaagcaaacagatctaatttcattctgagacaaggcaggtgggcttaatagacagtatgggggtgggcaaagaggagaaatggtaactgtgggaagacatcagttgtaatttatcttgacttagtaagacttttcctttttgcatgacatactgctcaacaaatggagagacactccagttaagtaattgctcagattattagtgtgttgtgctgaaaaaggactcctaagctgcattagcttgggttgacatcgcagatgctcatcttcaaggggtcagtacaagaatgaatctatttaacatcttcatcaatgatcaagataatggaaaagatacagcaggtccattaattaacattaggaaagacattatactgcaagggtagcttgcacattgtagggcagtgtatgaattttaaatggcctttaccatgataaaacacttgtcctttgcattcaaaattttaaaggctatttttgttcatccctgcaggcatggctaagaaaacaaataagtgaactcttgctactgtgaatctctgtgttctatttgctaaagcacagggcactaggactggaacagctttactttaaatagaacgatccattttttatagctgcagccccaaatgatttcctcatttccctatatgtaactctttcccagaatttcaaggcaatggtgtaaggcagggtcagatacgtaacttgaagagcccactgtgaaaaaaagaaaagcactctttgttcctaaagtagaaacaaccactaaagctactaagatataaagcttttttcatttcttcattgtttctctattaacttgttatggtgtttttatttactatttaatatcattctaagaaaaaaattgacaatttaaattattagcataaattaataatcacctttatattgtgtattgtcagttttaaatgcacacaggggaacattttactcatatatgaaatcaccaaaattacgcaattcatatttggtagctcatagtaaactggtaccagttgagtcggggtgctgctaaaaagatactcgaaaatgtggaagcgactttggaactgggtaacagacagaggttggaaaagtttggagggctcagaagaggacaagaaaatgttggaaactttggaactccctagagacttgttgaatggctttgcccaaaatgctaataacgacatggacaataaagtccaggctgaggtggtctcagatggaaataagaaactcgttgggaactggagcaaaggtgacttcgttgattttgtgtagaaagtttgatgcctgcttttttcacagtaaaatgctgacataaaaaacagccatcctaaaagtttccatcttaggtgggcagccatttacctttttctgccatcaaattttatgcatcagttgtacaaatttaaatatcaggcagaaaaatatacattggtgtggctcacatttacaacttcttagttaaatttttacctttacattgctcttacttagctcaattttaaaaatatagtatttttgtttactagaggaaattgaaaatatagaaacaataaaatgaagaaagaattatacacattgaagatagtcaatgtaaatagttttccacttcttttctggtcttttctaaatgtacaactttaaaaaatactggcagattccaaccatatataaaattttacatcttgctttttatgtaatattatattgcaaacattttttttcatgttacattctgcctggacatttttatggctgcagagtgtattaccacatggatttatttaatgcttactccatttttggacacaatttcatttataataaatactgtgatgaacatctttttgaataaaacttttctcatttttcaaggttatgtccttaggatacattccccgaagaacattactgggtaaaagcatctcagacattttaagtctcttgattcttgttgacaaattgctttcaaaggagacataccagtttttactcctgctagggatttaccacaatgcttgtacttcgttaaatgtagattactgtgattaatggtgatgggcatttttatatgtgtttgttttctaattctaattcctccatcgtgaagtatggtatctccttcacgtccttttgtagaccactcactcttacaggcatgatctcctggcaaaagtatggcagaagaaaacactgaaacatttctacagaggttgtatcatttctaatgtctccacttccctagccaccctgccttttaaaaattgggagaaaatcagaaaaaagctgatatctctttttttcaaagtttatttttcttgcaaaataatatgcttatattgcataaactaaacattgcaaataaagctaaagcatcccttgaccaagaccacaatgttgcacaaattcacagactatttgtgaccagcctgggcaacatggcaaaaccccatctctacaaaaagtagccaggcttggtggcacacgtctgtagtcccagctacttaggaggctgaggtgggaggatcacccgaacctgagaggtcaagggtgcagtgagccccgatcataccattgcactcccgcttaggtgacagagtgaaatcctgtctccaaaaaaataaataaataaataaaagaaaaaaaaatctacagaccaccttacacagttagttgtgcagtgttgatggagagaccctgggctggacaatatctgcttgtcattcccaatctttatcctctcatgggagggaaacattgctctcggttttatgtaaatccccccagatgcttttctttataaaattttttaaaaatttcattttcttattattaccatagtggaatgagcagaactggcttatccctgcccctctccttagcttgtttcctcatagaacgctgatgccttttccctgcattaaattccagttagtcctattgtttagtcctctttctgtagtccgggccagttgttttccacatttacatgttgtgaatatggttttgcatctctctagcagtctgatcccagagcccctctccgattttttatttttaaaggttcaggatgttttgccttattaaggaatgctgcggagaaacatgttagagaaacattattttaggatgccaaaatctttttctctccctaaagctaaaacacatacagtttcactctaaggaaccaattctttagaaaactgagctaaaacggaaatgaaatgaaaggcggcctacattaaatttcatttagtcctattgtttaatttatgttctgggctactcgattccttttaggccctaggcatgcaagatactgtttccgtgtgcttggtcactccttcatattttatcctatctttgggccttatggatatttctgttctggaggcttctgaaatcagtcggctctctttttgggagagttggtaggtggagtgggatatgttttagcaggcatgttggtttatatattttttccattaaacctattggctttcttctttgtgagtttaataatgtgatgtcttgcttctgttgaccaatttttaaagttttgattattcatttgtactcggattgttttgccatattttctgagtaattttgtttgtttgtttatttatttatttatttttagtacagccttgaaagagacattagatttcctaggaaagcatgatgaaaacacactctaacccatttgtggacctttgcagattaggggtgcttccatattgtgagccatgtggctaagcaggatatgattgcctcgtttctgacccagcagtcaaagatgctgtgctttgctggagggaagtgttcacagctactgcctgtgttgtaatttttttttttttttgagaattaacagaagacctgaatttttagagttttccatatggttgctttcctagtaggactaacattgacttaaaaaaaaatccacctcttcactttaaggaaaagaaaagtcctgagtcacttagtattccttacactcaggaaggctgactataaaggcttacacttcctgctgtgattgtatccttcttgaaagaaatgaagcagcaacatgaacttagttccctttatctgcacagtgattctaagtctcagtttctgccgtcttccctctctgactatttaatacacttatcgtttctctgcctggcattcccctataggagagattgaatttaacaaatgtacactaagaatgatagctgacactaattcaatgagcagaaggttaaatccgatcataattcctgaggtaatggagacgggtcaggtatgcagatctctgaagagtcaaagagattaaaggagactacacagttcctttgactctgtagccactaggaaactataatagcgttttaaggtagggtagtactggagcctaaagatttattttttaaaaaatgaacaaagcatcacagtcaagctgatgcaataattttgcaatcctttgagctgttaaactcaagaaagatgttagctaaatgcaatctggaataaatacattaattttcacatttccttttccccgttgcgcatagtcttgaactattttaactcagatgaactttagtccatgttaaaatctggaaagagtatctgcaaagatataataaatataaataaattacattaaggatatacgagtggaaaagggagaaagaaaaaatttgcaaacacttaaaaaaaaactgcttgatttaatgtctgtagatggaagctgtggatcagtacttcccatgagactccatagtggattgtcgctgatggcaactaacagaaaactaacgaaaaacttgcacctggggcccttgctggattcgcctctaacagcccttctcagtgggatggcaggatcagggttaaggctgataagataatggaatctgtgcgtgcccggcctgattgctcccctgatctgatcactagtatcggggtgacagctgcttttccaaccctctgggcagcaagtggcagagcagcatgtcaattgcatgtgcatatttagcagtcatatattgacaattaaagagaaagtgtttcacatttgtattacccttattaaagagtatgtgaaatatttagtcaaagagttggagggtttagagatcccatgtgaatttttgcatgactgagcagggttcttttaaaatatacacttgatcagtgaattatgataattcttgcattggtgtgcctgtgtaaagatattgaacattacatatgcaagtcacatatatacctcagaggaagactgtcaagttttagaattgcaatagtagtacatgacactgaaattgggatgggtttgttataattcaaaatggaggtaatgaaatcagaaaagaaaaaaaaagaactggaaagagaatgttttgttttcagggattaaagctttctaaattagtgggttagaataaagtattgtgtcactaaagatagtaaaatgtgtaaatacattactttttatagaaaggaaactagtttatatatacacacacagacgcatacacaagtatatctgttagtatatatccacttaaaatgtgcatactcttatatctcagatttccacatccaggaataggtattcttcacctgcccttttcacttaaataatgtctcttctttgttgtttggttttgcaattgaagggcacttccttttcttctgtgtaaaaattgtgtatttgaaaaatacaaaagaatacatgtaattgacacgtaagcaatgaagcatgataattactgaacactagtgaatctaccatgcaattaggatctggaacattatttatgtaattgtgttacacttctatttcatcctattttctacttcctatagatactcagtaaactgaattttatcatttgttttcccaaaatggttttatcatataagtacatattcttttcataatctcatttttcaaaattaaggtatcatttacatacagtaaattttattcattgtgatttacaattctttggctttttacaaacacctacccatcaaaattaagatatagagcagttctattacctctcaaaatcatcccatgccactttgtaaatcagtccctcccctttttccccactcttggcaacctctaatctgttttctgccccaagagtttagccttttccagagtgtcatttagatagaatcatatattatatacccttttgagccttctttccttctgcataacgcatttgagattcattcatgtttttgtacatatcagtagttcatttccttttatgagtagtagtattctattataggaatgtattgcagcttgtttattgattggctagctgaagagcaattggtttccagttttttgcaattgtaaatgtatcggctatcaatatttgtatacacatttttgtataaatataaattttcatttcatctgggtacctacttagaagtgaaatttctgggtcatatgataaatgtatgttaaacttcataaaaaactataagatgtagcacgcatttccaaaggggctgtatcattttgcattctcacaagcaatttgtcaaagtttcagttgctctgcacccttattagcatttaatattgtcagttgcctatttttttccaaatctagccattttaaattaatggtatctcactgagttataatttaaactttctcaatgactaattattttgagcaactttgtatgcttgtttatgatctatatggcttgtttagtgaagtgttcactttttttgccaattttaaaacatatgttgtctattttcttattgagtttcgagaatttttatgcacagatacaaatttgttttaattagatgtgtgattaacaaatattttcttccagtctgtgctttgtcttttcattcctttaacagtttttgaggatcagaaattcttaattttgttaacacataatttatgaatttgttttatgcattatgcttttggtacctaagaatttttcacctaacccgaagtcacagagagtatctctgatttctcctagcagtttatagttgtatgttttacatttagagtagttactcactttcagttacttttagtatattatgtgaggtagggatcaacatttatacattttttgcatatggatagctaattgcttcagcatcatttgttagaaagattattctcaattgaacagactttttatctgttaaatcaagtaaacatgtgtgatctacttctggattgtctacttaaaaaacttgatttaggtgtctattattttaccaatgccatattgtcttgatgactgtagctttaatgtaaatcttgaatcaggtattgtaaaatcaggtactttaaaacaaagattattttggactacttaattcttttaactgtccatataaatttttgaatcagcttgtccatttctatgtaaaacttgctgagattttgatgaaattatattaaatctatagatcagaatgtggagaaatgatatcttaaccacaccaactcttccagttcataaaagtcacttttttgatgtttaaactcaatgttatgtagttttcagcacacagatcttgtacatattttgttagatttataactaagtatttaatgttttggtactgttataatagtactttaaaaattttgattttcaattgttcatccttattgtatagaaatattagagagttttaaatatagaacttctatctgaaaacttaaatcacttattagtacttttagctttctaaaaatagatttcaggattttatacaatcttattgcccaagaatagagacagttctatttcttccttttcaatctgtatttcttttatttcttgtgattgccttactgcactgtcttggacatctggtatgataaacaggaaagcagacatctttaccttgttctcattgtatggggaaagcatttaatctttcatcaataaatatgatgtaagctgtaggcttttttggtatgtgttctttatcaggttttggaagtttctttataatttgccgaacattttctataaattacaaatcagtgttcaaatctcttaaatttttctcttatctttcgagatggtgatttttttttcttctctattacatttatatagtggatacattgattgcttttcaaatgttgaacaaactcagcattttaaaaataaaccccacggtggctgagtgcggtggttgacgcctgtagtcccagcactttgggaggccgaggcgggtggatcgcgaggtcacgagatcgagaccatcctggctaacaatgtgaaaccccgtctctactgaaaatacaaaaaaaaaaaaaaaaaaaaaaaaaaaaattagccgggcatggtggcggtcgcctgtagtcccagctactcgggaggctgaggcaggagaatggcatgaaccgtggaggtggagcttgcagtgagctgagatcacgccactgcactccagcctgggcgacagagcaagactccgtcaaaaaaaaaaaaaaaaaaaaccccttggtcatgatgtattattattgttttttttacatattgttgtattcaaatttactggtattttggacaagcgtggtggctcacgcctgtgatcccagcactctgagaggccaaggcgggcggattgcctgagctcaggagtttgagaccaccttaggcaacatggtgaaaccctgtctccactaaaatacacaaaattagccaggcatggtggcgtgcgcctctaatccaagctactagagaggctgaggcaggagaattgcttgagctgggatgccgaggttgcagtgagccgagatcacaccactgcactttagctcgggcaatagagtgaaactccctctcaaaaacaaaaaacaaaagacaaaaaaaaaaaaaaaaaaaatctcacgaaatttaccggtattttgttgaggacttttgtctctttattcatgagggacgttgctgtgtaattttttctctccacccgccccgcacctccgtcttgtgttgtttttttctgattttggtattagagtatttttggatttaccaaatgagttgggaactggcccctattttctattctggaaaagattgtgtcaaatttgtattatttctttttcaaatatttgggagagtttgccagtgtggccctctggcttaaagagtttttggttggaaactttaatctagaagtacactttaattaatagatatagaattatttggattatctgttacatgattgagatttcctagtctgggtcttttgaatcatttgcccattttacctaagttgttcatttctgggcatacagttgtttgtaatattattattatcctttaaatgtctgtagtatttatagtgatgtctccctgtaaaaattcttaatatttgtacttcatatcttctctcttactttgttggtcaatttggctggacgagtacaatgttttttgtttttttttttttcaaaaaatcgctgtggttttattacttttctctatttttttgttctcagtttaatttctatatgttttattcattctgtttgggtataatataattttatttttccagtttttaaggtggattcttagaaagttgcttttcaagtatcgctctagctgcatctcacgtattttgacaggttatggtttcattttcattcaattaaaatattttctaatttcctctatgactttcactttcatctttgggttatttagaaatgttttgtttgctaaccaattattttgggattttccaagtatatttctcttactaatttgtagtttaattccattatggctacagaacatactttgtatgatttaaatttctacaaattttaaatgtttttaaatttttatttttttttattatactttaagtactagggtacatgtgcacaacatacagatttgttacatagctatacatgtgccatgttggtttgctgcacccattaactcatcatttacattaggcatttctcctaatgctatccctcccccatcccccaatcccccgatagggctcagtgtgtgatgttcccctccctgtgtccaagcgttcaattctcatctatgagtgagaacatggggtatttggttttctgtccttctgatagtttgctgagaatgatggtttccagcttcatccatgtccctgcaaaggacatgaactcatccttttttctggctgcatagtattctatggtgtatatgtgccacattttctttgtccattctatcactgatgaacatttgggttggttccaagtctttgctattgtgaatagtgccgcaataaacatacatgtgcatgtgtctttatagtagcagggtttataatcctttgggtatatacaccagtaatgggatcactgggtaaaatggtatttctagttctagatccttgaggaatcgccacactgtcttccacaatggtcgaactaatttccactcccatcaacagtgtaaaagcattcctatttctccacatcctctccagcatctgttgtttcctgactttttaatgatcgccattctaactggtgtgagatggtatctcattgtggttttgatttgcatttctctgatgaacagtgattatgagcattttttcatgggcctattggctgcataactgtcttcttttgaaaagtttctgttcatatcctttgcccactttttgatggggttgtttttttcttgcaaatttgcttaagttctttgtagattctggaaattagccctttgtcaggtgggtagattgcaaaaattttctcccactctataggttgccttttcactctgatggtagtttcttttgccgtggagaagctgtttagtttaattagatcctatttgtcaattttgcctttttttgccattgcttttggtgttttagtcatgaagtctttgcccatgcttatgtcccaaagggtaatgcctaggttttcttctagggtttttatggttttaggtctaacatttaagtcttttatccatcctgaattaatttttgtgtaagatggaaagaagggatccagtttcagctttctacatatggctagccagttttcccagcaccacttattaaatagggaatcctttccccatttcttgtttttgtcaggtttgtcaaagatcagatggttgtagatgtgtggtgttatttttgaggcttacgttctgttccattggtctatatctctgttttggtaccagtaccatgcccttttggttactgtagctttgtagtatacattgaagtcagttagcacaatgcctccagctttgttcttttgacttaggattgtcttggcgatgcaggctcttttttggttccatatgaactttaaagtagttttttccaattctatgcagagagtcattggtagcttgatagggatgtcattgaatctataaattaccttgggcagtatggccattttcacaatattgattcttcctatccatgagcatggaatgttcttccatttgtttgtatccgcttttatttcattgaggagtggtttgtagttctctttgaagaggtccttcacatcccttgcaagttggattcctagatattttattctctttgtagcaattgtgaatgggagtttactcatgatttggctctctctttgtctgttattgttgtataggattgtttgtgatttttgcacattgattttgtatcctgagacttttcttaagttgcttatcagcttaaggaagttttgggctaagacgatggggttttctaaatatacaataatgtcatctgcaaacagggaaaatttgacttcctctttgttttatgatccagaatgtgatctattttagtgtatgttccacatacatttgaaaagaatgtatagtcagtcattgttttataaatgtcaattaggttaagaggattgattgtgttgttgaagtcttttatattcttactgaatttatgtccagttattttattgattagtgagagaaggatatttaagtctctaacaataagtggtttgtctattttcccttcaattttattagttttcttctttgtatattttgatgtacaattagatgaatgcatgtttggaattattgtcattctactaagctgcttctctttattatattaattttcctgaagtctactttgtctactatttagatagccactacagcatttttttttgtggttgtttgcatgatatatacactctcgtccttttatttttaatttgtctgcatatttatgtctaatgtaagtttcttgaatacataatgcaattggatgttgcctttctaattaatctaacaatcttagttttaaatgaatgtgtattttggcattttatgtaagtactgacatttttggattattctaccatcttgccagttattttttgtatgcactcatctgttttctgattcttttgttgttttcttttgtattgagtatttattttatgatgattccgttttatctataccattcacttattatttttagttagtatatatttttatagttgttattgggttcatattttaattaatcatatattttatgttcacatcacatatagtgcttcatagagccttataatgttatactcccaattcctccctcccttcttttgggatctttttataattttatattcacatgtgctataaatacacaataaattggtactattttttgatgtgataatccactatcttttagagtaacattatatatttgttcataaatattatttccaggactattcatttctttgtatagatctaaatttctgtgtgatgtcatattctttctaactggggaatttcctttaacatatcttgtagtgcaagtgtgctagtaatgaattctctcaagttttgtttgtccaaaaaagtctatattttaccttcattttgaaaggtgttttcattgggtatagaattccatatttaaatttttttctgcagtaatttaatgatattcttccattgctttcaggcatgtataatttctgacaaaagtctgctgtaacttttaaatctttgttcctttgtatgtaacttgtttttcccctggcttccttcaaaatttttgatctcctttggttttaaaattttaatataatataatataataaatataatataatattataatataagtgtgggttttttggcatttattctccatggcaatacttgagtttcttagatctggaatttgctgctcttccttaatgttagaatttccatttactttttatcttttctcttggtattccagttacagacatgttaggccattttttgttggtccacagctcttcaatgttttgttcaccctctcaccttctttctttcttcttatttttttggattccagttctattgacttttagtcaagatcaccaattctttgtctttagcgtgttcaagtctattgatgagcctatcaaagaattcttcatctctactactatttttcatttctaccattacaatttgaacttttattctattattttttacctctttgctaaaaatttttatctgtttatgcaagttgtcaacttttgctagcaggacttttaaaatataaataatagttatatcaaattccttttctgataattgcaacatctattatatttgagtctggtactcttaattgcttttcctcttcacattgttttttcctttttcttttctttttttgacagagttttgctcttgttgcccaggctggagtgcaatggtgcgatcttggctcagtgcaacctctgcctcctgggttcaagcaattctcctgcctcagcctctctagtagctgggattacaggcatgcgctaccatgcctggttaattttgtatttttagtagagatggggttcctccacattggtcaggctggtcttgaactcctgacctcaggagatccacctgcctcggcctcccaaagtgctgagattacaggcgtgagccatcgcgcctggcctttcctttttctttataccttcttctttgtgtattttgtaattttagccgcaaattggacacattgtgtaggactgaggttcatagtagtaatgcttgtaaataggcatgcctcattcttttctaggttgtaaagcaatccatttgagaggtgaaccaattctgtgttttcttcttgctgtaatttatataatgctccaaagttttcaaactcctccagcattactttgtgcttaggatgggagttgagataatggagggtttttctgaatatacttactctatacttagcttttgacattctctgttaaacttgtaccttagagaatttctctctctgttttctccttttttctagtagtagattactgttattatttacttggtacttgctttcctggttggcgggggaggtgacagagtgctttctgaggttctgttttagtttgagtcctaggcatgtgttgtgtgcccgggtcttgattgtggagtcttagtaagcctgcttctgagcagcttagctgagcagggaagtctcagttttctagggctgctgaaacaaattaccattcactggcttaaacaacagaaatttattctctcaaaatcctgaagactataaattagaaataaagctgttagcagtgttgattccttttggagacgctgaagaaagatatgttctatgcctctctcttggctactggtggttcccagaatccttggtcttcctcgggttgtagataaatcactccaatctctgcctccatcttcatatagtgttcttttctttgtgtttctgtgtcttcacatggtcttgtttcaaggacatctgtgatgatatttaatgcctaccctaatccactatgatctcatcttaacttgattacatctgccaagaacctatttctaattaagatcacattcacgggtaccaggaattaggacttcagcatgtcttttcttgagaatgtgttagtttgctagggctgttataacaaaaataccacaggttggatggtgtaaacaacagaatttattttctcacaattctggaggctagaaacccatgatcaagttttcagcagctttggtttatccttaaacctattttcttggcttgcagatggtcatcttattattgtgccctctcacggtcttttctttatatgtccatattcctggtgtctctatgtgtgtccaaatttcctctctttataaggacaccaatgaccccattttaacttaattacttctgtaaaagctctatcttttaatacacattttgaggtagtggggtttagagcttcaacatatgaattgggatggaggggaaagagacacacaaataagcttataacagaggacacaaccccaagctaattgagcgtagtagggcctaggtttttttttttgcccttcgcccaaatgtagagggtctgaaaatgaataggacttttacaaaaaagttcttttatctattttcttactaaaaagttctactattttcttattcaaatctgcctgatcattatttataatacctttaaaatgtgtttgtgatctttgtgaaatcatatttaattgcttttaacttgtggataatctagaggttgaattgacaaatgctatgcttcataaatgatttgcatatatttcttttagaagccaagtgctactaccaaagtagttttaccttagccctttcctttccaggatcaccagattaatctaacagtctctagtttgtacctataacccactggttaaggtatttatctcctgattgtggttttaataatggcatgtatctatcaggtatgcctgcctattatgtgtctttaccaatcaccaatcagatttcagctcacagggttatttcttccttttggagatttctcttacttcttgggagcccattaatgtaattagtttgatgcaggatctagttctttggtaatatgtgaaccttccagaatatttagtccatcaaatctcaaaaagcagaagtgtctgataataaatttttgtaatgtctttccattccacttacatagatatacctccacctttccaatgtttgcatagtattagattttaagggtgtaacattttgagaatgatacctctatttgtaggcataaagactattcacagttatgagctatttcatgtgatatgcagtcagcataattgtgctgaattttcataaacttgtatcaacatatacttgtagaatacacttctgaaagtggaattgctgggttaaaggcattttgagagtttttgatacatattttcagacaaatttaaatgttgctagaaaatataaaaatgtttctagacttttgtatttaataatacttacctgttttacaaattatgatatattatttcctaatgatcaacatttaccctttgatggcagtaaaatcttgttcatatggagcattgtctaagaaggcaaattgtgcagaagatactatacttattacctaggtcctagtttcagatttgccctgtgtttgctttttgactttcataagttagcttgccttcttcattctttgtagctttatacatgaactacagatgttgaactagaacaagggttattaaattttattccaaggatgggaaaatgaacccaatgggtggtgctttgaaattcctgtccctacttcaagcaagacagctgcacttttatcttttttgtatcagaagtactgaagattattccatttggggaaaataaggttctgctgttaaaagtagtttaaaatctctttccctaggtagatctaaagtcactcctagttctaaagttttcttatgattttgtacatacttccaaattgctagatttttcagtattcgaactccaattatggctcctacgtttttccccttctacagtcaatgcaaaaataaactcacttatttagatgaaaagtaacaaagagcgagctgtttcttcctttaatcccttatcttaggcttctcttttgaattacaaatgctttagtctcaactacatttttaaagagagaggttaaaaatatgtgacttctcattatttattatccttcagagttagattgaatttaaatatagaatatcatttcttatatcctgtctttttttattttctttagtgtgtatccattgcctatgtattgatcatttcttaagtactgtttctatccctattctcatcaatttgtaagtcccagcatactttcccatagtcactattgaatgctatagtcacatttattttgtctgaacactactttcaccataataagattttttacatttctttgggaaactctaattaccttaggcacaagaacaaaattcttggtttaaatctcttaatcaggcttcctcagaatagtcactgaggcaaactgactcactctcccatgtgcctgattatctctctcagaatgtttgaaatgcactcaatttgcaactatgttaaaaacttctacatctctacaagttccactttttccattgttaaagtgtaaccttcttcaggaaattttttcctactaactggggataaaatgtcctcttttcttttatcattgcagacaaagtacttgcactttgtctataatgagaaaacaatagaactttttgaaatggattctagtgaggctgagtttgtattaattttgtctacactgagcagaagtttgactatgctatctttaaaaagaggtttaacagagaaagaagcataattaagacggtagaacatatacacacacacatcccaaaatttaaaaagttaagattatgaactctggtttctaatttaaatgagaacatctattaaaataatcaaatatataaaagactgtttcagcatattttgtgcaatttaaaaggaccttcctttgatttgaaaagtgctttattatactgtatttattcagtagtgaaaactttagataacttactgtagacgattcccagtttttcctttaggaccaaggcactcattcccacaccgttagaaatggtggctgaagagcgtcagctgagtccctcactgaggatagccctcaactaaagagtgtcatatcaaccaaagtcatatcctatctttgagaacagtctgcacccagtgcctactttggtggaattataaagaccttattttcttgccttgattgagacagctctgatatgttatcccagttccacagctcaccaaaggattggctcgggcctttgtcgtgacgtcgctgcagctcaactttttcctttgcttacctacttcctttacaaccccataggtattgttcgtgagggcactcctaaataaaattgctgcagtcctgacatttactgtgtaacaacgaaaaaaatgcaaaaatggctaatatttaaacagctattactatttcccaagcattgtgctgagaacttcagattcattaagtcatctaaacctcacaccaatatgagatggaaatgattattaaaatctctattttacaaatgagtaaactcaccttagagaaattatataatttatccaaattctacagctactagattgtaaagccaagatctgaaactatgtctgctacattccagagatgatgcttttaatgactaaattacactacctcctgcatcttgaggacctgtattgaatgcctgaaagggcattttgggatagagtacaatttaatgtttttgtcagtgaagaccagtgggtatattttgaaaattaaattttgctctatatttatattgtgagaagacataattttttgggggggttaaaaattattattatttttaagttataaacagagtactgtatttagatgtcggatattattgtatttttatctctgatgcaaatgaaggaatgtgaaaattaatttcatgtgaggaaattcaagcctacttactgacattaataaatgttgattttttgttagaaccaatcactgatgtgctagtgaaattccaattaattgtttgtcactattgtagacattaattggcattccatctataatttgtgacataataaaaggcaagatcaaaatacagattgtttttttaaatgtatttccaagctaattgtactagctacatgacatgactgatcttgtctactgagaagagattgactgttaatttagttaaaaaattcatctgaaaattcctttgttttccaggcacatacagatgtagtcttatgttagaaagcttttacaaagcagaaaaactgtatattaaattgctacttttatgtatgtgaaacaactttgatatttatatatattttgtaataaaatattttatatttgtatagcactggtgagttttcacaaatattatctcatataatttttatcataattgtgagataactgaggtggtgttattaatttcattttctagacaagtaaatagagtatcaggctaagtgatttgttcagatgactgaggtaagagtctgtctgatcaattgacatggtgaggctgtgtccccacccaaatctcatcttgaattgtagtttccttaatccccacatgttgtgagagggacctggttgggggtaatttaatcctgggggcagtttccctcctttgatagtgagtgaattctcatgagatctgatgtttttataaggtgctttcccccttttgcttggcagttctcctggctgccaccatgtgaagaaagaagtgtttgcttccccatctgccatgattgttaagtttccagatgcctccccaaccctgcggaactgcgagtcaattaaacgtcttttctgtataatttacccagtatcgggtatttcttcattgcagtgtgagaatgaactaatacaccaatgctgttttaactacactgacatgaacatattaatgttttctcctccttgagcaatttcttctctattgccacccttctgagataaaatgttttgttctccccttcagaggcaaatttctccagaaaaaaacctaatttgctccactcattttcaaattatgtaaccaccacttgtgaatgttttgcaatctggtctgttttcatcactacaaaagggcggtgctatcacagttcaccagaaatccttgtcactacagcatccactggcattatcacagatcaaaggtttcagatatcattgttcaccatctctcctaaacatattacatattttaagaaaagttcatctctttgtttccatattaccgaaagttgttctttcctctcctttgttaccttcattgaatacttttcctatctttcaagtagagttgtatatgtatactaaagatacatccttgactttcacctcttctattggcatattgtatcttccatttagtgtttatgatttcaattatcacctccatctaggtgagaagcaatatggtacaggggttaaaaccatggcctctggattcatattaaattgagtttgaatcctagctccaacatttctgtggttttgaaaaactacttcatttatacatgtaccaaattgatttacccctgcttacctcagagggtttgaagagttaaatgggataaggtatgtaaaaggcttagccattgagattcccaattgttttattttagtaaaatttaatctccttatcataatgctataatactctataccatctggctgcttcctacctccaggcaagcaatattggtggtaaagattatttggtggcagaacagatggaaggaagcagatgtatttaagacatgttttataggaaggatttacagaatgggcattaacttggtgattcggatgaagtgatgaaaaaaggttatactaaaataactttacattttcagcctcatagagttgggtagatggtgatgttatttactgagataggaatgactgaaggaggactatgattctggagtagattatgagttaggtttagagtatgcggagttttgagttccttttaggtatctaggtagaatgattgaatagacaattaaacaggtagcagcattcagaaaagaaataggaggaaaagaactcagaaatattttaagaaccacattaaaatccacacagaaagaataatacaactgaaaatatatacaatcaagaatgtgataggtaagcatatgtaaaacttaagtataaatattaaaattataataagtatgaaagacgtactagaaagtttatatgtatgcataactggttctgaagaaaaaaggatatataaaatattaataatgatatactagaagaaaacttttctgaaataaaagcttgtattattgttttattcaaaaatattcattatgtggctagtatttttcaggtgctattttaggcgttgggaacagaacattgaaaaagaaaagattgactgttctcatggaatttatattttataggactaatacttataccatgtcccaggaaaaatttaaatgaagcatcaagaagacacaccctcatgaagttattaaacatcaagataaagaattttatggatgtttagtcaatgaatgcaatttatttgtgtgggtggagaataatgttggcctctgtcttctctataataattatcagtgagaacacagaggatcaatagcatcaaaactttgagaaaatcaaatgtgtcccaataattttgacacccaaccaacatttccttcaaataccaaggcaatgaatagatattctcaagtaaataacaagtgaagaagtactgtacccatgcaccttagttgaaaatgacctcaaaactggacaatgacatccagccaaaaaagacacaaagcaaattaaaaaacacaggatagaggacccatactcttcactgaatatacttaagtatagaaatattaaactactgtgggaattttgtttgcagaacagaatatacatgctataaaccttataatgaacaattaaatactacaaggtggggagagaagagaaaggtttattattcctatttaattttcttatcttttatagtagaggttcaaaatgatgctctaaatttaaatcatgaggtttttttttcccctctgaagtgacaattcctatcttttaatgtttaaaattattttcttaactttaaagaattcttttaggtaccattattatgaataggtgtccaaactaccgtttcttcatttcgttttattttcttatgttgaaattcaaatgaatttaagtaatttagaaattgaaaataagtatgatctcatttgaactgctgttctttatgtgttactctctgctcgtctctgtgtataagtgggagtggctcctggagtgacagtctcctgatgatagtaacaagggttgcctttgggggttgggcagtattgctaatgtggtcagtttcttactgttaatcataaatggtagtatatggagaaaactaccaggaactgaagaaaagaaacagttgaaagtcatccctggaaatggagctagaagtgggtgtaagttgggagtggagaattaaccatcagaaagtttttaatcttcttggctctcttagttcacagattggaagtcagcacattttaaactatggagggcaagttatttaaacaatagtattttacagaaaactttctagttctgatgcatttgttgactgtttcagatctgacttgctaaatgcttccatttcaaacctcaaaacaatttttaagatattttgtaagtatatttgaaataatcacatattttttcaggggattctgtagctattattctgtgttaataaataagctaatgttatatgtgttttagaacctggttgcatcatttgtttattttattttttgagactatcacaaagcagcattttgtttacataattatttcagaatatatatatccctgtaatgcaccaatagaagcatagacggacagagagagtgagacagaatagcagaccagattggatcatacttatttaaaattacaaaatgtatatattatattatacatctgtactacacctgtttgcacgcacatacacacacatatatatattttccaattaaaaaacttagcgtttgagaggacttacctaaaacaacctgatctttctgatttaatttttaccattataaatcaatgcattaaatgcagaaaattacttcttctaaattcctgtgagttccttacagtactaaaattatttcattttctaggatcttctttcaaatcaaactttgtgccttaagcagctgctatagggctcaacttctatgtcacccaggtcctagcaggaggatttgaggccaggattgcactagctgtctgggttttataagcaaactttggaaaacataatattgtacacccttttactgtttctttttttttttttttttcagaaatgtgctctcctgaagaaaaatcagaaatacattgataggtatgactcaaattcattttatccaccacgagcctattcttgggtttaaaataatacagctaatgcgaattatctgtttttttttcagtctcttggtactttttcagagttaaatagtctacaatgaactatttagctctgttcttgaattaaattaagaacagctatcatcaattaaaagtacattctcttttacatcaaaataattttgtgaagtaaatttttacattgtaagtgaaaaagaccttgtacctgaaatctagtattgtagcattttagaggtgtaaggcccgttggagatgattagccttcccagaatgctagggatggctcaaatgtgtctcgcctgccttggaaagacagatgtccctgactgggcaatgcttctggttccctacattatttttcacttgtttgctgctagagacctgagttcatgtgggaaacagaattgaaaggatcctggttgactaggggaccagggatctcagtgggatctaagttagcatccagggttactcctgaacatagtgatctatgcaactctgtgggcgcactacttctcggtctttcctgagaaccacttgatgctcaagaagatcagttcttttctagattctggatctaaatctcatcttagaaggaatttaaagaggaattagaaagggttttgctaaagtgcttgggtttagggattagattcaagctgcttgaggaaggctctgttaagaagtcacattccagtccccaaagaataaggattgtggaaagtagttcattgaatggaactactcattagtaaatttctacccggcagaatctttctcttttatcactgtgacctccattgtttaacctattgcctggcatagaggagaaacccaatatttgatgaatgaataataagatatgacaacaagaaaaaaaaagagacataattcggtcttactggggagtaagttgcacaccaggtcttggaaatgaagcaatcactagaatggagaaccaatttagttctttaaagaatcatctgaagtgtgaaactagggctccctcagtatcttcccaccaactcatcttacggtcttgggagtccccttttagagatttactcgtgacaggaatgtggcagaagtgggactgccaagttcatcgtgactgcttctggaaaaacagaccatacaaagtaaaacaaataaacaaaatccaaaacaattacaaaacagcaagcatgggacaatgcctaaaaaaagatgtcatgttatgttgatgtaatattttcttatagttaaattattctcttaaatattcattttccatgttttataaagagatctatattaatgtattcagatcttttggggttatataaccaccttctaccttgaagattaaaacagggaccttccaaatcagtgaacaagaacaactttctgccacctacagaaaatcttgctgccatcgtaagaaatgacagacctgtaatatttatgccaaagatagcatttcttgggtcccaaatgatatagctggagtccctgtatttactggctttgttcctattgctaaactgtcttctattacaaataaaagtttgctttggctcaccttggaataaagaaaaaccattagcaaaaactttatgctatctcttgccctaaagttcttccagggggaagagtttggaaatctgttttttctctaagttgagaaggaatttgtcaagagtctctctgtggttttctggccaccatataaaaggtcatagaaattcaactgcttctgatgttgtcatcttgtgcctttgcatcccagctggaattttagtggatggggcagaaaatttttgatttagctccctaagcttcaaacgacatgcactattatggcaataacacatcctataatttgcttttatcaactaagtgattttccctctaaatgtggtatttgtctgacgtgcattgaaatgattgttgaagaatcttaatggggaattctggtttgcctttggcctttgacataactttttctcattgaaataaggatcaaggggagacttgattaataaactgtgggattaaaactttgtcttaacagaagttgtcttggaaacagaataaggagggatgccctgatgtgttctccacccctgaggcacctgagcggtcaccgtggagagagaagggactagagacctggagtcggtagagccttggttagagaaagacactgtttgttagaaaggaaattccttaacagttatttctgacaatagaatcggtgtccttggaatacattttctttgttgatttaaatattttactttttgctgctttagagtcaaattagtttggataaaaaaattcgatttgaactcagtgacataaagctggtcatttttaagccaaaaacactaactgaatttggacttaaaaacaaaacaaaacagaacttttcttcttcaaagatgctatagagctaaaaagaaaaaaaaaaagtgatattgtttggtttctgttcatagacgtaagctttgggagttaagtttttgctttatatatgtacaaataaatgaatccaactatcccatgtgatattcagcttgtggtagaaactccttttttgacttaaaaaggtaaagatcacttgttatagaaaatttgttattaatttatatcaagattataatgcctaaaaaatgtagtgagtcaaaagagataaatttgacattttagaatggtacgatcttgttttaactgcaggtgaagacttcggttactgagggacgtcgttttctcttttaattaatttcttttcctgacatttctctcatcatgaggcaaatttgtttgtggcacttaacctttaagtattatgtcacttttcactggagtcatgcagtgaccaagagtaagcgaatgtaagacatgaaaagttttttaagaaggcaaaaacttctcaaactaaatttgccaccagaaattttcttctcaacttgaactcagaactcactacctgaggtgctttttgtttttgccttcttggtcctgcttcccatccttcagagctgaggaaccctgtgttctgcaaatggcttttcaggctcaatcttccctacccattaaatgcgtatatattttttcaatttgcttttcccttcgctgttcctttcttagttcctgctgtcaaatcctacttattctttaagctcacttttaatttcctaacccctactttctcttctctattatcttccctctcccagttttggattattgattccttctttattctgaagcattcagtacctgtctgtgatacaacatttactctatgatatcatcatgtataatctgcctcccttccttgagagtaactgggttttactggcatttcagcactggggaggaaggaattacagcatctgacctgagatccaatttcttactccctttactgagggcaggggtaagagattcccctggaaaaaagacgaggcaggtaacctggtctcatttccaggatgatgatatttttggggagaaagagaacttatttgcacatagtccttagtaggatgtccctggaaaagacctatagtaaataggacccgcaaaatgaaacttagctccctggagaatgtcatctgggctatataacattcaagggcagggattgattaattttttttcttaaaatgtcggagaataaaaattttaggcatgtgagccacatggcctcgattgcaactactcaactcggattggagtgaaaaaacagacatagacaaaacataacaagtaaacctgtcagtgttccagtgaaataaaaatggtggttggcttgtgggtcatagtttaccaacccctgatctaaggtataaaatagagatgcttcagaacttaaatccacctgctgtgtggggtaatcataattgtaaagcttcacttggagaactcaactattgttctgggcagaaacctatgtccagggagggaggaagggttggaggaaccacactggagggcctgcatctctcactattctgtctctccttgattgcctgcatcctcacaatcattaataaagcttaattccaaaggggatctctgatttgtgtagacctgatttgacaattcagtcctggagattggctcaacacattagcaccaatgttgaacaatgcatatttggtgaaaagaattacgctggaacactcacctaagtctcctagtgatatttgtaccttaaacgaagagcttctaaatgcagacatatactgctgccctggttgggaatcaggtggcccatcaaactatctcaaggtggtcatggtcttctctaacttgtatcattgttgaaatccctcatttttctacaggcgttttgaagatgactttcaaatacatcaaggtcatgttactgattgtattttgctctttaaaaagagtcacttttcctcagaaggtttctctgtctgcaatataacaacactatagggattagtgtcctggtttcgtttggagagacctggttaggtttgacttttgacttggcatttcagttgagtatacaatttgagagatctttccaccttctttctttttcttgagagatgggatcttgtcctgttacccagactgcagtacagtagtgcaatcatagctagctatagtcttaaacttaagtccaggagtttaagactatagtgagttatgattgcaccgctgcactgcagcctgggtgacaggacagtgttcccgcctcagcctcccaagtagccaggattacaggaacaagccaccgtgcttggccacttctctatttgtttcttcttccttttcttagtggaagatttatggacagaaaagaggaaattgatgtacagaaaatcgaagtgaggtacggaagcagctggattagacatagcctggtgtttgtctcatttgatcatgctctttgagcagttggctataaccttttgtatttcttataccattccgaatgactcagaatctgaaaagaaagcagcagaagaaattactaatagaagacagggccctgtcttctgaagcactcctctcttaatttggacaaaagacataattaggcagatttggcactaaatcttgttatgttacaaactagctgtgttattctgaccaaaatatgtaacttctctgaacttgtttttcttctgtaaaaaggagaagtccacctttcacatgtagatttaaagagaaagctcatttacaggttgggtgattattcttgttctttgttggcctttagccagaagttatttgcacatgcacatatgtcactcagaattataatcaaatgttgagaagcctccactacagatgttcctaaaagaaaagggcagattttctctttctagtgtggtttaaaagcagttctactggaaggcagaaggatgaactggaacaatctctaattatcctttattgtcctactaacctgtctattttatctgcttctttttggcacaaatagtatctcacccaacatgattattctaggagaaaaagccactcagctagtgcccaaaactagttaagtgctgatttagtgagttctgaagggatatatggcttgactaaaattatttatgcagtcggggaagaaactaattcacacagcagtgccctaattggcatcagagaggtgtttccgtaaagcccttaggaaaagcaggaagttgattaaataggaaaaaaatgcacatgaaaataggagtacaaagaatgcatagaagaataaaatgcagttgttaaataatcaccctgataatatttcttccccccgagaagttacctttgatttaatgcaggagagagcacctgggaaaatttcaaattggagtccctcccacacttcccctgcctatactaagaatccatggcccagaattcaaatactaaatctaagagaggcaggtaaaaagaacagtggaaaacagatggcagcagttacaactagcaaattcccagttggtggctctcacatttagaagcgggcatctgttcttcttccccactgcaaagtggttttaactcagaggtgttaaaaatatctaagttgctgttttattcatttctgctatttactgactttaatgacttacagtatatccgatgaaaagtacaatgtttacccaagcggcaagagactcaaaacagaaatatgggatgctgttaaaaaaccttgtggtctacaaaacagcatgtatggttttataggtgtaccttgctttaagaaatcaatgggtaccttaacgtttgtgtaagttgaaatatactttaaaatgcaccttgggtgcttgacattacaaaaatcttgagagagtcataacctctctgggccttagtttcctcctctctgaaatgggaatagtaatgcctacattattaatctactgttcaggtctcttgtgaaaattagggatagtatcagttgaagatattataagcccctcaaatactgtaatgcttagtcaatgttaatgcattttattatttataaaaattctcattttgaaataaacatccattcataaaaaattaaaaatggagagtgtgcctgtgttcatgagtaagaaagcctcaaaaataaaaggggcagttaacataattatgaataaaatgtctatagcctctttatgttattgtaaagatgcctttcccagaaccatttataacaggtaccaggaagagagtcttactgaattgaatatcattcaacccattgcctaatgtagatatttattgactgctggccatctcatattttgttttcttcccttttttgatttaaaaatagtattcattcattgtaggaaatttggaaatacataaaacataaggaagaatagaaaaataatttataatttaaaacccagagacataagaccagtatagatcttatgtcaccacactgagaaagcaccagtaataagattaatttattaaaagcttttctgctctcataaaagttaaattgagtaatagatttatccaaagcatggtttgtaatcacagtttctgacctcacaatcactctgaatattcttcttcaatattattattaataatcactaaccttttctgagtaattactatgtaccagttgctatattaaggcttcatatatattaatcaatatgaaacgcacaacagcttcatgtatttggcaccattatctacaaacgtgaaaatgagaacatttgatattaaggaatatgcccgagggcccatggttaatacatggtacagctgtgattaaattaaaaattaggggtatttgattccgtaatgtacactgggatattctgcttctctttagtatggtggcagcagcccagattttggaatgagatatgttgtgggtgttgttgattctccactcttcatgtgtcttttcatgtggagggactttcctatccagtcacttcctgtgccttcattctcttctcttcatgtcaagaagactgacatcccatttgtgagtaaggaggtttaaactgggtgccattgccttagccctttctgctcttctctttatttgaggtctgcctgtgtgaagagaaggtgcattctcagctgctccttggcagtgcgggctgtgtgggtctgaccaatagtgttttggagaggagggtaaattcaattcagggaggcatgtcaccctatttctttgtacttaagttatctctttctgtttagccctttaccaataatcatatgtttaactctgatatatatttctcagtttgttacatacttgggcatagacagaagtgtttttaaattgattttctatgactcttagcagatagtcccagatacttttctaaccttcactgtctttgtgtgaaaccttgggcaagtgacttcactaatccatgtctcagtaccttcagttataacacaggacatactttttccttcctcatgggtttttgttaggtttaagtgggttcatatgtacaaaaaatactgagatattttccccattttgtgatgtgaacactgaggcttagagagtttcagcaacttgcacaggatcacacagctagcaagaagaaaggcaggcaccgcatttcaaaccacatctgaagttcatactctctcaagacatgactctgataattatgacaggacctggggtagagagcatggactcagatccttctgtaagagtgggccagtgtcaaggaggtcactaaaggacagcagaatgatgccttgaaccgagcagtacagaatcttacacaggttgtagaaataatgtcttggaagctgacatgagggtgctattttctttttgttgttgttgatttttttgtttgtttgtttatttaagaagagtgtttttctatcactttttctttttgaactaaggttgagatttttaaagtactttttttgttttttaagatagaatcacatagcttgtgatcaggttctcatgcttcagaatgctatggctgtgttttatttttccacttcctctaattagatgtttgaggtcatgtctccctgcaccactatcaccattctcagaccccattagtctcttctatccctgtcctcctgtcaccctcaactttgaaagcagtgtatccctgtccttttttttcaccctcgaactcgaaagcagtgcagtattgtctaaggaagcataatatgtagaaaggattagacacggtttaggggaaagtttggtgatgcatctgctctgagagtacagagaattggcttaaaagggcatcagagtaaaagaccagtttgcagaatgaattgtcttgtgcttgtgattgtctttcttgtggaaaaggccattttctcaagggacaacttgagtttagtcatcatttggaacaggtacagattcttacataaaactaatatacatgaaagcaacatttgttgagtgcactgtacttgatgttttgacccacattacctcaattcatcttcacaataatactaaaagatgaatattattatccttgcttttacaaaaagagaactggggctcaaagtggttgaatacttcgcccagggtcaggtactagtaagtgcaggcactggtaaggctcatgctctagtttgtctctttccaaagcctctgctctttttgctctttcttgcatgaattggtttattaaatatgaatgggggaagttcactagaaggctttttcctcaaaagaagcctaggaatcccttctctgcttgtaagtggacacattagtatgatctccatgtccatctataaattatctatagtatgatcaattctgaaattgggaaggacaaacttgggcaaatagctgctctttacagaaagtctaattggaaagagaatgactatgctctgtgccatgaagttttcaagagaaatgttgcaaggaatagaaatcttgatagatatgaattttgttttgaaaagctccgtatgagaaaatcttccacgagggacatcccttttaccaacttggcaaagactaaaaatacagagcatccaggatcaaagcgtattcgtgatgcgaagaactatcccctgacaatcaggctggaagaaggaggtatcctttaatcttttccctttgttttattactttttttttctgaggggaaaaattctcttttttattttctcttgctgactaactcttccctttagtcattttcatctcacgactcatggcaattttccctctttacattaagaatgaatataaacacaaatcacgtttgagtttctatttcagggccttgtttctctcctcaaatgttcagaggtaagcaacagaaagttggagtgagcatagcactaagacttcagcaggatcagaagtttccatcttccctctttgctctgtgcatgccagagttatggagaaaaatgtttcttgtggcaacaggaaagcagtttgaatcaatcaaagatcatttatagtttttataaactggagagaagaaataggcttgaacgatctttagattccagggaagttctataaagggaaccagaagtagttatttataaatgaaactcgaggtttttggtaaggggcttatgtgctagagattgcacagcttcattcaatgtgtcctagtttttaggacaaaagccaaaataaggggcggaggattattgcacatagcttcctgtctgggagtctaatatgggtgcacacattgatgccaaggttcgcttttgagttgttactttcaaaaaagcttcatttattaaaaaataaaatcatcattattatctcattacaatataggccctggatatgaaaaaaaattgattacctgatctttagttcccaactccattctatctctaattttgttgcttggggattattggtctatcaacactcttcctgaataatcaatctggttaatttagcctataaaccacttttccccttgtgtctggtgtaacatattgtttagtaatgtgcccagtaaagcagaaaaagtaactcccaggaatagaaaaggaaacggcactcagattttgaacttgagtatcttgcattttacccatctgctgggctgtgcggtaactcactttttatttattttgtttttagccatatgactaactctacctcattgtgctcagcagctgaacaaaatgcacagtgctatattctgaggcgcccactcattctttattgcttttatgacaaagctgtccctccacatgtctgctgtgccctctgacccaaggcgtttacttcaagtaaacatgccagatggtggagaaaagtgatgggtcaaagaacaatgctcgagggtcaggagtcaccaaatccttcttcacaaagcaaacttaaaagcaacaatttcaccaaatgctctggagtgctttcacagtggaaatggaggtgggaaaggtagaccttaattacatattttgctttcagggcctaatggttttaggtacagtgtctattggctaatttgaacgtaagcaatttatgagaaacgataagaaaacaaagaggacagatggatcactcttgtactcagcaaagagcagcaaggtgaatagtttgtgtgtgaatgagtattctaagctctggcccaaaaattacacaggtaatttagattccttatcttttctaggggctattgttgaaagttgaggcctaaaggatgccattgtctaaaatacactagaaccctaacaaggctctagtaacctccaaggaagcttttagatgagatcttccatttttttccttgtctagtatggtgctgcgtaaatccagatatatgagcatttgaggagttactgtaaatatcttaagcacgaggatgtgtctttttaatgttgctgttttcaaaagtaatttaagaaaatgttcattagccattttacaggctgtgtattttagaaagaacattagaaatagtagttactccttacagataatctggcataggtaggcactattacctctctttttcagatgatgatggcataacatgtctgtaaaatgcactggatttatacacagtatcctaatatatttttaaaataatttaaagagggaaaaatttttgaatttttcctgttcagtgcattgaaacatatccatgttcctaaaactctttctgggttaagtactatcatatttgactttcaagataaagtgtctctcctaattgccaagcgtaagaacttattttttgtgtgtggtaaagtgaattctctagctgggatatggtataaaatagagttaaattggaattcctaatggagaggttatttatagggctgaatgtgtgtccttaataagttaccaagattctgtgatagatcacctgtgaagagattggcagtaatagttacttttcaagaattaccaaattaacatttaataatattaataataacctccagttattggatgtcaactatgcacgagaaactttatgagctactttatgagatactttatatccatgcctaatttaatttttccaactttagccaaaacgacagcaagagagtttacaaattaccaattgctgggtttatcggtttatatatgttatctcattaagtcctcaaaacaaccctggaaagtaggtacaatcattagtgtcctttcatatgtgagaaaactgaggtttagcgagattgaacaagttatttacttcaagatcatacacttgataaatggcagacatagattgaaacccaggcacaagttcttacactattctatgtattattatctctactatattagtaataaacagaaattcagagatgttgcgtctgcccaaagtcacactactagcaggaggcagagggcacatccaaactcaggtttttttttctgactttaaagcccacactagatatggcagttgctctctcaatagagctacattcaaacaccctagaaaagtaactgatgttctccattgtttctgtaaaaggtacaaattgttactcactgcatcatcagtattcatggctagtgggctactttctgttatgcttgcacacttctgctcctaatcactgagttttgtgtttagagatgtgtagtttccaaacctctttataccaattgaacatgttactgtagttatataattatgttaattgtcacataagccaatggtaaatataaatgtggaaatagaactgttatttccatgaaacctaaactggatgaaaagacaataaagggaaggtacaaagatattcagccaaattaagtatgagtgatgcaattgtaaaagattgagagaaaataataaaatctgagacaaattcttcattcacaacggcttcccaattttatttaaattttgattccacttaaaagaatcccaagttcttgaataaaagaccttggttctaaatcaaactattggccaatgaatggatatacatgttagcttaaaataaaatatttaagttatatacttataattttctgattgcctgatgattcctgataagggggtttcttgtctgtttaaggtggcaaaacagaggtgcaggctgattaactcagtaacttagatcctgccatctagtacagtggcagagctaagacaaagtggcagagcaagaaacaggatttaactccatggctctgtttaactctatagttctccacagtttatgctttgtcttttactgcctcaccaatgtcataaatttgagggttaggaatcatatgccaggaaaccccatggaaaattgttgtgtccacatggacttcaaaattccccctactccattcccgccctgagaaaaaccttcctctttctcagtcagggattaacctatttgattttcaaaaactctagggaaagatatttcatcacatcacattatgattatcattgttataagaattttattttccttagagactctaccaatataccctcctgctaagatgcagagcttttaagcaataggaaagaacagaaatgacttttaatgacatgacaacattgctgaagatataagtcccagaacttctctaacttcatgctgtctcccctagctacttacttgacactttctgaattactcataactgaaaaaatacactgtgttttaggcttggttattaacatcacattagaaataatttatttaaccagtttctatctgttgaattaacagaaataccagctctcctggagaatttccagagaatgattcgtgatcatattttcttgagaattgaagtggtataatgctgaacaagagaataattgctatatatacagataccctcttttctcaggacttgtttatgtgatgtccaggttccttgtattagttactatggctgtgtaacaaattaccccaacttagtggcttataacaacaatatttatttactgtctttcctggtttctgtggttcaagaatttggttgcggcttggctaagctattctggcttagggtccctcatgagattgctgtcagatgttgactggggtgagtcatttgaagcattgactgggactgggagatctacttgcaaggtggttttctcacgtaactggctggtggtgctgattgcgggtgggaggcttcagttcctctctacttgggcctttctaaagggctgcttgagtgtcctcgtggcgttacagctggcttatattcaagaatccagtgtagaagttgcagtacattgatctagcctgagaagttatgcaccatcatttctagcatattctattggtcacctaggatcaaaaggagcaaggatcaggaggggactgtcttagaacctggctaccacaaacccctgctttgtccacctgggatcatggcaatgatcaaaatttgttattgtaatgatagctgtctgtcttctctttcagaatttaagttcctttactgtctgtgttgtgttacgtattttctctttcttaaatgcataggtttttagaagtctttttaactccttttcatctcttcactctgagtctggatttgatgactgcgttaattatttgttgctgcagaacaaaccacaccaaaccttagtggtttaaaaccacaattgcttgtctgcttataatcatgtgggtcagcaatttgtgctgggctaagttgagtggtactgtgaccatctgtcttgcctggggtcaatcatataacccaagtcatctgacagttcggatggagctagatgatctaagatgacctcactcatatgtctggtgtttggcaggttgtcaactccttgattcttcattatgtggcctctccagcaggtgagctggagctcattctcatagtggtcttagagttgcaatcgcatctggaagaggcaaaccccagagtgtaaacacatttcaattctctgcttgtattatgctagcaaatattccattgactaagggaagtcacatgggcaaacccagagtcaagagattgagaaattgatgtcacttcctgatgggagcattggcaaagtcacattgcaaaagggagagatacaggatgggaagaattattatggccatctgtgcaaacagtctgcccaaatagctttcctctgagcctttgggtaacctttctttatttgtatcaccctgtaagctataagctccctgaggcaagggccatggctggtttatatttttctatatatttagcacttttcccactgttacataaatattagttgaattgaaatgaatataaaaacactttcagggaaagagattgtggaaaaggcaagtagaaaataaaatggaaagactcatgctgtattgacaattttcaactggtttagttatttaaacaaagcctcaatccaagcatactaaaccatttgatttttaaaaattacattattagttgtttgcctgaactcactacctgtttggtcaaaaagattggataaattgtgggtgtgtagataaaatacaagtatagtatgccaatcaacatcacacgttcatattgctggttcacattagatgctcaataaagcgcagctgtgacgtctcttgttcagtaatcatgggactgctcctgttgccaactttgcctgtagttcaccaaagtcaagttgcccacggtaagataatttttttttaagattattgttgataggttccaaaagtgtattaggtggttaaattcctcattgttaccaatggattagtgagtcaagcaataaacattaacttattaatgtcagtaacacttttactttcagtattcaatctagttttatttatgttttatcatctgtggcagtagttttcaaattaagagtatgtaaatattcaaaatattttgttctcagagtcggggaggtaatcaaaaaatatttttgataaggctgcatagacaatccaatattcccaacttctttgtgtttgactagaattttattgactagaattacagtgtgtcaatttggattatttcgtcctgatcaaagttatggaatatctgattaatgagaaaaagaaaagcagattgatgtgtatatattgtagcttattaagtagatcaactctttcgaagcatgaagcccatggaaagaaatagtaagaggagtttactggtgaaagctgagagactaaagtctgtattaagttccttaacatctgggtggtcaatatggttgtaagtaataggtcttatgagaattatgcaattaagatagttataatggggacgggtgtatttataatctactgttatttaaaaaatattatcccaaaatttagtgacttaaaacaacaataagcatttattatcctacatgatttttatgtgtcaggtatttagacaaagcataatgggatgacttgtctgtgctctatagtggctggagcctcagctgaaagaattaagagtcggggctgggaataactgaagtcttattcattcatgtggttgatgccagaggatctctttggacttgttggtcagaacactcctacaccctacacagcctcttcctgtggcctgggctttctcacaaaatggtggttggatttcaaggacaaagagaaagagagagagataaagggtgtgtgtgtgtgtgtgtgtgtgtgtgtgtgtgtttgtgtgtgtgtgtgtgtgagagagagagagagagagagagagagagagagagagagaagctgtattgttatttatgacctagctttggaagtcatgcattatcacttctgctgcattctaaccatgtaggcattcataaaggccagctcagttctggggatgaggaaatagaatcagtttcttgacggagagtgacgaagtgctggaaatgcatatggaattagaaatattatggccagttttggaaaatataatctgcacccatggagcaggagtaatcatgatcacattgtgtgtgatcatgaaatcttgctagggtttcaaaaaataattatacgaaatttttgatctgtggtctgaataatgaatatgattggtagtactgagcatagccaaggatgttgactccagggggatggtattaattaaaatatctttcagataattcagaaaatataagcaaaatgttttgttatattcatggcatgtttttattgcaggtgacaaaaattgaactcaaattggttcaatcaaaaagagtgaatttattaacttgtataactgaaaatttgggggacaatgctagctgagagtacaagtggataaagacctcaaatgatgttggcagcaggaatcagtatctctccgtatcttagctttgcttttcagtttttattgcttaggcaggcttttctcaatcttgaaaaaagaagccagcagcaattctaggtttatattttaccagcttagcaactcccattaaaaaattgtctctttttcaataattccagcaattgtttggagtattgagactgggtagactctgaaaaggtgattatgattataccaatctttgagtgtttatgactttgattagtaaagcttgaaccatgtaacatccggagggctggaggttggggttggcctcatctactctcatgaatcaagaggcatgatgtgtgtaattggtatatgcagagaatgcctttcacagaaactgtggaaatataatactgacgaattgatgtgggcactgggtccctgacgaaagagcactttctggctatgatagacaggatggctttggaggtcacccagaaaagactgaaatccccaaggatcaatgctacagggaagaaattgagagcctatgcttgttgattgatttaataagttatatatcaatctgacttcagtcttatgtatttatttgacacttagttgttaaacatctaatatgtgccaggaatggaattttacatgtttggctaggattgtaattttagtttaagtgagaattagaattgtctgggcaggtctggcagaggtgtggtgtgagttagtaaaaaacaattgtatgaggacctcagagcctcttgggaagtacatttgagggaaggtgaaagtctttgaagttggaggagagaggcaagtgcagcatggtgtctcccattcagatcaattccctagcccagttagccttgatttgtgtatgaaccccagggaaggcagtgggattagaagtcaatattgaaggagctgtaagacaaatggtaacactgcactgcaacctccttctgcagagagaaacccgaaggagagagaaacattctctcactttgctgctgaatagtcggatggctttggtatcttgagaactacagtgtctgggatatggtgggaaaaaatagctcccagtaaactcctaacaggcataagtttagggtagagagagagtatttatttatgaagttgtggatgatattctttgggttccttcgagaacacgtgggaccattgcttttttagaatgggaaagtgatggtcagtaccataaaatgtaggtttttacaaataagagggacatttgagttacatatagtttggtatagttcagtaatttccagtactattggaatatcttatttgtcctttattaatacaaggggctgtggagtggactggacttaagaaggattaaccttaaaaagtctgatttttggactggtgcattaaaaactgtaataacatccagggacatgttggaagtagacaccattatttctcaaatatactgattacataatctgcaatttaaaagaagatggccataattatctaatggatttttgggaggctatgtcagagatgtctggccttgtaaatgatcccacacagaagatgatcaaatgcacttctctctgaactgctctattttcaaatttattaaggaaactaagggagcttaattagcatagtggtaggccagaagacataaaataataaaatgttgagattacagaatagtgggctgtaataaaagtatgcttaaagtgtaacatagaggaataaatggaaataggcaagttcacagaagaagacatttgaatttggctttgaaagatgatttgaagttgactagatatagagataatgaggaaagaccatccaagttggaggaaacagaaatgcaaacacatcaataatcccatgtttggaacaatgtgtaatcttttatatcttgcttatgagtttaaattttatcttgttagacgttaggagtcacaaaatgatttaaattgaagaatgacataatttgatctttgtctcagaaagattgctttgacataattttggaggtctggagatagagaagaggagaaaagactagttaagcctgtcattcataagcaaggctagcaaggtcaaactccaagcaagaaatgatgaagactttgatttggtcagtgatggggagctgagaggaagtggtgcatttttgagaaagactgatgaattgtgtattcataaatcagataagacactgtatatttctatttacctaatttttattatatgtactttaacatagttttatactttagatggttggatgtgttatagcaaaggactcaaattgtcttagtagatggtggctaaatattcatcaaatagcaatactttctgttggggtttgctcttgagtttatttcaaattatatgaaaggagagagaatgaatgtgaaaaaggaaattagtagtctactgtattttaatatagcatggtttttatttgaatatgccaagaagatacagagtaattgacagtctgatttatttatttatttatttatttatttatttatttatttattatactttaagttctagggtacatgtgtacaacgtgcaggttagttacatatgtatacatgtaccatgttggtgtgctgcacccattaactcgtcatttacattaggtatatctcctaatgctatccctcccccctccccccatcccatgaccggccctggtgtgtgatatttcccatcctgtgtccaagtgttctcattgttcagttcccacctatgagtgagaacatgcggtgtttggttttctgtccttgagacagtttgcacagaatgatggtttctagcttcatccatgtccctacaaaggacatgaactcatccttttttatggctgcatagtattccatggtgtatatgtgccacatttccttaatccagtctatcattgatggacatttgggttggttccaagtctttgctattgtgaatagtgccacaataaacatacaagtgcatgtgtctttatagcagcatgatttatactcctttggctatacacccagtaatgggatggctgggtcaaatggtatttttagttctagatccttgaggaatcgccatactctcttccacaatggctgaactagtttacagtcccaccaacagtgtagaagtgttcctatttctccacatcctctccagcacctgttgtttcctggacaatctgattttttaagagaatgaatgaaagcgttcaaataggctgccctttgtcagaatttatgtaagcattcagattcttaaggttgtgttattatacaactagggaaaaattttcaatgtcaaaatgtgatttaaaatataaatatgcacttaaaaattttggaataattgacatattatatgggaaagccaaactatgacagtattgtgaccttcttagctctatttctgtaatatttccactctcggatcaatcaagttcttcaactgaatgtttagttcaaacttagattctggagacagtcctgtttctgatcggagaaagttaagaaacctgaggaagatagcttgggaggacctatattaagtgtctttggacaggtatagtctgatctagtgttcttgatttgtgaattggaatcctgataccaaactctaacttgtgtctcagtttcagtgacgtgttttaatttttgtcctatgtcttaaccctgctttgataattcatctagtattcctgctacttgagattataactcatactttatgtctatctagaactgaagtcctcaaaatctggggccatgctatctgttactacgactctctgacaatccaactacctttgtccttgaatcagcggcctccaggtgtcaccctactctgtacactgtctactgggagattcacatctattctatactagtagctggatcttattgctggtctcttttgacttgttctgtccatttgcagactgttctctgatttcaaaccctaacagaccacaatctcctatatttatgctaaaataatggttttcaattttccccaaaatctgtggaaatggttcaagtagtctatgtttatatttaataaaattttacttaactgtatttttaattattatgagcccaccccaaagtgtcaaccctatggcaataaagcacagattctgaagtcaagcttccagggtttaagtcccagctccaacatcactcacttgagtggctttacagaagttgattaacttttcattattttagtttcctaatctgtgaagttgttgtaattaaataatttattgtggggtaaaataagattatttatgtgaagaactcatcacagtgcttgaaacattgtgtcgcaaatattgttatttcccacctaataaccactcttactttttccttgcaaagagaacccaatgttgttctggctgcaacagccccaggagttaagtcaggatttgattgagctgagataggatgccacttcacttcttcagtgggggatctagggttgagtgtatgaacaatgaacataaggaaaagtcttcttttcaggagttttggggaaaagcattactcactaataaaatgtgaagaggaaagaccttcctaattttgctctgccctctatctttctgcttcaaattctgtcattggaaaacttgccaagtagagctacagcatccatcttgcaaccctgaagcaccaagatggagaatgaacatcaatgtgttgaggatagtggaaggatgggaaaagcctttctctatgatgtcattgttgagccactgagccaattaaagacatccaaattgtggacatttagttaaatttacaaaagttattatagcctaaaccaggcattggcaaactatggcttgtgggccaaatctggctgtttttttgtttgtttgtttgtttgttaaataaaattttattgcaacacagccatgcccattcatttacatgttctctgtggcagctttcatgcttcaatggcagagttgtttaatggcaacacagaatgcatagcccacaatgagtaaaatatctacaatttggccttttgcagaaagagttgtggacaccttgcttaaatcaatgttaattatattgtcttctgtttgaggttgaaagcatcataatggatacattgaaaacttttaataaatattaactattattgttctagtaaaaaacacacgtgcaatggagtaactttctttttcccagttctagataaatcttctgccatctcctcttatttgaagagtatcctgagatggtgagaaaaatagttcataataaacaaaaaattctgttcccactttgcagacattcatatgtgggaattgagacttttatttataccataaaaccgaaccgaaaaaaattagaaagaaattgtatgtaaagcttatctagggctgcacctgtcatatgtacttctgatttcaaaatgaatgttcactaaaatactttcactttcgccattcattataaaagtggttataatgcataacattataatgagtattttataaggaaatactacatacattaacttgtatttacactttaaaatagtcatctattttacattataggacaccaagcaatattgtacttgaaaaaaattgaaacaaattccattcctcaaaacacagttgaaaaccaaggatgtagaaatattttagctgcctgtttaactttgaaatctttaactttgaaatgaggccctcttatatgaaggacctcttcaaggagaactacaaatcactgctcaaggaaataagagaggacacaaacaaatggaaaaacattccatgctcatggataggaagaatcaatatcgtgaaaagggccctactgcccaaagtaatttatagattcaatgctattcccattaagttaccactgactttctacacagaattagaaaaaactactttaaagttcatctggaaccaaaaaagagcccatatagccaagacaatcctaagcaaaaagaacaaagctggaggcatcacgctacttgagttccaactaaactacaaggccacattaaccaaaacagcatggtactggtaccaaaacagagatatagaccaacggaacagaacagaggcctaaaaaataacaccacacatctacacatccggtctttgacaaacctgacaaaaacaagaaatggggaaaggattccctatttaataaatggtgttgggaaaacttgctagacatatgcagaaaactgaaactggactccttccttacaccttatacaaaaattaactcaaggtggattaaagacttaaacataagacctaaacccataaaaccctagaagaaaacctaggcaataccattcaggacataaacatgggcaaagacttcatgactaaaatatcaaaagctgtggcaacaaaagccaaaattgacaaatgggatctagttaaacgaaagagcttctgcacagcaaaagaaactatcatcagagtgaacaggcagcctacagaatgggagaaaattttgcaatctatccatctgacaaagggataatatgcagaatctaaaaggaacttcaacacatttacaagaaaaaaacaaaaaaccccatcaaaaagtgggcaaaagatatgaacagacacttctcaaaagaggacatttatgtggccaacgaacatttgaaaaaaagctcatcatcactggtcattagagacatgcaaatcaaaaccaccgtgagatatcatgtcatgccagttaaaatggtgatcattaaaaatccaggaaactacagatggtggagaggatgtggagaaataggaacgcttttacactgttgttggacatgtaaattagttcaaccattgtggaagacagtgtggtgattcctcaaggctctagaactagaaataccatttgacctagcaattcgattgctgggtatacacccaaaggatcatgaatcattctactataaagacacatgcacacatatgtttacagcactatttacaatagggaagactcagaaccaacccaaatgcccatcaatgatacactgcacaaaaaaacgtggcacatatacaccatggagtactgtgcagccataaaaaatgatgagttcatgtcctttgccaggacgtggatgaagctggaaaccattattctcggcaaactaacacatgaacagaaaaccaaacaccacatgttctcactcataagcgggagttgaacaatgagaacatgtgggcacagggaggggaacatcacacaccggggcctgtcagggggtggggggctaggggagggatagcattcggaggaatacctaatgtagatgacaggctgatgggtacagcaaaacatcatagcacttgtatacctgtgtaataaacctgcacgttctgcacatgtatcccagaacttaaagtgtaaaagaataaaaaataaggccctctttcttaagatctttgtttagtgctggagtgttttttttttttttttgtatcttaaacctattgaaatgcttcacaatttacttaagaaaaaggcacctatcattctggttatctactcttaaaataccaaaaggtatttgtaatagaggagtggtaagtagtcaagttatccctaccacgaactgctaagggaccttggtgaattcccttcaactctccaatcatttctttcttatggcaataccttagcaggtggtgtgaggatcagaagatagtggtttcttagtaaacacttattatctaatttcataatggatttgacactacacttatgatttatagcacatgtagaggttttgatgattttaactgcagattgaaaaaagtggagtcaaataggttttttttgtatttgtttttaaagcctaaactattgagtctataacaggaaaagaacattataaaatgaatacgtgattgatcaaaaatagcacatgtcagtaccccaggtataatagaagactcttgattgcttatgacaaaaaacaaacaaaaatactaaacttggttttagaaaaaaaattcaatggcagataagctaaaaaacacctagggtataggtctgtgagggctctgtggcatggttagatacaggggtcaaaaagcacttttatcatctttctctctttttctcctttcctttttcatttctttgcttggctttctatttattgcttgacttttctctgtagtagctttattcttacctaggttttcttcctataatgacgtgtggtaagtccaggataacatcccacctatctagcagttcctacagaagtccctggttatcatcctcatcctcctactgctatggacaaggagacctagttcacatgtccattcctcaaaaccagttggtaggcctgccccaaccaaatttcaaagacttagaacagagtaagggccggccttgcaaaaggagaagttagcttctggcacaacaagaaattagaatgctgtgaagatactcatatctctcacttgctgagtgcatgatcttggacaagttatcaatctttcttcagctttagcttcatcacttcctattgataggaagagttactccagaggtttaggttgataattcaatggcctaaggtattagagagtgtcctagagttgctggcatatacccagctggtaggtacccttattacatctttccttgctttcagtagcatggaaataagatttcgtgaggaagccgagtgtaaaataggagctgctctgaaattcctaccacaggatcactttccttttgatctcatacatttatacatggaaatcatgaaaatccgtataatatttcctgtaggtctaggctacgttaatgcagcaagcaaatataacctggggataaggtggataattcagctcttgtagtccgttaggaacagtcaaataactctatttatcttcctggtagaagatgtctaaacctaactgtcatcagggataaaaatgcccgaaggtgctcaatacctgttacctcccacagaatattcgccaccccgggcataaaagtcaagaggactgtgggactatcagtcaatgtgttgattagtaatctgctactctcctgttttgtcctgttaatgtgaggacaaaagctgtggtagtattgatacaacctgaggaacgcacagcaatttcaatgtgtcgttcgtcggaatgaagccatagctatgtagccttacaagtgctaaaagcaattagttgtaactgatcttgactatcaaagaaatgcatgggaggctggttgtgtggtgtggtatccttttaattcctgattgatttttgctgtaggttattttttgtaatttttctaataacaaacactgggtgacaatagcttttcttcaagcatgtattgtgatctttcgtttcttggtcctgacataatccattagtggctacatcacaagcctggatagaaacacagagcaggtcaagtcccattacaataaaaacttttgtttaacaaaatggttcccaagtccttctgtggcagaattaattcaggcagcatgaaataaagtattttggtatcataaacggtttggattttctctttgaattgctcttaagtaattatgaaatcattcattgcttattcaataatttaaaatatctactgtgtctactgcttgccactggggttcatggcaatgaacgaaacatctcttctctgagagacataatattctttaggatggcaaagacaattggattagtttactgagactgccacaacaaaatgccgcagtctgggtggatgaaacaacagaaatttatttctcacagttcaggaagctagaaattcaaattcaaggtgttgacagggtttgttctcctgaggcctctttccttgacatgcagatggccaccttctcactgcgtcctcacacggcctgtgtgcacattccctgctctctctctgtatgtccaaatttcctcttataaggatatcagttagaatggattagtgctcaccttagtggcttcattttgacttaatcacctctttaaaggccccacctccagtgtcacattctgaggtactgagagtcagtgcttcaacgtatacatctctgtgggggtgcataaataatctcataataatgtaaattaaaccagtgagtatgtatcacttaagctggtaccccaaaactataaataaaaataaggcagggtaaatgattgggtagaatgctggggaaattgttttaaacaggacagtcaagaaaatcctgtctattgaaatagcatttgaacagagaaatgaagagaaggaaagaagaatgggaatatttgggggaaaagtgttttaggcagagggcattgtgttcagtgtagtagaaaagagcctagaggctgatatggctggagaggaaagtgtcaggacagagatgagagcagaggggtaactggtgatcatcatggaaagttgtagaggcctgctaggaaagggtaacaatctgccggagacaatagattcctaaacccacaatcaaggctcagtgtcttatatgctagtgtagggccgtgcggggtgttgtggacaggactggctacctaatttgtagggcccagtgcaaaataaaaatgtggggcatcttgttgagatgtgaagatggtgacatcagggtattaaaccaaatataggatcattctcatctcagagctctgtgcaactgcacaggccacatgccctggctgtggaaacataagagaaaaatctggatttacatacatgcttcttcaaaggtaaaatgtgtgttcagaagctgggtagtcttgtggaaagtgtgtttctgtggtttagatttaaaatctcagttaaaatcccagcttctttgctttctaccagtgaaaccaactggttacaaatttctcatttgtaacaagacgatagtgaaccatgtcttataaggtttggttttggtccaattttgccaaataatggtaaaaaatgttgggtaaaatacaggattctctcgtagtccattttgtgttgctataacagaatgcctgagactggataatatataaagaaaagaggtttatttatctcacgattctgctgggggaaagtgctggcatctgctaggcttctggtgagagccacatgctgggtcaaagcatgatggagaaggtcaaaggggacaggaacacgtgtgaagacccaagtggagtcctggctttataacaacctactcttgcaggaactagtccagttttgcaataactcactcactactgctagaatggcaccgagttatttataagaaacctgtcctcatcatccaaaaaacttccactaggcctttccttccaacatcaccacactgaggataaaattttaacatgcgttttgatggaaacaaacaaatcatatctaaaccatagcatattccataaaaaatcatcaagtaatacatttaatttgcttctcttttacattctcttttgacatcacttccttcctataattcctgaacaaggaaaatgttttgtgaactaatggtaatgatttacactggaaatgaagattattcacctttttataaatgcaggaaatcagtctcatttatatgatacattttattatgggcaagaagcccaggtgtcagatagtgtttgctttgtcccatgacataaccgaaagtgtatgttgatggtctttattactctgcagtaattatttggtaaaatgagccaattctaagtgagcctctggtcttggcctcatcccttttgcttcttccccgcttagacagtcattttcctgtccttcttgcccaactttctccccaaaaagcagctgtatttgtgtgtctcatcctgagagggcaggcaactggctgctatcaaagtcactctgtggcctggccagtggggagccatgaagaaccatctgctgcagaaattgagtgtcacctctgcagtagtcttgtttacagaaagatcatggagttattcttaaacgaatatatggtttgccaaagaaaaggacatagttttaagcagtaaataaggagaaagctgtaacccatcttggtaagcctgcatacttagctgcatggaaatagtttttctgtaatcatgagcaatgacagcgggaaggcacactggaaacacacctcctattgaatgcagtctcaaatatgaaaacataaatgacaagaacacctaacttgtggatgaaaatcaacaaaagtatttgtaaagtttgtattaatcattttaactctcagagcctccctttgtagtatcatcccagtcatatctattgcctctaaggctccaattgcagggcgcgttaaggaaaaagcatgggctttggcaccagactgatttacattcaaatcctcactttacttactacctgggtttacatgaacttgtcaaaacctcttgcgattgtttcctcatctattaaatgggcatcataatacctactttaaagggttgttggaaaatttggagacaatctaatgattatcacaggaagaacttgaatgtagtagatgatcaataatcattaggtattataattagccaatattaagatgattgcttttcgttattcttacccatacatgagtacaataaacttactacaagaaatataggcatctgactaaacatacagttttaatggtggttgacaacacggcttaagttaactcttacttgaatacaatacaatgcacgtttttaaagtgccaattatgggaaaatcattgtccttgcattgggaggtacataaacaaaccctgaattcaaaagttggtggaatgatcaagacatgaagctactgaactgttaactattttgcaaaaggacaacagttcatttctctataaaatactctttgaattctttctgtaggacatgttgatattttagttagtcatatttcttgatcatagctccactgaaaaacatttcataacttggttaggattcaaaatttttatattattttctttttggaagctgtctctctggttgagaactcattaaaaaaatgtatcacatattcttacctaaaactgagatgtatctttcttgatactatttctaaatgaaagcatgaagatattgaacctagcctggtgctataggaagagaagaaccacaggaggtatgaacaaaaataagaaaaagacaaagagataagactttaaaatgtcaagaaatgaggagggaataaaaggagcagctttagaaagaaaatgatgcaaaaactggaaaaatatataagggaaaatgaaaggcaaaagaaaagttaagtaaagagaaaagcaggtgaaaagggaatttatgtcagaatatgtggccaagtcataagatctttgtcttacttttggtctgaaagaggattttcttgcttgaaaaaatatttttaatccatgacatttgttttttacttacatctcttagaacatttgagaatcctggccactgatatataaatctatagaatcaaacaaattttatgtaattcttgctatttttagagatctgctgtttgatctcctttgaatataatattagcagtagatttcattaatgaacactgccattcacaaaacagtcccctcttccagtggggcaaaattaaaattgtattcagctaaatgagaacaccaggaatcactgctgctactttgataaattgtgagactgttctaatgataaaatactttctagttctctttataaacagtgggctctcatcctggaaattccaagccctcactgatgtccaaaataataagcacaattggaggattggagaccatttttctcagcatggagatgtactcttatttctcatctcatgttttaaagtgattttcggaggttttcattttgaggcatagattccgcaataaagtgtagcacatcgttgttttgaccacagtagagttgtgtttttttaaatgcagtttgttccatctttaattttctaaacaagattctgaaaaaatttctgggaagttttcaagggaatgatcttacatcttagcattgtgtggcatttacatttgtataagcctactatggctctgaacagaaatctcagtgagtcaaagaatagggtttcttttaaaatgtgtttatcaataaaataactggaaaataagtttcctttcaaagttttgaaatgacaacaacatcctatttgtcatgaacatgtctggctggttaaaaacaaatagaaaattatttttatgtgtcttcaagatacttttgtaaagatattttaaatttgtatttattaataaaaacccaaagttagaataccagtaatgcttttttctaccaccgttattttcttctagaaaatgcatatgattaaaagcaaatttccctttcttctccttagaatactgctttccttgatattaatctgaccataaacaaagctatgagacactaaatctgtttcttagcaccaaagatacaacacagaaaatcatcaagagatcctcaaatcaaattttgctttggctatcaagattggaaaagaaatgataggaaaaaaagttcaaagccaacaggaagctcttagaagtcaagtgttattattgtagcgttatcatcagtctgattcattgcagtagtaatagttgaaattgtttataatcaaagagaagaatggaaggaccacgtcatcgaatattttgttggggctctttagggcttttcacatggaagatatgtattatataaaatatactagtaaaaattgatttctcacccttggcactatgtttttttaagacctgttagcatatgtattattttaaaaagtaattggctcctaagaaagtaacagatttcgttcaatagtcttcttttgagtattaatatcctgattaaacaaaaaatcttcatagttcagtcccatgaacaaagacttccctttaaaatgaacattctgtatcaactctaaattaagaacttctccagattcaaactctgaatggattgtgtgacagagaatagaacatggactccttaatctctattcttttccttgtctattctaatttacttggttgtatcacattcctaatttccctcaaatcttagggaagacaggaaaaatggtcaagttagggaagaaacgtgcagacatcttatatggagcccatagaatggatgaaaaaattagagaacaattttaatttaaaatcagttcagctccaaaaaggaaagggttaagccgagaagggataggtcttggcatgtgagacacgtttgtttggatttgccggtcatgaagtatttcccttagttggtccacatcagttatttatttctcataggttattctgctatggacatggtcagtgctcttgtagaaatgctaagatttttgggtgaggcaaatgatatcctctctacaaggtctctattggtagcagtctgtggctactacaatgctttcttttctaacctgctttccttatctttgaattttggaatgctgctctgtatacttggttaccaagctgatgtgtgtctctggcctggatgcttgcttctccattaatactgcttacctgttttattccacaaccttaccttaaactctgatacagttgtgtcctgattcctgatgtggtttttcaatactttatttttctctccacatataacatacctagctgttgagtgcctgggttctacctcaactaataacttccaggtattattctgctctgatattctgtctcaagctctagctcttaccatatgttacttggtctctgttcgttaccttctctctgagttctatttgcctcctagagtttcagaacaaacatttatgaatacgtatggaaaggacttctgggttccataagaacactgctttcctccttatcaagaagccttgaacaaatttttctttgtcttatagctggtcgaagtctgactgtcaatacaatcatatttattataaaagataagtcccaaagggtaaatgtttgggtttgatgctacagtcttctattttgtttcttctaattaataaaactttgcttcagacatggtgtgtgggaactgtgctgagtctgaggaaaagctgataaatctctgaaaaaaattgtgttataattttgtatagtagtgatattgctgcagaaaaacaggtgccaaccaaaaagcctagctttgaaagaaagcttcatggttgagttatgagacagctggggagcagcaaaatagatatggatccataagccctgcaggaaaaacaactttaatcagggcctgacacatttggtgattgtaacgaagtctcttggtatgtgtaagccctggatcaaatggcaccaattggctattgacaagcgttccattagtgcaaaactggatgaaaaactggccgttgccctgcacagactccaataataagaaatgaggttcttgtacggaaagggacttagtttgttttctaaaaacatatgtgcactggcccaggtgatacctctggtggactgaaattcctctaagctcagccttcagatactacagtggcatttagtgaaatctttccaagtctctccaagtgacaggcctctttgactccttaaattgattccatggttctgaataccagtagctaatgctgacagtttgacccaggagcagggagcgtcgtcctgccctgagagcccctcaaatggattttacaagggagtggtggatattacgcttctaggtgcggtgaagcgtgtttctagcactttccacagatcataaattaatttgaaatgaacttctcccctcccagaaaacacaatatcagagaaggactgtcatcatggtttttctgtagcatagtacctgaggggggaaaaatcattttctcctgcatttgttgactggacatgtgattggtgccaaatgctaggctgccacaaatgtgtgccatgtgtgtccaattcaaaataatttgcagttcggtgtagattctccacaccgtcagctctgaaactgaaagactggaaagagctatgcatatttttttctaaagataggtgttatgtaaagccccaaactgatgtttcagggaccccaaatgtcctgtcctcactgtttctgtaagtgagtttaaatataagtgactattcttgatagttacctgggaaagataagaagtagtttgtaggacatgcagtcttattttataattatgtgtgggcatttggcaaacaattataaaataatatagtatcctctctagtagtaatgctgcgaggtagaaggcataaaaccaattttgttcttcagaacttaaaattcagtgtttctttcacttgtgtgtagcacctgctgttttatatatgataaaattttacagaattgattatattaaacttggttgatgtcattagtttactttcatattctcttttccttagtatatagtaggacccatagaaaacatatatgattaattgtactatgattgaaagtgactgtgagttaaagagaataggaaatattgaggtggaagagaaaggagaaaggaaaacaaaagggagatgtgtgttagtaggcaagtatccaggtaattcaatatcaactacctttttagtggccttcttttctcctgcccagattttctcctgatctctagaacttaacatctaattgtccatgggctactcttttagtatgttccacaggtgcctcaaattcaatgtccagactgaactattcattttcgtacaaatatgtcatccctacatagttcctgtcttgaggaatggcactactattctacccaggagtcatctcagatgactttgcccaccttctttgtcacttaatagttataagcagttgtagagttcatctccaaaattccctgcacttttatagccaagtttcctgccttagcagttctcactggattactaggtgaatggacttgctgactccaccaccccactactttaatttagcctttactctgcagccatagctttttaaatgcaaatttgatttcatcactccactgattaaaattctttaacagtccttttagcccacaggataaatttagcacccaatattctttatgatctagctgtacatgcttctctaatctgatttcctaacactacaatctggggtctatttattatatgaaaagcagttttcaataaatatggtgctgtttcatgtttccatgtcattgcatatttgattttcattgttgggaatgcctttttgtgttgtttgtttggcacttggttgggggttgcacagttatccatagtgaagtcacatttcttcatctgcgaagcccctcctggacttattagtttaagttatgcttttactctactgctcctagaatcatgtacataatcctaacattgtgtccatccatgttagtttaattgctggtttttctgtgtccctcatttattctaagctctttgggttgagaacagtgcttttaacatttttgaggctctggtgcagtatagtttctggtatatgatgaatactcaatgtatatttattgaatgaatatacaaatgcaatgataaaagcacaggttcattgcgatgatggatgaataactcccagtttggagaaaacatctctattgtttgggggcatttggcaatgcatagacttaagagctgaaagaagatttgatcttaattcacatttgatttgcacttctggggcatattgatcttgaagaagcccatagcaattggtgactactgtaagggaatatagaaaaaaatgacactcacgtgaaaaactgaagagagattttattttgtcctttcagtctttgatgtattgatacacttaaatttccctcgctcttttcctttctaccttcttccctctctcccaccctctatagcttcttccaaaagaagtataaaatagttgtattagaacatataggtttattttaaaattatttatatataaatatatgaataaatacatatttagtcttaagttgactctgttaatatgtatgtatatgtataaaattttaaagaattagaatgtattgtaattctatgtaattacatataattctatgctgatgttggtaaggatcagaaaaggagtctggaactggagagggagaaaggaagtcacgtaatggcaaagccagaatatgtattttgagagccagtcttaggggaagtggatgaagcagaggtaaagtgcatgggggaggcagaatgcacagggccatagaacttcattcctctgcctgtcaagggggatttggctagtgcaagggcagaaagagccagggctgagtggtacacagggttcctatgtgttcagcctggagataccatggacagaggtaaggccggcttcctttgtggattaggaaacaagggacgtgaaggacctcttcaaggagaactacaaaccactgctcaatcaaataaaagaggatacaaacaaacggaagaacattccatgctcatgggtaggaagaatcaatatcgtgaaaatggccatactgcccaaggtaatttatagattcaatgccatccccatcaagctaccaatgactttcttcacagaattggaaaaaactacttcaaagttcatatggaacccaaaaagagcccgcattgccaagtcaatcctaagccaaaaaaacaaagctggaggcatcatgctacctgacttcaagctgtactacaaggctacagtaaccaaaacagcatggtactggtacaaaaacagagatatagaccaatggaacagaacagagccctcagaaataacgccatatgtctacaactatctgatctttgacaaacttgagaaaaacaagcaatggggaaaggattccctatttaataaatggtgctgggaaaactggctagccatatgtagaaagctcaaactggatcctttccttacatcttatacaaaaatcaattcaagaaggattaaagacttaaacgttagacctaaaaccataaagaccctagaagaaaacctaggcatcaccattcaggacataagcatgggcaaggacttcatgtctaaaacaccaaaagcaatggcaacaaaagccaaaattgacaaatgggatctaattaaactaaagagcttctgcacagcaaaagaaactaccatcagagtgaacaggcaacccacaaaatgggagaaaatttttcgcaacctacttatctgacaaagggctaatgtccagaatctataatgaactcaaacaaatttacaagaaaaaaacaaacaaccccatcaaaaagtgggcgaaggatatgaacagacacttctcaaaagaagacatttatgcagccaaaaaacacatgaaaaaatgctcaccatcactggccatcagagaaatgcaaatcaaaaccacaatgagatatcatctcacaccatttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatatccaaaggactatgaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaaaggatgatttcacgtcctttgtagggacatggatgaaattggaaatcatcattctcagtaaactatcgcaagaacaaaaaaccaaacaccacatattctcactcataggtgggaattgaacaatgagaacacatggacacaggaaggggaacatcacactctggggactgttgtggggttgggggcaggggagggatagcattgggagatatacctaatgctaaatgacaagttagtgggtgcagcacaccagaatggcacatgtatacatatgtaactaacctgcacattgtgcacatgtaccctaaaacttaaagtataataataaaataaaataaaaaataggaaacaccgtgaaaaaaactaccattgggtacacatggggaatgtctttttagccataccgaactaattattaacataagaattcccaaaagctttttctatctcacctatgctctgctgatactctagagctctggtagtactgagaatgagcggtcaacatgctagatatcccttctcttgtaaactcagcttcttgggtgctctcttaaattggagagcatacatctagggaagaaaatgtatccaatgccttctgtgatgccgggttcatgaaaacccaactgacactgctagggatttgaaggcatgtaaagggctgggtaaagggctgagtaggatatcatttgtagggtgcttcttactttgttgtgtaaaaggaagttgttatattaagattgctttcaagatgtggctaaaaagtaatgtatgtgcttcaggcaggaaaaacaaccaattcctatttctaaccactagcccaggcactttaatttactcctcctaactgcactctggtattagtttatcatcctgattttacaataggagaagctggacttcgcagatagtcagtggcagagctgggttcaacccggggtctggctgacttgaatcctgttcacattcttttctccactctgcctatttgctgtcacatcttggctggcagcaggagagtcaaacctgacagggaccgtgaaaagcctggagttttcagcctgctaggcaagcggcggtgccatagaggtaagtccctgtgagctctgtcatttatttctgtctactttaaatctcttatctgtaaggcgaaaagcatttacgaagctttcaggaaagtgctttgtgattaccagcactagccgagcaatggcttgcctgtttttcacagatagctgcaaaatatgtcttttagggagaattatctgctttcttccacttagattcatatacaaacacaccgatgaagaaatatgttttggattcccatagtgctaggtatgagcagatagttgctttctttttttctttttcttttactttttttttttttttgagatggagtctcgctctgtcacccaggctggagtgcagtggcgcgatcttggctcagtgcaactttcgtctcctgggttcaagcaattcttctatctcagcctcccgagtagctgggattacaggctcctgccaccatgcccagctaatctgtgcatttttagtagagacagggtttcaccacattggccaggctggtcttgaactcctgaccttgtgatcagcccaccttggcctcccaaagtgctgggtttacaggcatgagccactgtgtctggcgagcagatagtttctattccaggttgcactgaatcaggtgaaaaaagcaagtaaacactgaaaaacaaaaaagtaaatattcagttgtaaataaacaaaatccccaaacctaccccggtgacaaatttctgccttatggtaattgttgttaagagtaggaaacccaagatgtaattccattggtatgaaatatcaggtggtccctaccagtgagacaaatattttttaagaccttgagaaaataagaatagaatagaaagaatagaaaaatagaaatagaaaaaatagaaaagaatagaaaggctaatagctctttctaacttaaaaaaaaagtggcactccacattgtgtacatatttcaaaacatcatgccttacatgataaatgatatagtttttatcctcaattgaaataaataaacaaaaacaaaaatgactaaaagcatacctagcccctctttgtagggtctacttggatgatatttttatctttgaagagagaaagaagatgttcgaattggcacctcccttggcctgatgagagcttaatctttagtgtcctttgcgctttgtccatgcatacttcagctatgggagtaattcttaacaaattgtacagttgaccttctataagccagctcctcctgtatgattaaaagattgagtgttgcatgagaatgtgatgattcacgaagccctagacaccttagactccttgctctaatataagttgttgaaacacagacctgagatccttgctgcattctccgggtggaccatgggagccttcagacctggagcccaggccttgctgcagctgctgtgcttatactcctcccgcctaggcttctggaatcagggaattcctgagggaggaaattctgagtcttcaacaaagagccagtttttgtatattcccactgaaaaactgaacataacctttaaagggtaaagaatctcttattctatgattaaaaaagtatattcaaagccaactgattctatttgaaatagctcttccttgcgaggtgcatagttctggctggaaaaaggctttaataagccaggcatggtagggtgactgcttggctctactttgctttgctgttgaaacattaagcgtaatctgatgtgtcaatagagtcacctcagatactcagaatcattttaattcctcttaccgtcaaaacatagtgtcaatactgacacaaattggcattaaaaatatatgcgaaatcacctggagaacaacactttttactgataggagctctctttaaaagcagtttctgtcaaagattcaatttgaactcttttttggctttgaattttacagagcagcctaaaaaaaaaaaaaaaaaaaaaaaaaaaaagccctgacctgctttgcatcattcaaacctatctgtggaggaaagaagcttttcctttgtatctgaccccatgggagatgctgtccattcccaacgttgccctgagacggatgtgcaagatgacacataagtggatgacatcactcatggctcatgattaaatacttccctgggactcacaagatgtgttcagaagaaaatgggaagaaggagtgggtgacactgacaacattcttatacattccacctgggtgcatatttttactactctagatagatttcaggagagaatatgagtgtacaaaatgaaagaatattgatataaaagccttaaattttagttttgagggaatacaaacaaaaatatgcatatatttgccatattatatttcgtatgctttctaatatatagcacaaaatatgtaaatgtatgtgatgtgtaatttgtaaaatatatgcaatttgcaatatatatgttcactgtatatcacatatatgtagtgttctagatccccatgaaaatcaaaaaactaggacaaaattttatttttgataagtgacatattttttgctaagtggcatattcagattacctaagtagtataactacacattcattatttgactttttataaatatattgtaatgttatacttgatttttaaaaaaatatattgtaatgttacatttgaagaggtgaagtgttctttccgcgttatttaggaaattatttatttattaaggtgggaaacccatcaaatgtatgcttattgacattttggcacacacagttgtttgttttattttcttgctttgcaaaaatctttagggaataaatgacctgttgaactgaaaagtgaacatcattgcgtttcaatctttgaaagcaatagattctatcgataggaatgaccagattttctttgttgtttgaaattgttgatctggtcattctttttctagtttgctcatgttagcaggtgtttcatgtgtatttgtgtgtgtgtgtgtgtgtgtgtgtgtgtgtgtgtgtgtgtgtgtctggcagcaaatcactcagctgacctttttcataatcaactacaataaacggagtgtgtgtgtatgtgtgcgtgcctgcacttttggtgtgatggacagtttgcttaaatatatgggaaaagttaatccctctgcccctgacctttggcacaggaaccttgtgcttccagtagaaagtgtggtaaatgccaagtcctttgggcagagaatgtctgcattaatgttttctatgctggagcctgagccatagattttctgtcagccattctttgcactgcggatatggaataggttgagctgtatacagaatatagtgcctgctgccatctgttttgacaccctgaatattttaaccctaggcagtgtattaaaggagaaagtctcccagtccctatcatgcatgtgattgccgtggagtaccgaaggtgaaaggagctgtgcggtttaatgtgattgtcaaagggtcagttgtcatgttaattatcaagagctgagtgattatgacacaaagagggaggaggatggacatggtacataccaaccttgtaaataaagttaactcttgatgttcttggaagcccaaggctgcaactcttcagcatcacacaggcctggatgcagctctgcatatgctgatctctgtctggaatgcctcatcaccatgaaggttttggattacagggaatacgtgtttcaaacagggtaaggcagctttggcagaaagaccttgcagtaggagatgaaatgttgccagtctggcatctgaatttagcagttgagaagccattcttgactcccctacctccacatagcctctattgattcaaaatgtaaacatcccccagatcaattgtttccgctccatctgctttttcatggccttaggtgctctcacatcttgcctagattaattgccagattattggaagctgcctgtccgatccttctgtgtaattttgaaaataatgcaaatctgccatgcctttctgacctgcgtgctattttcacacacaccatgtcttgcccctcctgtcattctacataactctctctctccatgtcctatatttaaatcccacagctacgtatcatctccctggaagcctttacaagtctgatttaaaagtcctcctttggggtgtcatggtaccacgtgcttgttttggttatagttcttctcctgatttattacaatggtctcttgacaactcctgccttccggaacataagctccttgaggtgagagaccgttatattttgtttcgtataccagagctgggcaaagagtagttacaaaataagagtttcttaaattaactaacaaaataacatgaattttagagtagaatagtacatgacagacagtagtcctggtagttggtcagtaaaagagagcattcatttaggagatggttggtgacatacattcattctcataactctcctccctggacctctctcatccctcacctacaccaatcctgacatgatcacttgaaattgacctgggttaaatcatataaatctttgtattccaccttcttgaatcaattataatctttagtgttggttgggagaggaaggcccttcttccttctttctctgatttccaagagggaaatgtcttctaattattcctgggctttttttcttttcttttcttttcttttttttttttgcctcatcccttacaattccccttggagtgagaaagacgactggttagtttgggaattgacttaaggatgcatcgtgtatctctttaccctcctttttctcttggagcgtagctacacacaggagcatgcattctgctctgctaccccatgtcttaaattttacataacaggccctcacacagggaagtctggtgctgccagtgactggatgaggaggacactacttctggtgctcaataacagggatttaaatttgccaaatatacaaaccacattctccaggattagatttatcaatataaaaggtgatattttgctattctaactgtcttactcttttgttttgttgtattttgtatttgtttcagaatgcaggtggagaagagggacgtgtttattgggtgaacttagctcaatgcatagaatttgagagtgaggagaaatcttagctctactccaaatatattaatctttgaaaatttcacttctgcttactaaagaacagtagatcactttatgttacttagagtcagtcatcattggaaacattaattaggcttatgtttgaacaatgaccatggtgggatgagggcagtgacaggaggttaagtgtaagatggaagccagaaggccacagcctctttacatccaggtaagcagcaagattagtactagcagtgagggtttgaaagcagaagcaaggaatgaagatgtctgtgtgtgtgggaaggatacaatgaggataagtatggaaataaagtaggttgtagataccagtaatccaagcaagaaaatataggtcagaaatccagggaagaaacttggataaaaggcatacagaggcatagaacattaagatggtaagatatcctgtatgtcatcaagtctaaacatacattcattatttgtatcatgtcttaaatattgtcactgtactatatcagctctgtgtagtatctacctttttctcagaggcccagccctcactatgtattatcttactttgttcattctgtctttggacctctctaactattctgctttattttgagtcaaatcaatttcttttgattaatctctatgatatttatcactaactgtgatatagctgagccatggaatctcatggctgagagggacataacatgatactttcttctgccatagtacctagaaggatgaatattatcctaagcacagatggcataatttcattgtaaatattgggagtggccttaaaaggaaactggttctggtatctgcctcagaaaatacagctccatattcactaggttaaaatccttgtctttggcagacattcaccaatttgcttggtcaatattaaataacaagtcaagtccttcagtcatcaggggatgactttttcagttaacttatcctggcaggtgccgtggttgtgcattttgtttagagacagctgttttgttggagcataactgagcattttttatggccacagtaggtggctggtaaacctcataagaaagtattttagactcctcctcaactgcacaactccactctcctccaaaaggaagtccatctatctcatggtctgtggtgggtattcttgagactgtatcaagcagtcgttcaaatgcttggcttcaacagtccaaagatgagaaaaattttcacaaaaagcttaaacatatgctctttctatcttctctgagaagtggatggccctttgttctagaggaaatactgattaaatgactaaactttttaaacagggaagatatcaaccacactaccttcttattttccaaagcatgtgcattttttcatcatatccaatatctttaaatgcatttgccttgtctactcaaacaaatgtcagtggcatgcaaaattccagcaatttgtagcctccactctctgatgttcatttctattttctcgtgtaagttttgacaaacttcttctgcttactctcctcctttctatattctgatctttcagaatacagaattcttatctttcttgcctcaggtctcatttttctcgtatccccttttgaacaagtttctgctttagctctttgtctctgagatcattctgctgtttgacttttggttctctgtattggaatcacttataagggacatgcctacttactgtccttgccagagaaaggaatttgacagatagaacctcaatctgttgcagaatctgtttcagaatgccatcactactggcttgagaatacttcatttcttaccagatgccttcttgaaaggcgtgatatataggaatgttgtataaagattatactattgtctactatactactatatatgatttacttttatttctcttatattattagaatactaggtatctatatacttggagtatacacttgtctatatagttatcttgaatgagttatgctttaagattgtgcagtcagtttttttcgaggttcactagaagaaacagcctatattgaacttgttttgttaacagattattgaggatattgtccaccatatcatacactatgttatacataaaccttcggaaacatgccttttagtatttaacaggggaaaatgctatctcttcccacatatgctttctccttttaataataataaatttacattgccaacaatgtaactcattacgttcccatttattttgctccagttgccaggaagctcagaacaaaatgtaatggttaaatgtagcatttgatattctagttagtacaaatgcattttccctttatctgggttttatatttatatcttattaggttttttttttgtctgtgtgctcattgtcttagtctgttttgtgttgctgtaacagaatatttgagactgggtaatttataaagaaaagaggtttatttagctcatggttatgcaggatgaaaagttcaagggcatggccctggcttctggtgagttcttctgtgctgtgtcataacaaggtagagaaggtcaaaggggaagtgaaaacatacaaagagagagaacccgaggagcatcctggctttataacaacccattcacaagggaaaaaatccattccctaaagagctaatccagtcttgctacagcaagaactcactcattgtcaggagaatggcaccaagctattcataagagatgtacccccatgtcccaaacacctcccaacgggccccacctcccaataccacccttctgaggatcaaattccaaaatgagttttggtagagacaaaaccaaaacaaaacaaaacaaaataaaaaaaccatatccaaaccatagtaccaataatctcaaatttactttttagagtcaggatactatattgacttataatactttccctgaacaatcctcttttttgcttgggaaagatgtgataaagtccttagagacctactcttagagtctcagagcatccttgaaatatttcataatataagtctcattctaactctttgagtacttacaatgtacgtggcatgccactagatgctataagtcatgcacaaaccaaaacaaacaaaacatagcccctttcctcagttctgctgctttattgctggggcacaatcttctacaaagtagtaggtttttaaggacaattgagaagttgaaacaaactataggaggctaggaaacgtacaaattgagtaatgagggaaggctttgtggagaagatttcgcttgatctgggattcaaactgtgtatagatttgagtacatgaagcacacaaatgagtgtaatggcgtactggtaaactggtttccccttccacttcagcaaagccctgctttgcagtgtttgccagtttccatggtgtaaatacttctgctatggccaatttgaagctatcagtaatttaaccacatgcttgcaaagttcctgaatatttaaaaattagctgtcatgagcctgtttgagctgggtttagcataccactggatgaagtctttatacgaatgtgatactatgagtaagagttcagatttgtgaggtcccactaaggaacagaaaacagtcctgactgtctgcatctggaggttcatattgggaaatgatggcaagatgtaagagttaatttgggacagaatttggaggtttttgctgtgcacttggggtttattctttaggatgtgggaaggtcttgagtacttttaatagaggaatgacaggatagaattaatgttttaggaagataggccttttattatttatatgctgagtggttttaagggaatagagggcagcagaggtgagacctaggagcttcttgaaatgaagtatgtatgaagtaataagggaccagagttaggacagaagtggccagcatgggaagggaagacaggtgaaagggaggacagtggggacagtgcatctctggtagtatcgcatcagctgaattggcttacaagctctgactggaatcaactgagggttaacttacatgtttggggattgatattggatgttactagaaccttcagtgaggctgtggagagaacacttatgcagattctttacatgtggctgcttggttttattaccgtatgctggctggattctaaaagtaagagtccaagagagatagacagatgaaaagcacattgccttgtacaacctggccttgagaatcatatgatgtctttttcactacattctatttgttgaatcaatcacaaaagcacagctagttttaagggaatggaaaatgagacctccacctcttgatgggagatagcaaggctataaaagaccatgtaagagtgacacacaggagtttttcaataagtgcttgctattattatcattatatgagtttaagtgtctccaagtaaactagttccctctgaaatacagtgaatatttttagtaactgcctggtatgttttctgtgtgttcagtaacaaccttgaaaaggtggttgtgtagctctcattaagtgaatgatataattactatttggttctattacacaagactacagacaattttcttctctaagaagggggaacaagatcttacgtgtatgatgaggttgcttttatattaattaacttggacaaagtaacataataattgcaaactcttattgacagcttctcatgtactaaactcagtaaattatttttatccatgatcttgtttaatcctcacaaataaacctgaagagagtattattagccccatttatgaaggataaaattgaagttcagagaagtgatgtaatttgcctaaggtgacattgttaattaatgaaacctgaattcagttctagaactgtgttcttcctccccttcacgagatgtattgtatcacctcttcatgagctagaatgtatcacctcttcatgaggtgatatggtttggctgtgtccccaaccaaatctcaacttgaattgtatctcccagaattccaacgtgttgtgggagggacccagtgggaggtaattgaatcatgggggctggtctttcccatgatattcttgtgacggagagtaagtctcatgagatctgatgggtttatcaaggtttcaactgttgctccttcctcattctctcttgcagcttccatgcaagaagtgccttttgccctctgccatgattgtgagacctccccagccatgtggaactctaagtcaaattaaacctccttttcttcacagtcttaggtgtgtctttagcagcagtgtgaaaatgaactaatatagtaaattggtaccagtagagtggggcactgctgaaaagttacccaaaaatgtggacatgactttggaactgggtaacaggcagaggttggaacagttgtgaagggcttagaaaaagacaggaaaatgtgggaaagtttggaactccctggagaattgttgaatggctttgcccaaaatgctgatagcaatatggacaataaagtccaggctgaggcggtctcagatggaaaagaactagttgggaactggagtaaaggcgacttttgctatgttttagcaaagagactggcgacattttgcccctgctctagagatttgtggaactttaaagttgagagagatgatttagggtatctggtggaagaaatttgtaagcagctcagcattcaagaggtgacttgcatgctgttaaaggcattccattttataagggaagcagagcataaaagtttggaaaatttgcaacctgtcaatgcgatgaaaaagaacatcctattttctgaggagaaatttaagtcagctgcagaaatttgcgtaagtaacgggaagccgaatatattcccaagacaatggggaaaatgtctctagggcatgtcagaagtcttcatggcagcccctctcatcacaggcctggaggcaaaaatggtttcacgggcccagcacagggtcctggtgttgtgtgcagtctagggagttggtgtcctgtgtcccagctgctatagccatgactacaagggggcaaggtacagcttaggctgtggcttcagagggtgcaagccccaagccttggcagcttccgtgtggtgttgagcctgtgggtgcacagaagtcaagaattgaggtttgggaacctttgcctaaatttcagaagatgtatggaaatgcctggatgtccaggcagaagtttgctgcaggggcaaggctctcatggagaacctctgctagggaaggtggaagggaaatgtgaggtcagagcccctgcacagagtccctactggtgcaccacttagtggagatgtgagaagaggaccactgtctttcataccccagaatggtagatccaccgacagcttgcactgtgtgcctggaaaagccacagacactcaatgccagtctgtgacagcagctgggagacaaggctgtaccctgcaaagtcacaggcgcagagcagcccaagaccattggaacccacctcttgcatcagagtgacctgaatgtgagacatggagtcaaaggagatcattttggagctttaagatttggctgccctgctagatttcagacttgcatagggactgttggcccctttgttttggccaatttctcccatttggaatggctgtatttacccaatgcctataccccaattgtatccaggaagtaactaacttgcttttgattttacatgctcataggcagaagggacttgccttgtctcagatgagactttggacagtggacttttgaattaatgctgaaatgagttcaaactttgggagtctgttgggaaggcatttttgttttgaaatgtgaggacatgaaatttgagagggaccaggggtggaatgatatggtttggctgtgtccccactcaaatttcaacttgaattgtatctcccagaattcccacatgttgctgaagggacccagtgggaagtagatgaatcatgggggctggtctttcctatgctattcttgtgatagtgagtaagtctcatgagatctaatgggtttatcaggggtttccacttttgctcctttctcattctgtcttgcagctgccatgtaagaagtgcctttagccttctgttatgattgtgagacctccccagccatgtggaattataagtcaaattcactctcatttttttctcagtctggggtatgtctttatctgcagcatgaaaatggacgaatacatgaagtatacagtatcacttctccatgaagtaaggaactggaatagaaatagggccttaatattggctgcaaagaaataagtgtctaagagtgggattgctaatgttgcacatgaaatgataccaactatgtggaggtggacagggattcagaaagtgatggatttaggcaagtacgctgcaaggtttcaagtaagaatatagaatggagtcatgccagaaaaccgtgaaaacatgcttgtagaagagcatagccatcttcacatatctgttttagcactaacaatattagacactaaaactctactaatatatctgcttctcccagtggtctctgtgctcttggcaaagtgtagtatgtagtagattttcaatatatatctataaaactaaagagaaaggatttgcacttcatccctctttgactctaagtttatttccattttgttttccaaatgtaaagtttcttcaaattttaacatctattaatgtttctaattggaaccaaaatatgggatctctagagctcttctttgcttcttagtccagtgcataaaggtgaaagaagcacattcttatatacctgtttccgggttgtaataatcctgatgggaaaaggaagatgaaccacagggcaatggaagcaatactctgttatagtccctagagagagtcataatccttgcctataatgctgtatagatatccttctgcaatatcagtttggaaagaagaattcagtaattcatcagaacagttagaaaactgctagaaactttacgacctcatattctttaaagtaaccagtttattgtatcgttgtgacttttatttgttctcccccttgacatttatgtgatgagcacctctggtgatggctgaaattacacatagactaagaggactcaggcataacaaagatgtcttttaattttcctggagattaatctctccatcttaaatctacaaaagtaaactttttattggtttgattttgcaccccaatattttttccaagctacaattagagatgaaaattaagatagcaatgaaaaaaaactctgatttattacttttgacaggggaagtatttttcccaggctgtttctgaattcctttctttagaggaaatagcaggggaaggtgactatttctcagctagtagcagcttccaaaagaagaattatatttgggaaaatatttgagattaaatcacattagaaaagatgcatctcatcaaatcaaggtattattcaaataaacccatatcctgttttaaatgttaagtctgtatgttttaaagcttagagttttaacagtttatgctccttatagatagatgacataacctctacaaaccagaatttcacctaaagatggcaccctcctttggaaaaacacaggggctggtattttaatgagcatttgcaagccaagtgcctgatgaactacgtgtttgtgctgctttttaaatcgtcacaagtcgttgaggaggtattgttatacctattttgcagaggaaaaaactaaggctgaaattcactaccttgtctagggagctgtaaaacataaatagaagagccaaaatgggatgcagattatcctaaaccaatgcctctcaaactttttctttcttttttttttgaaactcaagagagtgcaatggccacgggcccacttttctttccctgcctagttgtgaaatgttgcttgttatttctaccaacctaaaatattattcctggcttttttctttctgaatttttaaatcagaaagccaatgggtttctaaaataattttcaatattgaaaaatatattttaccgatattttattgatctgtgatgccattgattgaaagacataccatgggattatgtatgttctactaagaaaaacaaatgctatcaacaaaactatgacataatgccttataaaacagtcctgcatgatgcatgaatgagtcacatcaccactcattgtctttcatcaattctaagaaatttagcaatttcttttgtttttaattcctctgcatggcaggtgataggcaatcccttttgtatgcatttaataacaaaacctaacacagcttcatctacttctgggtatttttttcttaggttctgtaaaacacattgttgttttgtgaggaaataaggggctctagtcatccctaaaatgatgaatatttgcctcactaaaaggaaacacattccccactgctctatttctgtatatttttgtgtatataatgacttctgcctcaatgccgaatcatgttgcaatcttttagaagacactttaaatggcaattaaactcaacacttgtagcaccaagaatattcaaaactcaatggaagtgacgacaatgtgaatatttatactgaaagcaatgtcatccacatcaaaactgccacctggccagcagtgattataatatgccattaaatctaagactcttcctaatttcagaggtattaaaatgtgaaaaactatacttcttagaatcaatgaaataagtaaatattaaatatgctttttgatggcctctcttttctacatttcagattctgatcgggtcccagctcttctattctcgaagcacccctgtcccctatacctctcatcctgcagagaaatactgctgtacgctgtgcctctttccagcaagaaaggtttcttcatctactctaggctgcattttagcatttaccccaaggcctgttacaaatggacagaaaattaaatttttctttttcctcttaggaagagaaaacctaactatatttccaacttataacagtgtattttccacgttttcattgtatcatggtcatgtgtagccctttgctgatagacagggtgagtgtaaagggatttaattttcactgcttgattgaactcgtcactaaactttttaaacaacttgatagtttgtatataagaattattttctgtaagttgtctgtttactctgttgatagtttattttgctgtgtagaggctctaaagtttaattagatcccacttaacaatttttgctttttttgtgattgcatttgatatcttcatcatgaaatctttgccctttcctatgtccagaatcatcttgtctaggttgtcttccaggatttttatagatttgtgttttacatataagtttttaaaccatcttgagttgatttttgtttatggggtaaggaagggacctagcttcagttttctgcatatggctagccagttatcccagcaccatttattatacagggagttttccccattgcttgctcttgttagctttgtcaaagattaggtggtcataggtgtgcagccttatttatgagctctgtattctgttccattgggtggtccatttttctgtttttgtgccagtaccatgctgttttgtttactgtagccctatagtatagtttgaagttgggtaacatgatgcctacagctttgtactctttgcttagtattgccttggctattcaggttctttattgattcaataggaattttaaaatagtttttttctagttctgtgaagaatgtcattggtagtttgataggaatagcattgaatctgtaaattgctttgggcagtatgaccctctcaatgatatgaattcttcctatccatgggcatgggatgttttttgaattgtttgtgtcttctctgatttctttgaaaagtgttttgcaattctcattgtagagatctttcacctccctggttagctgtattcctaggtattttattctttttttttggcaaatgtgaatgagattgcttttctagtttggcttttggcttggctgttgttggtgcatgggaatgctagtactttttgtacattgattctgtatccaagtatttgcaaaccatgcatccgacaaagatctaatatccagcatctataatgaacttaaacaaattaacaagaaaacaacaactccattaaaaagtgggcaaagggcatgaacagatacttcaaaagaagacatatatgcagtcaacaagcatatgaaagaaagctcaatatcactgatcattagagaactgtaaataaaaaccacagtgagaaagcatctcacacctagtcagaatggccattattaaaaagtcaaaaaataacaaatgctggcgatattgcagaggaaatggaacacttacacactgttggtgtgagtgtaatttagttcaacaactgcagaaagcagtatggcgattcttcaaagagttagaagcagaactaccattctatccagcaatcccattactggacatatacccagagcaatatagatcattttactgtaaagacatacgtacgtgaatgctcattacggcagtagtcacaatagcaaagacatagcatcaacataaatgcccaacaatgacagattggataaagcaaatgtgatacatgtacaccatggaatactatgcagccatgaaaagaatgagatcatgtcttttgcaggaacatggatggagctggagcatggataataactgaggaaaggaaaaccaaagaccacatgttctcacttgcaagtgggagctaaatgataagaacgtacgaacacaaagaaagaaacaacagacactggggtctacttgagggtggagggtgggaggagggagaggagcacaaaaggtaactattggatatgggcttaattcctgggtgataaaataatctgtacaacaaatccccgtgacatgagtttactgatgtaacaaaccttcacatgtacttctgaacctaaaataaaagttacaaaagaattattttctattattaaacatgtcctttggaaacattttcatatataactttgaatactttgttgtgccctgaggaaagtatgcagtagctgatttttgacttttattgaaaatgttttttgttctccattcttcacaatttttccattgaaatgtaatgataatacctgcatcgtctaccaatccaaacaatatatagtcaaaagcgaaattgatagtctctcactttctctttctaatcccattttctaatgtaactactgtaaactatgatttcctttgctgatagaaacaaatgccacacacacatgcgcacatatatacatatatacccattgaagattaaaaaacaaacaaacatgaggacctaacatggagctgctattcttccctaatggtctgttgcggacctattttgaagtcgatgcataatgatccacatttttaaatagctgcttattgtttcatagaattaatatatcatggtttaggaaaccatttccctatatatggatatctaagtctattccagctgcagtaacaaaatgtcataaactgggtatcttataaataacagaaatttatttctcacagttatgggtctgggagttccaagattaaggtatcaccagatttgatgtctggtgagggcttgttcctcatagacagtgtcttcttgctgtatcctcacatggcagaaagggcagacaaactcctttgggcctcttttgtaagggcacaaatccctttcattctctaaaggcctcatctcttgctactattgcactgaggattaggattcaacatataaattttgagggaacacaaatatgcagactatagcagtggatagtccagttatttacagatatttttattataaatcttttagatatctttttgggtaagactgttgacagtatcagacattgctgatttttcttttttctttccccctgatggaatcctaaaaatgaagatactcagtgagggagtgtgcgtactataaattttatattgctagctttattttccaaaatattataaaaatgtacattcatcaataataaatgagactgcctttttctgtaggttttcattagcactgaatgttctcagacttttacatggtcacgtaataggcaaaaaaacattgtgttgttttaatttgcaattttatgtttactgatcatggtatattttcattttttattgatcatttgcatttcctcttttgtaaactgccagctcttatctttgactcagtttagactgtctttttctaattggtgtgaaagaactctttattagaaataataaacaatgagtgcttactctttaacctgactctgactctcagtactttataagaatgaatacgtttaattaatcctcacaacagccttatgaggtagatacaattttataggtaaggaaactaaggcagagaaaggttaaataatatgcccaagatcataccgctagtaagtggcagagctggtgttcaacctgaggctgtcgggatgtaaactcatgtcctaacccctgcgctatgttccgatcagctggaagggaagatttggcgtgtgtactgagaacaaagagatataccatcactgggtgcagaggagccatggcaggcatatttcagagcatattggaagacaaatatttatgtctaaagtctgataagaatgatacttctcttaagaaaaaatacaaaacttaccatttcgaagtgaattcttgacaccgtagattgttgttgaaagtgaactgtgggggacgttgggaaagccgatgaggcagaaactgaacagtgaaagcaaaggagcagagaggaaaaccttagttgcacgatgcattggaggtcataaattctttaacgcagggagactgcaaaaataatgtcactactaccttctttgttatttgtagtttaagtaaattgtatgtagttttcattcctttagctactctgaattaatccctttgtggtctttataaagttctccgttaaagaaaactggcatctgggccttccttttccccgaggattgctacagaacagatagatttataactcttatgatatttattttaaaaactttggatgttccagaagcacaacttatatttttctcaatacctctgtttagtttcaattttggaaccctgagtttgcctgattgcaaaaattaaaaataaaatatcttagtcaacttaagataaactcaggcgtctgttttaagctcatttaattctcttagttattctttcctttttccaataattttctaggagctttggaccatgggagttgggaaggtgatctggctcagggccatttttcttacaagtgagtatccacaagatgatacaatcctttctggtctttggacatgaccatacttctcatggaatcttatggggcatctgttttgaattgaattgtcttcctcaaaaatatgtattgaagtttatcaattatatattgacgataaatatgaaagtacccccccatatctcagaatgtgaccttatttggaaacagggtctttgcagatgtaattagttaagatgaggtcatactggagcgtgatgggcctctagacaataagaacagtatcttcttataagaagacaatatatgaacgtacgagaggagaaggccatgctctgagagaagcagaggttagagttatgcatctgtaagcccaggagtgccaaggattgctggtgacatcagaagccaagagaaaagcatggaacagattatctcccagagcctttgaaagaacctggccctgctgacatctggattttggacttagagctctcttatgggtgtgggcacagggcaggctctacacaagtcccacagcctccagaacagtgaaataataaatttctgttgtattaagccatgaagattgtagtaccttgttatagcagccctaggaaactaatacagcatccaaactcaagccacttctagagtgtcctcttagcctagagttccaggcatccactccattctggatcacttgggaaaatggccatttccagtgtcctgtcaaactgcccatctgctagagcacttaaaaactctgctttactcaggggccagggtagcttggatactgcctgtagtgcttgccagcttccaggacaacaagacagagacaaggcttcagtactttctgttcttcgatcctgaaacccttctgggggtcctatactcttatgacttagagctctcttatgggtgtgggcacagggcagtctctacacgagtcccatagcagtatgttttcctgctgctctttttgctaaaccttccccttctttacctatcacacctctcatatccatatcctctcaaacttgggatttttgtgggatttttatctagactaggtaaacagaaaacaactgcttccacagcctggtctatatgtatttatccctgaattttttatttggcatctggcaggtatgaaagtctagaatttgctatctttattcttgggttccttcatgacaagaatgggagagagtcgctgtggaaaggaatagtacaggaaaaactcatttactaatattttacaagagaattctgacgaaagtagccaaggtggatgcacaagtcttagctgaaaattgaggtcaaattctaaagcttagaacagatgcgggtacccaaactgcatctcttacagaatgtgaccctttaaggagtatacctatccatgtacagtcatatttaatgaagtcgaagggtggcagtatatgccagtcattgtgactaccgcttgatgcctaaatatcagtctgtcagtctgcacattaatattggctaatgttttcatgaatttgttttcttgtcagaaaatgtgagtttcttcctagcgtttttgagggcttttgtgcatttgttaagttgttctggaatctttctgctgtgacgtggctgttttttgttttgttttgttttgttttgacttgcctattcctgattatattttacctttgtatgattggggaatcatgtaggacctgatataaataatcaagtattttaatagagtgatacattctgaatagagctgatcttgacataaaactaagtattctaataatacggccgggtgtggtggctcacgcctgtaatcccagcactttgggaggctgaggtgggagaattgcttgagctcaggaatttgagaccagtctggacaatgtagcaagaccctgtctgtacaaaaaaatttttttttaaacccactaagtattttaatgatagaggaattattatatacctgctatatccttaacacaaaagtgtgtggtatggacgggggtatgagaaatttgtaaggcatgatataaatccacatggagcattgcatctactagagtagcaggacacatacatccatgacacacaaaaccacgaatacatacaagttacagaatgcagattattatataattaaacagtatataacatactgcctactaagcagcactcaggggtgaggtaacaactcgatcaggatgaaataaaactggcctggaattacctccagctgaagatgacttgattcttgaatctggccggattctgtctagagagagaatactcctgggccagctatgcactgttctccaaacttggaaaagtggcaataagtaggaaagaaatcccattttaagggcacatgcacaacaggaagccctttttttctagatagactcctggatgcaaattccccaggtttatattcacttaggcctcaatctcactcaggttaatatattatttgaagtgattttgctaaggatagacacacaggtcttactacatgcgggctaaatagttgaagatgtctctattttctgctaccctagtgctctctctttgtgcagccgcattactcaaacaaacaaaagaaaatcttcccagaacactaggaagccacacctttggtatcagtcttgtatggaagggtagaaacatgtgggcaacttgagacctgaggtcaccatccaaactcatcaaagaaaatagcaccagtgcacagtcagttatcttttagaatggtttctgccaatcattctaatctattttgtattgcatttttaattttattcattgctatatcacttaattcccatattttatgttgcctttgtgactattttctcttgtgtgaaagtacctcttagtcattcgcttgtcgtagttgtttggatagttgcttcaattttttatttctatttatttatttatttttgctaatggattatcagcatttaattatgatctttttgcttttcttgatttttccctcattatgaagttcctggagtgagattactgagttaaaatgaaagaagttgtgctgttttccagaatggctgtaacaatttacaatgctgtttgccatgtatgagtgtgttagtgtggcagattccatattctaatgatggccataagaatatcttcattctacgtgatctttgcttatgtgaccttgacattcctctcatcaagcggtgaggctctccccacaacacttgactctgggtgggcttgtaacttgcttgtaaccaatagaatgcaaccaaagtgatgtggcatgactgatgaggctgaataaggaaaagcaatgcagcctccaccttgttttccagaacattcacgttcggtgccatgaactgccatataagaaatttgggtgtcctaagaccacaataccagaatgcatgtaccaagccacatggaaaggccacatataataagcaccctaaaagtagttctagatttccagtctcccaactcaggtgccagggtttggaagtcctattgacatcccagcatgaaaatttacttggcaattatgtatatggacttgcctctcaggaagaggctaaagtggaggtctggatttaaaggtcatcaagcaatgatgaaaattgaaactatgggagtgattgtgattgcctaacgagagtgtatcagttaaccattgccacatcacaagccatctcaaaacttagtggtttaaaacaacactaataaatatttattcataattctgaaacctgagttgggctcagtggggtagcttgtccctgttccacatggtattggctgaggtcgttcatgcatttgcagtcagttgatggcacaactggagccggaggatgcaatgtggccttatccacatgtctgtcacctgagataggattgttggaatggatgggagccggtcagatctttctcttccccatggtctctcatcttccagggtctgtctctatacataggcctgtatcttcaagaaggataccccaaactttcttacatggcatctctgggtggcaaaaaggtgaaagcagatgtcttaaagcccagctcagaatttgtatagtgtcatttcccttcattctattggttcaagcaaaaggccagcccagtgagtgtgggaggggaattgaatgtgaattcagtgattcactaaggctgttatctaaccatcagtcaaaaaggatatgggaatgagaataatctaatgcttggaagagcacgacatctaaagagtgagtgtagaaaaagaagcccattgtgtgatattccccttcctgtgtccatgtgatctcattgttcaattcccacctatgagtgagaatatgcggtgtttggttttttgctcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtatgcatgtgtctttatagcagcaagatttatagtcctttgggtatatacccagtaatgggatggctgggtcaaatggtatttctagttctagatccctgaggaatcgccacactgacttccacaatggttgaactagtttacagtcccgccaacagtgtaaaagtgttcctatttctccacatcctctccagcacctgttgtttcctgactttgtaatgatcgccattctaactggtttgagatggtatctcattgtggttttgatttgcatttctctgatggccagtgatgatgagcattttttcatgtgtttttcggctgcataaatgtcttcttttgagaagtgtctgttcacgtccttcgcccactttttgatggggttgtttgtttttttcttgtaaatttgtttgagttcattgtagattctggatattaggcctttgtcagatgagtaggttgcgaaaattttctcccattttgtaggttgcctgttcactctgatggtagtttcttttgctgtgcagaagctctttagttttattagatcccatttgtcaattttggcttttgttgccattgcttttggtgttttagacatgaagtctttgcctatgcctatgtcctgaatggtgatgcctaggttttcttctagggtttttatggttttaggtctaacatgtaagtctttaatccatcttgaattgatttttgtataaggtgtaaggaagggatccagtttgagctttctacatatggctagccagttttcccagcaccatttattaaatagggaatcctttccccattgcttgtttttctcaggtttgtcaaagatcagatagttgtagatatgcggtgttatttctgagggctctgttctgttccattgagctatatctctgtttttgtaccagtaccatgctgttttggttactgtagctttgtagtatagtttgaagtcaggtagtgagatgcctccagctttgttcttttggcttaggattgccttggcgatgcgagctcttttttggttccatatgaactttagactgtggtggggtggggggaggggggagggatagcattgggagatatacttaatgctagatgacgagttagtgggtgcagcgcaccagcatggcacatgtatacatatgtaactaacctgcacaatgtgcacatgtaccctaaaacttaaagtataataaaaaaaaaattaaaaaataaagaataaaattctaggtcattcagaaaactaaatggaaaaaaaaagaagaaaaaaaagaaaaagaagcccattatgtgactgaagggtgaccagagatacaggaggaaaagcaagtaagaatgatattatagcaattaaaaattccacttctagaaaaatagaacggtttgttactgccaaagtaagaacataataatgaaacacaccttcagatttaataacaagcagttattggtgacttcgacaggaagagattcagtggagcagaaggagctgaagccagattgcagaaggttgaaggaaggaagcacagggagagagaaggttgcctgtaaaagggcagagagaactggggaaatagccagaatttgacatgtttctattttagtttgttagtttgtatatacaggaggaatttggaccagtcaaaatgctgagaggaaggtggagacaaaaagggaaaggttgaaggtatttgagaaacaaatattaaggaaatgagttctagtttctagttctagtttagcagaaattaaaatcagtttaactgtgcagaacaagattttgttaccttaagctattattttcattcattttaattttctaaaaagacaatttacttggaatcaaaaggagtaaaatccattaaaatgtataaatatgtaatttcactttgctttttgaagtgcccagttaagaatgatttaatctaaaatgaatccatttaaaagtaaaaatgtttaaagtaagaggaaatattttgaaagtatattgtcttatgaaagtaaatagtatatttaaaatatgcatccttgcatttgacatatttattcattttcttcaagatgtaaatgctttaacaaatgttgcaaatgtagagaaataaattaactttacatcaaagagcaaacatctcacaaatggcaacaagagagcagttgtatttaagatgtctgatattcctttatgtctatattaataataaataaaatatttcactgtactatttttcctcatggaaaaccctgctgtccttattcatatacaaatcaagctgaagggggatctggatgcctgtgtacctcccagaagctttttctggaactgatttgatgagatgatttacactttctaaccatccttttatacagataggctcttcactatttttacctttggagtcctgggtattttgctgggtttgataaagtggatcagacacacatgtttgctccagagagtttaaacatacattattgattctatcgtttgaaggtaaaaatgctttcagaagaaacttggaaaacaagtctaaatcaattgaatttaaagaccaatagaaatccctagatatggtttccacagcaacaatttgaatgtttaatatttctttgcactcaaaaggtaattaattgcttcattaattcaatgcaaaaattttgcaacctactatgtgctaggtaactgagaagcaaaaagaataaagccaaatggcatcttgtttttgccccttctctcccatccggtagccaatagagagttcacagtctactcaggatgccaggcaaataaagagttttaataataatgtgatatgtgccataatgaaggtgggaaaaatgtactttgaaagcacagaaagaagttaaatttgtctgttgagactaaagacagacaggaaagactcacctgtttaaacagctgaggagacatttgagttttattttcaagaatgatactggtttgtagaatgaattgagggcttgggaagaggtgggaggatggactgagtggtcaggaggaaagaagtgcatcctgttcagaggaaatagcatgtgtaaagacaaagaactgttaggacattgtggttttggagtgctccttgcggttttttttctctagtatgacagaaggcatgatatgctgagggagtgaaaagttattatgctggtagagtagacagagatatgataaaacatttctgtgacatcataagaagtttgaactttattagtggggaatgttgaatgatcaattatttatatcaggcataaatattaagaacaggaaaatcagagcaatgaatcataggacttgtatgacaagaggtgattaatatttctatttctctgccttcaagaaaagcaattgtcaaggtatgtttgcgggtgacttgttcttttatgtaaaagagtctgggggatgcccccttgttacttgttgtgttattgaatagtttttatcaacaagacttaattccacacgctgaatctcacagtgtgtaattaaatcttagactcttgttttatccttagggacatgaagacctcttttggcaatttttaattcacttgaaggcaattttaaagttactcctttgacttttcattttggactaaataatcctatctcatttttttcataacttctatgttacaatgctttaaaccatttcagttgctattttctggatttttctcctagtttcttgatatattccttgtaagtggtaaaataagcaccaagcaatataatattttaaaaagattctgggtgatgttagatctaagataaaggattattcccagccatttcttatcatacatctgttaggatatacctagtattatgttagaattttttaaaggcagctctgcattggtgaaagatacaatttatgttttgaccattcttttttcttttctattttgcagttaaaaacattttaaaagcagtcttgtaaagttttttcttatcattgatgggtgatttctcttgacatcttaaattccattcatatctcaagcaacaagctataatgaaatgaggagatgtttgggagacccgagttcaaaccatgtctctttaagaaaggttggaatagagcaatttaagctaaaaaagtcccagaataattatgggacattctcaaaagtatcctaatttggatgataacctgcattatcactttaggctcttgtaattatgagtttatgcttctctgaatctcagcttcctccttggtaagagggaacaaaatatatagccaatacaattgctgggagatttaaatattttaaaaagttaaaatttttagcatgaagcttgacacaaagcaaagactttagttaaataggccttttcctcttttcttgtcccctttttataaaaatgataattcctcccttcaaatcaggtagtctctgtatacataaattagctaaatatctgagataaaaatatacccaacgaaataacatgtttgtaaagttcagacttagatttcagtaggaagcttaaggtgcatccttgctatacccacaatctaggtcattgctaatgacattgcataatacagaaatctatgtacaatggcttcagttatcccttagcttcatatgcaaccaataagaatgcttctatgttcagctgagccttcagtttttagatgaaatctcattaaaacagaatttcaccaagtgcattcttaggaacactgttccctgtaagtagttagtggacattatgaatggggaagaagtgctgcggacaaaaacaaacaaacaaacaaacaaacaaaacaaaacaatgtggaaatgggaaatgttggaataaacaaagttaaagttacctgtaacttgcaggatttcccagagcctttagcatactcatctttactgtgaatctgaaagagtgtaatatagtatgcagcatttacaaaataagtaattgaacttggatccctttttccatggagctcctcaacataccaagttattgagagctcagtttaccacagtgttttccagtcttggtagaatgttcattcatttatttaaaaaaatattgttggcttacagcatttattgattgagtgctttgtgtctaagtggcacttggcacttcaaaccatattatttaacacattataatttaatatgtaaaaagtaattagaacttaaaaagtatagtaacatggtaaatttggtaaatgattttttcattcttattttgtggcaaggatttagtatgttagctgtttagtacaatggtttccaaactttctaaattgtgtcctcagttcttcacagggcaaatatacttatttatttataaattgtatttgcatattaatgggttaatatataatgtaagcatgtgcaaaatttagatgttcgaagggattagatgaaaaaataaatagaaatagaaattctaatattttcttcctgggctttgatggttcaccttgccaacctctaggccacatacttctctctttggagaccattgtactagtagtaaagaagcaaagaaggaaacagagataactgctatatacttggaggaaatattgtctttcattcatcatatttgtcatcacttattatggagaaaattgaggtttgacactattgtaaactgttcacaaaaaaggataaagaaataattttttgatcttaataagcttatcctgattgaaggaaatatataataacagagaaatattgactgaagaagacactcattgaaaatggtgcgataggagtctccagtgcttgctcattcacagaaacatcaattttaataaccattcatgcacaaatacctttgcaagagctaaggaatcaaagtgagaattacagtacctgggtggaacacagaaataagaaaaggcactttgaagaaggtagaaaggattgttgcatattgcttgcatcacttctctcccaagcccacacagcacagtatatatatattttatatataatatatatatattttatatataatatatatatattttatatataatatatatattttatatataatatatatatattttatatataatatatattttatatatatacatatatattatatatatattttatatatataatatatatatatatatagagagagagagagagagagagagagagagagataatcttcaggttgggaaaacagttacataagcacaagacttcatcataggctacagcaccaggtcagccccagtgaacctcagcaccagacttgcccccacagacccaggttttaggcttgtcccagtgctaagctggctctcaaagcctcagtcttcaggcctgcccctatggactcatgctgtatgatagctaccatggctccaggcactggaccagtacccatggacctaggcttcaggctggctcctgcaaatctaagcgccagccctgccccagtgccagaccaggctctgtcatcccagattccaggccaaatgtcacaaacccaggtgccacacctgtctgccctctgactgaagcatcaagccagctgttctggtgacttcagtagccagcctgtctatggaacctcagagcggagctgcccagaatttctggttgagccaactggtgaagtgtttttccttttaaagccagtctgtaaagactagaaacagtgcctatttctttaactgcatagacaccaacacaaggccaaaacgatcatgaataatcagggaaacatgacaccaccaaaggcacaaaataaattgccagtaactgaccctaaataaatagaagtatatgaactgctagataaagaattcaaaatgattatcttggagaagctcagtgaactacaagagaacacagataggcaactaaacaaaaatcagattaaaaatatatgaacaaaatgggaagttcaatagaaaaatagaaaccatagaaaagaaccaaacagaaatactagggttgaagaacacataattgaactgcaaatttctacagagagcctaaacagcagacttgatcaagcagaagaaagaattggtgagcttaaagataggtcatttgagaatatctagtcagaggaacaattttaaaacaagaaagacaatgggactatggggcaccattaagcaaacatatacattatgaaattttcagaaggagaagacaaggatgaaagagaggaaagcttatttaaggaaataatgatagaaaactttccaaagctggagaggaaaatgaacatccagatccatgaagcccaaaagtaaacatggaacataaacgtatatttagattagacgtaaaaagatattcacttaaacacattataatcaaattattaaattaaagacagaatctctattttttacaaggcagaatagtttctattgtgtgtgtacacacacatatatatatatatatatatataccacattttctttatttgttgatgggcatttacattgattccataacttgacagttgtgaatactgctgtaatatgagatatctgcaatctgagagtgcagatacttctttgacatactgatttcagatcctttggaaatcccagaagtgggattgctggatcatatggtaattctatttttagtttttgagaagccttcatacagttttccataatggctgtactaatttacatttccaccaacaatatacaagggattcctttttctgcctatctttgcaaacactggttatctttcatctcttttataatagtcgttctacaaggtatgcagtgatatctaattctgattttaatttgcactactctaatgattagtgatgttgaacatattttcatatatctgttggccatttgtatgtatgtttgcagcaacatggataaacctggagggcattcatctaagtgaaacaagctgggcacagaaaaacaaataccatatattctcacttctatatgaaatctaaaacaaccagactaatggaagaagcagaattgtggttttcagaggccgaggaagggggactggggagatattggtcaaaaggcataatgtttcagttagacagtatgaataaatgataaatatttaaggtgttgaatatgttaattaacttgatttaatcattccacattccatacatatatcatagcatcacattggagcccataaatacctacaattgtaatttatcaatattcaataaaataaaaaaagaagtcaaagagaattttgaaagcagcaagagaaaagccttttatcacatacaagggaaactaccttcccttataagactatcagcagactttttttttgcagaaacctcgcagaccaagggggagtgggacataatatacacagtgttggaaagaaaacaacaaaaaacctttcaatcaagaatattatacgtggcaaagttatccttcagaaatgtgggaattataaagatcttcccagacaaacgaaagctaagggagttcatcgtcactagatgagccttacaagaaacggtaaagggagttccttcaattgaaaaacagtacactagctaagaacataaaaacatatgaaagtatagaaatcactgtaaaggtaagaatatcatcaaagggtcagactctagtactatcaatagtactagggtcagaagaccctagtactattatggtggcatataaattacctttaacactagcataagagttaagatacaaaattatcaaaaataactttagccataacaatttgttaaagaaagcacaatataaaaaagataacctgtgatcttaataacataaaaagtgaggagaggaaaagtaaaagtgtagaatttttgtatgtaattgaagttaagttgttagattaaatagactattataactgaaaaagatattttatgtaagccctgtggtaaccacagagaaaattacctgttacaggtccagaaaagataaagaaaaaggaatcaaagcataccactaccaaaaaatcatcaagttacaaaggaagactatgagaggaagaaaggaataaagaaactacaaaacagtaaggaaacaatgaataaaatggcaataataagtccttattatcaataatcacttaaaacgtaagtgcattaagttttccagtaaatgacataaagtggttgaacagcttaaaaaaaataaaccttgatgtaattctatactgcctagaatggagtcagttttactttagaaacacatacagaattaaagtgaagagatgagaaaagatattctaggcaaatagtaaccaaaaaagagcaggagtggctatacttatgttgaacaaaatggactgtaagtcaaaactgtcaaaataaacaaagaaggttattatttaaaaataaaagggtcaattaaacaataggatatagcaattataaataatattcacccaacatcagagcacctaaatatataaaacaaatattaatagatctgaagggagagatagacaataaaataatagtaggggactttaatgtactactttcaacagtgtacaggttgcctagactgaaaatcagtaaggaaacaacagacttgaacaacactatagaccaaatggacctaacaagtatttatagaacataccaaccaatagcagcagaatacacattttttttcaagtgcacacagatcattttccaggacagatcacatgtgaggctatgaaccaagtcttaataaatttaagaagattgaaatcctatcaaatatcttttctgaccacaacagtgtgcaatttaaaatcaacagtggtaggaaaatggaaaaattcacaaatatttgtaaattaaataatacattcctgaacaatcaatgggtcaaagataaaatcaaaagaacattaaaaacctatatattttaaatatataaaattattttaataatattaattgatttatttaaatatagaaaataattttgggtggaaataccctaaacatcaaagatagcaccattttagtattaagtgtgtcaatggggaaaagcctaagattttgggtcaagacacccaggttcagacctgaattctatcatttcccatcatgtgatcttaagcaagtaacacatttcctctgagtttcagtttttctcatctatgaatgaagataatattactttgttgcattgttggaatataatctaatatatgaaatgtatcagaaacttattttacttgactagaaataatgttgttaaggcatatgttatagatcccaagcatgggaggtaaacctctatcaaaaaacaaatgtgattaacctacattatatatgtgtgtgtgtatctttctctctctctctctctatatatatatgtatacacacacacacattcaacaattaacagatcatccagactgaaaatcaaaatgtctgtcagagggggagagagggagggagattgagagagagagagggaaagagagaactcctattttactttggtttattttgagacagacactctttttattaaagtatgaatatataagtgtgtatatttttcctgttgatgaagaataatgaatagacattaaacattcatcttatttaaaatctttctattttttcctaatcaaaagactcctgaagagtatcttcacgtgttagcctcagagcctcttcccttgctggaccctgtgagatgtttgtccacatatagtgacttgctgcttgccttccatcatatttcagcttttacagtcaactttccactttcctgaccacctaaaaagtacccagtaaataaccctttatcgctttaccttgtctttatcttttttttttttttttctgagacagagtctcactctgtcatcaaggctggagtgcagtggtgtgatcttggctcactgcaacctctgcccccggggttcaagtgattctcgtgcctcagcctcctgagtagcttggatttcaggtgcccgccaccatgcctggttaatttttgtattctggtagagatggggtttcaccatgttggccaggttggtctcaaactcctgacctcaggtgatccacccacctcggcctcccaaagtgctgggattacaggtgtgagccaccacgcctggccgcctttatcttttacctgttaagagagtagatcttcaatgttctcaacacacacacacacacacacacacacacacacaaaaaaaaaaaaaaaaaaaaaaaaaaaacaaacaaaaaccagtaattatgcgaggtgacggatatgttctttagcttgattgtggtaatgcatatcacaaattacatatgtctatcaaaacatcatatataccttacatatatatagacagaaataattttaatttgccagttatacttcaataaagctggggaaaaaacccagaaatatttgtagaacattaatcatatactaggtagtaggcatcaggaatacagaagttatgatcttttgaggaacttttaaatattaaagagatgccctaaactgggtagtgttttcaaaaaaaaaaaaaaaaaaagggaaggtaaccgtggaaaattcctttttaatattatgcatattttattttgagtaggaactctttctgtgaaagtatcatggggaaagtgttgtattaggcgtcaacttgcttggagggatcctaggactctcttgttcatgattcttacttgagtcttgttctcatgaattctatttgtttctagctacttctcctctttaggcctaatttagtgtataagccttctgctgtcctctaagctgtggttgctagtcattgctcttccattctcctcattacttgccatttgatctcagtgtatcagccatttaaactttttcctttgtcaatggctgccatattattcacttaccagtagtctcccatttcaccctttgtgatggttaccccagtatatcattactttagatacattttatttcaccatgactctaacttcttgcggatgttcacttatattttaatcacataaaatagtcttcattattacttaaataaatgtgtctttagaatttttcaaaaggtattttctatcttaatgttgtcatgcacttggatttgtacacataaaaccttagctatttaagggatgggtataacctatgaaaagatttctcaggtttcttttttttttttattatactttaaattttagggtacatgtgcacaatgtgccggttagttacatatgtatacatgtgccatgctggtgtgctgcacccattaactcgtcatttagcattaggtatctctcctaatgctatccctcccccgtccccccacaccacaacagtccccagagtgtgatggtccccttcctgtgtccatgtgttctcattgttcaattcccatctatgagtgagaacatgcggtgtttggttttttgtccttgcgatagtttactgagaatgatgatttccaatttcatccatgtccctacaaaggacgtgaaatcatccttttttatggctgcatagtattccatggtgtatatgtgccacattttcttaatccagtctatcattgttggacatttgggttggttccaagtctttgctattgtgaatagtgtcacaataaacatacgtgtgcatgtgtctttatagcagcatgatttatagtcgtttggatatatacccagtaatgggatggctgggtcaaatggtatttctagttctagatccctgaggaatcgccacactgacttccacaatggttgaactagtttatagtcctgccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctttcggctgcataaatgtcttcttttgagaagtgtctgttcatatccttggcccactttttgatgtggttgtttaatttttttcttgtaaatttgtttgagttctttgtagattctggatattagccctttgtcagatgagtaggttgcgaaaatgttctcccattttgtaggttgcctgttcactctgatggtagtttcttttgctgtgcagaagctctttagtttaattagatcccatttgtcaattttgggttttgttcccattgcttttggtgttttagacatgaagtccttgcccatgcctatgtcctgaatggtaatgcctaggttttcttctagggtttttatggttttaggtctaacgtttaagtatttaatccatcttgaattaatttttgtataaggtgtaaggaagggatccagtttcagctttctacatatggctagccagttttcctagtaccatttattaaatggggagtcctttccccatagcttgtttttctcaggtttgtcaaagatcagatagttgtagatatgtggcgttatttctgagggctctgttctgttccattgatgtatatctctgttttggcaccagtaccatgctgttttggttactgtagccttgtagtatagtttgaagtcaggtagcgtgatgcctccagctttgttcttttggcttaggattgacttggcaatgcgggctattttttggttccatatgaactttaaagtagttttttctaattctgtgaagaaaggcattggtagcttgatggggatggcattgaatctataaattaccttgggcagtatggccattttcatgatattgattcttcctacccaagagcatggaatgttcttccatttgtttgtatcctcttttatttgattgagcagtggtttgtagttctccttgaagaggtccttcacatcccttgttagttggattcctaggtattttattctctttgaagcaattgtgaatgggagttcactcatgatttggctctctgtttgtctgttattggtgtataagaatgcttgtgatttttgcacattgattttgtatcctgagactttgctgaagttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgcccgttttcaaagggaatgcttccagtttttgcccattcagtatgatattggctgtgggtttgtcacagatagctcttattattttgagatacatcccatcaatacgtaatttattgagagtttttagcatgaagcgttgttgaattttgtcaaaggccttttctgcatctgttgagataatcgtgtggtttttgtctttggttctgtttttatgctggattacatttattgatttgcatatattgaaccagccttgcatcccagggatgaagcccacttgatcatggtggataagctttttgatgtgctgctggatttggtttaccagtattttattgaggatttttgcatcaatgttcatcaaggatattggtctaaaattgtcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttccttgtttagtcttgggagagtgtatgtgtcgaggaatctatccatttcttctagattttctagtttatttgtgtaaaggtgtttgtagtattctctgatggtagtttgtatttctgtgatttctgaggtttctaatttttttctgaaacttttcacttcaaatagaattttaattgtattggctctgagagagtgcaaaccaagttagtactgagtcagcagatggaggaatccttatcattgaacaatgaaacaacttgaattcttttttgccctttttgccatctggtatctgtgctcatatttgaaacattaaccattcaagaaagattttttttttgtatccagtagtcagaatatttctctgaagactggtgcttatcttttcaggaaaaaaaaaagataaaatgttataaatatgaatggagccctgaactaatatttgacagtgacataaaagcttaagaaaatgcagagtacaaagtgagtctaaggagatgccattttcaatttattttcataatctaattctgtattgcttgtaaaggttaatctaaatccagcagaaccaaggctgtccactgtttacttgttataggcactgctacattattctaaatgcagcaagatgaacatggcccttgtttacaacctagttgctatttctttttgaatcatagcagataaagtttttttcatgtgaacttcaaattattagtagtcaaatagtgttcataatggtaaaatgcatctaagaaaacacctagaaaggaatttataatattcactttgaaaatagtgacacaatatacatttaacctccagttattcaaataaccttgcagatcacctttttctggatgtctacctactagatgtcctcaacttctatttgatgaggaagaaagccaaaggaactcaaatagtttaaatattaacttaaataggagcctaaggaaatatctattcaaaactttagcccctaagagttaaacattaccttatgtggtagtaatggcttctagatattctggtgttttccttatgtataaaactgtttatctctatttttcatgagtttttctagtataaacaaaacataaataattaatgtggtaatcatattatgcttgaagccaaattcgtggtctaagtctagatcttttagcatgtgggatacatattgccacttttcaaattggtttgtctttgagtagagtttgaagactatttcctcttgtggttgtgttttccatttggggacttgtaagcaatgccttggtttctggtggagtggatcagtttgagacgttttctctgtgtgaatcactaagaagattctattaactattctttagatttagaaataatttgttcactgaataatcagtctgtgatggacaagtttaagaagattacaaataacactcattaagtaaaagttaagtgttttcttgaatcagcttgaacctttatccattggcttaatctagctcttgtctacttatttggttttgggacagaccctttaactttctctcctaatgggtatttcagatgttaaagagcttttgggcacggggaacagtgatgtgctcagcttggtcatgttatgggaagagggctgaggttgctttaagtagctacagaagaggcttcaaagagaacctcagcttcattccctgtccgttagtaagctacactttccacccagcagctctgattacagtgagtctgaaaatgtctccttcagaaacactgcccattgctcactatttttgcaccctgcctgttacctaagtctctcagtttcttgctcatgctgccagcaaactgtcctctattgaccttggcctctgcctacttggctcctatcactttagggactcttcctccttaatatggattttcaatttgtactctcactgacttctagctgtctccacatctcactatcacctctgccacagagaatgtgtggttgcactgatgggtcttcaggtaggagagagtgccactgcaatctcatgtcaggcttacctcagaggccactgttgtgtatgtgcattagaacaatgacaaaaaccaaaaactctaccaagaacggtatctgtcatttaactcaatgtctagaattcagattactgctcatctcagccctgggaagcagttattattcttatccctgttttaaagatacggaaacaaagactcagagaagctaaatactggcagagctgggactcaaacttagctctgtttaacttcaaatcccttgcctttaaccactgtaatatggcagagaccaggtcacagggtcatgttatccacagcccagagtcctttgaacatggctgccctcagaaggggcctgtaggcatggtagatgccccgaggcttttcaggaggggtgatttcagcaacagacgccttctagcacagataatttcctggcagcacaatgaggctagcatatctatcctgttacatacaatttcttggtggattgaagatgtgaagcaaaactatgctttaaacttcaaagcacttgtgtaatgacagaaatggtagtgggcttgtaatagtaggacctagtacttgtaccctaggcctggaatttattgacctttaaattttggatacatcactcaatgtcttactttactcatcttaataactgggtcaatcttaattttaaaaggacaatcatatggacttaatcttctaaaaaaagattagcttattttgataaagggcttggcatttgatagaaattgagtatactagtaactttttttgtttgtttgttttttcgtttttaattctccaaagaaagactatatctggctgcttaataaagagaaaacctctcaattgaagtgtaacacacacagaaaagtgcagaaataaatgttcaactgaattaactatctcaaaataaactcacttgtgaaaccactttcttactcaagaaatagaacatggggccagcaccctggaagccatttatgtccacgcctaatcactaaaccctcctttttccccagaagtaaccactgtttggatttctaacactatagaactgttttgcctactttttaaagctttatgtaaatggagttatatgaaatgtattcccttgtgcctggcttcttttgcgaaattatgtttgtgagattcatggatgttattgcacgtgggtgtagttcatattaacggcagtagtgtgtttcattatacgaatgtaccacaatttatttattttacagttgatggacatttcaattgctttcagttttcacctattactaataatgtttctatgaatattcttgaccttgtcttttggttagtatgtatacatatttagtctatactaggtatgaagttgctgggtcactagatgtggtatctttaacttgaggagacaatacaaagcagatatcccaaatacttttccattctgtcaatagtgtgtgactgcttgttgttcctaagactagccaaatcttagtattttcagttatttgaattctgatgggtttgtagtggtatgtctttatctttcctcggctactaacgaggtttaatcacaccactttttttttttttttagatgaagtcttgctttttcaccaaggctggtgtgcagtggtgcaatctcggctcactgcaacctccacctcccaagtttaagtgattctcctgcctcagcctcctgagtagctgggattacaggtgtgagcaaccatgcctggttaatttttgtatttttagtagagacggggttttgctattttggccaagctggtctcgaactcctggcctcaagtgatccacttgcctgggcctcccaaagtgctgggattacagatgtgaggtactgtgcccagccagtttaaccccctttaatatatttgttggaaatttggatatcctgctttgtaaaatcctttttcagtctcttgccaccttttgcaaatgagttctggatttttcttattggtagtttgaagtactttattccatattagtcctttgttgattatatgtgttgcaaatactgtggcttcccttttcactctcttgtttttttaatgaaaggaacttcttaattttaatgtagtctaatttattagtttctcctttgattagtgctttttgttgtttgtttggaaaatatttcttaacctcaaaatcatttagaagatactgacttgcatggtctctcaggagttttgttgtttttattttcacatttagagctataatcctcttggacaggtgatagttgtctggctactacatttttttctatgttttcattcacctgtgtcctctttgctttatggaaaaaagtgagactatggcttgaggaagatgtgactctttttctatatatctgtactctttatgactatctttttatacattgtcacatttcctgaacataactccctctcccccactttattaagcatattcgagacatagaatgaatttcttaaataatattttagtactgttgtttcttaaggagattaggacaaaaacattatgaaacacccttgatgaaaacaaagaagtaaatgcagatatatcaagcggtttattcagagagatgcaggttattcttacttttcatagttcttcccaccattctctgccatgccatggactagaaggttctatcctagcatcgctctcaatacctgcacttaatcaacaatgacatctcttccatttgatagtgagtgatatgaatgaagaaaggaggcttcccgggaaagaggcttcctcattttatagcagaacttgatgggcattgcgaaaacacaagaatgattctagtctgtatggaaaagcatggctacttcagtgcctgttggcataattaattttgtgaaaagcttgtacatggctagctaacatataatcatgactaaagctgagagatgctccatcatggaacagacatccttcatgtttcttttgtcttgctattttactttccataccaaacactgttacaaacacaaaccattggtttagcatgaaaaggctgcagtaaggaacatacagatggtggcttgcagcaaggtcttgcacatgtttctcatggacaaaattggcatttttgcaatctcgtgtgcctctggtatggtgattacaaagctaacacttttatgttcctctgaactgtagcatctttctgtttgttaagcatattttttaagtgtaggtcaaaattacaaatatctttttctttgtctgctttctagagttgactgcagaaaatgaagaggtttccaagggacaaggcctatgtgagtctgtcagaggctagactcatctgtgatttactttcctttctaactccttgggagaacactgttttcctgtctctgtgcagtttgcagtttttgaaggacacgctaataaaggcacacttctaaggaagataggaaaggtcaactagtgcttctcaactagttttagaaaacttctggcttctacagctatgtgataatttgcgtagatataattattaagggcttatcctacaacttagtaaaagttttgcgctttttctctagcacatggccttttaaaatgccagtaactttgttaattccaagccaattattttcacactttccaaagcatgatatcacactggtcatgtgtatctctgtattgggatacaataaaacacacacacacagacacacacacatttacttattactttcattctcagagatgatgccattgttctcactattttaatttaatgtgtgcaagcttggtcagtgttacatgttgatggtaaaaagataaataagatacagattctgaccttaaagagattcttacggtagaatatgtatactgatcaaaaattaagctatggactacaatatttttcactttgaatattcagaaaaataccacttaggacctaaaaattatagctagcctattttgaaaaattccccagttctgactgttggccatgtgctagatgtaagcaaagagaagaggtaaataaagagaagatctctgctgtgaaggtacttacaaaccaatatgctacactttctcactttgcatagattcaaaatcaggaagatactacagcagtgcagacaattgttattgttatctggttttgcttaatatcactggatggcttatttttttttttgctttgttttattttattttattttaagttccgggatacatgtgcagaacgtgcaggtttgttacataggtatacatgtgccacggttgtttgctgcacctatcaaactgtcatctaggttttttttttttttttttttttttgagacgacatttcactcttgttgtccaggctggagtgcaatggtgtgatctcgactcactgcaacctctgcctcctgggttcacgcgattctcctgcctcagcctcccgagtagctgggattacaggcacctgcaaccacgccaagctaagttttatatatttagtagagacggggtttcaccatgttaatcaggctggtcttgaacttctgacctcaggtgatccacctgcctcggcctcccaaagtgctgggattacaggcatgagccaccgtgcccagccatcatctaggttttaagccccacatgcattagatatttgtcctaaacctctccctccacttgacccccatccccggacaggcccccagtgtgtgttgttcccctctctgtgtccaaagcttattcttttctttcataatttctctgaattaaaacactattgtatccataactttaaatattttatattctggtattgagcaagtagatgacctttattagattagggagtggagtactaaaagatagtcactctttcatgaaaagaatgcaaagcagaaagttcttgcttctgttgaattttgtataaggatgtctttgtccagctagtgaactgtattacattttgacaccattgcatatctggtatggttttttgaggtaggaatataaaattaataattaataattttgacaaagtataattttttctttgtttttgactgagcaatgatcaaatggatagattactcatgctaatattttgtaatatctagatatttctataaactaagaataagcatagacaacagcagattgtcccagatcatcattattaatataatcatcgtggattactatataaggtcaagatgtcaattcttcacaaattaacttatgggcttgatgcaattctgcacaagattatatgattatctggaacttgaggaaatcttattaaaattcacctagaagagagaaaaagcaagaagagctaagaaaatattgacaaaaaaagtaatggatggaagccttgtcctatgaactgttaaaaactagaacaattcagtgatgaaaaactgtattttaactgtcaatttaatgtatgtataggtatgtgaaatctcaataacatgtatatgaaaaaatattcaaatctaactaaatcctagtcttcaagtatctatctgaaagtctatctttcatctatgtatatttagaacatttaataaggaaatatgcaaggaccatataaaagatctacatcatttattgagtgatataaaattattttattatgtccctagattaaaaagacatataggataatataaatgtacaatataaattatcttatataccctgtagtatactgttcagtacataaagtaagtattcaatgactatttcttaaataaatgaatataaaaagtttgtattgttttgtaattattggaaggcttatttcagcatgaaataaaatctaagtaagtattgatacatagaaagtaattgtcggggtaatttggaaaaaaacatattgtcctaggtacctgataagaatatatatgaaggaggtaggtatattagttaggagtttgcagagaaacagaatcaataggggatgtgtgtatgtgtgtgtgtgtgtgtgtgtgtgtgtgataaatgatttatcttaaggaactggcttatgtaattagggaggctgagaagtcccacaattgggtgtcagcaagaggaagatccaggagagctggggatgtagttctgagaaccagagtgcttgtagtataagtctcagttgagggcaggagaagactcagtcaggcagagactgaattcacccttctccacatttttattctgtttcgccctcagtagattggatgattgggtgcagggtgctttactgagtccaccaattcaaatgctaatctcatctacaaacacccttacagacacacccagaagtaatggttattctgggcaccccatgtcacagtcaaattgacacataaaattaaccaccagaattaacaggaacagaaaaaaaactttgaagtttgccagattacatggtgaaacaggatgagtagaaaaatacttatccaaaaatagtatgttggagaaagagaagcaatcgcctatatttaggccctgaattagatactctttgtctgatagatagggcaatgtcagcttagaaacatctggcatgtcaggtattatattcaaagcaataggatattgggaagacatgcatatttctaaggaagagagaaacttagagtgggacttaatgactgttctctctgagatatgatttattaaaattctttccagtataattactcataaatatgggaaatcaactgcaatttactcccaggaatcaatcagtgccttttcttgctagatcgatcccttgtgggctgctgatcactattcctggatttggaccagtgatgcagagtgcattcattattcattcacttattccttcaataaatatttgtgaaatgcctactcagtgacaacatggtggtggtatggctgccgatttaataggaaacagcacatggcttccagtctcttgagctaagagaatgggaagtatgggggaaggcaggggacacaaatttgtgtgtccaaagaatgtgatgtagggtctgtagagtagctggctaaatttgtaactgcccaaatgggttcaccttacctgctgcctagacagagacaagttatcaagaaaggggaaatacaatagagaaagagtaattcacgcagagctggctgtgcaggagaccagagttttattattactcaagtcagtatcccgaacatttggggatcagagtttattttattttattttatttttttgggagacggagtcttgccgtcgcacaggctggagtgcagtgatgcaatctcggctcactgcaacctctgcctcccgggttcaagcaattctcttgcctcatcctcccgagtagctggtactacaggcgcacgctgccacgcctgactaattttttgtattttagtagagacggggtttcaccgtgttgcccaggctgatctcgaactcctgagctcaggcaatccgcccgcctctgcctcccaaagtgctaggattacaggtatgagccgcctggcccagacggatcagtttttaaggacaacttggtgggcaggaagtcccagtgagtgctggagtgccaggagtgctgattggttcaggtcagagatgaagtcatagggagtggaagctgtctttatgtgctgagtcagttcctaagagcagatgagccagtttatggatctgggtggcaccagctgatctctcaagtgcagggtctgcaaaatgtttcacacacttatcttaggagcagtttagggagggtcagaatcttgtagcctccagctgtatgactcctgcaccatagtttctaatcttgtggagaatttgttagtcctgcaaaggcagtctaatccccaggcaaaaaggaggtttgttttaggaaagggctattatcatttttgttttatactataaactataaactaagttcctcccaaagttagttcagcctacgcccaggacagcttggaggttagaggcaagatggaattggttaggtcagatctctttcactgcttcagttacaattttgtaacggcggcttcaagttgtgtgtagatcataaagtgtgtgttgactacatgaaaagtaaacaataataaagagttgagactaaatcctaggagaaatacggagctattagaagtttttaagcaagaggaggacatggtcatatttatgttttagatggagcactttgtctgtagtacagacagagataaaaatcaggcaagattggaagctgggagataggggctgttgcaacaatttagacagcaaaggttacagatcgtgtacgtttcataggttacatattttggggccttttaaaaaaatacaaaattttgaatgcaaaattagatgtgaagctctagaaggggtcttaagactcatgagttttattctacatccacctttagatccagtgaagtagtttacgtggtctgaactatggtgggggcagtaggaatgaagaaagatgaatgaaaggaaatctgaaaaggaacttggtgattggatgtgcaaggtgaggggagagaactatcaaggaccatgcttagttttctgtcttgtgcaatcaattggctcgatgaaggaagggtctgttcattgagacaggaaacacaggaggcagagtagattttggtggcaatatgggaagtgaagttttgcacccaggcaaagtagaagtgattgtgaaatattcaggtgtgaagctcaagatagtgaaattatcctacttctgatgaggctcaattaattttggcaacttgggtgttcagcatcctgaggatgaatgtaatgccccatcaagtgtggctcccaaagtaggtgtagatttaaattttgcataatccgtagttcagtgattattgccttgaagccctattgcctaggtctgaaaactaatgctgggttatgtaggactcttactgtttttctcacccttactgtggtgcctttcaggatgattttttttcctggtcatgttgcactgtaatactgggacatgtgctgcttagctagcaggttaccctgaaggcttttagttcattggggaggatgaatttttggttgtatgtgtagggtttctgtaatgtaggtcagtgtctgagctccctttgattgttaatccatagtcttcaactgattatgcaacccacggaggacctgataaatataatgttttaaagttcagcagcaaatttccttctccgttgtcctttgatttgaaaatggctgacaaatttttcttacagtttttatgaaagtgaagacagatatgactaccaacgaatataaaaatctccccaccaggaaagttttagactgtcatcaaatgacttaatataggagataataatagagtctgttttgcaacctaaaatatagtattttctactatgaacactgtaattactatttacagctagattatagggaaatctgtgggtgtcatggaattcagtttaaaattatggaaactctgtttgcataattaaaaggctagttaataaattccctcctattttctaacctatttaagcagatcatatatgtaccaatatttctctgctaactatggtagagaagacaaccaactttaaatcttctgttgctgaataatacccataataactgtgtataatatatggctcataattagtgaatatgctgagctttttcaagaaatgcattagatatggcatagatacaaatttctgcttcattaaatgactttatggactatattttgctgcttttgcacatgtgatcttttcccctgtttgatagcaagattactttacagctccttaatgagaatatctttttttttctgaaaccttttctgaagttttattgaagctctgggtgacctatttctaacggttttagagctctaacattttctctcccttatttaagtagctttaacttatgtttgattagtggttttagaagtagattcataatctaattttaggatgaaaatcttttcttacaggagaaaacaaatttaaaaataaccttacatgtcacaaggtgcctatggattatggaaatggctcacattcccggggcacttattgggtaaagagggtgaaagccagagatgacttctcttagttgcattttattcttagttgcatttctgcaggaaaatttctctttattaagaggactagaaaataagttcattgatgggtctaaggaatgactgcaatacaatgttaggtgctgtgatgtcatagtagtatagaagcagagatgagatgctaataccgggtatttgtagaatgggtgggaggtttccaggtgtccaggtgtcccatatttaaggaagcttaatattcacatttgaattttggagcagctatgacttaaatatcaagaaatattgtgataaatgatttgagccctgaaagataaataggaatttacctaccacagaagatggaaaaaggctggagcaaaaatttagaggcaacaattcatattataatttttttagttagagtaaattttaattttagttctaaaagaaatccacacactttagcaaactgaaacaatacagacatatgtaatgtaaagaggaaatatctactttatgttgttgccctccctatccccagcctctattcatgcctctctccacatgtttagtgtcgattctctgagagcttttcctatgagtttactcatttacatatctgtgtgtgtgcatgcatgtgtgtatgtaattagtttcattgttatgtaacttgcatcactcaatatgccttatcgaccatttcctgttagtgcatttcagtctactctatacattttaagaactacctatcaacatggtataaatataccataatttatttaaccatagccatatataaggtgtttacaattgctatggactgaaaatcaccccgtctgtaatttttatgttgaaatcttaacccccagggtgatagtattaggaggtgggacctttgggaggagatcaggtcatgaaactggagccctgctgaatgggattggtgcccttatcaaaaagttggcaaaggatatgaacagacacttctgaaaagaagacatttatggaaccaaaagaatatgaaaaaatgctcatcatcactggccatcagagaaatgcaaatcaaaaccacaatgagataccatctcacaccggttagaatggcgatcattaaaaagtcaggaaacaacaggtgctggagaggatgtggagaaataggaacacttttacactgttggtgtgactgtaaactagttcaaccgttgtggaagtcagtgtggcgattcctcagggatctagaactagaaataccatttgacccagccatcctattactgggtatatacccaaaggattataaatcatgctgctataaagacacatgcacacgtatgtttattgtggcactatttactctagcaaagacttggaaccaacctgaatgtccaacaatgatagactggattaagaaaatgtggcacatatacaccatggaatactatgcagccataaagaatgatgagttcatgtcctttgtagggacatggatgaagctggaaaccatcattctcagcaaactatcgcacggacaaaaaaccaaacactgcatgttctcactcatagatgggaattgaacaatgagaacacatggacacaggaaggggaacatcacacaccggggcctgttgtggggttgggggaggggggagggatagcattaggagagatacctaatgctaaatgacgagttaatgggtgcagcacaccaacatggcacatgtatacatatgtaactaacctgcacattgtgcacatgtaccctaaaacttaaagtataataataataaaataaaaaaaaaagaggaccaagggagtcatttaccctttctgccatgtgaggacactgtgaaaagaaggctctctatgaaccaggaagggggccctcaccagatagtgaatctgcgggtgccttgatcctggaattacctttccgtactgtgagaagtaaatttatgctgcttataagctatgccatttatggtattttgttatagcagcctgaatgaaataagacaactctttttctatattacaaataattctgcaatgaacttctatatccataattatctcctaatttattcctctatttttctttcctttccctcttttttccttctctatcttcactcactctctccatcacactctcacatttatctaaacaaaatctttgtgcacatttgtatttctgtagaatggatcctggaagtggaattgctagaacaatttaaatattgatatgtattcctgaatttcccttccgaaaactctgtaccagcttacacttccatcaaaatttggtcgggtttatttcatcattaatcatggatatctttgcgttttcgatgggaaaaaatgataaatagtatttaaatctttttgttgtttctcctaaaatggtgaatttgaatttgaacatcttttcacatgtattttggcccagtgaatttccttaatttttcttgttgatttttacactaaattattttaaaaatgatttttagaacatctttattcagtttggctattataatttttttctgctgtatgttttgcaaatatgtcctttaagaaatgtttattttctatatttttttttgtggtagagaaatttttaattttgatctagtcaaatctgtcatttttttccttaattttttctgtattatttcttttatgtctcttgcctaagaaggactttttcagatcaagattataaaaatattcttaaatttttttttgtattttcataggttttttttttactttaggtttgaattcacatggaatttaattttaatttgtatataacatagggtatggctgagatctaggtaatcaccacatcgatctcattttctttgtatgtacatagttagattttatttcccagtcttctgtgcagttgggtgaggccctatgactaaactgtaccatggaatgagaatagaagtaatgtataccacttctagtcttggctcataaaaatctttcaagagagatcctctgtgtctatcctcttcccaaatggtcttggaggccaggtgttgaagatgatagagtcaaatttgaaagagtttagatcccagaattaccacttagagaagagtcatacaccaatcaggaatatccatttttgactctatgtgagcaagagagaaacttctttcaatagctttaagccactgagattttagggtttatctttcatagcatttacataatcaatacacagagtaagattgtgacttaactttttccaactgtcaggtcaattgtcgtaacacactttatttaatagcttgccatatactctgtaatttgaaattctacttttagcatattctatattttcataattttaggagtgattctagattctgttttgttttattgagctacgcatttattcctgcaacaatgccatgatattttaaccactacggctttgtaatttttcctggtatctggtagcagaattagcttttaaaattgaggcgtgtcttgttcctttaaagtctttctgtgactcttagaatacaatagaaaatctctaacatgatctctaaagccctgcatgatttagccactgtctgtctttctagatgtatccctccttctctgcttctcagctgctttaattttctgaaaatgtaaagtatcttaggacctctggaccttcacaaatggaagtttcacaaatatttttccatttgcctgaaagagttgagtgtatccagataaactcttgctcccatatgactttgatctgttatgtaaagagagagaagtcattactgattccatgtagtcatgaagacattcttaagtataaataacttaaggacatgtgaggtcacatggaaaggaagaacttgacttggagaattttgaatttttttccatatctgacccatagatgaatcagttctccactgacatcacatgtttctcatcatgtaaataaaaaatgatgaatatcaaagttttctttagaaaccctggagacattgattgtacactatgttgtgtgtggtgtaagtatgaaatttaatggaacttttaagtgtatggcttacaaataattaacaaataatttcgatgtctaatcttattgcattaactataggcctgttcaagagcaaaaataacactgtatgtaagttttacataaaattatagaccttttccacctaggggtaccgtctgtctcaagctcctatatattgctgtataagtgaaggttctggcagcaaatagcacctcaaacagtgtaactgaagagtgttttataggagatgacagacaatggtgtggggaggggaaaaagaaatgaataagagatggtgcagtgctccagagttggtactgatggggtcctgttaccagccccaaacctgagagaatcaggagagagagaagttactggaagttgaaggccaggccacctgacagggaccatccctttagtataggtgcttaactaacctgcggtgacgtggcagagagagccataggaatcaatccttgctcctgttctctttctactctatggtcttctgctggagtcttctgttggtcaaacccaactggaagctaaaggggaaggtagccgcattaataagggctgttaagctcttgaggttcaaagctgggtaactaaggatagagaaaatttggagggagaaaagaaaatatcctgcacactctgatgtatcttgaatttatgtttttaggattcatataggatgaagattaatttcacatatttccaagttccaaatcaatacttacaacactatctgttgagcttgactttccatattactttctgaaccccttcgaaattattatgcataatagagtatgttctggagtatgtggtctgggatatgtttttcactgttttgtagtagttttataaaatgcttatttgattggataagactttcctatatttttttccagatttaagagtttcttttagcatttaatatagatctagatgattaagtgttttcaaactatataaaaaaataacttgtttctctgctgtgtgttgtacttttacaaatatgtggagcattgtatctagtgtgttataggcataggtaaacagtaaagtatggctgaataaatgaatatacatttatttaagaatatattgaagtatatatgttcaaaaatactagaataaagcaatgtatactacagttaagattggaagacattacatgacatttacttaaataaagacagatttatacacggaaataacaggatgaatggttctcatgtaaataggaaagaccaaacaaagtgtttactgatacacttgatattattaaatacatcatataaaagattcttaccagaatgtaaaaggggacacatgtaaattggatttcatatccagatacaagggtacctcaaggtgtctgggcacttctgccagtatcagctccagagagaattcaggtactaggtgtctagtacaggactgctccaagatgcagaagggattctgaacttctcaggggaagggggatgccttcaaagcttctgttttatctatctaggtcatttctattactcccctcaactccttatcttattgaattatctctcttatccacctttaaaaatttagcttatgtttataccacttaatcttttcttttacaaattctttctcaatctgcagtctatgtcctcagtgttcctataaattcttgggctggtggcatcaccatatcatcatcctcctcatcatcatcacagttgtgatcaccatcagaggctgatatttgttcaaattactatgtaccaggtatttggctaaataatttatatgagttatctcatttaatttttacaatgaagtagatattataagtattcctgatttagagatacacattgcatactgtttataatctgttcgactcatcttcctctctcaacagtaagttcattgaggccttcagtacatcctttatcttgtatctttatatccctggccttaagaatagtgatcagtacatggagttatactccaaatatttgaatgaatgttggtttagtctattttgatttaatttctagacatagattttatatgatcatttaaaaatagagtgacactttgcttcctatgcaaagccacaacatttctggaacaataatttattttattaaatccactaaaatatttgtcaaattaaaataaaatccctcttgggttttagttctctgttctctatgtgtatttaattcaaattggatgaaagactgatgatcatggatttctgctattgaagaaaatggaataaaagacttcttggcaaaacagtcagttttttaacttgcaaattaaattatagtgtagatttgctatcttgcccccattaacttcttgccctctttggctatctgagtcccgtggggatcagatttcccgtagcccagtataacatgctattgatcaccccttctgctttgccactttcaccttccagtacaaattggcctgtgtcaagtggaggaggaacgtggagggggaagataattaatttaccctcacattgaaattagatgcattctaaaaggaggcaatcatctgggcttggatccctgaggatctaccaattttgggttgtaaattcctcagctaacttattctaaagtatcaggagcataagtaaatacatttttcatacatctgtgtgtactggggtgaaaaggattggatggtaccctgaagtagaacctagcagtgaccttttcaaagtttttacacagttttagtcacatggtgtcttgaagttgaaattatgtactctcaaaatattggaaacttctttgaaaccatggaaacagcatgtgagatgggggatgactggacagcagaataagaccttcctattatgactattgttctttcactatgaatatctaaaagtgtatcttcataagtcactttcttctagttatagctttgagaacatcagtgcttttagaatcaaagatattgtcacaaaaggaagcgcaagccatggaactgtttataatatgattataaacaattctttctctaatacttatagttctgctttcatgctaaataatgtatttgaagatttgagtcagtaatcttcctaagcagagtgacaggagcctccaaggcatatatacaaggctgtttcactattctgcagcatttcagagtgcctgttatttaacgcaatacagataaattaacatgcaataaagcttccagtagtgatactaatttacaacaatggtagaacaaaaatgttgttaataattgtaattcttccagagggtttacttctcatttcactctattatggcagtgaaaatgtgtttagggagtaacagagtaccgttctccagaacccagtagcagtcctcttaacgttatacgtgtggtgaatccctaaaatttaaaatactccctgaacttttctttttcttttttttttttgttgttgttgttgctgttgttgttgttgttgtgtctctgccaagttttggaatcaagatgatgctggcctcacagaatgagttagggaggagtttctcctgaattttttgcagtgctttcagtaggaatggtattagctcttctttatacagatgataaaattaagttctgaatccatctggtcccaggcttttttttgtttggcaggctttttattactgattcaatttcagtactcattattggccagttcagggattccattgcttcctggttcagtcttgggaggttatatgtgtccaggaattaatcaattcttctaggtttctagcttgtgtccatagtggtgttcatagtagtttctgaggggtttttttttttcctgtggggtcagtggtaacatcccgtttgtcatttttgattgcgtttattttggatcttctgttttctttattagtatagctagtggtctatctatcttaataatttttttcagaaaacaaactccaggatttgctgatcttttgtatggttttcacttctcaatttccttcatttcagctttgattttggttacttcttgtcttctgctagctttggggttggtttgctcttgtttctctaattcctgtcgttgtgatgttacagcggtaatttgagatctttctaactttttgatgtgggggtttagtgttataaacttccttcttaacactgccttagctgtaggactgggcaaaaatttcatgtcaaagacaaaaacaaagcttgacaaatgggacctaattaaactaagggacttcggcacagcgaaagaaactatcaacagagtaaacagtctaccaaatgggagaaaatatttgcaaattatgcatacaacaaacgtctaatatccagaatctataaggaatttaaacaaattcacaagcaaaacataaacaacccaattaaaaactgggcaaatgacatgaacagacacttttcagaagaagacatacacatggtccataagcatatgcaataatgctcaacatcactaagcattagataaatgcaaaccaaaaccacagtgagatatcatctcacaccagtcaaaatggctattactgaaaagtcagaaaatagcagatgctggtgcagttacagagaaaatggaatgcttatacgctgctggtaggaatataagttagttcagcccttgtggaaagcagtttggcaatttttgaaagaacttaaaacagaattaccatttgatccagttatcccatgactcagtatatacccaaagaaatataaaatgttctaccttaaagacacatgcatgcatgtgttcactgcagcattatccacaatagcaaagacgtggatcaacttaaatgcccatagttgatagactggataaagaaaatacggtacacatacaccgtgaaacactatgcagccataaaaaatgaataagatcatgttctttgcaggaatgtggatggagcttgaagtcattatcctaagtgaactaacattgaaaaagaaaaccaactactgcatgtcctcacttgtatgtgggagctaaacattgagtacatatgcatgcaaagaagggaacaagagacatcaaggcctacctggtggtggagggtgggaggaggatgaggacggaaaaactgccttatcagttactgggtttattacctgggtgacgaaataatctttacctcaaacccctgagacatgcaacttacctgtgtaacaaacctgcacatgtacccctgaagctaaaataaaagttaaagataaaaaataaaaaaagaaaatactccttgagaatgatgtgggcagtagggaaaaaatttgggttcgttattgaaaagcaataatttatgcataaggagaccccaattgttttgatcttgtatctaagttatgtttatctcagtgaattcttggcctaatgacctttctattcctcaattaacacatttagtaaggattatagtattggtcaacctctccatttggaagaaagtggaatgcatagatgaatttgtcttagatgagcagcttattaatttagagtaaaagatatgtcacaaccaattctaggactaggacattttcattgctgtcactcataggttatttaaaaggtgctaaaaaactttgaaaagtgaagcaacttgtattaaaatctgaattagttcaggtgaccttcagaaaccaatcactttaaatcacatttctaccttgctgtgataaaaaaatctgcatgtaatgggaaaatttaatcactaataacagatatttttagctatataaatcagttcaaagagcaataattgagcattgctgtgtaccaggcatattgaaggtaatcaaaataaagaaaacttagtgtctgatcttaggcattattatttaagtaaacaagctggataaatcttacttcaaggagaggactctaggaaagccttttttttttttttttttttttttcaaataaatggagtatgactggctttctggctgccagagaggaggatagtaaatggagattttgctcagtgttcctatgataggttagttgggtttgtgtgggctaacatatacctccaaaatactggggagcacattctgatcagtccaatagtcagcaatgttacacagagaggtccttctgcttgatgtgatgattccttctttttcaaaccattgtcaacttttctctggggccaacatagcctggcgacaggaaacagcatactaaatcctgccactgtgactgaacgtggagatagagaaatgcttcgtaggaaacccagatgcaaaggtgtttgctttcacaatttctagaggaagaagttgactgatcaactgaaactacccaatttgcttaatcttttgaattttgttcttcttatgctttcgataactacattaaacaaggttaaacatctctaaccacctgagtatgaaaatgagaaggggctgggtgcagtggctaacgcctataatcccagcactttgggaggcctaggcaggtgggtctcctaaggtcaggagttcgagaccagcctagccaacatggtgaaacctcatctctactaaaaatacaaaaattagacaggcatggtggcaggtgcctgtaatcccagcttctcaggaggctgaggcaggagaattgcttgaatctgggaggtggaggtcgcagtgagccaagattgcaccactgcactccagcctgggcaccagagtgatactctgtttcaaaaaaaaaaaaaaaaaaggaaagaaaatgagaaggatgggaactttgtcatatctctctttatcaccagtgtttggcaaagtgcctggcccatagcagtgttcagtaaatgtatgataaaagtatgaaagaaagaataaatgaatgaatgaatgaagcctgatttgatctaagcccctttaaattccatgtataaataagattagctttttttacctccttcagcagaaaagaccaatgaatacaatcactaattgaagttctctttgtttgccaactttttaattaattgaaattagtatgactccttgtcctctcagtatcttgaacaattgttggcatataatagtgctaattgcttgcataaatagatgaatgctctggtgaaagtagacactttcatcatttccaatccctacactctaaatcctgacctattatttatatttaagtcccttattttctatgaaggctcacctcatctcattctttaacacagtggttctccttcccttggaccttgtgtaaactatcttttttatattttttattggcatctagaaatgacggtgatttaccttttctgcttctgggaatttatcattaaggcaaattttaaaatactgggcaagttcttttgaaagatgtttattgcattgttatttttaagagtgaagctgctataccttgcttcaatagcttaagagtacaaagtaagataaaatcttttaacttcacatccaacgcatctgagctgctatcctgctttctcttcccagagttcctcttccaagttgaggacaaggtgtccaggcatatttattgagcccataaaagttgttattataacttcatggaaaaagatctgtaaaatctattcacttcatcaaaagacttgttctctgtagctgttagtgttgtcaccatgatacggaattacttctgaaaaaaggaagttcaaaattatggccttgaccattgctggaatcaccatggtaaacaaggaacccagctgttaccaacttggcaattgtttctttgtgtgcagggccagaagatacttttccttcccaggtgacattattgtatgcttgcttcataccaaaatatacatgggctcccaaatgttacaattgttagtgactagctcattcagtgcatgcacctggctctttttcccaaggcacaccatagtggctgcatactgaggggcttcagcctcagccaaatgttgcataaacagctctttcttacaaaattctagagctcgaggttggtccaaagtttacatattttttcaaatgagttttctcttaggggcgcctgtttctttcccatgatctggcttcacatagattctgatagagttaagcatcctaaggaaaaggctcttcttcttttagaaatttccttgactgtatataactctttagggcagctggctttgtgggagaggagcattgcttaattccatcaactacctgtattttaggtcctagacacttatatattaaaaaaaatctgcaatagtcttagatagatgcatgctgctttatgttgtaaactgaagcgtcattcattttaccctctccaaaccaaggttctttccaaggtaactgatatctttaccaggaaactactaacaacttttacacaatattttcctcactgaaatgttgtaggtagcctcacttgggacattgctacactagtatacaaaatggaaacaattcaaaggtccaaaaataggatcttaagcatgtaaagtggttggtacacttattcaatttgatattatgcaagcattaaaattaaagttatgaagactttataatgatattaaaaatgctatgagttactaagtgatagaagcagaggttaagtcacaaatctgtatacatttcactatctattccaagatacataatgtaaccactttgacgtatttttaatttttggaagtccattactagaaagtcctggattgatcaaatgcacacacaaaatctagagaatgacgtaatacagttcctggcttttcacctcaaatcacttttaggtccattatgagtccgtttggatggagatcaagaagtcttttctgtcttgggctgctctgttttcctgttcccttaatgtcccattatcttcactctttggctattcagggttaaacttcttgttcctcttggctcactgaagtgctgtttagtttgccatttttctaaaagctggtgcacgtatgtgtgtgtgtgtgtgtgtgtgtgtgtttatctcaaagacacatctcactcctgccttatggacaagcatccataatacaaacacatttttaaatactaagataatcaacttcttagaatgtcattgttctctttgttttgcttctattttgctaacgtggttggggtctttatggacccttacatttctacaaaaactaatgagataagaaggaagccccatcttcccatatttagtaggggtgggatcagaaaggaatcttaccagaatatttatagtacttttattagatagcaaattgcatttcatttttccatttttccctgatttccaaagtgtatttatgttttatattactttcacgtcaaagaaaaacatgcaagaggaaattatggaaacttagagaatgaaaaaacttttttttttttattgataaggaagttgaattccaggtcaattaaaagaggtatccaaggtaagtgttgatgacaaaacctaaattcttaaaacagctccaccattttctagctttattacatagagaactctgttttcctttccgcacctcagttttctcatttacgaaatgaggctaactggttaggttgtggtttctatgcagtttacccatgatatggcacatgtaaagtgtttagcaccaattctgtcacataatgggtaatggatacatgctatttcccttccctcctggttgtataaattcctggtgcagagccttaccagcataccagcaagaatcccctcttgagtcactgtaattactctgctttattaaacttatatacagtgtcttctgttatgggctaaattgtatccacccaaaatttatatattcaagccctaactcccagtacctcagaatgtgacattggaggtaaggcctttaaaaggtaatgaggggcctgacatggtggctcatgcctgtaatccctgcactttgggaggccgaggtgggcggatctctggaagcaagagttcaagacaagccttgccaacgtggtgaagtcctgttgagaggtgacagcctgctggcagtcctcacagccctcgctcgctctcggcacctcctctgcctgggctcccactttggcggcacttgaggagcccttcagcccaccgctgcactgtgggagcccctttctgggctggccaaggccgaagccggctccctcagcttgcagggaggtgtggagggggaggcgcgagcaggaaccggggctgcgtgcagcgcttgtgggccagctggagttccagatgggcgtgggcttggcgggcccgcactcagagcagcgggccgcaactaggggcttagcacccgggccaccggctgcggaggatgtactgggtcccccagcagtgccggcccaccggtgctgcgctcgatttctcaccgggccttagctgccttcccgcgggtagggctcgggacctgcagcccgccatgcttgagcctcccaccccctccatgagctgtgtgtggcccgagcctccacgatgagcaccgccccctgctccacagcgcccagtcccatcgaccacccaggggctgaggagtatgggcgcatggcacgggactggcaggcagctccacctgcagccccggtgcaggacccactgggtgaagccagctggactcctgagtctggtggggaggtggaggacctttatgtatagctcagggattgtaaatacaccagtgggcactctgtatctagctcaaggtttgtaaacacaccaatcagaaccctgtgtctagctcagggtttgtgaatgcaccaatccacactctgtatctagctactctggtggggccttggagtacctttgtgtggacactctgtatctagctaatctggtggggaggtggagaacctttgtgtctagctcagggattgtaaacgcaccaatcagcgccctgtcaaaacagacctctgggctctaccaatcagcaggatgtgggtggggccagataagagaataaaatcaggctgcccgagccagcagtggcaacccgcttgggtctccttccagactgtggaagctttgttctttctctctttgcaataaatcttgctgctgctcactctttgggtccacactgcctttatgagctgtaacacgcaccgcgaaggtctgcagcttcactcctgaagccagggagaccaggagcccaccgggaggaacgaacaattccagacgcgccaccttaagagctgtaacactcaccgcgaaggtctgcaccttcactcctgagccagcgagaccacgaacccaccagaaggaagaaactctgatcgcatctgaacatcaggaggaacaaactccggacacgccgtcttcaagaactgtaacactcaccgcgagggtcctcggcttcattcttgaagtcagtgagaccaagaaccccccaattccggacacactgtctctactaaaaatatggaattaaccaggcatggtggtgcacctctgtagtcccagctactcgggaggctgaggcacaagaatcccttgaactggggaggcggaggttgcggtgaaccgagattgtgccactgctttccagagtgagactccatctcaaaaataaaataaagtaaaatattaaaaaataaaataaaaggtgattaggttaaaatgaaggcattagggtggacactaatacattctgactggtgcccttataaaagcagaaaatttggtcacagggagagataccaggtagtatgcacagagcagagactataggagaccacagtgagaaggggtccaaaaagagatttctcaggagaaactagacctactgacaccctcatcttggacttccagccttcagagctgaaaaataaagttttggtgtttaagccacccagttcatggtatttttgtaatggcagcccaggcaaactaatacacctttcatctttaaataaaagttagactgcttaaaggaaaatactgcattatactcatttgtaatgatagcaaatgatcaataatttcctgaaaaaactgatttttattaagtgtggaaacattgttttatatttctttgagttctcccatggagacctagctattgaggttattggcaactataatgtgataatgaggattatcagtaatctttttttttccttttgcaaaaagtgagtagaattgtgctttttatgaagtcataggagtaaattcatttagagctgaaaagattattccttattgcctgtacagacataggtagagataattaaatctgtaaatgtaatttctaaaattaagattaatgaccaggaatgtatgattccctcatatgctgatgacctcatgttgtctgaggctaaatgttagggcttctcaatatctttgtattaatgactatgattgagttattttaaatgtagtcaggatacaagattaacttgtctatgttggaagtttgtcttgtatttttcagaggatcaaaaataggcaatcataaaacgataaagtcaaaggatttttttactgagctttaaaaattgcatttgattctcattttttgaattgtgggaaatgtgggaaaaactgagttatcttaattaatttatggaagggacatcaagagatgaaaaagttttgcaaggttttcaacatttgccaagcctaaagctcaaatgcaaagttagcgtaaatgagaaatgctctgaacagtaggttatcaagtttattaatgagaaaaatgcagaaaatagtgcttaaataagtgagaaggctacttctttctgagcagaaatgttgtttgtatatcctttcaacaatgcaggtacgtatatatgcatatatacaaggaatatttttctaatgtctcattatcttaacttgctgaataacctttgaatgttaattaaaacctcagaatctcattcacacatctataaataaaagatattaaataatcttcaacataccttctaactctagaattttatagttttattgtatccagggttatgaataaaagaggacaacagatgcagtgtcacttagggaggctacttgtcacacacattctgctggcaccttaatgacaatctctgcagaaggggcagtgactaacttatgagtttgaacaccaaacctatccttcaaatggtgggagttctatttcctgctgaatcttcaggactagaagaatacttgcaacacggaagacatccaatacatttgtcggataaaggaacagattaatatttcgagtgctttttggattgttatactctattgtggtgtaatttcccatatttttaagggtcatgtttacatatgtctagtcaattatatttcgctagagagctagagaattagagaaacatgatcacttgttgctgctaaactaaactaaatgatctgaaacatcagcaacattttaaagaatcttttgtggtgttcctctcatatagaaaaccagaaaactttgtcttgtctttcaatttcttccttcatatcttctattttcttctcttatttttacccaactctactgttgctagggaaagtatgtattgtctgaatgtaaactctatgaaggcagaggcactggctgtcttttgaatacacctaggacattgcctagcaatgatgatactaaaagatatttgtttaatgaatgaatggtaacatttataaccacagaaagataaaataatgtctggctcactttttactagtaatggggaagggtagcctggaaggaagggagtcatgtatgtatgtacatttataatacatcaagagagatatactgtaatttccattttttttttcaaaaaacaagaactctttgtgtctcattattttcttggtcaagttatagtgagaatgttcatgagaaaaaaaggccaaaatttaaactgctcaaatttctagccattcttttaaaaagcttgatttcaaaagggtatattgtaaattttagccatatggaaaataagaattgaagacaacagaattatcctcagtatgagttgcctcagacatggttcttctagagggtagcttagcaatggccttcccctcaggtaattatcacaacatttctgtgcatgtctgagtgtggtgcacgctttctgtaacttaggagcctgagatagctgaaaagctatgcaagtacaataatcagaatgggaaccagccaggcattctgactcaagagggataaaaaggaaatcagctgcctaatgaggctctttctttaccccctgcccttgtgaaaaatagaggctacagtatttcattatgaatctgtgtgcttcgtttctcaccctaccttggtttgggaatcaaaggacatttctgttaggtctcacccttggagctctcgtccttactcatgccttgaactattattacctctatgcaggtgtcttcccaaatctgtgtttcaagtcacatcttcctcagcccttgtcgtcactgtcctgcattccaactaaacaatttttatttttatatattgcctattttgacgtataggtgcagactttaaaagagtcaaaattatatacaatatttcatttttttctcaaaaagtaaattattaaacttaatgaactggacttttatatttttcttcttagcagatgtgttgcaaaagatcaaacttttttgtttttttagaagtagggagtgtcagagcaacttgctggctttctttttttatttcctaaataaaagcactgagtaagtgtggcatgtacatcactttaatgttgagactgcagagtcatattgaagagatttattctctccttgaattcgactctgaaaatagcttgtactaacatcaggaactttgcatcctcatcttcgtaatcatatggttcctacagtcagatttaagacagagagtttattgcagctgaaaaaattattttaaaatgtgaaagactagttgtttactaagacttttccataatacacgtgaagtttatatccaagaagcatgtttttgatcaagtatatctaggcattatttatatgtttcagaaattcttaaatatttgtgtatatatgtctcagaaattcttaacttttataaactgcaacttagtcattctggttttatatcaagtcttgctgagatatttcctttacctgcccaaatcctagatttaaatgagtttgaaatatatttaatttacacccatctatgttataaaaatatttgaaaggtatatgatccatggtgttgaaactttacttctgcagggaataatgtccttctggagggactttctcacttacaaggtgattttctccaccacggctatcaatccttccttaccatggtagtaatggtggcaaagggaggagctgagtttgtctttttggccttagattatctagatatgcatttcttcttctacagctatagaaaggagatcatctccattgccatttctatactgtaagcattcaagactctggacttatttttgcctaattacatggttcctctctacctcagtatggttgattatgtattctatttccttatgtagtatgtcacactggcatctctccatgaggtaagtgcttttcatctacataaaatgagtcccttttgccatggagtttcaccagaaactgacaacacttgcctatggtttagctgaacaacgtatatatttttatcataaaagatatcttttaaaagtactatatattgaaataggaatcattaaaatttattaaaagagattttagaagagttccatgaagatatttgacaagaatgtttgacagtatactttgggagagaccgaagtaaagaattcctctacataagtttcttgggaacctgaggttttctctcctgtgctatatttagatgtgtggcatgtctaattttctgcttccatgcctcactgttcttctagtgcttatcgtaatccagctaaagtgtcaggccgaagtgtggagaaaacattctgtcctgagtaagccaacttgcagctgtatgaggaccctctgtgccagtcaccgtcatcctaccattcacccatgcattcctgacattctaaacagaagtcgataaatgttttctcagtaaagtaattctgaaaacttaattctaaatgttgtattaacttagcaagacttgaagtgcctggaatgctggccatgtaacttggttgatcagagggtaccagctaccagttcaatttaaataaatgcagttcagttcaagtcaggccaatttggttcaattaaactcaattcaatacacacctattgagcacctgcatggccaaatactgtgttatgttctcagtatatggagacgaataaaatacatttgatgtctgcaatctaacaagcagcgtaagcaaacaaataaaataaactgaatgtggtttaataagtagaataatagaattatctacacaatgctgaagtaaccagtgtatgaagtaattaatttttttaagggggaaaaatgccacggtggacctctattaacttcagtagggatgacaccaggttcaagaggctgaagaagagacccagagccagcaaatgggacatagagttgaagtgaaattacatacaacgtggtaaccagtgatggcaggctagacagaagaactgcattgcatccagaaatggtccagtggcaggggctgggcaggagaaccacagctgcttgcgaaaggcatgcggtttatacagcgttttcacttagcatcctcctcctaacaacctacatttagcaaccttcatttaacccaaaacaaaaggcgtcactctcctgtacagcctgtgttccatgggatggttcaggggttcaggtgttcctcatagataaggaatgggttttgggttggccactcctgaactccttagctaggaactctgaacacacattcaggtatatctcccatacagggtcattctcagggtatgcttaaatttagttattgctatcaggtgtgtctaccatacagggcactatggtgaagggcatctcaacaaatgtttcctgaaagaaattagaaattatacacaaatacgattttgaaagatgaccaaaaatgtgctgagttttagggtgtggtcaagtttagacaaagggaagaacactgaatacactcctccatggtgatggatagactcgtatgcacatgatactaatcttggctattttaatacagttacttattcactgattattttcaggtgcacacattgtttcatccataccatggcaaacacgtactagatcaagcgaagtaaagaaatggattaaggtatcacatagccaagatacttgatatttgatatagcggtgtagttttttcaaagagaagtcatttaaaaatctcatgttttagcctcagctgcttttctctctttcatgacctttcaattctgcctaattattagcactgacacagtgctacctgactagtcagcacacttgctgataaaggtgcatttcttacacatttttttttttttttgcatttcacttcacaggccaagatttattaaccagcgtctttagggaggagtctcatatgaagacttcaatgcttttataaggacatactgtactacatttataaaaaaaagtactataaataatattacaagaggcagtacagctcaggtggctctaaaataagctgagtgcagagtctgtatgatctaagatatatgtcgctccaccacactcagtacaacctagaggttttctgcctttatttcattctctttatccatcaattcagggtcagtttcacaaaagcttaaaatccttcacttttcagtaaaagatacaagaaagggcacctctggctggcatggggaaggacctttccattttatttgatgacatatgattattactttattaagggattgttagaaatgatgatacagatgtctgattgatatcctaggaagattgggaaattaaaaattggacacatatagatttaaagctcagctcgtcactcaatagctgtgactttgggtgataaggttactttctctgggcctggcacagtggctcaagcctgtaatcccagcactttgggaggccgaggcgggccgatcacaaggtcgggagattgagaccatcctggcgaacatggtgaaaccccgtctctactaaaaatacaaaaattagccaggcctggtggagggtacctgtagtcccagctactagggaggctgaggcaggagaatggtgtgaacctgggaggtggagcttgcagtgagctgagatcatgccactgcactccagcctgggcgacagagggagactccgtctcaaaaaaaaaaaaaaaaaaaaaaagaaaaaaaagattactttctctgatacttggttttcccatctataagatgagactaagaataacctcagggcaggatgttgtgaagatacactgaaataatatgtgtgtgtaaagagctgaacaatatctgttgcacaaaatacatgctcattaaatggaggctatcataaaaataaaaaagtgggagcaaaatgtcacacacaaagttccagtcacatcagtgaatgttctgtttcccaagcaaatgaatgtagcatactttctggggagtcaaattctcatttccaaatgggtggcatttcaactctcaatcctgtgtgttaaattgacagtaaaagtagagcaaaacttgacttttttagaaaaaatatctgtgaaaggatttttttttcagtaaaacagaatgtggcaaaagtttttggttgttatatgaaaggtaactactaagagaaggcaggaagatttataagacataagtaacaatctttcagaacagtaatagtatgttacaaacacaaataagagaagccattacaaaaatggaaaaggatgttacttttcatgtctggggcatgtttttaggggaacatgttggtatgagtgttcagcatgaatatctgtgattatatgagtatgctgtgattacctgactgatagtaagcctgctaatgcagttgatgggagtggagagtgctggtgtggagaggtgggggatgaaattgcagcctccgagacaatatgtttttatcctgctgtacatttccacaaagtcaaataactggtgatattggactctggaaaaagaaccagtgactttctaagccaacaatcccaacttcaggcttacaaaattgtatgtagtccttggaacagccatcaaagtcattccatgaataaaaggggctcccattgccaataagtttggaaatgctgaatattatgtctcaacacactacatgttggcatattaaacactctgagaagtcctgccatagaaaggaactaattagcgaatagtttttcattttttttcttctgagacagggtctagctctgttgccctggctggtgtataatggcatgatcgtggctcactgcagccttgacctcccagtctaaagtaatcctcccacctcagcctcctgagtagtcaagattacaggtgcacaccaccatacatggataattttttatttgtagagatggggatcttaccatattgcccaggttggctggtcttgaattcctggcctcgagcaatccttccaccttagcctcccaaaatgctggtattacaagtgtgagccactgggcctggcctttaacaaatagtttgatgatttcctaattgtaacactgtatccctttatcaagaaacttttacaaacatctttttgagctagtgacctagaaagcacactttgaaaaatcctgaatttggcaaccaggaaaaaatatagaattatacatatggtaatatacagtgagctgttttggggagatgaacatttataattttatatctcctaaaatgtacaccttatgctgtgaaggatgtagtggaatcttttggttctagcttacgactagctgaaaaaaaatttttgtactatcacattaagcaagaaccagttatttcatagttttattttgcacattaaggcacaggagataaatcttactgtctgacgaaatccttttcaagttttgttctacagtttccaagtcctgatgcagctttcttcttaagtaaaactatttccttaatttgagcaattcgccaggttgaagaaaacttgtaagcactgttagtacttgtcaggagtaaatgggactctagagagttctttgaaataggaaacatttgaacagaatatcatcttgctttcagctgtttgtatagatgcaatttctgcaattctatacctcacagctctaatttttcttcttctgtgtctcaggcttccatcaataatccttccactgaaacacacttgacaagagaggtagagtagacgcccttgcaatatcttctgaatgtcactcagcagtgatttgtaatcgggtttatatattttaaggagaaaaatgtaaaactaaatagaagattcaatccatatgaatccagattggacaagggtactcttagtaaaattttataaaatcaccttttgattggacagtggaaattttgtaaaacagaaaaaaaaatcagtgattttggattcctattgtggatctatatctacaaaataaaatcgtctggtaatacaccttattgtatgaatgaatgggctgttttgaggaccagttacatccaccttgtactgtgatttttaatacatgtttctaagctagaacctctataatacagttgttaccttgtctcgtaacatcagtattagaataaaggtcctactctgtgtgtatactttaggtaagcaacaagattcctcctgctgctcttctgaaattcagggatatctggactagagcctaaagtcctttgttatttgaaaattaagtttgaaaacccaataaaaatattctttctggacagcaaaaaatattacattaatttcatttgatttggatctttctgtttacttagtgaaagctcttaaaagcctattctgattattttggaacaaaattttaaaaaattaagtacatttttaaagtgatgccatatagttctctctcagtttatacagggactatatactcatattaagttttcatcatttgtttatggaatagcattagaactttctgggaaaaaatatatatcctggaccgtgtatctcaatttcaatatatttatgtgtcctgtgtgtgtttagtcacacaatgaaagaatagcctatgtaaagcattgtctggaagaaggggtgatgagtttataataatagcctttgactaaatataaggattagatgagtttggtatgtgaccataggctatcgttctactttctctggagcaaattgcactgtttgaggaattcctgtaagctcataattatagtagataagcattttacaatttcacatgaagatctaaattgactaattgaaagaggttactttaaaagtggtgaaagtgatgagacctatacgcccatttaacatgaactctaatttccctctgttgaatttgtgaatttacagtcattcttctccctttcattcaactcttcaggggtcaaagatttctaccctgttggaagaagccactgttgaagtgtgaaaggctactctgctttctgcgtccatttaacctttggcctgccctaaagagccagccaagtgtcaatcagggctgattgggcacctgtgcctggaaacaagacagagaaatttagctcttccaggtcatcaaaccatctccagatggcaaagaacttctgaagttatgaacctaacttgcttgtgatgcaaattagtgacctagggtgagatgcttcattaatgcttactcctgtgagcctccaaggtgtcagaagttggactgcttactctcacattttttttttgctgtgtaatgtgcattaaaataatttatattcatagagatggtccaataaattgcatatggctagttaataagctgctaaagcagagaagaaaattagatttcatttagaagaaaacaatatttggctttccccatggaaatatgtgaaaaagctttagaaaattctgttaacattgaggtctcagaagagactgtgattaaaaataataaaaagaaaaaaatatgaatttctatccagatcactatttttttatccaagtgatgagaaaaattatgcaaacccatgcatttgccctgagttatgattgtattatattaacctcagctgacaatatcctatgctagctttggcttacttagaattctgcctcttgggtataaacacacatctgaaattgactcagctcatttctttcttgctggggtcactttactggttactcccaactactgaacttattttatgtgttttcttttttacaatattacattctaaaatttttatcacctaagaattcctctctgatgattttattactcaattcaagatctataattacgaccaaatctcacagataacaagatgctaagatgggctaataaggttttgcttcttttactttattcaaggtaaagtactggttagagtgaacactgcccagtcatttgcaagcaatgttgggactatcaggagtggcttgtattttcccataaactatcctagtgcagtagaaatgcctgacagtacttgatggctggtatctttggatctgagtagttcagatagaaaaagcaattatcttagcaatgtctgagaaagatgtttttgaaatttcattactaaaaataacaggtgctaataataaatataaaacagtaaatatttgagtatctactttgtgttcaatgccatgtggatcattttttcagtagtattgcttttcagcagaacacattaggtcatttggtaccagagtgtgtaaccatggagtctattttctataaaataggagaaagcttactctctgctcaaattgactgaaaagctactgccagtggatatttgactcttgtagaattattctttatagtgcatcaggtggacaaaaaagaaaggattcacagagaaaaggtatgaattattacatgagttttagtgcagtataactgttggatgattctttattctagttatgggtagtgctttgaaagattaatttaagactagtcctctccagaagttcatgatagtagaagattaggctagattctataaataaattttttatataattataaaaattaacatttatactttagaaattataaaaataatttaatttgaatccatgagtgaattcaatatgttatcagatacatgtttcttttcatttttcctgatataataattataagtagggtattctctaattgttatgactgaactatctgattctgatgctgatgcaatttctacattaatgtaatcaaatagatgtaccaaactaagtggaactttcggtatactggaatgcttattgtattgtcagacattttggtattaaaccattttttatctatgatgaaatactacttggccatggtgctattctctcaagttcattctcacttacttgtcatactttccttcatgtccttcaataatatgagctatctgagagggcatcccgtgtagtcacattactttatgtaattgcctcacctttttcttcagattacaacaaagcatttgccgtgctttatcgctaaagtcataattattttccatgtcatagatctttattattctccaaagtccactttttctgttttaaatgaaaccaaatctttccaaaaatttatgcttatagaaattcttcagaatgtatattctgtaatttgatttaaagtatacaaaaattcagattatctatatatttaattcaaacttttaaaattctgattgtctgtctgcttccagtaaaagtgtttcttcagctgtcataatccagaaatatggcaatgttcaccaatctatagagaaattaaaagtatctgagcattcattgttgttttaattttcattttcctgatgacatatgatgtggagcatccttttatatgcttatttgttatctgtatatcttattttagtgaggtgtctcctaaggtttttggcacattttaaaatcagattgtttgtgtccttattgttgagtgttaagattatttgtatattttcgataacaatcctttgtttgataagtgttttgcaaatatttctcccagtcaatggcttatctttccattcccttgacagtgtctttcacaaatttatactttaatgaagttcagcttatcagtttttttttcatagatcatgcctttagtgttgcaactaaaaaaatcaatgccaaacccaaggtcatctacattttctcctgtgttctggaagttttatagtttttcagtttacatgtaggtagaggatctattttgacttaatttctgtgaaaggtgtaaagtttctgtctagttttattgtttttacatgtggatgtcctgtccagcaccatttgttgaaaagataatccattgtattgcctttcctcctttgtcaaagatcatttgactatgtttatgtggatttatttctggactctctataatgttctgtggatctatttatctattcttttgccattgccatacttttttgattattgaaactttctagtacatctcaaagtcaggtagtgttagtctttcaactttgttattttccttcaacattgtattggctattctgggcattttgtctttccatagaaactatagaaccagtttgtcaatatacaaaaatgactttctgtgatttttatttgaattgtattgaatctatagataagattgagttgatatcttcacaatattgagtctttctgtcaatggacatggaatatctcttcatttatttaattctttgatctctttaataagaatttgtggttttcctcacatagatcttataaatattttgttgatttattcctacatattttattttctgggatgatagtgtaagtagtattcagttttttatttaaaattccacttgctcattgctagtatatagaaaaatgcttggcctttatgtattaacctgtttatcctgcaaccttgttatagtcactttgtcagttccagtattttctttctggattctttcaatttttctacatagatggttatgttatctatgattaaagacagttttctttcttttttttcaatctgtgtacctttttttccttttcctgtcttattgcataagataggacttccagtaccttgctgaaaagtggtgatgagaggagaaatccttgccttatctctgatgttagtgagaaaggagtttctcactgttaaatgtgatgttagtgtgtaatgtagaaataggtgtcagatgctttttctgtatctattaatttgatcaggtgatttttcttttttaacctgttgatatgacagattgtattaattgatttccaaatgtaagcagtcttgaatacctgcaaagtggtggtagtgtgtaattatttttgtacattgttggattacatttggtaatattttgttgagaatttttgcatcttttttcatgaaagatcttggtctgtagttttcttgtactgtcctcatctgctattagggtaatattggcttaatggaatgagttagaaagtattctctctggttatatcttctgaaagagattgtagagaactgacataattttttccttaaatccttggctgaattcaccgtggacccatctgggtcgggggctatctattggaaggatattaattattgatttaatttctttctttctttctctttctttctttctttctttctttctttctttctttctttctttctttctttctttctatttttttttttttttttgagctggagtttcactcttgtaggccaggctggagtgcaatggtgcaatctctgctcacctcaacttccacctcccaggtttaagcgattctcctgccttagcctccagagtagctgggactacaggtgcccaccaccatgcctggctaatttttgtaattttttttttggtagagatggggtttcaccatgttgaccaggctggtctagaactgctggcctcaagtgatctgcctgcctcggtctctcaaagtgctgggattacaagtgtgagccactgtgcctggctgagttttctttataaagatagacctattcggattgcctatctcttcttgtgggagttttggcagattgtctctttcaagaaattgactcatttcatctaggttatcaagtttgtgggtgtagaatttttcatagtattccgttattatccttttgatgtccatgggatgtgtaatgatgtctcttctttcatttctgacattattataatagtaattttcgtcctctctttttcttttgttagttagcctaggtagaggcttatccattttactgatcttttaaaaagaccaaactttttgagttttgttgatttttttgattttctgtttttaattatatttatttctgttctaattttcattatttctcttattccgtttgctttggatttaatttgctcttctttttctagtttctaaagtggaagctcaggtgactggttttatattcttcctattgtatgcttttggtgctatacatttctctctaacgaagcactggtggctcatgcgtgtaatcctaccattttgagagggtgaggcaggaggattacttgaagacaggaattcaagagcagccttggtaacaaagcaacacaccatctctacaaagaaaaaaaaaataataataaaaattagccattcctggcatggtggtgcacatctctagtgttcctgctactcaggagggtgagatgggaggatcccttaagcccaggagatgaatgttgcagtgagttatgatcaggccactgcaacctaccttggctgacagggtgagaccatctcaagaaaaaaaaaaaagatttcatctaatcactgcttttcttgtatgctagaaattttgataagctgcatttgttttttttgtttgtttgttttcagttaggtgcatttaaaattctcccttgttatttcttctttggtccatatgttacttagaagcatgttgtttaatctctgagtattttgggatttttcagctatctttctgttattgatttctagttaattccattgtgatctgagagaaggcattgtattattttatttattcttcttaatttcttaaagtgtgttttaaggcccagaacatggtttattttggtgaacgttccgtgtaagcctcagaaaaatatatattctattgttgtatgaagtagtctataggtgtcaattatacgcagttgatttataatgttgttaatttcagctatgttcttactgatatccttcctgctggatccatccatttctcagggaggggtgtttaaggtcacttatatataaaattttaccagatatagattgctcaaacaaggaagttaattaatgcactgaatcattgaatcaagataaagaaatataacaatggtttgtgatgattggatgaaaatagcagcctcaaatgtaatggcaataaacataatcctgatttttcagaagaattagcatggcaacattttacctaaaaaattatgaacattttattggcctacaacattgtttaatgtaagggccagaattgtgagtccatttctcaatatatgtagtcaactttatagtgtttagatcagtgcattattaattccattattttatagataatttgaatctcattaatttcttcagtttttcaaaaatattaattaggcacctggtagggacaaaataaagtctttaagtccttgaatgctttaaagatatgacaaacagcctatcctaaacaaaattactttctagcaggagctactatacctcactcaaaatacatataatagcagattaataagttttgagtctatgaaaagacataaagatatagaaaagctgctgttgccttttacatgaaggagagattacttccagctatatgcatcagagatgacttttatcagaaaagcagcattttactttgtgttgaaaattttaaaaattggatatgagggatggaaggcaggacattctagacaacatggtggaataataaaggatatgcttcagaatcagaaagatgccttgccaaagtcttggtgtcattaaccagctggcagtcattatttgactcagattttaagaacacgtcttaaatcaccatcacttaatcctatcgttccacattatttctttacatctaaaatcaatgagaatctttagaaggaagaacctataaactctaagtataatgtagtgttttaaaaaactgtaaaaacctttatttctaagtttgatttagtaatcatcttgctttctgtttagaaaagctagaaacatcactaccttctttatagatgacaatgatatatcttatgtggttaaacattaccaagtagttgccttaatcttggagaggaataaaggtaattaaaaaattaataaagctgtcaaatttttgtaatgagaacccctctattttttaatgtctcctgtattattacaagatgatcatatattttactggggattagagaaataattattttctgccttattaatcctgcatagttggatgtaatcgtgatgtaataaatacgttaaaggaggttctcccagtttcttttctataaagttatcttagttacaaatgctttttgacatttgcattattatagcatcttttttcctaatacaggcttttttattagggagggggaaattttaaatttcctttataaaatctctctgtcctcaatgtgagatgcccacagtaagcaaacataccttatatccacattggcttcgtgaaacatgagtcacggttatagcaaaactcgctaaaaatggagcctataaatttataggctatataaattggagcctatatatattaaaatggagcctataaatttatcctttataaatttaaattaggaatatattttctctggcttaaacagggaggaagaagaaaagagggtaaaactcagtgctgtccatgcatgaagttagctttggtaattgacttttgtggtactaagatactaaactacatagcttcactaaatgtgaggctggaatgagaagggtatgcagtaattagttactttgactttttttcacatagcttagcatttattactgtttctctcattgctctgacctaaatcaatgacctttaaaatgaaatatatttcattgagtctggtataacccctaccctttctatgattattatacataatttttttttaaattaagtgactcaaaatatggaagacgcccatccatggaagaggggctgtttttaactttactgaaacatcaagaagtagtcattatgataaaatgtgtgcctcatttaacttaagaaatcaaatgtgacatttatgatcaaggcgagagtaaaaaactcatttattatacatttagttagatataatttattatttaaccaaagtttttgggcggatggtcaaataaactaaaagaaaaaatgaaaactctgagaggaaaggaaaaaaaaaagattcttccagtagaaatgatcttttgctctcatgttgccataagacatttaggtttggaacaggttggtttttaaaaagcagttgttacagatgaagatcaacctgtagtcattttaaaatcatctttacaggctatatcagctaaagtgcacttcagttgtttcccccctcaatggtttaatgctagacttacaaaatccgaatccttgaaaattaggtcccaggatttttaacatcatcctcagtatattaaaaaactcagaaattttaaaaaccactgatttaaatggattattttttcttaaggaaaaaatcttattggttttattttacacaggataatgaggtcttttatgttttatatttaattcttgaatgcttttatataatgagaacacggagaacttttactagaatttttgtgtgtgaacatcaaatagatgcataaattcaagttatcatatgttcctacctgctcaaaactgtagccatgaaaataatgaataacaatggaaaagcaagtggacctagaagatttcaaacttaagataaatattgctgagaacaagaaaaaaaaaaatagaagagttacaacatgaatggggccaaagccatagagattctggtctcttgatcccatatagacagtggcagtaggaagtgtgatacatttagggtaaaggggactaaaagttctctacacaggaaggaaggaagaaaagaggcacatgagaaataagtttactgcttgaaattaaggcctgggatgggaatttctttcaggtaaaggaaactaaaacaaagcaaagctcatgtcagatcattgcttgcagctacagcatttagcaagctgtttttccggtagggaggatttatgtacataccacttcaagatgagaaactaaaaacaattccaaaggtggatgactgaatctgtgatattctcagctcaccagggacagaaggatgttgttaaatgtcattataagacctggtttcagacctgaggttggggctgggaagaagcaattacaaagttactggagaggaagggatgaacacagagggcaaaggaagagatagatggatagattattgagaatgcattcacaagtctcccacaatagtccagatcacatgaagatggctaatgctaaaacacaatcagaattaaatgttgaatttgttctacatgaaattaattttatggaacagtctgaggaaaagtttaaaatagacgtaaaatgacaatgagctcaaaacaccttccattttaaaagggtactaaattataaagcaaaatgtagaaataaaaacaaaaataggtgaatattagaaagaaccaattacaaatcttgggtattaaaaaatcagtaaaatattaattaaaaaatttaatagatgggataaattcaaaaatgtctatatatatatatatatttagtgaattgaaagtggtactgaggaaaacattcagaattcaggagaaaaacaagtagtggaaagtttgaaaaaacgctgtacaaacgctgtcatattggattagggtcaccctaatgaccttgctttaacttcattactactgtaaaaaccctccctatctccaaatatagttctcaggtactagggttgtggattttaacatgaatttttgggagacacaattcagcctataacagcatggaaaatatttaaaatgctgtaaggatacacagaaatgagaatttttagtacagtggtcattagaaatgctaactggcaaagccatgttggagagcaatttgaaaataatatgtaaatttaatgatgtatttatctttcatccagtaattctacttttagatatttataaaaagttttgcacatgggcacaagttagtatgtataagaatgttctttaagatggagggatatactacatcactcaacaaaaacaaagctgttatacaaaaacataatgctagctgaaaaggtaagttgcagtgttataaacatattataatatccatataacaaattttaaaacatgacaaggcacagtggttcatgcctgtaatgctaacactttgggagggcaaagcacgaggattgcttgagcccaggagttcgagaccagcctgggcaatatagcaagacttcacctacagtaaaaattaaaaaaaaaaatttagccaggcatgatggtgcacacctgtagtcctggctacctgggaggctgaggttggaggatagcttgagcctgagaggttgaggctgcagtgagccatgatcacaccactgcactctagcctgggtgacaagagtgagaccgtattaaaaaaaaattaaaaatatgttactttctctattgttattctacaagtatgtagaatagctcaaaatatgcatacttttgcaaatactaagttcaaggtattatttgcatcctaagatgaaagaggtgagggaatttgaatcatggatgaataccagttgtggtagggagaataatggactcccatatatcaactatgtgcccattctaaccgccagaacctgtggctgtcacgttacatagcaaagggaaataaagttggcaaatgaaattaaggttgctaattaactgaccttaagatgaagagattatcctggagtatttcagtaggcataacataattaacaaaggtccttaaaagtgaaagggggaggcagaagagtcagcatcaatcagagtgacacaatgtgtaaaagacttgactggccattgctggctttgaaaaggaaaggggccttgagccagggaatgcaggcagtctctggaagttgggtaaggtaagaaaacagattatcccctggagtcttcagaaggaacacagccgcacggagaccttgattttaggcaagttagatgcttctctgatttctgtgttattttgggccatgaagttttagataattcgttacagcaacaatagaaaactaataggagttcatttgtttctgtaacactttattacttaaaaaaatacaacttcatcatataaatcttatgttttctttcctattacatcagcttgcacaatgtcattttcttattaatctccaatttataggggcttcatagtgacagctagaagttggagtaagatgaccagctggccctgtggaacatccaatgcctggggtgtttgaaatcttgtggatactttggatagtgtccagacaaatagcagttatgattacatccttacactgttaaatgttcagtgccacagcttgctttggtctccgaagggatcaacaattttcttatgtggcaaattattattattttatttagcatatttctacaattacgttcggctacaaaatattcatcattaggggcagatatgataaagctattaactgctgtcaagaaacatggatagttttcttaggaaagaaaaaagaacgataaagatgttcacaaattggttctttccgttctgctgcaactcctgtctttgtgaacgccaaatatagctaatggtccaccacatattgcttaggcactaacatctaatttctggttatgctttatttcccataatactttatatttccaataccactttgtttttcttccttcaactctctgccatccaagtcttctacttgaataattttcaagaaattttgggttgtaaacaattggtagtttcttccataattatctttcccgtaaccaaatgtattttaaattgctttcaggataagtttatttatgttttcatcttaatgtactcttgtggaccctgttaaccttaaacatttgcttgacatctggcatttttttaagtctctaagtatttacctcttaatctttgccttttgctatgaatatatatgtctgagccttcatattataatactcagcgggttctttatctgatcctgttgaggacacaggcaattttttccaatgaggaaaaagggcacaatgaaatctcatgactttctttttactgaaggagagaatattttgttctgtattaccagaaaatgaaaagaaggaaacttgaaaagaccactcctagtattttcctaattttactcatagtaagttggagaatggggacaatatttttaaagaagatagttgagaaacattatttggtaagtgctctaacatgaaattaagacgactgcttcttttattcggtgaaaattcctgtagagcgtagaatagtgctgtaaatttccccctccttccctttctctcttccttcctttctccttttcttcttcctctcttcccctctccctcctcccctcctgctctcctttccttcttcttccttcctcctttctctctccctccttatttcttttcctctccctctttatattttcttccttctttccttcctgccttcctgccttctttcctcactttcccttttaattttctttctcatctctttcagaccatttccctttttcacacatgccctttgtttcttaaatctcttaagtccacctttatttttcttctgtttagcaatctctcccattctttttgctatcttgtttctgtactcacatacttttccttataaccttcatatgatttatttccaggctatttctacggtaacaatactggttcaggcctaaagcactacagaggcacagtgaagtggtttatgtcatcctttataatgcaaatccagatataacagagttgttgattgcctaccatcttccccccagccctccacctcctctatctatgagtatggggcaaagtcatatctttccaaatggggtagaggtgggggtggtgtttgtaggtcaagagggcgagcttcaggcaacatatttagggtagtgggagaacaggggatgagtcccctccagatctagaattcttttgtcccaatcttcctggtaaagctgacaaaagggcagcaacaaagtgggagattcctggaataattgtccctgtcctggaagtcgtaggcagtctccaggacccggaatcatctccaatgttacttaaactagagggataataatggttgatgactgaattaactttaatattttctgatcatgtcctgtcttcactcataaccttacatagttttcaaaattttgctttcaaagatctccaagtatttgcactcttccctataatctattatttctctagtccaactatcctttctaacccaataaaaacccaattaatactatttttgtataaataattttggaacttcctatgcttatcatacacacacacacacacacacacacacacacacacgtagaaagagaggttctcactctgtcatgcagtgtggagtgccatggtgacatcataactcattgcagcctccaactcctgggctcaagagatccttctgcctcagtgtcctgagtagctgagactacaggcatgcaccaccatgcccaactaattttaaaatccttttatagagacagagtcttgttgtgttgcccaggctagtcttgaactcttggctcaaatgatcctcccacctcagcctcccaaagtgttgggattacaggagtgagccaccgcatgcttcccagggcgtatttttgaatcgagcacatatcttcctttatctcatcctgcttaatcatttaacctattctaatttcatagctttctcttatattcatgaaagttgtatcttcttacatgctgcccaaaggattgctcaaagtttcctgtaataaatcaaatagtaacatgcctttcctctgacagtcttgggtgaggttccctttatatagtgcagtatttttgaaattttcttttccatgttcttctgtttattgatctttaggtgatgagacagcctattctgatctagtatttgctggcaaatgggtagggaacttgtcagctgcttttggagctccatttaactgctggagaaattgccttctcagattaccagggttcgagttgatctggttgtttctgtgccaggatttcacagacttttactaagtgcaccctttagcttaacagagatggaaccttctgaaccttgctttaatttttaacttaaaaaaatacaattatttacattattaaaattattattttagttaatttttattcaggcataactcatataaagttctaaactttaaggatgtaactcaatgactttttgcatatgtataaacaaatacaactaactgtcttccatgtcaggatatggaacacttagagcatcacatacagctccctaggacatttttctagtcaataacatcccctctcatctgtggaggtaaacacccttttagcatctatcaccattaatttatttttctattcttgaactttctatagaatcatgcattattgcctcttttgtatctgccttgttgcatgtagtgacagttcttttttaaattatttatatgtattatcccgtgtcttaacatatcacaatctatgttttcattttactgttaatagttatttttgttgtttatagcatttggttgtaataaataaagtagttttgaacattcttgaccatttcttttggtgtacaaatacactaatttttcttgactggacctaggagtggaattgctgggtcataaaatagcatatgtttaactttggtcaatactctaggtttacaaggtagttttatcaaactacactccaatttgcagcatataaaaatttcagttgctctatatttttcccaacatttattatgttaaataatttttcatgttagtcattgtgattgatgtgcaggaaagatcttgttttaacttcatttctttaatgattacattgatgtttttatcacactgtattagtccattttcacactgctgtaaagaaatacccaagagtgggtaatttataatggaaagaggtttgactcacagtcccgcgtggcggaaagaccttaggaaacttatactcatggcagaaggcgaaggggaagcaggcaccttcctcacaagttggcaggagggagaagtgagagcacaggaaaaaaaaaaccaaaaacctgccacttttaaaaccatcagacctagtgagaattcactcactcttaggagaacagcatgggagaaactgcccccatgatccaattaccttcctcccttcacacgtggagattacaggttcctccctcgacatgcagggattataatttgagatgagatttgggttgggacacagagccaaaccatatcacacacaaaatacacacatacacagtatcactttatcacttttgctcattaaaaaattggggtgcccatcttttcatgatttgtagtagttttttacgttctcctgatgtgagcccttttatcagttttctttctttgtgtgactttcatttttattcttaattatgttttggatggtcagaatgtctttaatgaaactgaatttcccatttttttaaaatttaaatatatatatatatatatatatattttgagacaaggtctcactctgccacccaggctggagtgcaatggtgcgatcttgtctcactgcagcctctgcctccccggctcaagcgattctcctgcctcagccttcagagtagctgggattacaggcaccgccacaatgcctggctaattattgtatttttagtacagatagggttttgccatgttagccaggctggtctcaaactcttgagctcaggtgactcacctgccttggcctcacaaagtcctgggattataggtgtgagccaccgcaccagcctcttgatcattcccatagtcatgaagatagtttcctgttttcttagaaaatttattatttaacatttaggtctatgatccatataaaattaatttctgtctatggtgtgaagtagcaatggttcatgcttctcaatttatatatccaattgttctgaaaccatttattgaaaagactgtcctttctttattaaaacatacaggtatctttaaagtaaatcaggcaaccaattatatgtgaatctgtttctagactttaatctgtttaattggtatatttgtctatctttttgaaaataccatattatcttaataacagtcacttaatataagtcttgaattctgctaatgtaagatctcagtttctattctttcaggattaccttggctattttaagtcctttaaatttttatatcaattttagaatcaacttgtcattttactgtcacacaataaacatgctgatattttgattaggattgcactgacactgcagatcagtttgaagagaattgacattttaacaacatccaatatttttgtccacaaatattgcatatatctgcatttacttaagtctcttaaaatttctttcgataatattttattgctttcctttgtagaggcttcatatagattttattagatttactgttatatttgatatttttgatgctaggtaattaccattctttttaaaattatagtttccatttttttcttgctagtgtataaaaatatttttgtatccataaaccattaattcactgtgtctattaatttacttttaatccttattgtaggtttttaaatattttttacatataccatcatttttctttcttttctgttttcaaacctaaaaggaagatcacaagccaatacatcttaaaaacatagatgtaatttataaacataaattactgataaaatagaatattttcttcttaccagtaaggtgctaattgtaaaatttttgtggctaaatttatcagatttagatagttcctttccattactagtatgctaagagcttttatcatgagcagattttagattttctgaaatgattttgtgcatatatcgagatgataaactttaaaattctgttaaaataatgaattacactgattgattttcacatgttaattcaaccttgcactccttcttggtaatgatatatactttatatattgttgaattcaactcataaatatccatttagggttttacgtctatggttttaagaggtattggcttgtgattttccttttatgtaatgttgtttccagattttgatatcagagatatattgatattatgggcagtgggaagtgttttctctttttatattctttggaagagtgtgtgtgaaatttgtatttttttctttaaatgtttgatagaatttactatggaagccatctgggcctggagtattctttgtgagaatttttaaaaagctttattgagctataattgacatttaatacattacagaaattgcaaaacaattttttaagttttgagatacatacatacttgtggagctatcactacaatccagataatgaacatacccatcatctttaaaattcctccctccacttctctgatcccagtaaagacatttattctgtcactatatattaatatgcatttttataatttttttgtaagtgaaattacacagtacatactctttattcctggcttctttcatccaacataaccatttaaatattcattcaggttgtgtgtatcagtatcagtagttttttcctttttgtcaatgagtagtattccattgtacaggtataacacagtttatctatttacctcctttgcattgtttctttaaacactgtttttttacctatttacctctttttgggttgactccagtttttgcctattacaaataaatctgctatgaatattcatgtacaagtatttgaatggtcatttgctttcattttttcttgggtgagcatgactagatcaaatggttggtgtatatataaactttaagaaagtgtaaactgttttctgaaaatgttgtaccattttatattcttaccagctgtatataagagtttcagttcttccacatccttatcaacacctggtatgatcagtcttttaaattttagcccttctaatagtgatattatagtatctcatcctgattttgtgtttccctgatatctaatgatgttaagaatcttgtcatgtgctctgtagcctttgtcatacttatgtatatatgtatgtatctatctatttaatttgctatttttttcctactagtctgacttttctgctcattgtacatatattgtgctgctggaagttgtaaaggagtttggtgattctctctgttcattttcttaaaaatcctctgttctttctgttttgtttttgatattttctattgctatactttaaaaccttcccataatttcatctattgcatttttaaattctataaaattatggttttcatctctggaagtttcaatttgattcttttttatatgttctatatcgctaattaactttttgaatatatggaatacagttatccttaatgttttaatttcatctgttaattttaacatctgtcagttttagtttggtttcaattgattgttttttggtttccatttattgctttgttctttgttatggattatattaccctgcttttttgcataactggttatctttcattggatgtcagatattgcaaattttacctttattggtactatttttctattataaatattcttgagcttttgtcccagatgcagttaaattacctggaaacagtttgattcttctggctattactttcaagatttgttagtttggaccagaaccatactcatttagggttaattatttctcactactgagataaaacacttgagtgtgctctactcattgtccacgaatcatgattttttccagttttgctggagaaaagagacactattccgggtcctatgtaagcatcagacattgttatctctaacccttttagcttttctccttggcctcaggcaatttcttcaatcaatttcctgatcagactcagctgagtactctgaagttctccgaatttccttctctgttgctttctacactctggtactctttctagaaaactctagttgctttggtgtccccagactttcagcactgtctcctcaactcaaggagtcccctgggctctgccaggatttcccctctgcactgctgcctggaaactctctaaaggtagtaagctggggcaagagtgggtctcatcccatttgttttgtatctcccagtgcaaaacaaatgttttgatgtcaggcctcatgtcaagtttcatttttgaataaaactcttgttccaaatattatgttattttattggttgattaaagtggaaggtaagtgatatggtttggctgtgtccccacccaaaatctcatcttgagttgtaacctttataatcgccgcgagtcgagagagatcaggtggaggtaattgaatcatagagtggtttccccccatgctgttctcgtggtagtgagtgggttctcacaagatctgatgattttataagtgtttggtagttcttcctgtgttcattctccttcctgtagcctagtgaagaaggtgccttgcttcccctttgccttccatcgtgattgtaagtttcctgagccacccgctacccagccatgctgaactgtgagtcaattacatctctttcctttataaattgcccagtcttgggcagttctttatagcagtgtgaaaacagactaatagagtaggtaatggtcgtctgtgaaaaaggttttaattacaagctaaatttagtttgtcttagttttaaaaatatttatttttatttttgaaaattaattttaattgacaaaaattatatatattgtataccatatgatgttttgaaatatgtgtatacattgtaaaatggctaaattgaggtaattaacatgcattattttctatactttttgtggtgaaaacacttcatatttactcttaatgattttcaagaatacaatacattgttattaatggtagtcaccatatggttcagtagatcacttgaaattattcctttgatttagctgaaattttttgccctttgaccatcatctatccaaccccctacccccactctctgtccctgttaaccatcattctactgtcgcttttttgaattcaacttttaaaaattccacacgtaagtgagatcatgtggtatttgtctttctgtccctggcttatttggcttaacataatgccttccaggttatccatgttgtcacaactgacaggatttccctctttttaatggctgaaaaatattccattgtgtgtacataccacattttatttatctattcatcagtcaatgaacatttaggttgcttctgtgtcttggctattgtgaataatgctgcaatgaacatgggaatgcagatatctgttttacatattgatttcattttctttagatgtatacccagaagctaattgttggatcacatgatagttttatttttaactttttgaggaaccacgatactacttcccataatgtctcttatattcctaccaacagtgtgcaagagttctcttttatccacatccttgccaactcttattatttgtctttttgataacagccattctaataggtgtgagatgatatctcatgtggttttgatttgcatttccctgacgattagtgatgttgagtgtatactggttggtcatatgtttccttctgagaaatgtctgtaaaatttattcacctattattaaatcaggttatttgttttcttgctattgaattacgttccttatatatcttagttattacccccttatcagatgtatggtttgaaattttttttctcccattctaggtcatctccttactctgtttgtttcctttgctgtgcagaagcttttaagtttgatgcaatcctatttgtctattttgcttttgttgcctgtgcttttagggtcatatccaaaaaataattgcttagaccaatgtcatggaggttttcccttatattttcttctagtagttctagtttcaggtcttaaaatctttaatctactttgagttgattttttatatggtgtgggggtacgggtgcagtttcatttttctgcgtgtgaatatccagttgtcccgacaccatttattgaagagattgtcttttctccattgtgcgttcttggcacctttttttgaaaatcagttgactgtaaatgtgtctgggctttctattccattccattggtctatgtgtctgttctgattccagcactctttatgctcttttgattgtaatagctttgtggtatattttaaggtcaggtagtttgatgtctacagcttttttctttctgctcaacattgctttgcctatttgggatcttttgtagttccatatgaattttagatagttttttctatttctgtggaaaatgtcactgaaattttgataaagattgtattaaatctgtaggtcactttgggccagaataaaaattttagcaatattaattatttcaatttataagccctagatttcaatttattaaccctagatttcaatttgtttgtgtttgttttcaatttatttcatcagtattttatagtttccagtgcacaaatctttcatgtccttgattaaacttatttctaagtatttttttatagctagtataaatggcattgttttcttaatttcttttttcaggaggttctctgttagcatatagaaatgctactaatttttgtatgtggattttgtatgctgaaacttcactgaatttgtttaatagttctaacaggtttttggtggactttttgagttttccatatataagatcatgctgtttgtaaacacggctaatttaacttctttctttccaacttgaatgccttttattttcttttgcctaattgctctggctagaactttcagtgttatattgaataaaagtgacaagagtggtcattgttgtattgttcctgatcttagacgacaatttttcaactgtgttgaatattatgtttgccatgggtttgtcatatatggcttttattgtgtttaggtactttttttctatacctactttgttgagagtttttatcatgaaagcatgttgaatttcatcaaatgccttttctgcatctgttgagatgatcatatgatttttatctttcattctgtcaacatggtgtgttacatttataggactgggtattttcatccatcttcatattccaggggatacatctccattgatcatggtgaatgatacttttaatatgctgttgaacttggtatgctagcattttgttgagaagttttacaaatatgttaattaagtgtattggcctgtaattttcttttcttgtattttcgcctggctttgatatcaggataatgctggccttttaaaatgagtttggaaatgctcccttttcttgaatttttgttgttgttgttgctgctgtttgagacagagtttcactctgccaccgaggctggagtgcagtggtgtgatcttgactcactacaacctccaccttctgggttcaagtgattctccttcctcagcctcctgagtagctaggattacaggtgtgcaccaccatgcccagctaatttttgtatttttagtagagatgggatttcaccatgttggccaggctggtttagaactcatgtcctcaggtgatccgccattcttggcctcccaaagtgctgggattacaggcgtgagccatcccgcccagtcttcttgaatattttgaaagagtgagaaagattggtattagttctttcaatgttggtggatttttgtaaagaagctttcagtccctgagcttttctttatgagtgacttttcttgttggttcaatcttcttacccattattggtctgttcagatttttatttattcataattcagtctttataggtggtatgtgtctagaaatttatgtatttcttctatgttattcaattcttggtgtataattattcataatattcttttataatcctttgtatctctgtggtattgcttgaaatgtctcttctttcatttctgattacatttatttgagtcttctctctttcttagtctagttaaaggcttgccagttttatcttttcaaaaatccaactcttagttttattaatcttttctattgtttttctagtctctacctcatatatttctctctgatctttattatttctttctttctactgattttttcttttagtttgttctttttctagttgtttgaagtgtaatcttgggtgatttattcagtctttcttcttttttgatgtagatgtttattgctataaactttcctctcagaactactttttctgcattctataagtttcattatattgtgtatccattttcacttatatcaagatattttttatttttttctttgacccattggttggtctgaattatgttgtttaattttcatgtagcacattaaatttaattgataaatgactattcagagatgttttccttatgtcagctgctattttataagtttcaaggagttcttccatttcatccaattttcacatttatttgcatgatattttttattatattttcttatttattaacaatttttcataatgttccctttttatcctaatttgataacattggatatagctgccaattgcttctttatacagttcatgcagctactgccaagctatttgagtttgccttgtcatagagtattactcgccactccagtgtagttaaaaaaaaaaaaaaagcccactgaactaggtatctaaaaacatgggataaaataaggctttgacagatcataattttgaacttattatgtaaattttgtagacctttgtttccttacctgtagaatgaaaataatcgtggctatgtggtttagaaaactgtcttaatctattggggctgctatagcaaatactttagattgggtggcttataaacaacagaaatttacttctcacatttccggaggctgagaagtcaaggtgctatcagaattggtgtctgccgaggttttattccctactttatcgatggtgcctttttgttgtttcctctcatgatggaaggggcaaacaagctctcttaaggttcctttataagggcacaaatcacattcatgaggattctgccatcataacctaatcacctcctaaatgacccacctgttaattaattgcagtggtgattaggtttcaatgtatgaattttgtggggacacgaactttcagaccatagcaagaaccaaataagagtagaagggcatgctaaataatgaagagagttatgagtaaaggatcctggttacaagtcctggatctcacccttataaactagagcttggacaagttggtaaatatcatgaagacagcatctgcatatattttgtttttctctctatccacagaatagcacctatatagtaagtatgcaaatggtaattattgaattaaatgctttgccaaataaggggattttagaagattatacgtaatgtctctttaagttatatattctgtaattctaggtaatatatgtaaaagtgctttgaagattgaacagtacaattgtaagaaattatttttaaaatcctggttacataattgtaaagctgctaaagcagaagtaagacatttttgatattattgccagataactggtggcaggcttggattcttcaatagggagtagacagagtatggactataaagttctgctggactaaatgataattattacatatcaatattagatgggccactggcatcccctgagttttcagtttattctataagtgcttgcataatacttttaagatatacttggcacctgtatctaacaattataatacattgagcctttcctcccaatttccttttgaatattagtaaggctatatagttggctcctacctagtaagaaatactcccttgctgctacatttttgaaatggtgtggccaaaattggtatccagtaaacaaacacttatttatataccactgagtgtgggtaataatgagcttaaataatgcatgtatgtgggtcatttgttctagaacattgtggttttaaacctattgcagatagaccaagttaattctcaggcttctttattttctaaaacgtcagaccagtaaatagaatattttatgacatgtaagttctgctgtcattttggatcttaaatctacatcttaaaaaatgatatagcataataatgatagtggtaacctgaagcaatttttaaagcttgttttctgttaatgggggacattacctattttctttttgactgtgaaagattcaggtcagcaaagatctagcaaaatgcatgtcattgcagatttccttcattgtcacctgttgcttgggcatcgtcacatgtgaaagagaaaatgatttcttcttttctcttttctttgtttcctgtctttttaaatgttctgactgcctggtgtgtgtccaggacaaaatgttttttgtggggtgtgtgtgtgtgtgtgtgtgtgtgtgtgtgtgtttgtgtgtgtgtggcagggggaggggagtggggaggcatgtataagaggcacaaagaagagataaaatcaaaaagtacataatatgtcttttactttcctcaggcaaaaattgtttttctatttggtcttagttcggcttagtgttaactgccagctctaagtcatgccttcctttggaagacattttcaatcagaatgtacgctagaacatcctgttagactgttctgattttatggactaatgtcttctgtctttctgtcttcaggagtttctgggcttgtagacttttggacacgtggaaactgttatatgcaaaaccacaggtgcttctatctatgtgttcagtttttattcctgcatacaactgtacaataaatataatctttgttctttagaaaacaacaattgttcttttgcagtttgaactttgagcctcacattttgatagaatattagagtggtaatgacttccaagataatttgtgtagcactttgcttttacagatcagagaatttgggatgatagcaagtgaatgattgttaaagatcccactgctctttgtcagatgagtaggttgcgaaaattttctcccattttgtaggttgcctgttcactctgatggtagtttcttttgctgtgcaggagccctttagtttaattagatcccatttgtcaattttggctttggttgccattgcttttggtgttttagacatgaagtccttgcccacgcctatgtcctgaatggtaatgcctaggttttcttctagggtttttatggttttaggtctaacatttaagtctttaatccatcttgaaatgatttttgtataaggtgtaaggaagggatccagtttcagctttctacatatggctagccagttttcccagcaccatttattaaatagggaatcctttccccatttcttgtttttctcaggtttgtcaaagatcagatagttgtagatatgcggcgttatttctgagggctctgttctgttccattgatccatatctctgttttggtaccagtaccatgctgttttggttactgtagccttgtagtatagtttgaagtcaggtagcgtgatgcctctagctttgttcttttggcttaggattgacttggcaatgcgggctattttttggttccatgtgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttcgttgagcagtggtttgtagttctccttgaagaggtccttcacatcccttgtaagttggattcctaggtattttattctctttgaagcaattgtgaatgggcgttcactcatgatttggctctctgtttgtctgtttttggtgtataagaatgcatgtgatttttgtacattgattttgtatcctgagattttgctgaagttgcttatcagcttaaggagattttgggctgagacaatggggttttctagatatacaatcatgtcatctgcaaacagggacaatttgacttcctcttttcctaattgaataccctttatttccttgtccttcctaattgccctggccagaacttccaacactatgttgaataggagtggtgagacagggcatccctgtcttgtgcccattttcaaagggaatgcttccagtttctgcccattcagtatgatattggctgttggtttgtcatggatagctcttattattttgagatacgtcccatcaatacctaatttatggagagtttttagcatgaagcgttgttgaattttgtcaaaggccttttctgcatctattgagataatcatgtggtttttgtctttggttctgtttatatgctggattacatttattgatttgtgtatattgaaccagccttgcatcccagagatgaagcccacttgatcatggtggataagctttttgatgtgctgctggattcggtttgccagtgttttattgaggatttttgcatcgatgttcatcaaggatactggtctaaaattctcttttttggttgtatcactgcctggctttggtatcaggatgatgctggcctcataaaatgagttagggaggattccctctttttctattgattggaatagtttcagaaggaatggtaccagttcctccttatacctctggtagaattcggctgtgaatccatctggtcctggactctttttggttagtaagctattgattattgccacaatttcagctcctgttattggtctattcagagattcaacttcttcctggtttgatgcagccatcccattactgagtatatacccaaaggactgtaaatcatgctgctataaagacacatgcacacgtatgtttattgcggcataattcacagtagcaaagacttggaaccaacccaaatgtccaacaatgatagactggattaagaaaatgtggcacatatacaccatggaatactatgcagccttaaaaaatgatgagttcatgtcctttatagggacatggatgaaattggaatcatcattctcagtaaactatcgcaagaacaaaaaaccgaacaccacatattctcactcgtaggtgggaattgaacaatgagaacacatggacacaggaaggggaacatcacactctggggactgttgtggggtggggggaggggggagggataggattgggagatatacctaatgctagatgacgagtaagtgggtgcagcgcaccagcatggcacatgtatacatatgtaactaacctccacattgtgcacatgtaccctaaaactttaagtataataataataaataaaataaaataaaaaaggaaaaagaaaaaaaaaaaagaaagatcccactgctttggtagtgacaagacccctatgaaatactaggtgtagaatttcatggcccattccgtttttctgctgtaccacacacagcctcataacatttcaataaccatcttcagaaatgagccttatgtcatcctctccctgtcagcccccacatgatatcgtagcatgaaggtttcctgagtttggtagtctgaaacaatctctcttctccctccatgatgcagtggaaagagcatggaattggaataattcactcaactatatttattgaatgccttctctatgccaagaatgtgaccaggacctaggaatacaaaagtgagtgaaggacgttatcctggtttttacagtctatttggacttgaatcttgcaacttatcacttgtatatctcagacaaatcattttgcctctctgataccccattctctgatctttaaaataagggtaaattcaattttttaaagtcctaagaattaattaatgtataaaaatgtaaatcttctggcacatttctgacaaacagcaggcattcgctcaataaacgttaatatcttccctctaacttctaaggattattgtgaaaatcaagtaagataatggatataaaattgtgttgtgaattggaagcatatgttatagttacagatgaagttggagttttagagggtctacaactttcctcacctttcaagttcaattctaatgagaagaggaagacacctcaggattaaagtagctatttagttactgataaaagctggtttagaagttgattttgatgtgcttcccattcctttacttcagagtgcaacttccctgctcaggcacaggcatactggaatagctacaagttttacccactggaacaggtaatttatttcaaggcagagagcaaagagaataaatgttttctgcagggaagtggagaagctgtgaaggggtagagctacccatggctaattctgttttcaaactcacctatcaagtaaattgcttgacctcatgtggaagagaaactgcaaatgctaatttttgaaaacttctctgcatggaaaggaaatagaaggccaaaaaaatatatgtttctccaacagatacatacatattcctgtgaaaaaacctcaaatcagcctccttcctccaacttctcattcttttttttttaacttctattttaaattcagggttacatgtgcaggtttgttacatagggaaacttgtgttatggagattagttgtacagataatttcatcccccatgtataaggcctagcacccattagttatttttcctgatcctctccctcctcccatcctccaccctctgataatcctcagtatgtattgttcccctttatgtgttcatgtgttctcatcatttagctgtcaattgtgagtgagaacatgtgatttttggttttctgttcttgtattagtttgctaaggagactccagctccactaatgtccctgcaaaggacctgatctcattctttttaatggctgcatagtattcccctgtgtgcatttgccacattttctttattgagtctatcattgatggatatttaggttgattccatgtctttgctattatgaatactgctgcaattaacatacctgtgcatgaatcttcataagagaacaattatattcctttgggtatatacccggtaatgggattgctgggttgaatggtagttctgtctttaggtctttgaagaatcaccacactgtcttccacaatggttgaactaatttacattcccaccaacaatgtgtaagtgttcttttttttctccacaaccttgccagcatgttattttttgactttttgatagtacccactgtgactggtgtgagatggtatatctcattgtggttttcatttgcatttctctcagtgatgttgagcttttttttcatacgattgttggctgcatgcatgtcttcttttgaaaagtgtctgtttatgtcctttgcccactttttaacggtgttattttttttccttataacttttttttttaagttccttatagatgctggatattagaccattggatgcatagtttgcaaaaattctttaggttgtctttttactctgttgataatttcttttgctgtgcagaagctctttaattagatcccatttgtcaatttttttttttttttgagacagagtctcgctctgtcatcaggctggagtgcagtgtcatgatcttggctcactgcaacctccgcctcccatgttcaagcaattctcctgcctcagtctcctgagtaggtagaactacaggcgcacgccaccatacccagctaatgtttgtatttttagtagagacggggtttcaccatattggctaggatggtcttcatctcttgaccttgtgatccacccgctttggactgccaaagtgctgggattacaggtgtgagccaccatgcctggcccccatttgtcagtttttgcttttgttgcaattgctttcagtatatttgtcatcaaatctttgcttgtgcttgtgcctaggttgtcttccagggtttttatagttataggttttacatttaagtctttaattcaccttgagttaacttgtatatatggtgtaagaaaggggtccagttttaatcttctgcatttggctaaccagttatcccagcaccatttattgaataagtaatcctttccccattgctggtttttgtcaggtttgtcaaagctcagatagttatgggtgttcaatcttattttttggttctctattctgttccaatgacctatgtgtctgtttttttctatcaataccatgctgttttgattactgtagtcctgtagtatggtttgaagttgggtagcatgatgcctttagctttgttctttatgcttaggattggctattctggctctttttttttgttccatatgaatttaaaatttttttttctagttctgtgaagaatcttgatggtagttttatagacatagcattgaaactataaattgctttggacagtatggccgttttaatgatgttgattcttcctatccatgagcatggaatgtttttacatttgtttgtgtcatctctgatttctttgagcagtggtttgtaattcttcttgtagagatctttcacctccctagttagctatatttttaggtattttattctttttgcagcagttgttaatgggagtttgatcctgatttggctcttggcttgactgttgttggtgtatagggctagtgatttttgcacattgattttgtatcctgagacattgctgaagttgtttatcagcttaagtagcttttgggctaggactatagggttttctacataaaggatcatgtcggctgcaaacagggataatttcatttctggtctttctgtttggatgccttttatttctttagcttgcttgattgccctggatagaacttacaatagtattagaacaggagtggtgagagaaagcagccttctcttgtgccaattttcaaggggaaggcttccagcttttgcccattcaatatgatgttgactgtgcatttgttgtagatagctcttactgttttgaagtatgatcattcaatacctagtttattgaatgtttttaacacaaatggatgttgaattttattgaaagccttttttgcacctattgagataatcatgtggtttttccctttagttctgtttatgtgatgattcacattaattgatttgcatatgttgaaccaaccttgcatccccgggatgaagcctactcgatcatggtggataaactttttgatgtgctgctggatttggtttgccagtattttgttgaggatttttgcatctatgttcatctaggatattggcctaaagttttcttttctttggttgtatctatgccaggtttttgtatcaggatgatgctggcctcatagaataagttagggagaagtccctcctcctcaattttttggaatagttttcagtcagaatggtatcagcttttctttgtacatctgataaaattcagctgtgaatctgtctggtcctgaggtttttttggtcggtaggctgtttattattacagcaatttcagagcttgttactggtctattcagggattcagtttcttcctaatttagtcttaggagggtgtatgtgtccagtaatttatccatttcctttaggttttctagtttatatgcatactgatatttataatattctctgatggttgtttgtatttctgtggcgtcagaagcaatatccctcttgtttctgattgtgtttttctgaatcttctcttttttcttctttattagtataggaagcagtctatctatcttattagttttttcaaaaaactagctcctggattcgttgatcttttaagtggttttttttgtgtgtctcaatttcctttagttcagctctgattttggttatttcttgtcttctgctaacttagggatttgtttgttcttggttctctagttcttttggttataatgttaggttgttaatttgagatctttctaactttttgatgtggtcatttagtgcagtgccataaatttccctcttaaccctgcctgtattagtccattttcatgttgctgagaaagacatacctaagactgggtaatttataaagaaaaagaggtttaagggactcacaattctgtgtggctggggaggcttcacaatcatggtggaaggtgaaaggcatgtcttatatggtggcaggcaagagagaatgagaaccaagtgaaagtggtttccccttataaaagcttcagatcttgtgagacttattcactaccttgagaatagtatgggggaactgcccctatgattcaattatctcccaccagttacctctcacaacacttgggaattataggagctacaattcaagatgagatttgggtggggacacagtcaaactgtatcattctttccctgactcctcccaaatctcatgtcctcacatttcaaaaccagtcatgccttctcaacagtcccccaaagtcttagctcatttcagcattaactcaaaagttcactgtccaaagtctcatctgagacaaggcaagtcccttcggcctatgagcctttaaaatcaaaagcaagttagttacttcctagatataattggagtacaggcaatgggtaaatacagccattccaaattggagaaactggccaaaactaaggggccacaggccctatgcaattccaaaatccagcagggcaatcaaatcttaaaactccaaaataattttcttttaccccatgtctcacattcaggttatgcagatgcaagtggtgggttcccacggtcttggtctgctctgcccctgtggctttgcagggtacagcccctctcctggccactttcacaggctggtgttgagtgtccatggcttttccaggtgtgcggcgcaagctatcagtggatttaccattctggggtctggaggatgatggccctcttctcacaacttcattaggcagtgccccagcgggaactctgtgtaggggcttcaactgcacacttccattctgcactgccctaggagaggttctccatgaggccctgcccctacagcaaactcctgcctggacatctaggcatttccatacatcctctgaaatcaaggcaaaggttcccaaacctcagttgttgacttctgtgcacctgcatattcaacaccacatggaagctgccaaggcttggggcttgcaccctctgaagccatggcctgagctgtactttggtccattttagtcatggctagggcatctcagatgcagggcatccagcccctaggcttcacacatcagggggacctgggcctggcccaagaaaccattttttcctcctaggcctccaggcctgtgatgggaggaattgcagtgaaggtttctgacatgccctggagatattttccccattgtcttggtgattaacatttggctcctcgatacttatatgggtaataaggaactggcttgaatttctcctcagaaaatagttttttcctttttgttgcattgtcaggctgcaaattttttgaacctttatgttctgcttcccctttaaacttaagttccaattccaaaccatatctttgtgaatgaataaaactggatgcttttaataatacggaagtcacctcttgaacgttttgctgcttagaaatttcttccaccagatggcctaaatcatctctctcaagttcaaagttctataaatatctagggcaggggaaaaatgctgcaagtctctttgctgaaacatagcaagagtcacctttactctagttcccaacaagttttcaatctccatctgagactacctcaacctggacttcattgtccatatgagcattttggtcaaaaccattcaacaagcctcaaattccaaacattcccacattctataattcaaaatgagatttggacggggacacagccaaatgctatcactgctttttctgtgttccagagattctggtatgttgtatctttgttctcattagtttgaaagaacatattgttttctgtcttaatttcattatttacccaaaagttattcaggaattggaaaggaaaaattatattaaaatattcactctaatcacttttgggtatgatttccagtgattattattatcatgttttttgtacattttagaatttattaataatgtgttttttaaaaactcaaccccctctcccgctgccaaaaaacaaaacccaaatactaaaaatgggcacaaacaaaagcctaacctagccaaaagtttcttcttctctaattctgacaaagttttctaatgtcttcttttcagttacattcagtatgagtgatccaagagactcacttcatgccttgaacattaatggaagggcgaattacaaatattatatgtgaccctaaaaccccatcttttccattatttgtgaataatgataagccctggaagtaaggtgaaaagttctaacatcttttccttcattagtgtcttttcacttgtttaaaagccatctgtagttatgattctgtcaaatgtatgttcattgtctttgcctgtgttttctgttttttgacattattgttaacatgtaaaagctttttgtatattagaaaaatgactttattttctgtaatgtgaattacaaatatcttctcacttcttgattttgttgatagtcttgatagaacatttttggaaatagagactttatttttaaaattaggttcaatttatttatcttttctttgaacttctttgttttttatactgagaaaggcctccacttccaggttataaaagttttctgcattttttcttctgagctattatggttttatttttacatttaaatatttatattttagaatgtttactggtgtaaaggttgaggtgtgagaaattattttcccccagatgactctccagtcttataataccatttatggaataatccgtgattgcctcatctttatcatattctaagtttctacatgcatttgcatttatttcttggcttctaatttgtgtcaagattccatttattttttcagagagcaccacattttaaaattaggttgctatgttatgtattttaaaatatggttagtaaaataccatctctttgttcccataatacagcataaaagtgaactcaggaggtggttctctgttggagagattacacatatatttatcattttttattacaataacttcagtttttttaaatcaatatcacagcttttgctattttggaagggtgcctcttgaaatgacatttaggcaagcctatgattcaattggtgtctcaactattagcattctaggatgcagttgtatttcaaggaggaataatctgggactggcaatttcactataaaaaactggttatcataggcaagcagtgtagcacaaggcatttaggagaaacatatatctttgttctgtatgttttgctgagacatcttcccagtatctctttggactgagaaatatgctgttttctcaaatagaaaaacctagtgattgtgccatcttagacatttggaatgacatgccaactttgtgtgtgtaggtgtattgtgccaggtactcaaaatagattatttcaaatactcgaggggctcaaaaaatctatttgacaagataaataattaacatttctgattccttttactgaattcaagaaataactccaatctaatttgtgatatgacaatatttttggtccattgctaatttttagcagtatttatatagcttttcaaagagtgctgtaactacggctagaaaaaatatctctgaaaagtaagcacctagagtatgtatgtgctttctgcctttagttcatatgattcaccccgacttaatttatctttgggaatttattcccaggaaataatgcaaactatagaaaaaaatgtatatatgcaatttttattgtcatactacttaagaattaactaaattgaaaataactgaaatgctcccatttaggggaatttttatataacatagtatttacaggtatggaacatttgtcttaaaataatgcttacaaggaggttttatggtgtgggattatgctgttgatgaaaagtcaggtattaaaaactaaggctatggagggtagtctcagctattaacattacattgtactgtaaaaatgttagaaggggttctctgagagctgggattatgggtagttgcttattaggcttctctaatctttgtggcttttgtgaattttttacaaagtatgcaaaaatgcaattgcttttaaaatatgtttacaacactttctcttgactttaatctagcatttctaatatcatccattaattttctttaatatatctttttactgaggtacaagttgaatataaaaatataaataagtgaaaattattaagatattttatatggataaacatctatgtaactactattcagattagtataatagaacatttccactgccccataatgctctctcatgcctcattccaatcaatactgctatatgtaactaaccactattttaacttaatttctctacaattcatgattgatcatatatgcatatttgaacttcatataaattgaaaaatgtaatatgtattcttttgtatcttggtttttcattaaacattatgttttaaagagccatctttactgttgcatgtaataacagctttttcattttaattgttgtgcatgctctatattaataaacacatattttcagtagatcaaaatgctttctcaaagtggctgtaccaatttctattttcatcagcaatgtataagagttctagttggtccacttccttgagttctagttgttccacttttatcacatctttggcattgttggctgttttaagtttagccattctatgtaagagatacaatggattgggagaaacagcagttgagaagttgtatccaaggaatctcatctacttaatattttctcttagatcactgatgctaatttttttactatatcttcttcaatttgagtaagtcctattaatttcttcttgtcattggttattacttttacagattatgttttgttaagatcctccaatgaattttttacatcatgcattgcaattttcagttctataatttccatttgctctttaagaatatttattactctcctgaaatatgccatggcctcattcattatatatgtcttttcctataaacatacttataatagtttttttaaagcctttgattactaattttcataactgtgtcatctctgtgtttgcttttattgactctcttttatcttgattataggtcatatctgggctattcttcattttcttaatatgctagtcttgatactatgtacaaatgaatgcagagattaaagtatgaattttgttctctttatttctcagagagtacaaaacctcttttctgttgggtggttaggatgaggggctgatcactcatatttcttttagagttaaattgatttggagctgagatgtaatttcaaatagatttacttcagttacgattggcccaaatcccaaattcctgtcactgtctttttactcttgtcaatatttagctcaaatatgttgggatgtactttcaagtgtttgggttcatatttgtagtcaactctagtaacatcttaaaagtcaagcaccacaaaatttttgcattataaagtaaattctctctcaattttaatccatttctaatgtcacattcttgtattatgtctagataagatcaacattgcagctggagagagaactttcaacctgaataatgtgtttttgtgtttgagcctcttcctaattcctaacagtggtttatttcatgaacccactctttttttctaaagcttgcctgatttctcattgtctctccaaagactgaagttctgctccatgctatacctctacacagctcaggcacaaacctctagatatgaaagttctctgctctctctaatcgtatttaaagggcttgttttattggattagtattttcatgttatatactttctcatgctttacctttcaacctttctttaccactatattttagaagtgcttcctttaaactgcatgtaatcgagttttaaaaatctagtctgacatcttttgttcattaacctgaacatttaatccattacaattaatgtatgtgcagatccatttgggttgaaattgtcttattttatcttttctaattgtcctgcctgtatggtgtttattttttagttctttcatgcctttttttgtattgagtgtgtatactatttatttatatcttttcaagtatggcatttatcattctatttttattcatttagtggttaataacccttataaaataataacatatttttcttctactggataataaaaatacataggtatgtaagtccattcaccccttcctctttcagtttttatgccattattttcctaacaccacaaggtacttttctttggatttgctttaataaatatattagttcttagggctgctgtaagaaagtaccacaaactggatggcttaagatgaaagaaatttattatttcatagttctagaagctagaaatctgaaattaagatgttattagggccatgttctctctgaagcctctatgggaggattttttcttgcctcttgtagcttctggtatccccaggcatttcttggcttgtggtggcagagctccaatatttgcctccaacttcacatagctgtctttcttctgtttgtgtgaatctatctctttgtgtctcctcttttcctataaggatttcggtcatattggattaggggcccactcttctccagcattacctaatctcaattaattacattggtcatgaccttatttccaaataaggtaacatttgaggtactgtggggttagttctccaacatatgttttgagggaacacaattcaatataacaatgaattaatgtttatttagatttacctatatgtttaatatttatgttgatttttattttttcttacatctcctaacttctacctgggatcattttcttctgattggagtacacctttaaatatggatatgctggttgaaaactctcatttttgtccacaattgtttgtatttcatttatattcttgaatactgttttttctgtgtatggaatacaagcttgtcagatatgtcttttagaatattgatgatattgttcaactacctcctggtctccattgttgtgattgagaaattaactgttaattggaaactctttgggcgattttattttttctggcttcttttaagactatgcctttatttctttctcctgcctgatcttccttacaccttatacaaaaattaattcaagatggattaaagacttcaatgtcagacctaaaaccgtaaaaaccctagaagaaaacctaggcaataccattcagggcataggcaagggcaaggacttcatgactaaaacaccaaaagcaatggcaacaaaagccagaattgacaaatgggatctaattaaactaaagagcttctgcacagcaaaagaaactaccatcagaatgaacaggcaacctacagaatgggagaaaatttttacaatctacccatctgacaaagggctaatatccagaatctacaaagaactcaaacaaatttacaagaaaaaaatcaaacaaccccatcaaaaagtgggccgaggatatgaacagacacttctcaaaagaagacatttatgcagccaacagacacatgaaaaaatgctcatcatcactggccatcagagaaatgcaaatcaaaaccgcaatgagataccatctcacaccagttagaatggcgatcattaagaagtcaggaaacaacaggtaatggagaggatgtggagaaataggaacacttttacactgttggtgggactgtaaactagttcaaccattgtggaagacagtgtggaaattcctcaaggatctagaactagaaataccatttgacccagccatcccattactgggtatatacccaaaggagtataaatcatgctgctatgaagaaatatacacacgtatgtttattgcggcactcttcacaatagcaaagacttggaaccaacccaaatgtccatcagtgatagactggattaagaaaatgtggcacatatacaccatggaatactatgaagccataaaaaaggatgagttcctgtcctttgtagggacatggatgaagctggaaaccatcattctcagcaaactatatcaaggacagaaaaccaaacactgtatgttctcactcataagtgggaattgaacaatgagaacacctggacacagggtggggaacatcacacactggggcctgtcgtgggatggggaagggatagcattaggagatatacctaatgtaaattacgagttaatgggtgtagcacaccaacatggcacatgtatacatatgtaacaaggctgcacatcgtgcacatgtaccctagaacttaaagtataataaaaaatatttattttaaaaaaagactacgcctttgactttggtttttggcagtcttgctttgatgttcctgtatatggatttttagtgtatgtatgtatgtatatatgtattaattgtttattcattcatttgtgtgtttcagatcctttggggtccttgaacctgtagactgctgcttttcatgagtggcatatttatgaggaaattctctaaaatcaaaacagtgagaaatgtggggttgtgggggatatagttgggagataattttccttgggtctctcatgtttctatttctgcacatatataacagtttttgtttcaaactatcttggaatacagatttgaaaaatagtacctatctgggtggaaggcagatttttttgctatccaaaataataaatgtaatgttcccctttgatgcaaaagtggggtagttttgttagcaatctccttatgagatgggatttcctgaaatcatggttccttagctgtgacataaaacctactatatgtgcaacatctaccagagctcacctttgaatcatcttttgggacttggggtcaaaaagaagttatgtaaacaggaaggtcatgctgcctgcagtgtggtaagaaagtgttttatgacacagaggtatatgtcttctttcgacatctaggaaactgtggaaggataacttcttaggttataaaaaggataaaatctcagacccttcatagttgcttaaaataatgtcttttttcggccagatgcggtggctcatgcctgtaatcccagcactttgggaggccgaggcaggtcatcacctgaggtcaggagttcgagaccagcctggccaatatggtgaaatcctgtctctactaaaaatataaaaattagccaggtgtggtggtgggtgcctgtaattccagctacttgggaggctgaggcaggagaattgctttaacccaggaggcagaggttgcagtgagctgacacggtgccactgcactccagccaggatgacagagtgagactctgtctcaaaaaaataaataaataataaataataatgtctttttattggcagctgtataaaacaccatttttcagtatttagattatgtcttggtgtgccttgatatttattctgctttttttgatgtttagtggaattataattctatcaaatatgaaaaatttcatctcattatttcctcaatatttttctcctccctcattctgttatccaataatacttttgttggatcatttgatattgtcctaaaagttgattacactccttatttttaaaattcctgttttctttttgtatttcattttgaatagtttcaattgtcatgtcttcaatttcaatgatctttacttccgcagtgtctaatttgatgtaatcctttccagagcattttttatatttagacaattttttttctcatttttagaaatttcatttgggttgttttatctcttaaatttgtttcttctttatgtttacttgtttttctttatagccttgaaggcacaggcagtccctgactatgatggttcaacttatgatttttcaacttcacaatcacatgaaagtgatatgaattcagtagtatctcattaaattacatgaattacatgactcaacactttattataatattggcttcatggtaggttattttgcccactgtaggctaatgtgagtgttctaagcatgtttctggtaggctaggccaaacaatgtttggtagctcagatgtattcaatgcattttgacttatcatacattcaaattacaaagggtttgttttggacgtaaccccatcgtacgtgaagacacatttgtatttatagtatttgcaaaaccttttttaaggtttttgtctgctaattccagcatctcttgttttcgagtctatcattgatttttctccaggttatttgtcatgcatttctgcctccttgcatacctgataatttgtattggaagccagccaatgtgaattttatgttgttcagtgttggatttgaatgtgttaatttaaagagttggtattttttctggcagtcagttaagatacttgtagatcagtttgatacttttgaggtttcctcttaagctttattaacatgagtgttgagcaagctttattgtaggactaatttagtcccctctttctcactaagtaatgactcacttttgaatgactccatcatatgcctcaaatattgtgagactcttcattctggctggtgggtatgttaactatgctaggcatgtgagatcccaaaatatcttgtttgtttttatgtagggagagcaaaagttttacgattaaaatagaagggctgatgtttttgactatgtgctgatccttgaatttaaaaaattgtttctatgtaatatttgaaggctaggatgataatatttttctgcaaagggaatttcacattcttctgctaggaacctgggggtattgtcattctgagaccaagttcaatgtttgaggttctatggattatcagatttagaaatatggactatttatatctgatttacctttgatttatttttaccttttgaaatctgggcttattatttgtgtgtaaaggtgattttcagactgtctgacttcattgggctttgacttttatgtccaatttttatgaagctaccaaaaacggaatttcagatttgtagttcttcttgattggcaaagaagagagacacttgaatgctaatatcttcactcaggtatttctggtgctacagctgctggtacagtgtgtagaaccaccaccataagccttttgtcacttaatacatttaaaaatagactttatttttaagagcagttttaggctcccagcaaaacacagagaaaatatggagaattcccatatacccacctatacaactcacctgctctcagcatcttgtacaagtgtgctacttttgtcacagtgaataaacacattgacacatcattatcacccaaagttgatcgtttacatttgggattcactcttagcgttgttcattctgagttttgataaacatgtaatcacaggtatccactattaaagtatatggaaagtttcattgacttaaaaatcctctgcgctcaacctattcatctctccctgtcctctaactcctggaaaccactgaattttttactgtctccatggtttaaacttttccaatatgccatatagttagaatcatacagtatgaaacctttatacattggcatttttaacttagatgtatgcatttatttcctccatgtatttcatggcttggtagcatactttttaaagaaacaataaataagatcccattttctggatgcacacattttattatgcattaacttactgaaagacatcttggttgcttccaagttgtggcaaatatgagtaaagccatataaacatccatgagtagatttttttggagctatacttttcaacttatttaaataaataccaataagtataattacttatttgctacaaatatgtttaattttgtaataaactgccagactatctttgtaagtgattgtaccatttttgctttcccatcagcaatgaataagaattcctgttgcttcacatcctcaccagtacttagtgttgtcaaagttctggatcttgaccattctaatattcataggtatatagtggtatctcattgttgttttagtttgcaatcccctaatgccatatgatgtttaatatcttttcatatcatgacttgatgtctgtatatcttctttgattatacctacacctgttgctattattattttgaaccaactattatttattagatcaattgaaaacaggaaaaaatattttattttacctttgcttatttcttctctaatattcatccttcggatatgaacttcacatagatctgactttataacctatatcattttctttctctctgacacaattctttttaacatttcttgcaagataggtcaacaaatttcctgatttttaaaaagagttttccatttatttcttgtggtaaaatccacatgacataaaatttactgtcttaaatttttaagtgtacttaaaatgatactgatggtaattatgttcacattgttgggcaaccatcaccaccacttacctccagaattcttttaaacaaaatatttttgcaaacacaaatatgaaatggggaccaacatttatcttcaaaacattgagacctggtataggatacaacctccactgagactggcttatgcagctcttggatgatattggaggttgttaaatggtcttctaatatggatagaaaacagttttagcaggctcttgcatgatgttggaggttgttaaattctaatatggatgaaaaacagtcttagcagaagaatgatctcattcctggtgctgtttctcaaagagaggaattcagatgtgaattcctgaggctaggtagtttattctaaatataaatttattggcttatggctcgggagactgtgaagtccaagattgaggggccaccattttgtgaggtccttcttgctgtgtcataacatagtggaagggcaaagagagggcaagaggggggcaaacccattatcttgataatgaatccactcttgtgttagtccattcacaaggacagagtcctcatgacttaaacacatcttaaagattccatctcccaataccacaaccaatggcaattaaatttcaacatgaattttggacatgatatacatttaaaccataacatataccacaaaggtgagcccctgaaataaaagtggagaggagaccatcagcctatctcttctctttgaggagacgaggaatctcctaagaggaatctcagttgggggtttaaaggtggtctatgccttgtgaagataagaagagagctagagagaaacttggacagataacctcaatgcagggccacaaaacatgcataccctgcacaaaagtgcccgggttgtgaacatgaattggagatgaaattgtaccctagaaccatgcactctggcttgggtgtgattcattctggagaaagaagcatagcaacttttggaaactgatgtgcctagaaggggcacctctttgtaatttgttagcccggaggccacatatgcttacatgaggaaacctctttttcaatgcaaagagccactcataagcaagcaacagtagttccaactattaaaatgaagatttcatagctttaaagtgaaaataacctaaagcaatgattcacaattacactccgcgttttcctccctttgttaccctgcggtattcagtaaagaccctttatacatgacaacattgtctccattacagcatgcgctatctattcttagattaatgtgttaaagtgatatcagcacccatttctccaaaagataaacttggtagctagcagctgtaatcagcaaaaatccaccaagaaattgtgcccttggaattgtctataaaccacctgatccagtcacattcctggaactaaactggaaggtgtgggcaaaatggtgagcagatgaagtatgtgtagttttagaagggaattgtttacagcagctcaaagagaacttccagaggaagataaaaatatctcaacagaaaagaaaatttgaatatcatgaaaaacctaagaaaactctaaaactctttccagacagctcttttgactgaaaaaatatgaatatgttttgtaattattgcagaagtctatgtcataaagctacataaaattaaatcatgatttatcttacaaaatcttaatgttaactctaacctctttaaaggaagactttctttgttttacctaaaatattaaaaaattactgataaagaaaatgataatctgcatggtatacaagtatcactgacccccccccacaaataaaacagaaaatgaaaaattcccaagcattttaatagatacagtgcaaaaccaaattttctatatcttcaaatattactaactttacaggattagttattataatttgagtggatgctaatacataaagagtctgatttctaccaccaaatattttaatgaagttgttgatataattttcaaataaggagttttattatttcctattgctacctactcaaccttttgagagaaatattttctcattgtttatttgattaatattactggctagtgaaaatttacaacattttaaccatagtttccctgatgtgggtgaagacatagccctatagaaagggtagcaagaacacatgtattttgacacaaattctgtaagagaattttacaagggtaggactattaatatatctttagcaactttattagttttgaagtgctaaaatcatggatgtagagaactatatgagcaaataaaaatttgttcaaaagaaattttgttaaaattcagaattataaagtattgcactaacttactaatatccctacaatgtgatcttcctttcacctcacaaatgatatttgtgatgaaaagtttggtagtgataagaattataaagtaaaggtaagaaaggctaatgagatagataaatacatgcaggggtagtttttaggtggtcagggaagtaagtagtaagttgcctgtgagagctaaaatatgatggggaaggctcaagtcatgatgtgtacaagagcattccaggcagagaacctgcaagtgcagtgtctgaagctaaaatatgaagatattcttcaggagttttttgattagggaaagattgaaagatttgacaaaaatgaaaaagtccatttgttattctccatcaacagaaaaaatatgcatttttatatttctagtttaataaaatgtcttcatcaaaactaaaaccaaaataaactaggaattttcccatatatgtagaatgagaatttaggctattcacatttgtttctaagagatatttaccctatagtgagagcaatgattaacaacattatttccaattaattaaaataagttttggaaacattctacatattacattatattccaacagcccaacaggctagtattatcttcattcatagattaggaaaactgagtctcagaaaaaaatccataacttgtttaagatcagatgatcaaaaacattaaaatctagtcctgaacctgagtcttctgactcaaaatccaggaactttgtcatctgatgaaactaacactgaaacactactgaaagtagtttagtctacctttaatgtttcagatatccctagaaagatcatatatggatacttcagaatgtcacactttgtaaagcatagtggcaaggtttctgcatcttaaagaaggtggttgggaatatgtcattatctgctaagtatttctcatctatttatttaacaaatattttccttttttggcaaatataaattatacatatttaaggtgtacaacatgatgtttggatatacatacacattgtgaaatgactaccactatcacacaaattcacatatattcatcatctcacatagttactgtgtatgtgtgtatgtgttcagtgagaatacttaaaatttactctcagcaaattttgagtatacaatatatcattattaactagagtcaccatgatgtacattatatccctagaatttactcatcctttgtaattgaaactttgaattctttgaacaaacaacatatgtgtttcccacacctccaagaccctggcaatcaccattatagtctctgcttttacagatttgagtttttgagatttcatgtaaaagaacatacagtattcctgtttctgtgtgtggctaatttacttagcataataccttccaaacaaaattatgaatattgtgttgaatggcaggatttccttctttttaaagattgaataatgttctagcctctgtgtttctgtttgtgtatttatgtatgtatgcgtgtgtgtatgtatatatgtaaatgtatttattatattttctttatcaattcatcaggcaataaaaacttaggttgtttctatgtcttggttattgtgaataacatgacaatgagcatagaaatgcatgtatctctttgaggtcttgatttcatttcctttagctgtataaccagaagtgaaatcactggatcatattgtagttctatctttaattttctgagaaacttcaacactgttttccaaaatggctatactgatttacattcctaccaacaatgtacaagaattcactcttctgcacatccttgccagtacttgttctcttttctatttctggtaatagccgttctaacagatatgcagtgatattttattgtgtttttgatttgcattttcctggtggttagtgatgttgagtaccttctcatctacctgttggccatttgtatatcttcttttgaggaatgtctctacaatttcttctgctcattttaacatcaggtcatttgttttcttgctattaagttgtttgggttctttatatattttaaatataaatattaaccccttatcagatatatggtttgcaaatatattctcccattccataggttctctttactctgtggattgtttcctttgttgtacagaatctttttagtttgatgcactcccttggtctattttgtttttgttgcctgtgcttttgggatcatattcaaaaactcgttgctcagaccaacgtcaggaagcttttaccttatgttttcttctagtagttttacagtttcacgtcttacatttaagcgtttagtccattttgaatttatttttgtatatgctgtgagataagcatctaattttattcttttgcttgtggatatccagttttctccacataatatattgaagagactgtcctctttcccctttgtgtgttcttgccatttttatcaaagttcaattggccttaaaagtgtggatttatttctgggctttctgttttgtttcataagtttatgtgtctgtttttatgccagtgccatactgtttggattataataacattatattatattttgaaatcaggtagattaatgctttcagttatttttctcaaaattgttttgggtattcaaagtcttttatggtttcatatggattttaggatatttctatttccataaaaatgtcattagaattttatagaaattacattgaatctgaagaaggtcatatagatattttaacaatattaattttccaatctatgaacacaggatttttttcatgtgtttgggtctcttaaagttttcttcatcaatattttatagctttcagtgtacaaagcttttacctccttgtttaaattcatttcaaaatatttttgatgctgtatcattttattttttatttcttaattttttatttttaattttggtaggtatgtagtaggtatataaattcatgatgtacatgagatattttgatacaggcatacaattcataataatcacataaaggtgaatgaggtatccatcatctgaagcatgtatcctttctatgtgttacaaatactctaataaaactcttttagttattttaatgtgcacaataaattactgttcactgtagtcatcctgttgtgttatcaaatactagattttattcattcaatgtaactatgtttttgtatccattagccaaccctgtgtccatccctccagcccaactacccttcccgacctctggtaaccatcattctactttctctgtccatgggttcaattgttttattttttagctcccacaaataaaggagaacacgtgaagtttgtctttctgtgcctggcttatttcatttaacatagtgtcctgcatctattatgttgcaaatgacagaatctcattctttttttataagtgaatagtactccattaaatatgtaccatattttctttatccattcatctattgatagacacttaggttgttttcaaatcttggtgatacggtttggctgtgtctccacccaaatttcatctttaattgtagctcccataatttccatatgtcgtgggaggtaatttaatcatggggtggggctttcctctgctgttctcatgatagtgaataagtctcacaagatctgatgattttgtaaaggtgagttcccctacacaagctctcttgcctgctgccatgtaagatgtgccttttctcctcatatgccttccaccatgattgtgaggcctccccagccatgtggaactgtgagtccaataaacctctttttctttaataaattacccagttttgagtatatctttattagcagtgtgagaacagactaatactattggctattgtgaataatgctagagtaaacatgtgagtgcagacattacttcaatatagtgatttcctttcttgtaggcatatagttggtagtgggattgctggatcatatggtacttctattttcagtttttttgatgaacctccaaactgttctccatagcagttatattaatttacattcccaccaacagaggaccagagttccttttcctccacatccttgttagcatttgttattgtctgtcttttgtataaaagccattttaactggggtgagatgatatgtattgtagttttgatctacatttgtttgatggtcagtaatcttgagcacctttccaaatacgtgtttgccgtttgtctttttttgagaaatggcagaccttttgctcatcattttattagatttttttttgctgttgagttgtttgagctcctgaagtattctgtctattaatctcttgtcagatggatagtttgcaaatattttcttttttctttctttttttattttttgagacggagtctcactctgtcacccaggctggagtgcagtggcatgatctcagctcactacaagctccgcctcccgggttcacaccattctcctgcctcaccatccccagtagctgggactacaggtgcctgccaccaaccctggctaattttttgtatttgttttagtagagatggggtttcaccatgttagccaggatggtctcgatctcctgacctcgtgatctgcccacttcagcctcccaagtgctgggattacaggtgtgagccactgcacctggccaatattttttcttattctttcggctgtctcttcactttgttgattgtttcctttgctgtacggaagctttttaggttgatgtgatcccgtttgtccatttttcctttggttgcctgtgtttgtgggatattaatcgagaaatcattccacagaccaatgtcctggagagtttccccaatgtcttcttttagtagtttcaagtttgaggtcttagatttaagtctttaatctattttgatttgatgtttgtatatagcaagagagagagagggaaataggagtctagttttattcttctgcatatggatatcattttttccttgcctatacataggcaagaaaaaaatacgtatatttgttgtttgttttttgatttgaggttaccacaaatcttgcaagtatcttgtaatccattattttaaagtgatgacaatttaatacagatatcataaacagactagtaagggaaaagaaaactaataaaaactctacactttaatgctattttagattgacaagttttcttaatttctttttcagaaacttcatcgttagtgtatagaaatacactgatttttatacattgattctgtatcctgcaattttactgaattattttttagttctaacagtttttttggtcgagtctttagcttatcttaatatataagatcatgtgatctgcaaacagagaaaattttacttcttccttttttatttggatgccttttaactatttcttgactaattgctctggctggccattccagtactatgttaaatagaagtggtgaaagtgggtatccttgtcttgttcatgattttagggaaaaagctttcagcccttcatcattgagtattatgttaactgttggcatgtcatatttggtcttttttatattgagataaaacacttgtatactgatttgttgagcatttttttttatcatgaaatgatgttgaatttttaaacatgctttttctgcatttattataatgtcttatgcattttaccctttattctgttaacatggtgtatcatgtttatagatttgcatatttataaaccattcttttacctcagggataagtcccacttgatcgtgtcatataaacttgaatgggctgctggattcagtttgctagtattttgttgaagacttttaaatctgtgttcctcagggattggcctatacttttcttttcttgtagtgtccttgtctggctttggtatcaaggtaatgctggtatattagtcagggttctctagagggacagaactaataggatatatataagtttattaaggaactcacatgatcacaaggtctcacaataggccatttgcaagctggggagaaggaagccagtttgagtttcaaaactgaagaactcggagtttgatgtttgagggcaggaagcatccagcatgggagaaaaatgtaggctgggaggctaagccagtctagccttttcatgtttttctgcctcctttatatcctggccacactggcagctgattagatggtacccacccagattaagggtgggtctgcctttcccagcccactaactcaaatgttgattattttggcaacaccctcagagaaacagccaggatcaatactttgcatccttcagtccaatcgagttgacactcagtattaaccatcacagctggtttcataaaatgagccttgaagtatttcatcctcttcaaagagactgagaaggaatggtattaactcttctttaaatatttggtggaatttgacagttatcgtattgctgcctattgctcatttcaattctgtttatttttgctttatatatatatgttccaatgttgagtccctatatatttacaactgttagatcctcctgatgaatttacactctttatcatgaccttttgtgaccttttgtcttgtgaaatgttttgacccagtctattgtgtgttatataagtttagcctcccctgctctctttcatttgtatgagatatctctttccatccctttatttttagcctatgtgtctttttacaggtaaagtgagtctcttgttggcaacagatagttgtgccttcttttaaaaattcatttagctactctatgtcttttgattggataatttaatctatttatatttaaaatgattattaattgatcagaacctactattgccactacaactgttttcttaccattttataatttctctgtttctttctttgtttcttgctatcttctctggtgatttgataattttttattagcatggttttattcctgttttacgtatccactagagtttttttttattataaggtttacataagacattttgtaattataacagtttattataagctagtcacaatttaactgtaatgaaatacaaaagctctacccttttacttctcctgtctttcatgttttatgttattgatatcataatttacatcatttcatagtttgcattcataaagaaattattgcagcgatagtttttaaaaacagttttcttttttatctcttatatctcctattttcttttttgtctctcggacatttgccatagatgaacccatttcactctttttgttccctcttttggaggaagtcttatgattctgcaccttttcttgatcccacaaagccaggccaggtgctgagaggctctcatttattttccatagtgcaatcccaagtgttgaaggttaagcacttataccaatccagcagagttgagtcagctgtctgtgtgtgctcaagcatgacatgcactgtttcacatgttgtccatgaagacatacacagtgtgttgactataggagagaaggggaggatgtgactggaacaggagatatacttaggcttgttgggggagacctcaggtggtgtgttctatgaggactgtgggcaagtgtcttggtagagtccacaattagctaataaaaaactcaggcctttgttaagatccacaccctgattgttttgagtctttgtcccttttcctgctactaactgtcccagagtattcagtcattatgatctcctcagtcttcagagtgggtcaagcaagaagtgaaccttttgggtactgttgctcatggttgaggaaggcaagtgagtcctcaccatgctctcactttcttctgtgggaaaaatgggccaacgaattctgatatgatttgcctgtgtccccaccgaaatctcatcttgaattgtaactcccacaattcccacgtgttgtgggaggaacccggtggggggtgattgagttatgagggcaggtctttcctgcactgttcttgtgagtgagtgagtctcatgggatctgatggctttaaaaacaagagtttgccttcacaagctctctttgcctgctgccatccatgtaagatgtgactagctcctccttgccttctaccatgattgtgaggcttcctgagccatgaagaactataagtccagttaaacctctttcttttgtaaattgctcagtctcggatatgtctttatcagcagcatgaacacagattaatacagtaatttggtactgtcagagtggggtgccactgaaaagatacacaaaaatgtggaagtgactttggaactgggtaacaggcagagattggaacagtttggagggataagaggaaggcaggaaaatgtggggaagtttggaactccctagagacttgttgaatggctttgaatgaaacactgataatgatatggacaatgaaatccaggctgaggtggtctcagatggagatgagaaacttgttgggatctggagcaaggtgtttcttattatgttttagcaaagagactggtggcactttgcccctgccctaaagatttgtggaactttgaacttgagggatgatttagggtatctgacggaagaaatttctaagcggcaaagcattcaagaggtgacttgggtgctgttaaaagcattcagttttataagggaagcagagcataaatattcagaaaatttgcagcctgacaatccagtagaaaagaaaatcccattttctgaggagaaattcaagccagctgcagaaatttgcataaataacgagtaatgttaatccacaagacaatggggaaaatgtctccagagcctcttagaaatcttcacagcagtcccacccatcacagtcccggaggcctaagaggaaaaaatagtttcatgggccaggctcagggtcctcatgctgtctgcagtctagggactttgttccctttgtcccagccactccagctgtgactaaaaggggccaagatacaactcaagctgtggcttcagagggtgcaaccgcaggccttggcagctttcacatggtgttgagcctgcaggtgcacagaagtaagaattgaggtttgggaacctccacctagatttcagaggatgtatggaaacacctggatgtccaggcagaagtttgctacaggagtggggctctcatggaaaacctccgctggggcagtgcagaacagaaatgtggggtgggagcccccacccagagtgccccctggggcactacctagtggaaatgtgaagagggccaccatcctcaggacctcagaatggtagatccactggcagcttgcactggaaaaggtgcagatactcaatgccagcccatgaaagcagccaggaggggaactataccctgcaaagccacagggacagagctgtccaagaccatgggaacctacctcttgcatcagtgtgacctggatgtgagacacggagtaaaaggagatcactttgaagctttaatatttgattgcccattggattttggacttgcatggggcctgcagcctcttcattttggccaatttctcccatttggaatggctgtattgacccaatgcctgtatccccattggatctaggaagtaactaacttgcttttgattttatagcctcataggcagaagggacttgacttgtctcagatgagactatggactttggactgtggacttttgagttaacagtgaaatgagttaagactttgggggactgttgggaaggcatgattggttttgaaatgtgaggacatgatattctggaggggccaggggcacaatgatatcgtttggttgtgtcccacccaaatttcttcttgaattataactcccacaattcccacatgtcatgggagaaacctggtgggaggtgattgaattatgggggcaagtattttctgtgctggtcttgtgatagtgaatgagtctcatgagatctgatggctttaaaaagaagaaaaacaagttttctgtctgcctgctgccatccatgtaacatgtgatttgcttctccttgcattctgccatgattgtgaggctttcccagccagctagaactataagtccaattaaacctcttacttttacaaattgctcagtctcaggtatgtcttaatcagcagtgtgaaaatggattaatacaaattctctcttggcactgagctgtgatgcctgggggaaggagtaatgcaagcaaactgaaactattcttcttactctattaaatgtattcattcttgaaaatttgctttaacagggtgctgggatatctctctagatgtttaggatcccacaaagatactaccctctgtggattgttatcaatattgatgtttttacaggggaaagaagatagagactcctactctgctattctgttcatgtcactctggattccccaatttttacttctctgagaaagtctttatttcttctttacatttgaagaaattttttttgagaatacagaattctaagtttgtttcttttttctctcaacaatttaaacatttcactccactctcctctagcttgcatgttttcaaagaagaagttgggtgtaattcttatctttgttactctatgggaaagttagttatttcttcaggattcttttaatatttttatttatgtttgagtttccaaagtttgaatatgatatgagtggatgtagttttttgttgttatttatcttgcttagtttttttttctctcaagttcttggatctgtggtttatagtttgatgccatattgggggaaatgctcatttattagtgcttcaaatattgcttctattaccttcactgtttcttatcattctggcattcccataacatgtaagttacatcttttgtagttgttgcacagttcttggatagtctgttccatttcttttaagacttttctctttgtttcatagttttggaagtttctatctatgtatttccaagcgaaactcagatactctttcctcagttatatcttctactaataagcccatcaaaggtatttttcatttttgttacaatggtttttttgtacactctagcatttttaatattcttttttataattctcatctctctacttgcattatctattagattttgtatgttgtctacttcttctactagatttcattgcatggtaatcatacttcttttaaattcatgatgtgataattctaacatcactgctgtatttgtgtctggttctcacgttgttctatctcttcaaactgtgtttttgcattttagtatgtcttgtaacttttccttgaaaggtggacatgatgtactggataaaaggaactgcagtcactaggcctttagtgatgtggtagtaaagtgtgaggtaggggaattgctctgcagtcctatgattaggtttcagatttttatagagtctgtgctaataggctgtgaacttcacaaatgcttctcagtttgttcttttttcacctcattagatggtacaggatggccataggggactggagtggggtaaatctctgcctccacaggaaaagctagaatagctgcagttgaatatttttcttctttcaggtgaatcaggctctgataaaaacccaataggttgggctctggtaaaataatttttttgaaggcaggctttgttaacaggaacaggttgccatggtgcatttcaaaatgatttctttcctcctcctcttgcaggaagccaaagtagatttttctctgatcttcactgtgagaacctggtagaggtcttggaggtagaactcacaaaactgttagggttgtcctataaatgggtccacctggagttttcatctctcatacttgtctattctgagcctccagcaatttgtgaactacagttcagcttttcctgcattggtactggttcctatgaaggtgggtttctgctctggtaagttgtgattctctgtattcatcaacttgtctctccaattttgggggcagtggtgtgaactgtgacttcacttttctaacacacctaagaagaattgttgatttttcaatttgttctgaattttttttcttgttaggatagaatgctgacttctatgttcctgacatgccagataagaaactgtaggccttactagtattttttaatctaatcatattttccagagaagactcttccaacctccagcatagagactaaaagcctgtatcccaatattttgggagctgactgacaaaaatggactgaaggatcctggaatacagtattcacttttcacttaactgccctgctttctcatcaagaggagttgcatcttcctgtccagagagccctttgaattgccatttccagataatgtatcagtgtttgccatgatatatgggtagagatagttaactttctgaattcagcaagactgttctctcttttaaacagatattaaaccaggttttcttactttagtcactatatctttacttccgtttctatagattcttgatgcccccaacacttgattggtaatttttcagtgtgaatcaggttgattattgattttgccctccaacacttgcttagcactcagttttctcagttctttctcagacgtctgctttttagcttctaacgctttgtttctattgtctcctttcctattctccccaagtcctctgggtttatatcttaaaagtccctttattgtaattttaatggggtttaggaaagtagtgaaagttgatgttcatttttaatcatttgtctttacttggaaggtaatttcaaattatgtcaaaataatttaaccattataatcaatattttaaatgtcatgtaggaatattccaggaataattatatattaagaactggtagaagctaagatgattaagaagagtgatgaatataattttatatggacatgatataccttgttttaaagattatctacatttgtattgcccagcagagatgtttttgttaatttaatgttgccattatcaggacaaatgtatcatcattcagatatctccttaaacattatctactgaaataaatctttcattcattcatcaaacatgtattgatttcctactataagccaagtattgtttaaggattaggggatagaaataaagagtatatcacatctaaaatatattaaagacttctaaatgtacaactataatataatgaactaagtgaaaagtaagatttttcttcatttccccaggtggtagattcctgctgttactaaattcttaatcgtcattatacatttcacctcctgtgcacactgctcctttatttccttatattgcctgttagacaccaccctgattagattccttcactcccaagttaatattttttaaagtctttccactggatatactttactgaagattatctgatacccaagagagggattaacatgccatgcaacacagcagagcatacaactcaaatttatgttagatatcctttttgttaaatacccctttgccatttcaaacaatgttaccttctcactgattggttcacctcatcagtccctggacttcaattttactgcaggactcttccttctgtttctttttagttcttcaaaaattatctgggtctcttatgtagaacaattcaattttcttcaataaattctgggcccatgtttgtgtattagccagagtaggctgatatcattggtttaataaaataaatatttaatatttatagtttgctgtgggttcatagagaggcttcgtttcgtgtagtcattcagggtgcctgaacaaaggtaaaaaaatacttgaagggtagcccaggaaattactggactgagcctgaaagtatcatttatcagatcctcttacatttcactgtccagaactcattcatatgtccccacttaactgcaagagaggtgaaatgaaatactctttgatgaatgtatagaattctttctgccacacttaaaaaaatactaggttgatttgcaaaataaaagcctgatctgaattatactttattttactggaattttagtaaactttttttcttgtacatgagtttttcatcttacgtaggccttcctgtctgagatgataatcccaacccttaaaggagaagaggctcctattaattatggttttttgtttcattttctgtttattttagtgacatgtactgccctgtttattacatctatacttagtcaagttcgtacaatgtgcatatataatttactatttaaaaatttttactaataatacttgaggaattttcttctcatgggttgatcttatctactgtactctaacgtgatactagatgcttttaattctgattttaaccactaggatcaatgttaggtcaatgtctctggagcttgttgactgcagcagaaaatctgtccctacattttgtgaaaccccacttttcttcattgttcccttaggattccctactcatcgtttccagcttgtcagctactttctttatttttatttcatattggttttcaagttattccctttagctaccttgacttatcactgtttttttttaaactttgattgctcctcatgtttctataatcagctggatggttgttttttactgcttatacatttagtcccttaaagtgaaaaaagttaatgagtacttcagttccttccatttgctccgcattccctgaccttcctgttaattttagtctcccagtgtgttgtacacattatagttgtattttgtacaactttacttttcagcattttaatatgtgaatcagtctttgaattcatcttttgttttgttgtcatgtgacagtctttataaagaagttttggaatcagcaatgctactccttaaattatataataaattaaggttgcataaactgagttcaggaagggttttctgtaactatagtatggtttgaggagagtataattcaaataatctaggaaaaacaataaaatgttttattcaaatttggattgatataaaatatttttcaaatgcagcaattttaataaatagattagtttagaggctagctactggtctgttgctatttctgatgggttagtctcttttttagctaatgggttaatatgggtgagcttattagagttaccaatgcaataaaatccaaacttttacttttgaggtaggaggaaatatgtttaaaaaacaaacgtttttgttggcaattatcattgtataatgaatactctctttgaaggatatggatggagaactgtttcttgcttagtaaatttgtggagtagttaacacttttgtattcttgacagtaataggtatgtaagctttcctgtctccagtgttctaggaattgtccctccccgccaccacagggatgggtgatgagcacattaccaaggtatggccaattagtttggccattttgattgttttatagagaaatgtataatccaggcatggcctattagagttaccatgatgcctgaaattttcagagaaaattactttccctctcatactcctaaccccctctagagttgcagtagggaccatgtaagttggggagctgctggaagttcttactaccatcacccagtgatcccctttctaaggacaaaacagggggaagtgtgggaggcaggtgagggataaaagactacataacgggtacagcgtacactgctcaggtgatgggtctaccaaaatctcagaaatcaccactaaagaacgtatccatgtaaccaaaaaccacctgttccccaaaaactattgaaacaaaacaaaacaaacaaacaaacagaatgaggaaaacagctgcaaaagggagagatagaaagaaaatttcttgatggcatttttgaagccctgtatctagttgtgtctgaagttagtcacctatcagatttctcggaaaagtaattcattaagttacatcgtaatttcagctagttttgcttcagtttctttcacatactactaaaagtgccccaactgaaccagtagactacctagattatatatatatattaatatgtatctatagatgtagtcatctatctatatctatgtctatatagatatctatctacatctatgtctagatctatatataatgtcgtaaaataaaaatattcatttagaagggtaagaaagggtcatttctatattactcaccattctatctctatcatatatcatggtgactgcacatagacatatatcatattactccccaatttgatcttgaggtctctctctacagagtggctataagctctagccctacccttacaaggctccaggggatgtggttgtgggttttacaatgtgtctttcataggattctcctttatcttagcaaacagcctaatgcctaagtgtccaacccatggccccatgtccctctcatagtaaacttgtttatgagggcaaatataacaatttatggggataaactggcaaatgtccttgtggctcttgtctgagctgtgtccagtttattcctgccaaaacagccactatctaggagagcattgactaggaggcaagttaggtctgggtgtgtcggtctgaggagacacagaggaggcaacataataaaaacacatgaaatattaataacacaagtggtttattactcgcagatccatgagagaaaaggtgtacttatgaaggtaatgggaatgttcctgaagaaataagctcaaccaacaggttgggagccagagagagatgaatctaccggctgaggcatttactggggtctaggacattacctaactatgtttcctgtggggagtgctaatgagttggtgaggttaaggtaagcaggtacaagtttcatggaactatgctgtgactgacagtggtcactgaagcatatctgcacagtttatgcaggttgtggggctcagtaggggaagttaagtattttgtatctgtatatagtataggatgatggtcaccaggagatggttggataaagcagatatccagataaaccatattgagaagatgggaggagacagagaagtagaaactgtgtcaagggtgaataaaccctgtttctggtatgagcaagttaaacctagatccagaatgaatgccaagacaggatataattttagaagttactacaacatgtttaataaatattcatgaatgaacaaataatctaactagtccaatttattgggcccctgttttgtgtgaagtcctatcttaggagagagtaaaataataaaaagagtaagagactttgtcctctagttgatgatgttatgcaagctttgagttataagaaaaatgtaaggtagattaagagaaggggctaaaggaagtgaaaattgtacattgaaaaatagctaagccatgaaagggcactagagttagactacctgagtttgaatcagtgctctattcttgtgaactgtttgatcttggatatattacttaaacccagtttccttatctgtaacaaaggaataatattgttacgttcttgatagattttctgtgaggataagtcaagatattctatttaaaatgagttaaatgcctaggatatgttaagtgctcagtaactattggctatttttatttcaggaagcaaagatgggcagaacatgatttaaatattaaggaaaagagaattggaagcaaagtcaccctgggtatctgaatatttattgtattgcaaatcaacaccaactatcaaaaaaatgcccacaaacgtaatttaacatacaatatataatccagcaaaattttagtgttgcacaggttagatttacacaatgataggtttattttagagattagttaagacttgaatctttggtagacaggagggaaaaaaagacctctacgttatacttaaaaaatttttaacaagaaaggacttagagtttaaaaactttgagtgataattatagtgttggattttattagatattctgcatgaggaaaaaagtggattaaaaaagtacatttaattgtctgctaggaggtagatatgcagaagattattacatagctagatggaaaaggacttcttgagtctttacaatacttaaagatgataaaatttgatagaattttatagactcattcaggaacaaatgcctttctatgtcataaaatgctgtttgtaattacattttttcctaactttaattcttacctcatggtaaaatggtagttacctgtgggtctctggatacaaaggaaaatgaaatcccattaatagacataaagtagcttcatatatgtttaacactgctggtctacacatttcaaaagcatgggggacttccacttgattcaagggtcttatggagaaaataaaacagcattgtatagtagaggaaagaacatacaaacagattaaagctatgtgaccttgaacaaattaacctttttgagcccaaggttccctgtgagtagaaagaagataacaattatagtgtcttgtgaggattaaagataatatttacagagagagaaattttttggcatatggtaggagatctaagatagataagtatgaataaataaaactgttgacacaaaatgttaagtagcaacttgcaagattttgataaatactgatagagtcttagctgatgtcatcactaatgaatagttgtgttcagcactgtggcttaataatttcattgcccccgcccagtccagtgatacatggatcaatgttgaccagacagggattatgacaatgaagccagcgttccatgctttctcttcttctcaggctatatgccctttttatttagcatgtaaaggaagcgttagtctgcccagttttcctttcttcttagttcactgaaaagcttctttaccttcacaaaactaggttcctcaggggcattctcaatctacttcacaccatggaaggatgaagccttccttaagagctgcaaaatacatattgggatgttaaaagtagttacttactggttttaaggactttttattcgtttagatttaagctgatcaaatccccaaatttagattttagcatatatgagtttatccattggtccaagattatccttagaaggtcacaacgttttattttctttgtctcttttccttcctttttgagaaaaagattactatataaatggtttatttacaagagtttgaaactttttttaactttagtcagatattccttcttttctgtttttttctttctttctttttttttttttttttactttttttcctcataagaaacttttcaaagcagtctggcatttaaaaaatataaatctagtttacagtcccaccaacagtgtaaaagtgttcctatttctccacatcctctccagcacctgttgtttcctgactttttaatgatcgccattctactggtgtgagatggtatctcattgtggttttgatttgcatttctctgatggccagtgatgatgagcattttttcatgtgtcttttggctgcataaatgtcttcttttgagaagtgtctgttcatatcctttgcccactttttgatggggttgtttgatttttttcttgtaaatttgtttgagttcattataattctggatattagccctttgtcagatgagtagactgcaaaaattttctcccattctgtaggtggcctgttcactctgatggtagtttcttttgctgtgcagaagctctttagtttaattagatcccatttgtcaattttggcttttgttgccgttgcttttggtgttttagtcatgaagtccttgcccatgcctatgtcctgaatggtattgcctaggttttcttctagagatttcatggttttagatctaacatttaagtctttaatccatcttgaatgaatttttgtataaggtgtaaggaagggatccagtttcagctttctacatatggctagccagttttcccagcaccatttattaaatagggaatcctttccctatttcttgtttttgtcaggtttgtcaaagatcagatagttgtagatatgcggcattatttctgagggctctgttctgttccattggtctatatctctgttttggtaccagtaccatgctgttttggttactgtagccttgtagtatagtttgaagtcaggtagcatgatgcgattcctcagggatctagaactagaaataccatttgacccagccatcccattactgggtatatacccaaaggattataaaacatgctgctataaagacacatgcacatgtatgtttattacggcaccattcacaatagcaaagacttggaaccaacccatatgtccaacaatgatagactggattaagaaaatgtggcacatatataccatggaatactatgcagccataaaaatgatgagttcatgtcctttgtagggacatggatgaagctggaaaccatcattctcagcaaactgtcactaggacaaaaaaaccaaacactgcatgttctcactcataggtgggaattgaagaatgagaacacatggacacatgaaggggaacatcacacaccagggccttttgtggggagggggaaggggggagggatagcattaggagatatacctaatgttaaatgacgagttaatgggtgcagcacaccaacatggcacatgtatacatatgtaacaaacctgcacattgtgcacatgtaccctaaaacttaaagtgtaattaaaaagaatatataaatctttgctgctatttttgaggaagaggtaggtccagagctctgatttttcatccctatcatctccacagcttctgcagtacctcccaggaactacaggtttcaggaaatacattttaaaacctccatgttagtgaaaaaagaactggaattcttgagacttgatttttagcattagttctaccatcaaatttgtttgtgtcactgatagggttaattgtttcatctgtaaaacaagcggtttagaacagtggttctcaatttgggctgcgtattagcatcacctggggagttttaaaaaaatcctgatgcttaggcctcactctataccaattaaattagaatctctggggcatgacccaggcagccgtattttttaaaacccttctaggtgattctaatgtgcaaccaggttttaaaaccgctagagaatttgtgagcaataacgttccccaagtccatgagtctgtgcagcatgttttgctagatgtcgttaacatgtgcacagagtccagtataaagtgaggatgagggatgaaggtagacataaagatggaatctggaaaatggttttttaaaaaaatcctagtagctctgtgttttgagcaaacactttgttatatccctgatgggaatgattttaacttcctgtaaaatgaagttctcaaatgggaaattaaatttaaatgcaatgttatttttatacaaataatatcgtttgttaatctaattagccaagaattatgcctaaatattttattcataaaacaaatagaaaaggcaggttgactacggaaatataagatatggttaatattccttagttgatggtatagattttaggcatattgaagtaacatgttgctaacaatgaaaatctctgatacttatatagtgtaagttaaaagtccctgcatcaaaaatgttaaaaacaaacaaaacccagaattactgcagtgtgcatattgtccattattaaaaactattgtttcacagttttcaaattaggaaacaaaaatttacagcattggtaagcaattgatcttggaacatataaaaattggatgacattattcgtgcaacaatctgcaaatgtcaaatgaatttattatgattggataaattatagtgaatactaaatagtttaaaaatgataacacagttggaataaaatgattgatattaagtattttagatgcataactaaacagaaatgacttttcattttattaccaaggccacttacatattttttctcatatttgtgcagctaatgagcattcaagattcatgtgctttaatctccactttttaacagggtagttcttttctgaaagttggtaacatttaaataaaagaaaaagtgctgttatcacttgaggcaagacaatatattaacaattttactacctattctttaggctttttttttttttctgggatagatttaccaaaaacggaacaaaaaaaaatttacacattttctggacagaaaggtcagtcggtcttttgtgtttttgtattctggtctccttaccctagagaaaaattcacactagccttttcatgtggaagtgtcctgaggggttagataatatgccccaacattgacaggctagattttgacaatgtggaatggagccagcagcggcattgaccacttctcaatgaaccatggtaacaaagacaatgagttcttttaccaatgatcatgagtgactgcttgttgagaacatcccaacttccttctttttttccagactgtagattctgatgtcctggtacaatataaagtgagtaaggagaatgggtcaggtgaggagagggaaatagagtgtgtaagaaaaggcgggtagttggggagagagagagtgagagcaagagcgagcacacgcgatatgggaggtagcgggaataggggaatagaatgtagtagtgaaacagaaaacgattgatgtggtattttcaccaaatttggccagtagagactgggaactaaatataatttggtttagataaattaaaggcatttaacatttttctgtactttctgtgttgtggcacaattcttagttgtcacacacttttaaaaatataaaattggtacaaataacgcccaatatttggtcattagtgagttatttctttttagtgaaaaatatctaaaatgcttctgtgaagtcttcttagtttaccatttacatagggatctctattgtcaacttaaattacttactatctacaccacttattttgtggctcattgatatacttctgtgagacatttctttggttgtctcctatcataaaactcatatactttattaacagatctaaattttaaacttctaccatggtaggaattgtctaaaaaaaagttgagtaagtgaatatatggatattcctctagagtgagttgtctaagggcaggaactaagaataccattttatccatgtgttttcagcacagcacagttcaggcaactaggaagtgctcaatacttgattgtcaacaagtactgcatgaatagatgaatagactagtatggaattaagacccaaatgcatatatccacctgcagagttgattcattcatatctcatgaaagattcatttgttagatccagatatgaatttttaatccagtacaatatgtgctttttactaatatattgtggtaaccagtctgattaatgtcaacaataggggatatttagataaaaatctcatacaaattatgaaatctatccttaatttttcaaccaaatcttatattttatatttattttctctcttatgcaaaaatgaacatagtcacccagcccaacatactcaatttctgtcaagctccaacgcctaagcactgttagtttttttttaaagtttattatgagttgcccaaaaacatcccaacaggccactgtactttatcttagaaggatctgagcaatgaaatccagaagttcttttggtgaagaaaatgttaggaatctcttttaaagtatttctgtgctagtttaaagaaattctttgaaattctcccatcgagatgtagggtctgtttctaacaccaggaaaatatgacagaatttgtacttggtgacttctgagaccaggtcatgaaaggccatgggttttctgatttgtttgctgaaacactgaatggtgacctggtaagtctgactatcctcaggtctttgatcattccatcaaagtccagctgtgaagaaccatcttggtaagtgggtcctaagccccagctcttctagctcccagctatttgagtcaccccctaaacatcaaggagaagaaataagctatgctttgtctgaattcctgacccacagtctctgtgagcataataaaaatgtttgttttatgcctctaagtgttggtgtaattttttacagaaaaagagtaaatggaataaattttgtatcctgaagagtatattttattttaaaaactataatacaataagttttgtatttaccatttatgagtaatatataatgctatatttaatttaatctaagaaactcctaatttactttactttctctaccctttcaaagtttgaaatcactaaatgataaattcagtgactcattttagcatattgtgagcccatttgaaaagtatctcaatgttacttttagttccttttccgtttccagtaaatataaattcctatagtgttctgctttttactttcattgtgcctgaggcaatcgccatggaggctggatgtagcccaggtttcttgaaggcattgttcttggcttgagtcacttttccactggactctcttctggcatatgttaatatacatgataaaataaaagaattccatggtcaaagaattgggaaacatattttaaatgctcttcttagagagtcataattaatgttagcatatttaataatctgagaagtcctagtataaggaaatctgtttgactctgtttcattcagtgtttctgaactcttttgactatacccagatcatgtgaccatgcaacactctagagaatacgctttttaatatctaatgtcttgtactactggtttagaaaatgcttattgatctagagagagtagtaattagaaaatgttcataattagccaagtagtaataagtaactattagtaattagcaaaattcaaagagcttactttattttttctttcatttatatacactctttgaaattattaagtatacaggaacctaaatgatggccttaaaaactctaaggaatgaatgattgataaatgtgaagaagaattgtaggagataagatcagagaaaaagggattagcagcaattaaggactattatagataatataggtcaattattatgaatagctctatccctcctatatggttccagggtgtttatcagagtttccaggagaagcataacaaagtgttggaaatacacatatttaaatttatgattatttaaatttgcctttaggtgtattgtttaactctcttgcatttttaaataagagtagaggagggtgtaatcatgagtataaaataattgagagcttgaggtctgagtagaacagaaaaatcacagctttggagagtgaggtaacacctttgtatcccagtctcgttggggaatggtgtattccggtcaaccaagtctccaattacttcattttgacagcaaaactgatattagagcacagatgtgagggttgaactatagaacgctctagattgatttttcaagtgctgtatacatttttagaaaagcagcactttaacagctacaaatctttaatggagttgctagaccatcaactgacatgtcaacacaccttgaaagaagcctcatcaaatgcaaaggtaaagttctgtcagatagtgttagcaaagcaaaataaactcataggaagaaggaaatatttcttccaaatacctgagtgttataaaataaaacacttcaaaagtccttagatgtttctaatatgtaatctgggtaaaaagataagaaatggaaaaagcaagaaggtaaatgaaagcacttcttaaaatatttaaataggaaatgataaaaatgtaaaagtgaaactgtgcttattagtgggggaaaaaaacaactgaagttaatttcaagctgccataggataaaagcaaagatgagcaagataatgtgtcactggcttggggaaattaaaaaaaaaaacattgttaatacttaagccagaacctattaatttctgacagaaactattgatttcagaaaactagataatttctgacaaaaagggttctaggtcaaataaatttgggtcaaacaataacaagtctttttattgagtctttattacactaatgtgtttttcaaatcattctatagtgtttcccaaatttacttggctatggaaatttttgtttgtttgttgagacttatcctcttttgggactcaggtccaaggagcaaactttgggaaacactgatctagcccttttgtttgataaagctattattgaccttgctatgagactagctgacaggtggcctgtaggcacctcatggctcctgccgttagtactcatggctctaatgactgaatttaggtggaacttgtgcccttccctggcttaaatccacaaattaatttttccatctataagatagggattatcttttgcagaaggtaaaatgagatgaagaaaggtgataagcctctcaaagtcacacaacatgaacactacatgtcagaatttgaactttaaacttctttctcccattctgctgagtattgccttccaggttaaaaaaatatatagtatctgtttttagttaaagagtgagctgtggcttggattgagcccctcttctttgaatgggactctggtttaactaaaatttagagaagttctgaagcttttaatgaaaggctacatttatcaaaaatagggcccactcattaaatactaaggcttatatcattaagaaacaatagagaaaggaagaaaaacctattcccagtttcgatgaaaagagagaaggcttttaagaaataagggtggactttccaacagagcagtcatgaaaagttgaatgtccaaaatgagtacattttaaagaaatatataaatatttttcttcagacacagaaatattcaaaagatggttacacatgtgaacgtgaaccttggaagggaggactggctatagggaaacactggccatcttcatgaataagaaatttgaaaatgaaggagcagttggagttatattaatggttctcaaattagttctctttctctttctctttctctttctttctcttctcttctcttcttttctcttctcttcccttcccttctcttttttccctcattctcatgcttctatatactttttcatactttgactgctttctctttgtcttttataaagtcatctttatgaatcagatagctaattgtggaacaccaatgggattattgaattctgtgatctatttgtagagtgctagtagttctctggcagggcctttctttgcccaaggaccagttacattgtggttgtggtggtggaagtctctttatatgtttgcttgtttttccaagatcaagtggcattgccttattcacttgcctttccccatttaccgttttcaatttcctaaaaggatttttccatgtggtctgtgatgatttagctattgaaagtagattggttgtctgaaaactggctagtttccacaagaaatgtttactatatattcctaatttgtggaaattatactttgagaattattgataaatatcctgatacaaagtttgaaggagatcacgtaggggaagagaaggttggattttctaactcagcctttgcaaggaaagatgcaagagctcttaaaagcaacccctcttgaatgtggttactgacttttactgttcatgttctagcagagtgagattttcaccctggaaaactcgggcactgtacagttttctaaacaaatacagttcaactcatcacttcttgtcctgaggattatgtagatcattggtaagtgaatgacacatcatgtatgagatatcatgtttctctggtaatgggtgagcatcaacttcaatgaacatcatagtcagaaacaaatctcaccctagtgtaaaactttgaaatcttaaagtgaaacattctacttacttagaaattggattattaggccgattctctttatggcacctctcacatttttcttatttgctacttgcttatatctattcccatcctctctgcctattcacaggaaggtaagatacatgtttattgttgcattgctgggctaaaatagggctgggcacatagtagattttcaataaatgtttgctatatgaatgtctcagggtattaataaataaacacatcttcattttaagggaaagaaattgagtcaggtgaggttaagtggtttaccaaaaagtgttataacgaactcatagatagactagaaatataattctgtatcctaattctgaaaccagcaaaatatacctctgtgtcttttatctggtgtaattgcacatgtttactaaaaaggcatttggaattttagactaattatatgccaggactaagataagttctgtctgatggtgaatccttgttttaatattatttgtaatctgttgacattatagtttttgaattgtctgagattttttctcacattttagtacattgaataaatcttataaacgtgaaacttactttttaaaatctgttacatagaaatttggtaacattcttttattagatgaataaaataattgcaatagtaattcaagaaatcacttcatagtattcttatgaattatttttggttgtaaatctttataaattttatttgtgtactaatattttgctcagatagtcatatttttattttaaagggattaattttacattctcttatactttagtagtaaaaagtaattgtttttggtagactgaattgtgtttaaatttttctcactctctcctttctttttcttttttttttgagtgggagtcttgctctgtgccccaggctggagtgcagtggcgcagtatcggctaactgcaagctccacctcccgggttcaagtcattctcctgcctcagcctccagcgtagctgggtctacaggcgaccgccaccacgcccggctaatttttttgtatttttagtagagacggggtttcactgtgttcgccaggatggtctcgatctcctgacctcgtgatccgcccgcctcggcctcccaaagtgctgggattacaggcgtgagccaccgcgcccggccccttcttttcttctgttttcctgtccttcttccatgactcagcaattctctacttggtggagtgtctggcaatgccctgttcttcacctgtgtggtggttacacaggaattagctttataattactggcagttatactaattataaaccatataactgtgtgtttcatgtactgatctgcatacatagttaataaaaattaaaaaaattaaaagcaaagttatatagtccatatgtttccatctagaatggatttaaatttaatgaaacatttgtatgtatcattatttctgattctcagaaatttataaaagtttcagagtatggaactttctatttgtgttccaatttatttatgaataagtctctaatagacaatgcatataagtgatttattccacttaaaatttattttttattagacatgcattgaattatataaagaacattaaggatgagaattgcctgttttattttttgactcttctggcataagtaatcaagtcaattttagtaaaatttctaaaggacaaggtaatttcaaatactttcaagtacttttcttctgttgtctgtagattacacatagaggtgtgtaattaaaaacttaatatagcctctagtagatgaaacatatcttggataaacttttgctcttttatcctttagaacagatgtgtttatcacatatttctcaacagaatataattttgtttaggtcattccgccaacagaaaagaaacaacatgcctatccccaccacaccctaatttaattatggatttattgctttatggatattgatattcatggatttcaaattcaaatatgaacagagtatattttgtagaaaaactaatattttaaatggtgaaatttaaaaacccataataacatcattacattatttgtaatatccagtgcgaagacaatatactatatatagttattttatttcccatctgatagggtatttttgcacaaatgtaattctacctgtaaataaaatactgatttatagtcattggaatgtgagactatagaaggttttcccccaatttttttaaattaattctccttgttaaaagggaaagtaaagcccataaataagttaaaaaacgtttgactcagaatgtaatcttttgatcataatacaacaatagatgtttgtttcttttgttgtagaataattaaggtttagtttattttattttttattttatttatttatttatttttttaatttattattattatactttaagttttaggatacatgtgcacaatgtgcaagttagttacatatgtatacatgtgccatgactcatcatctagcattaggtatatctcccaatgctatccctcccccgctccctccaccccacaacagtgcccagagtgtgatgttccctttcctgtgtccatgtgttctcattgttcaattcccacctatgagtgagaatatgcggtgtttggttttttgatcttgcgatagtttactgagaatgatgatttccaatttcatccatgtccctacaaaggacgtgaaatcatccttttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttaaagtcctttggatatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggctttgatttgcatttctctgatggccagtgatggtgagcattttttcatgtgtgttttggctgcataaatgtcttcttttaagaagtgtctgttcatgtccttcgcccactttgtgatggggttgtttgtttttttcttgtaaatttgtttcagttcattgtagattctggatattagccctttgtcagatgcgtaggttgcgaaaactttctcccattttgtaggttgcctgttcactctgatggtagtttcttttgctgtgtagaagctctttagtttaattagatctcatttgtcaattttggctttggttgccattgcttttggtgttttagacatgaagtccttgcccacgcctatgtcctgaatggtaatgcctaggttttcttctagggtttttatggttttagatctaacatttaagtctttaatccatcttgaaatgatttttgtataaggtgaaaggaagggatccagtttcagctttctacatacggctagccagttttcccagcaccatttattaaatggggaatcctttccccatagcttgtttttctcaggtttgtcaaagatcagatagttgtagatatgcggcgttatttctgagggctctgttctgttccattgatccatatctctgttttggtaccagtaccatgctgttttggttactgtagccttgtagcacagtttgaagtcaggtagtgtgatgcctccagctttgttcttttggcttaggattgacttggcgatgcagtctcttttttggttccatatgaattttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgcacattgattttgtatcctgagactttgctgaagttgcttatcagctgaaggagattttgggctgagacgatggggtgttctagatatacaatcatgtcatctgcaaacagggacaatttgacttcctcttttcctaattgaataccctttatttccttctcctgcttaattgccctggccagaacttccaacactatgttgaataggagtggtgagagagggcatccctgtcttgtgtcagttttcaaagggaatgcttccagtttttgcccattcagtatgatattgactgtgggtttgtcatagatagctcttattattttgagatacgtcccatcaatacctaatttattgagagtttttagcatgaagcattgttgaattttgtcaaaggccttttctgcatctattgagataatcatgtggtttttgtctttggttgtgtttatatgctggattacagttattgatttgcgtatattgaaccagccttgcatctcagggatgaagcccacttgatcatggtggataagctttttgatgtgctgctggattcggtttgccagtatcttactgaggatttttgcatcaacgttcgtcaagggtattggtctaaaattctcttttttggttgtgtctctgcccggctttgttatcaggatgatgctggcctcataaaatgagttagggaggattccctctttttctattgattggaatagtttcagaaggaatggtaccagttcctccttgtacctccggtagaatttggctgtgaatccatctggtcctggactctttttggttggtaagctattgattattgccacaatttcagctcctgttattggtctattcagagattcaacttcttcctggtttagtcttgggagagtgtatgtgttgaggaatttatacatttcttctagattttctagtttatttgtgtagaggtgcttgtagtattctctgatggtagtttgtatttctgtgggatcagtggtgatatcccttttatcattttttattgagtctatttgattcttctttttttctttattagtcttgctagcagtctatcaattttgttgatcctttcaaaaaaccagctcctggattcattaattttttggagggttttttgtatctctatttccttcagttctgctcggattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgcttcaaatgcgtgccagagattctggtatgttgtgtctttgttctcgttggtttcaaagaacatctttatttctgccttcatttcgttatggacccagtagtcattcaggagcaggttgttcagtttccatgtagttgagcggttttgagtgagattcttaatcctgagttctagtttgattgcactgtggtctgagagatagttagttataatttctgttcttttacatttgctgaggagagctttacttccaagtatgtggtcaattttggaataggtgtggtgtagtgctgaaaaaaatgtatattctgttgatttggggtggagaattctgtagatgtctattaggtccacttggtgcagagctgagttcaattcctgggtatccttgttgactttctgtctcgttgatctgtctaatgttgacagtgggctgtcaaagtctcccattattattttgtgggagtctaagtctctttgtaggtcgctcaggacttgctttatgaatctgggtgctcctgtattgggtgcatatatatttaggatagttagctcttcttgttgaattgatccctttaccattatgtaatggctttctttgtctcttttgatctttgttggtttaaagtctgttttatcagagactaggattgcaacccctgccttttttggttttccatttgcttggtagatcttcctccatccttttattttgagcctatgtgtgtctctgcatgtgagatgggtttcctgaatagagcacactgatgggtcttgactctttatccagtttgccagtctgtgtctttgaattggagcatttagtccatttacatttaaagttaatattgttatatgtgaatttgatcctgtcattatgatgttagctggttattttgctcgttagttgatgcagtttctacctagtctcaatggtctttacattttggcatgattttgcagcagctggtaccagttgttcctttccatgtttagcacttccttcaggagctcttttaaggcaggcctggtggtgacataatctctcagcatttgcttgtctgtaagtattttatttctccttcacttatgaagcttagtttggctggatatgaaattctgggttgaaaattcttttctttaagaatgttgaatactggcccccactctcttctggcttgtagagtttctgccgagagatcagctgttagtctgatgggcttccctttgtgggtgacccgacctttctttctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaatttctcctggatgatatcctgcagagtgttttccaacttggttccattctccccgtcactttcagccacaccaatcagacgtagatttggtcttttcacatagtcccatatttcttggaggctttgctcatttctttttattcttttttctctaaccttcccttctcgcttcatttcattcacttcatcttccattgctgataccctttcttccacttgatcacattggctcctgaggcttctgcattcttcacgtagttctcgagtcttggttttcagctccatcagctcctttaagcacttctctgtattggttattctagttatacattcttctaaacttttttcaaagttttcaacttatttgcctttggtttgaatgtcctcccatagctcggagtaatttgatcgtctgaagccttcttctctcagctcgtcaaagtcattctccatccagctttgttccgttgctggtgaggaactgccttcctttggaggaggagaggcgctctgctttttagagtttccggtctttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtaccctgccgtgtgaggtgtcagtgtgcccctgctggggggtgcctctcagttaagctgctcgggggtcaggggtcagggatccacttgaggaggcagtctgccggttctcagatctccagctgcgtgctgggagaaccactgctctcttcaaagctgtcagacagggacatttaaatctgcagaggttactgctgtctttttgtttatctgtgccctgcacccagaggtggagcctacagaggcaggcaggcctccttgagcagtggtgggctccacccggttggagcttcccggctgggctgctttgtttacctaagcaatcctgggcaatggcgggcgcccctcccccagcctcgctgccgccttgcagtttgatctcagactgctgtgctagcaatcagcgagactccgtgggcgtaggaccctccgagccaggtgtgggatataatctggtgcggcgttttttaagcctgtcggaaaagcgcagtattccggtgggagtgacccaattttccaggtgtcgtctgtcacccctttctttgactaggaaagggaactccctgaccccttgcgcttcccgagtgaggcaatgcctcaccctgcttcggctcgcgcacggtgcgtgcacccactgacctgcgcccactgtctggcactccctagtaagatgaacctggtactgagatggaaatgcagaaatcacccgtcttctgcgtcagtcacgctgggagctgttgaccggagctgttcctattcggccatcttggctccacattcagcggtttagtttattttaaaaagagaaaagattaaaaggaaaaaagaaaccaaaaggcagatatagttctaatgaattagtcttagaagtaaatcagcccactgggaatgaacttcttttgaaaatgcagtgtggagaaacaggttaaactctgatttttgatgacagaagcaaggggataaaatttatatacagattgaattctggttgtatttctaggacagcatttgtgcatgctgctttgagacccacgtcaactctttatctttctctttgacagatcagtattgaaatgagaagcccagcagctactaagccctggtgcaagtgttctttccacactaccaaactctctcttattgttctattacttaggttcttcttatggattggttacagatatttaacttgagagagaagacaaggaaaacccattaaataataattgttgggaaatttactgtttaagttacctggtgtttattgatgtctgaaattttcaacgttcccagtcaggttagagatataaatgaagtgtgaagcttaccatatccggaggacaataccttgtatgtacttatttgctgatggaatgaatggtaattatatgaatgaatgaataaattaatgaattacagatagaaaataattgtaaattactattacaagttgaactaaatggaacacttaagagtaggccaaccctacacttgtggacggataagaagaaagagagctaacacgtagttggggggaacaacaggagaatttatgagaatagcagatcaaatgtaagatgcattttgaaggattacaatcaagacatatttcatggaggagctggcacttgaggtaagtataacaacagtttaaaataacatcagatttctttttttgctatcctttctacaaattgcaatgagaacactgactcttctttaattttgattcttttatttgaaaactgggttaattcaaataaaattatccttccttagcaaaggtaggatttctttatcgaatgtcatcttcattattaacccaatttagtgttataagactttcacactttttacggaatagtgcatggcatgttgtaaggggttaatgtttattattcgactgactgtatatcaagttatagtcacagtaatctttaaaccaagagcttctacttttctggttcctgccttgatcaactttccttttttttccccctgtggctctgtctttggacttccattctgtacctgaactatctattggtagtctcatcccatctcatggctttaaatatcatctatatgatgactatttacaactgtacagttctagcctgtaactctcccttggactccaaactcctatatgcactacttaaatgacatcttttgttggtatttaatagttacttcaaacataatacatccaaatgaaattctttagtttgctcctaacagtttccccaccttgcttaatgccacctgaatttctccaattgctcaaaccaaagacactggagtcatcattgtttcttttatacccacgtccaattcattagcaaatctgttgcccctattttcaaaatatgttcagaatctgaccatttctcttaaggtccattgctaccaactcttcattgagggacattatgttggtagcttgaaatcagccatcatgagagtatttacacctcggaaactggcaaacactacacattggggattattttctgagagactgggttttaacacatttaaaacacctttggctgttgggtaagctatagccatgtactttcctgcatgaaggtcagggattttatttagccagtcatggtaaaggaaattatgggaggtgaaccaaccaggagaatctgcattgtaaaaggaaattcaaatagtcatgagacaggaaggaggaaaagaaggattggtagccattattagaggcagccagtacattcttgtatcttttccagttggtaattgaatgaacaaaggtctaggattcacattcctgaaaatggaggcaaggtaatggctagataatcacaagactttagccacataggttagagataaggacagggttccattcctaatgaggaattggaaatctagacagggacattgtgaagaatattagtcagggatgtaatattatctggagaatggtgtcttggcaagattaataacttaatacccattaatattgtttatcacactttaatatttttatttcaatagtttcacactttaatttttgtccaaccctgaaaacagtggttctgaggtttatgcatcagcatcacctgggcttgttaaaagacattactgggttccatcccagagtttttgattcagtatgtctgtgtcaaggcttgagaataatatatgtctaagaaaatctccaaagatgttggtgctgcagatctgaatgtctcaatttgagaaccacttatttacggaaaaagcaaggagcaggcagggatggtggagactgcccgttgtttttgatgccccttgctaatgatagctgtgcccaacttccctaatatggttgtgagcaagtcagctatagccccaaatgtactgtctcaaaggttctgcagttagccagacccttactctttggaaggcagtttggtttccttgatggtattattcctttttccttgggtggcttattcctactggtggcatgcagtactcttcctgaaaagaattctcattcatcagtattcaattaaattttcagaacaattatgatcctagtgatattttattgtccttgattagctagttcctcaatccaatactgagtttagtcacatgatgtagaataaattggaaaatacagagttccagtggtaacaaagatgccagttcttatccccagcccaaaggatattgcaggcatagaaaacaagactgattttatgctctgttggttaggaaattgagctgaatagattttctttcgaaaattagataagtggttctcaaagtgagatactcagacctgcaacgtcaatgtctcttgagatcttgttggatgtgcatatcctcaagacttgccaaagacatactaaatcaaaaactctaggatggaacccagtaatacctacattttctgagagagagagtgtgtgtgtgtatgtgtgtaagaattgttagggggaacagagagagagtaagctagaaaaagaagtagaagtgtacagctgaatctataggtagaagaaagtatcagaaactacctgggaagaattagaaaaagtaggggttgctacaatattatatttgttccttataaggtcatagtcatctgataattagcaaaaatgtattaaaatcttctgcgcatatgatatactaatgatatagtaatacagctcacttgctaattacacatatttttaaaatttattcatttaaaaaatcactctagggactctacaagtatcttactccacgaatgaaagatgaattgcttgaacttgtaagcttttgttttgataaaggcacgttttacatttcatttactttttacatttcttttaaaagtattttaacattataaattttcactgatttatactgattttttcaattaatccaaattgtggaagcttttctttcttcactaatccttcagtcctccaggctctgttagttgagataataattagaagtttagtgaaaaaaatgttcacacaagaatagtgtaaaggttaagatgtttgcatcacagcttggagcatgtctacctttcattttttagctctcgtctttccagttgatcatgtaagtagatttaaactccgtcagtggttccttatcttaagtgcacattaaaagcctcctttgaaaatagtaatttctcactcccacctctagatatttgtctaggatgtgtgtcgtagtccgtttgtgctgctatcaaagtgacaaaataccagagactgaatagcttataaacagcagaaattcctcacagttctaatagctgggaagtccaagattgaggtgccaggagattctctacctaatgaaggcccacttcctgattcatagatcacaccttcttgctgtattctcacatggtgaaagggacaaggtagctagctctctgggacctcttttgtaagggcgctagtcactttcatgaggggcttgccctcatggcctaattacctaccaatggctccaacttgtaatactatcacattggtgattatgaatttggagggacacaaacattcagaccacagtaatggactagaaattaaacttaaaaagctttctaggtggttttaatgtgcaaccagcttgaggatgactgcacgagagaaaaacaaaattcacgataacttggaataactgaacaaacacattttgacaagtttttaaatccagcagccaaatcttattatcctctagtgatttacaattcacttcatcttttaaatataaaaatatttaaacccaccctgatcttgtgacatgagcaagggagatgatagtatattcattttacagaaaagaaggctaagaatttatatcaattttgtaaacttaattaggtacttaagtaattttatgaagatttatttattatttatcagtaacatatatgttgctaaacactggactgggagatttccatttcataacatgaaggtgatacattcaatttcatagcattaggatgctttcctttttatacacaaacttgaccctcaatggatacaaaccatagcttatgttttcctattttttgtaaccagtattagttttaaaacatttcaggcacagtttgcatttatcatccttgtttattttgactcattcatcacattcatgatgtttacagtactttcctaactttggggccattattaagctgagaagtgacattaaccttcccagagagaattgtcgacacaggaaagctgacagcctgatcttctaatatgaaatcacaggtttgaaaggtgaggaaattgaccttgaaatcttccctttgccatctactggactctgagcagtcaaagtcattctgactgaagggcaagctgggccgtttgctctttgccttttattacactttttgtggcagaccaaacctccattagaagactattgaaaaatgccataagcacagctgcaagaaagatttctttgtgtttgcacatcagcacagtagcttctgggcttatttgaatgccatggtgagcgcttttataaggcagcctcacatctttagaacaaacgtgtggtggagttggaatttgaactcaaagttactgactgccagacttgtgctcagatcagcaggttctgcaactacccagctgttttgttcttgtagaattgggctgagcagcaaagaaaaagagagcatagcttatgaaataacatgattggttcaccaagtgcaaatatgtggatcaggagcttgatgcttctgccaataataaatgaataagagaagactcatcagtggccattttaataaatacattaatgaaagaatggaaatgtggaaagaatatagtggaatacgtattcaagcaggttttttccagatggtcaaatggtaggacaagagattttcagaagtcacagctgagaactttagaatactgaatactaaataactttagaactgtaggaatactgcttggagagaaatgaaaactatttcccaaaggagaattttgtaggctgtacctttgtttcattcgcttcttctagcatgggcaggtccttgcagaaaggactgagactggctttatcagggtcttattaatttctgtatctactgcaagtataaccagatatcatttgttaaaaatgggttccaattcaacagattctcttataatatgggcatcattatcctctcccattttatcagtgttgcatatcatttttacaattgttggtaatcttacacccataaaacatgaaattaattaaacaaaaactacttctttcgagtattaaacaaacaacaactgcactttaaaaaataagctttctgctctatccatgttgctgcaaaggacatgatcttgttcctttttatggctgtgtagtattccacggtgtataggtaccacattttctttatccagtctctcattgataggcacacgggttgattccatgtctttgctattgtgaatactactgcaatgaacatacacatgcaggtatctttataatagaatgatttatattcctttgggtatatacccagtaatgggattgatgggtcaaatagtatttctgtttctagatctttgaggaatcaccacactgtcttttacaatggttgaactactttacatacccaccaacagtgtaaaaccgttcttttttctccccaacctcgccagcattaccattatccttaggaagctaacgcaagaagcaaaaaccaaacaccgcatgttttcacttataagtgggagctgaacgattgaacgatgggaacacatagacatgtggtggggaacaacacacagtggggactgttgtgggggtgaggcaaggaagagcatcaggaataatagctaatggaagctgggcttaatacctaggtgatgggttgacctgtgtagcaaaccactgtggcacatgtttacctatgtaacagactgcacatcccgcacatgtatcctggaacttaaaagtcgatgaaaaaaattaaaataataaaacgaagccttctataattaaccctacaaattcaattgtttgaagcctccatcatgtcagggtacaggaggatctagtttttgacaggattgtctccccaaaatttggggacttcttagaggatgcttatgcattatacaaatctgttcttggtataatgttcaattctactcatgaaccaaacctcttctacaagtcttcttgtacaatttctgggtaagagatttcccttaggctagtatattatttgtatgtagaaacatactttccattaatttctttcagtgatagctgatatgaagctgaaatttaagtaaaaggttaatgaaatattagggataacataagaaaagtgttacagcttctatataatatatgtctatgtatgtgtgtatgtgtatgttgagtttgtggatgtgtacatacatacttcatttctcctctagtatttcagttccagctcctttatgccattctttcacccagatacctgctctgagggaatccatgttggtaataaggataacattctgaaggggagaagagagagggatagatggctacaaaacaaaaagaattgcactatttaaaagcagcccctcccacagactagcatttctttaaggtacatagtcacactgctttttgaaagagaacagtttcctcagtggcagttgaagacattgtttggatagaaattgtgtttttaacatgatctggcatatactggtaggatgccagtagaattgtggaaaactgcggctggaaaccattgtagagggcttgcagtgcaaactttctctatatggatgagaaaacagaggcacagaaagctacatgccttattttagacaactgagatagttagtagcccaaagaggcctagaagcctgagaaccactaagtcagggttattgacttagtcacctcttaagagggtgacttagtcaccctctttaaaatgtgtgagcaaatttgggcattgttgatttattgtaaaatggtatgccaaagcacaacctgttggtaaatagcataaaacccagggacatccttaaagaaaataataaaataatgttctttgatttctctttcattcctcttccttcccttctttcacattttatctcaaacgttgtggtacaggagcctatgctcacttttaggcccctgttctatacatactctgactagtgtcttagactcaagcgtactgttttggctttatcttaagatcataactttcccgttgctcttgatccaaaaatactgtatttgttttttgtaaatttattctggcattctgtactcttctcaagatagtgtgaaaatgtctaagtcattaaagacaagcaaatatgtaatgaattaccttccaggggcacagtgttataatataccagtgtgtcttaaaccttaatctccatgtaagtcactcaaagaccttatttactgggggaacctgcccccgatagtcacataggttcttttctattttccctaagtgtcagctggtctgagaaataaaaggaaagagtacaaaagagagaaattttaaagctgggtgtccgggggagacatcacatgtcggcaggttccgtgatgccccctgagccgtaaaaccaacaagttttattagtgattttcaaacggggagggagtgtatgaatagggtgtgggtcacagagatcacgtgcttcacaaggtaatagactatcacaacgcaaatggaggcagggcgagatcacaggaccacaggactggggcaaaattaaaattgctaatgaagtttcaggcactcattgtcattgataacatcttatcaggagacagggtttgagagcagacaactggtctgaccaaaatttattaggtgggaatttcctcgtcctaataagcctgggagcgctatgggagactggggcttatttcatccctacagctttgaccataaaagatggccaccccctgaagtggccattttagaggcctaccctcagggatgcattctctttctcaggggtgttccttgctgagaaaaagaattcagcgatatttctcccatttgcttttgaaagaagagaaatatggctttgttcctcccagctcaccagtggtcagagttaaggttatctctcttgttccctgaacattatcctgttatcctgttcttttttcaaggtgcccagatttcatattgttcaaacacacatgctctacaaacaatttgtgcagttaacgcaatcatcacagggtcctgaggcaacatacatcctcctcagcttatgaagatgacaggattaagagattaaagtaaagacaggcataggaaatcacaagggtattgattggagaagtgataagtgtccatgaaatcttcacaatttatgttcagagattgctgtaaagacacatgtaagaaataataaaagtattaatttggggaactaataaatgtccatgaaatcttcacaatttaggttcttctgccatggcttcagccagtctctccgttcggggttcctgacttcccgcaacacttattaaaatgcagattctgattcagcaagtctgggtgggctctgggattctgcatttctaagttgtttctcaggtgatgctgaagctcttggtacattgaccatactctgaacaataaggcaattgctataatagttaaaatacttgcatttcaaaagagggcatcaatattttgaactaaaaatgacaacatgagaatttcaagcagaagtgtttttgacaatctttgtatcactacatatagtcaggtggttattatatctctgtatcagatccatttgggaaagcccttttgagctcattatatggaagagtacagaagattggacaaatttttctttactgatgacaaatttcaaccataagctgatgatttattctcactcttctagtactttcctgtcttcctccttcctttacaaataaatttttagagcttcccgtgtacaagattctggttttgttttatctgccttccaaaggaaaaactttagaaatatttattgaatgttcattatttcttagttggtaggaacagtgggttctaattttaatttgggaggagattagttttctttctctttatccctctagcccccatggcaatctactcttctaacacatatcttgtactttatttttcttttttctctgtaattgtgttttcaaaaccagattcagcacttttctccttcctccaatgttttagaatgtgcctaccagtatggcttaattttgccccaacatctattatggtgctttgtatattaatatgcacaaataagtctcagtaaatgaatacacaataaatgttcatggtatttaattgacttggttctttagggcaactctcccccatgctggttttcaatgacatacggaaaatacctgtgggttatttgtttgcccctcctagatgctactgatgcaggtattctctgttatttatatatttaagtacttttcaattaggacagcaacacttttattcccatgcaaataatacccccttaatcctacaattcctacatgtgaagttgcaaatatcatctccttggcatgcctaatgtagaataatcttatgcacctgctttttctctttgggcattgtgtttggatgcaactaggaaaaatgagtaggtggttctgataattccttctaaatttgagcctcttctttgaatgaagtcgtggggaggatgtggataatgaaattgccaggccagaatagagatcttttgtgtgcttctaatctacgtgaaagacagcattcattctttataaatcttttattcctgctcaatacttattgagtaccagtatgttccaggcatagttagcagtagcatcccttccttcctggagtcaaattctatttgcgcatgtgtgtgtgcatgtgtatatgcacatgtgtgttttatgaagttaacaattaaatttagaacatagttcctattagggataaaaatagtgaaactataggaagcagattaggaggataaatgggagaaggaatagtatgggccttaaattttggcttttaggaaaggtttgtttaagaagacattcgagcagacacctgaggtgaagtaaggggtgagacatatgggcactggaaaaaaaggttccagacatggggagcagcaagtgcgaaacccctgggttgagaatgattctggaatgctggatgaaaagcaggaggcttatgtggcagatggagtaagtgaggtgagtgaagagatgagttcagacaggaggctagcctgtacctataagtggctgctcagtaaaaatcatgatactcttctgttttacaatttcagtggcttttattgctcttaggatgaagatgcaaaagcttgcatggcctgacctctacttaattctcaagcctcatcaggcatgctgtactctcccaagttctctgttccagcccccacactctcctgtggcttcttttggttcttctcttttactattcttgtcaccgcagggcctttgtatgtgccagtcccactgcctggagaactcttcacctacactcccaacctttgctcctttgcatctcagcttcattaccagttccttagagaaggcttccatggccttcctataatctctgttaggtgcactcatggtatcatgcaccctttcttcatgaaacttatcaacatttcagtgttgcttttctttatgtggttatttaattaatgtcttttcctgctgccaaattataagaggcacaaggctagaaaccatgagtattttttccaccacattatctctaacaccttgtatggtatctgtcacacagtagttgctcagtacatatttcaatagttgattacaaaaaaatgaactccctttttttcctgctttactttcaccttttatttctcttttcttttttttctctctgctctctttctttcttcctcaattctttcttcttttatcttactttctgaagactcttttaccgctgaatttgagattccatatggaagtgaacatttcctaatgactaaaggatgatgatagaaaggagttggtggcgtttaatagcatgctgccgttctatctgaaatcaaagatccccttcataagagagcatgactgttacatcttccttaaaatgaaaacctacatcaaacactgcagcaggggtacttttccatttcatttcttttgttctgcttgtggctttgctgaatccatctatcattaacatttataatttagcattgtcttctggcacagtgtgatgcgatctgtattgctgacagatgtgtctcagtcttggtcttaggtctttcagctgtctggtttctgggattttgcttatctaagcatttcatttgtcacactacctgccattgtcaacacgtttgtctttatcctcagtcattagtttcttatgctctgtcttaatcccattacagggtttgttcttgctatttttatttgtcacggtatctattttagtagcagatgtagttgtcagaacatctcctttgctcctgttattggtgtcacttgtgcattcagtgttagactttgtcttgtgtgctattctgggtctttctatgtacacttctttgtccacttcattgttttaatcatatcagatctttttttttctcccaggaatgcataattgtggttcatttatttcttcttgccgattctgaatatggtcgagttgctttgtctctgatgcaagcattttcggaaggccagatcaatggtgtaacagaagtgaatgcaaatttatgagtgtttggtctcaacatgtgtgcactcagtcagagaacagagcaagagtgtgtgcttttgattatgtgaggatagtatgttcacttataggcttgatttttactatgtgctcttcatatttgttttaatatagtctactggatgagaggtttatttttttttctcagtttagtgtatttctattgtcaacaacattttgaagtagaatacactttatctttcctacacttgggtgatggattaacaaagaaagcaaaagaagtttattctaaaacaaactgattgcttgaaaaaaaagctaattaagcaatggtttaacgaaaaaataaataaaagatgaggataaacatggaagggtacggataataaaaaacaaataggacttggcttgataatggtatacacaatattagcctcagaagtaaccatttaacatttacaattgattctcgcataacctaaaataacagagtacacgagggagcttcaacttactaaaagatagaagaaattctcttgcttgggaattggagatactctctcagaggaactagctatagcttttctaaggttttgatccaactcataattggtggaagaaaagagaatgtataaaaatgtctaaccctaggaatcctgtaattgcataaaatattttatgtccaatcaactgatttggaaccgtatcattctaagattcatattctccctctaccctgtgattttaacaattgcttttaagttgttgagttttaaatatttgaactgttttgttagtttgattcttctaaactgaggaaatcagaatattagtcgcttggaagaaaagacttaattttaattatggagtcccaggaatcaaggaatccaagagacagtagacgcttgaaacactggatttaaactgcctgtgaagctcttttcaccattaaagtgtaggaaaatagactttttaggggaaagagagatgttcattggagtttgggttttttgtgcctaatgacagccagcaatgcaaatttgaaagacgtctgtaaggctcttcaaatgaaaagaagagcacttccatatttatcctgtgaatgaataaaacacaagatcagtagctgtttaggctggagaatatttcatatatacatgttaatgtccatgcaaaaatctgcttgcatataccttatagcatcttcccactttgtacctctgtggtatttggtatatagctctaaggcttttcatggcatcatgattgtttgaatatcttctgtcacccttgttatgagctccttgggtcgattcactatttattaagccagtgctttgtgaattcttgttttttaatatataatttttaataaatggatgtcattctataatctatgccagataattaagcagtaaggttacatgctgtacatcattttccaacttaaagaatttatagccttagaatagggcagtgaaaaaaaggtccatgttgaaacattttcaggtaggcatacaatcactgtgtgtgtatgtaaaatacttgaaaatgtgggtaactgtgataaaaaagcaggtatctacaaaatactaaacatatgctccacattgtataaaacactatatgatacatatgacatctaatttactcatcataaaaatctagtgcagtaggtatttgtagtacttttttggtgagctgctggctcaaagtagtttccccttttctgggaaaaaaacttgcgagatcttgatgactacatttctaagttgaactttaaatttctggccatagcttgtggatccatggtttggatatgatccaagcagagattaatcagatttaatcttccaagatgtggaaatttgggaaagagacagagagactgggaatttttggagctgagtcatattaatgacagtcaatgggaaggtcacctgtattcattcactcaacaatatgtattaaatgccttgtgtgttccaggcaccaagcagggcctgggaattaaatgacagtaaaagtagacataatctatgttctcaaggaatttataggttactagaggggaaaacggtaataaaacactcataaaactaaaactataaactgatataaataaaaaaatggaatgtagttctatgataataaataataatagaatctaaaacaggcaaagattgggaagtagtaaaatttactttttttctacatttattgtttagaaagcacattacgtaagtggaagtgatacacgtggttgagagaagacatttcagggagaggaaacagcacgtcagaagccctagaatgcaagagggcagcgtggtgcagtattccagtgtgcctaaatactgagagctgggaaagagcagaaagttagtatggagagtcttgattgcctggttaaaaattattgttcgtattataagaataatgacattcaagagaaaggttttcatcaggggcctaatatgatcagatttgtgatcagatttagtccatgggaaagttgatgctagtttgctatggcaagagcaacagagtgggaaaagaagtgaatgggtttgataaatatttaaaaaataaatgtaatagaatttgatgataagatttatcaccagaaagagagagagagagaggtgtcaagtatgagatcaggtatgatttccagatatttgacttgaaaaggtagggatagataagttcaccaagttagataactttaagactcagagtgaattgattggtgttgaacaatgtaggattttatgtgcccatttgaggcagttgtgatggtcatggattttgtttctagcatatgtaaaggattacttatgttatttttgaagtttaaagtttggtaacagagaacttgcctagaaaaagatggtggtaaggatttcttaattttctagatcttcttgggaagaaattcatgaatcgtgaaggcactcaaagtgagtcagatcgccatctggtgactatttacagaaatagcagacacatgctccctgggtacatacttataactaacatttattgagaaattattaatgcctggaacctgtgctatacatttatatgtagcatcatatttaataacagattataacatactgaaatttaaagggtgatataaggtaatactattatatataaagaaagtatataattgaatggtacatgaataatttaaatgaaaaaagtattgagatgacaatgggatgatgaactgcacctcccctctctctgcttctgtcccccactgacatatgtacatgcacattcacattaactattttttcaggagaaaatttggaattaattctgctatagaatttggtctcttccctcctaaagaaaaaagagtcattgatagctcttgagttagctctttttaatgtaagccaggtttagaaaaaagtcaactttttttgcacaatacatccatttatctattcaacaattatagactgagcacctattatggtgaggctctgttctactgaagattcaacagtaaaaaaaatgtatgaaaactcctatcattatgaagtttcccagtgaggggagacagaaaatgacaaataaaatgtataatatgccacatagacttaagtgctaagggaaaaaaagcgcataaaggggataattacagatagtagaggtataggaatgttgatattttgagtggatattagattccatgtaacaaaaacttcaaggtgataaagaaacagaccctctggacattttgaggtagagtgtccacaaagaagagacagcaagtgcaaaggccccaaggttggaatgtgcctagattatttaagtaaaagaggcctatgtggctgtggtagagttagggaggggctgactgaaaggagaggaagttgaggataccaggaggagagttcatatttggtcttggagttcactttaagggctttgatttttttgcaaaatgaaatgagatcctgctcagcagaaatttacccttttcttgatatgagaatcagattttgttccttgaagagaatttcacatctgttttagagagatgggcttacttctcagattaccaacaagagacctactctatcttcttgctggtggaaaattgggagttggagtgttcaccttcttgcccactggcaccaccgcatttcatctcttccatctctatagccagacacagctcataaggggttgaattgtgagcctcattggagtttacccttaaagagggataggatgttggactaagagactcagaaggtaaggctgcgtgtagagaagaaaatgaaaagggctgggcattgtggctcatacatgtaatcccagcactttgggaggctgaggtgagtggttcacttgaggtcaggagtttgagaccagcgtggcaaatatgatgaaactctgtctctattaaaaatagaacagttagccaagtgtggtggcacacacctgtagtcccagctactcgggaggctgaggcagcagtgagctgagattgtgctactgcactccatcctgggtgacagagcaagactctgtctcaaaaaaaaaaaaaaaaaaattaaagagaaaaggaaacagagtgcctatagaggacacctttcttttcaagatctaagtgtaaaagcgccctcacttgtgtgattcagggggttatgttaaatactaagcttcctctcaggatggactacaattctgagcattcagccaagaaactcatatccaaccatggtggtcttgtgtgttttatctgggagaaactgccaaacaatggggcccaggaggactaactattctcttcagtcctcttatagatactcgagcagagataggactgttgtgggttggcttgtgcaccaccccacaaccccaaaataagtattttgaggtcctagcccccggaacacatgaatctgaccttacttgcaaatgggatgtttgcacatgtaataaagataaggtcatagtggattagggtgggccctgaatccaataactgatgtttttataagaagtccatataaatacacaaagacacaaagacacccagaggagaacaccaagtgaagatggagaaagattttagtgatgcatctacaagccaaggaccacccaggattgctggtgactatcagaagctaggagagaggcatggaacggattttcccttagaacctctgagaggaatcaaccctgctgacagtttgattccagacttctagcctctataatatgagagaataaatttcttttgtttcaaggtattcaatttgtggtactttgccatgacatccctaggaaactattacaaagaccaaaggggttttaaacccacaatatggatgtttatctgagaggtacagagaactatgaactgaaaaaatgggatataaaatccttaagcatgagagaaaatggaattcctgattgtactccatgggctaaaaatcaacaacctttaaggtagaaaatgaagcctcagtacattaaaatgtttagattgacgttagccgagagtatttcctgtctgatgtactgccagatgtatcagtatttataaactgaaagacagagggctggatatggttcataaatgcagctactcttgaaataatacacaatactattgggccagaaattctgcaacaattggcagaagcttggtgttggtctgtccactcctgagtgtagatcatatgcaatttccagctatcctgggtccccagtggatgcatatgcccttagacttgattcactctcttttgcgttacgagactcttctaggtaagttttgataaccagtaaacatgaatctcatttaatttattttactttttaaaacaaccctggaagcaagtattatattttctgttatttgtgaggaaattcagaggtcaaaagactgagtagcacagcagagatggcagaaactgaaaagaaagggcagaatttttaagcatggagagtacaaggaaggacattctgagcagaggggacaatgttcaagtaaagttacagaggagagaattgactgtctttgaggaggccccagctgtagcagacagaatctgttgggaactgaatcttgaactaaaacgtggaggactttgaatactatgtgaagaatttggattgaaattgtgggcaatgagaagccagaagtccatgtggcacttgtatgtatgtatgtttgtatgtatttgtgaatgtgcattcaattgtgtgatatgaaagagggaaaagagtggactgacacaaagattagaatttcactttaaggattactttggcagccatatatagaatagcttgagaaaaatacaatttatgaggctttcaaagtgtgagaaaagaggagagaatgatattttctcagaaattgcttactggagcagttagagagacaatctacatgaatgactggttttatttatgtgtgtgtgtgtgtgtgtgtgtgtaatatacacagtaatgaaacaaacagattattttgtaaatttggtgggcaaaagcagctgagttgtccaagtgtaaaactggattttgaaaaaattccacctgtaatgtataggtttccaatctagtctatctcttttaattttaataagtcaactgccaagtgacttctccagacactattgcttaccattagcttttgtttggccttggtagtaaagcattaaccaaaaatatggaaacatattttgggaagaactagtctccccttaatgtgatctcggtgaggtggtgtgtttattaatgtgttttcatactgctatacaaaactgccccagacagggtaatctgtaacggaaagaggtttaattgactcagttcagcatggcttgggaggcctcaggaaacttatactcatggtgaaaggtgaaggggaagcaaggtacctacttcacgaggtggcaggaaggagaagtgctgagcaaaagggaagagccccttataaaactatcagatcttgtgagaattcaatcactatcacaagaacagcatttgggaaaccatccctatgattcaattatctccgcctggtctctcccttgacccaggagaattatgggaattagaattcagaggagatttgggtggggaaacaaagcctaatcatataagtgtgttaattcaatgggcagttaccttctaccagtcccactaattactttgacaaacaaaatatggcaagatgatttttgaggtatattcaaaactagtattgtagttttgcttagcattctgctatagagtactaggaaaataacaaggaattgaaattatgtgtatttttttataaaaaatacatttttgttttattttatttatattttcccagctttactgaggtattgacagctaaatattgtatttgtttaaggtgcacaacatcatgttttgatatatgtaaacattgtgaagtgattacctcaatcaagctaattaacatatctattacctcacatgttatcttttgtctttttaataatagccaatctaacaggtgtgaggtgatatctcattgtggttttaatttgcatttccctgatggttaatgatgttgagcagctttttatatacctttgccatttgtatgtcttgtttagaaaaagtctatcgaggttcttttcctatttttaaatattattttccaatttggatgcccattttgttgttgttgttgaccaatttctctggctaggatttctagtactgtgttgaatacaagtggtgagagttgacctctttgtcttatttctgattttagagaaaaaaaattcaatccttcaccactgagtacagtttttagttatgtacctgacatacagagtactaatgatgttaaggtacattctttctactgttaacttattgggagtttttactttgaaaggatgttgtattatgtcaaattctttttcatcctctgttgagatggtcatatgtttttatctttcattgtgttaatgtggtgtttcacatttattgatttacatatattaaaccatccttgcatgataaacatggatgaaaaaattctgaaggaaatactagcaaatggaattcagtggcacattaaaagtattgtgcatcataatcaagtcaaatttatcccttcatgtgatttaatattttctttatgtattttagggttttgatattagatgcacatacatttatacttgctatgtcctctcgatatattaacccctttattatcatataatctttttttgtctcttgcggcaatttttttacttaaagtgtgtattgtctgatatcagaatagccactcctgctcttcttcagttatcatttgaattgcatgtctttttccaacccttcatttatattctatgtgtgtccttaaagctaaagtgaatctcttctaggaagcatatttttggatcatattttttaatgtattcgacaactccatatttgctgattgtagaatttaatccacttacttttaaaataattattggtaggtaagaagttactcttgctgtttttaaaattgtttcatgactgttttatagtactttttttgcttttttcctctcttgctgtttaattttgtgatttgaccatttttttgtggtggtgtgctttgattcgtttccctttatgttgtgcatatttttataggtttttaacttttggttaccatggggtttacatggaacatttaaaaaattagaacaatcaattttaagctgatatcttaattttgcttgcatataaaaactcttcatttttgctttttccccctgcccaatttatgtcattgatatcacaacttacaactttttatattctggatctattaacaaattattatagttatagttacgtttactacttttgtctttcaacttttataatatagttaaaattaatttatgcaccattattacagtagtagagtattctgtatttgattatatatgtacatttttgcgagttttatatttcatatctgttcatgctgcctattcgtttctttttatttcaggttaaagaacttcttttagcatgttttgtagggcaggtttagtggtgtcagttcattcaggctgttataacaagactaccataaaccaagtggcttataaaccacagaattttatttcttatagatttagaagtgaggaagccaaagatcaaggtgacagcacatttgtcattcagtgaggtcttgctttccacttcactgaaggcatcttcttgctatgttcttacttggtggaaggggcaaacaagctcccttgggccttttttattagtataaaagaactaatgtcatccttcagggctctgatctcatgacctaattgcttcccaaagtccctaatttttaataacaccccaatggagattagttttcaacatacaaattttcaagccatatgaacattagaccatagcaagtggtgatgaacgtcaatgaagtacttcattgtttgttgggaagcatttatcttttctttatttctgaaggacagctctgccttgtatagtactcttagttggtagtttttctcctgtaggacttcgaatgtatcattgctctccgcctacagagtttctactgggaaattcactgagatctcaggaaggtctcagttgtatgtaatgagtcacttttctgttgctgctttcaaaattccttaaatttttttttgacttttggcaatttgagtataataagtctcactgtagatctctttaaattcaacctagttgaggtccacttggcttcacgaatgtggatgtctattttgctccccagatttggaaatttttagccattattctcttaaataatcttcctccttatttccctttctcttctccttctgagactccaaagatgtgtatatgggttgcttgatggagtcacatgagtcccttagaccttcttcactatttttcattcttttttcttctctgactggataattccaaatgacctgtcttcacaatcactgattttctcatatgggtaatcaagactgctattgaattcctctagtaaatttttcagtgcaaattttgtattctttggttatggtatatctggttagtttttttaaaaatcatttctatatgtttttgtacccattttgttcacatactgttttcctggtttcacatagttttacatctctgttctcttgtaactcactaagctttttaaagatgattaattggaattcttaagaaattcacggatatccatctcttttgggttgtttattggaaatttgtcttaatttttgattatgttgtattttatagattcttcatgttctttgcatgtttgctttgttgtttgcacatttgacaaagcagctacctctcccagtctttatgaactggccttgactgtgagataccttcacttttcaggagtactttatatgagtcgtgatggagactaactccttgaggagtacactgtaaggctggggacagagtcccttccacaatctttcctcactcctagaggaaaagccttagtgccaatctcacagagaagtgctaactataaaaggatgtccatcccttttctttgttcctagctatcccagggaatcaagctctgctggctattttgtgatcaatatgaggcaagatagtaactggctctatagagggtgctctgaaatgttggggctaagcccccttcactttgttcctttcctcctggaggaaaaacctcaattttggacctattctaattcttacagtgcagctccagctataaggaaatgctttcctctttatttgttccaagctgtcccagattaccaagctttgccagttgttcaatacttgatatgaagtgagctagaaactagccccatggagtgtgctttgagataccaggaggacagttgtccaagtgcacattctaattccactttccccatgtgggaaaaatcatgagctgaggcaatattcttggcactgagataagccagtttaggggagggttgatgcaggtaaaatgaaattgttcttcttatctataaatgtgactgttttccaattatgttcctctgaggtacttctacttacctggatcctgaattggacttcaaggtgtttgttaccaatatcattgttatactggtatttctgtagaggaagaagagttagggctttctactctgccatcttgccgatgtcattcacccagacattttatttcagaacagttttagacttacagaaaaattgcaagaatagtacagatagtacttaggtgcccctgttattgacatctcatattcctatggtacatttgctaaaattgatgaaccaatgttaatatactattattaaataaggtctattattcagatattcttagtttttattgcatgtcctttctctgttccaggaatccttctgggagaacccattatatttagtcatcatgtttccttatactcctcttgattgtgacagtttctcagaacttccttatttctgatgaccttgacagttttgaagagtactggtaaaatattttatagaatgtgtctcaactggggtttttctaatagttagactagggttatgtgttttgaggaggaagatcagaaaggtaaactgtcattttcatcacatctatttatagtaatattctaaaaagctcattgctttttttctgttcattgcatgccatttttatgtttttttttttttttattgctccaaaacaaaggtatttacgcaattactaaaactctgaaagtttttttgctgcttcacagtgtggatgaatagttgataaatactttgagtgaagcctgactggtgtcctactgaaacacacgtggagtccctggcaaagaatgacctctatgatttttgaaatcttaagacgttagggatctaaaagctgccttttcaaagctacaagcagtttggagctttcagcactgaagcctgcaattgatcctgagtggaaagtaccataagccaatacctccatttcagaggttgagctatgaggttgggagtgcaaatgtggtatttatgagtttaattctcaggattctttctttctttctttctttcttttggtggaaaggaaaaaaaaggcttgttggctttttatgtatttagagtgcactcttccatatgcaaaccatgcttgtccaaatagagttgtggatgattttcatttgtcccaaattagtggaagatgagtacagataatgagtatgtcatttttagtggaagatgatgagaactgaaggttcaactcactcatgctgcagtgaaaactatagtaaaggaattggactatcaatgggctacatacagattataatagtgaataataaatattttagagcagagtgatgatggactatggtttgcatattatgattttgaagacataaactacacctataactaagtaatgggttggtagaaggtgaatagtatatttatctttaatcacgaatttatgagaagtcagattcctcatatcctatgcttcaaactcaggattccattaaaggctaataaaagaatttgagtattgccagccatgattcctgtctttagcagtcattcctgatgctcactagtgaccattggctggcccaatgagaaagggtagctcttgaatggtgttgaggtcaaacggtgtgttaagaaatttctcctctctttgtgtactttgaagcttggtttctgagattaaatgtaaccaaaacactgttagtggtggtggattagttggattcaatatgagaaacacaagagataggcaggatgactctcactaaaggaatcagaggactgtgaactgctacatataacatacagatctctaagttattcttgagctatactttttttttttgacagagtcttgctctgttgcccaggctggagtgcagtggcaatcttggctcactgcaacctctgcctcctgggttcaagcaattctcctgcctcagcctccctagtagctgggactacaggcacctgccaccatgccaggttaactttttgtattttagtagagacagagtttcaccatgttgcccacgctggtgtcgaactcctgagctcaggcaatctgcccaccttggcctccgaaagtgctaggattacaggcttgagccactgcacccagccaagctgtacttttttttttttttttaaagcttcaaaccttcaatatttcattaagagttacagtttggtttcagtcattctgaggaaaattaaggaaggggcttggcccatacctggtaaaagaatggaaggaaccaatttttaaccatttggaccagtgattctcaatgggagtgctttttgtcccccaggaaacatctggaaaggtataagagatatttctggttgtcacaatttgtgatgggggaaaaaagaactaccagtatcagggggatacaggcccggtatcaggtggatagaggcctggaatattgctaaacattctacagtgcaaagacagcctttcacatacagaactatctggtccaaaatgtcaatagtgctgaggttgaagaactcaatattttatatgttttcagggaatttctatgtgggcttgggaaagtttgaagtcaattgtcatttgtatatttaaagggatatattttatcattagtctataaattccagttgcaaagtagaggccctgcacatttgtgcacatatacacacaccagaaataaactctcttgcaattatcttctctatcattgacagggcaatgacctatgaaaattatgttatgtctaatagtccctcattgttatgtgcaaaacacccagcaaagctcaagttaaggttgtggtcacaaagaaaagagctatcattgctttatggtgttgtctgaagttaatgatttgctttgttttgaagcttacttttaaaaaattacttatcaagttatatctttatagtgcgttaagcctgggtggtttgtgttattattatacatgttgaattttagtgattgactgcagaatacaacgatgccatctcgggatcttctataaattggcaataaatattattgaaacagttttggaattagagaaaaaaacattctctagaataagaccttctaatgaaactcattcttccatcttgatcaacagcagaagtaaggtttttatttacatgaatggttactagaattgtagaagttagtctagtgctattaattatttgatcagttttacctatcaataagtttattcatttttatggtctaattttaaatgtattagaatagaaatgcaaccttatgttctgcttcaagttatgtgatgatagtaacagcaacgttagggaagtcatcgtgtaattatttagaaataaaaaagaaattttagagccaatacagatctctctttttttttttttctccctggcctgagatagcattttcagaaaaaaatagccccaaatgctatgactgttaaagtagtttggtaggccatattgcgactctcctggtggtaaagaagctgctgtcatgtgacaggtctcccatggataaccattacctcctgtcaatgagaaatgtgaagattaaaaacagtgtcaccaaacactgacatcatcctgcattttttatttaagagctgctgaaagatttcctgctggctgaccaaatatgtgaacagctggctcctgaccataatctgtcacttgcagcacatttcagactgcccatttaagagcaacataacatccttgggaccttcaagctagtcaaaggggcagaagaacttaaaaggaagcacaaagctagccaaaactatgagtaatccaaagaccattaagtggtttgtgagtattaagtatgataggtgaaggcaaatacttgagacattcaaactttttttctagtcatgggttataaatcctgagattggagttggtcattgggaatgtaaactcatatgagtgactaaagggaattatgtgattgctttgtattcaattttcaaaaacagtgtcctagatatgcttgcttatttatctaactgtctaagaacctatcatatctttaagacatttataaataaaaaagggaatgattgtttcattcttttcttatgaccacaaattaatcctactctcctcgatcaatcagcgatcagagtgccagtttggctgatatccgtataatagaaagtctcatttgaattgattgatcagctggataagttagataaaatgcagtctgcttttattcatcttcctgtttaataatgagctgtctggaacttccacttctttgatatatgttgtattctaataaaaagcaatcagctgcagaatttgctcaattctgttctctggattccctgataacacctaagttttcttgcttatcattatgctgttaaactactctctattgaatcaagaaggatataagctcctcttaaagtgaaattttccaaaatgttgagatttcattcacagccaaaataggagtgaccttctttggctgctttcccaaagtcaacctagaaaattgccatctacctggcacccaaaatgagactggaagggtagataagagctcatttatgaaaggccttgttttgccaagatacaatgcttggatccttgtctacgtgacagggagccagaaggttttaagaggggagtgatataattcatttcttgttggagtaaaaaattacactgataaaaccagaaaacagctatttgaagtagtcaattaaggattcctcagtgattgaaaatacattgtatctggaatcccatcccccaatttgtcagcagaatgaatatattaccacttcaaccatattatacactttcttccatcaataaataatatttgaatacagagcagaaaaatacatgggacgacaaatcttatcaaggtcttgtattaagtaaacaaactaacttttcatctttcactttattctacatctatttagttcactgtcactgatggaaaaaatctgctttttagaagggtgttaaggaatatagaaaggttgagtgagaaataaaaaatttgatatgataaaggaagaagtaaagtctctaatagatccgtattacatatatgtttatggcttacaataaagagttctgagacaattaaagtacctgaacatttgaaaatcttaatatttttccgtatttatcttgcccctccaacaagattgtaggattcttagaggcaaggccatgtttttgtatatgtttatccctcactgtgtgtagcattgtgcatgacacacagaagatattctgtaattacttggtgattgacaaattcttctttatttgtgattttttttagcactgacggtgaactagatgctgtggaggactgaaaatgatatacaatataaccactgcctcttaggtgttaaacttctcccaaatggagtagaactcagagaggcatatgtactttaaggtcacatagcatagtagtaatatctgtctctcttttctctataaagaaaatatgagaaatattcacaatagcaaatatttttgagagatcgttgtgaacctagtgaaatttttttatgccatatgcattgcatgcttacatttcatttaaaaatacagcacatcagtgtgcccacttaatatttgaggaaagaatttgtaataatatacgccccaaattggaaattctgtaagaatttgattatcttcaaaataaacgggatggatttttttatgttggtatgttgccattataccttcttcctctaccaagtcaactcaattcattgaaatatcccaaaggaacagttggaaagaaccttctaggggattggatgcaatttttctgaaacagaaggttccacatttaccatccagcaagaaaaggcaagaactctttgggcaactgctctctttgctgttgatgcaagctaagacatgctttgttgagtaaatcttgggaggatttcagatcctttttcaaactatgctggaatttttgcttccttttctaactatattggattgtgtaatgataacttttaaatgaatcattataatacagggacatgtcctacaaatttaataatggtcaccatgaagagcagtatgcaataaggtttcctcagcagggacatattctttctgaaagggaaatttaattatgtagcttgactactgtgtaattcaaaccctagctattgcagctcttttatagtacacaatggtcttagtggcagacagaagaacgacggttaccaccccatacgcaaactcagaaagctgaactgcccagtgtcttgcttttgctaaatttttgaattaatatacagctctttaggcattcctcccttataaaccatgtatgatagaagaaagccatggggattttaattatgtgttaattgtatgccattttctttttcttgcatttcgtcttccatcttttggtaaagtgagggagtcagaaatggaaaatatggagtcaaacaactttgcatgaagggaaacacaggatgactacaaaaactccctaccaatccccctgaagctattacaaaagtactttgggtgcctagaaaaaagtactatataaatccatggttcttgttattaccgtggaggtatactgtagcgtagttagcctgttgaaagggtagtgattccatggaagatgatgggatggaaataggaaggttggggaaaatattactggaataatagggagtgtccagtagatttattttaatatacactatttttgttgactttcctcagttgatgatagcaggaatagaatgaagaccttaagatgggtttgcccaatcaattgaaaactagttagcctggctttttgaaatccttagttgctatagtaaaggatgtgcatgagtctgttatttttctacacatgtagtattgaatagtagaaaaagcaataaacccaaagttgaaagatgtggattctagaactgctactcagatcctgctacttccgagctgtgtggctttagctctgatagataatatataaaatggggagatgaaaaggtagtttctgcctacctttgtaggtccttactgaggtgtcatgttgattctatgagatattaaatttgagaataatttattatgtataaagatctaagaaatatgtgacaatattgttattaactaaggagagaagagtgcttagtgtaaaattaaagccttgcgactctcaatccctgaagaatgcatacatattctgtgcctttttgctgagaaggggagagagtgctaatttatttaccttggcattttcttgtgcacaaatgtcacccctctccatccaaaaaatatgcttgctggcatttcttgtaaattgcttcttattctagctgctgaagtgagaccaaaggacatatatatatatatatatataagtttagactatttttgatatttttagtgttatataatcattgtacttttctgtataaagtaggtgacaaagcaggaagtagtttaacactcttggccccaggatctgagaaagctgcttcctaagtcttttgattgagacaatcttcatggccaatctacaatgctaactgattgtggcttttcctgcttaaaacctttcattagaaatcatcacctttagagaaaaaaatcacattatttacattgcatgctgctcacaattagaatcttcacctactaggcttacctcctgctttttacatcttaggcatcattaatcattttttatagttctctaagaaagtgttgccatttcatttatgccttagcacatgttcttttctttgctggatgcactctttctgctttgccctcatggaaaatacttgttttattttaagggaaagttcaagagtcacctagtctatgaaggagtattctatgaagtacacctactctatgaagtatacctactctgtggtgaactctactgtgctactccaaggcagagaggttatctgtctcttctctactacaaaaaacctcatacatgcttctgtgatagcactattactttgatcgggttgaagaagaatttcctaagtctgaggatgcaactaggagcaggtcttttcctttaattaaagagagaaagaacagagactcaaactgtgagagcaaaacagcaagctactttcacctcctatctctctacatgcagaggaaaggaagggtacatgctgatattgaacagagtgatattcaggcaagacagggacagctcttctattagcatattattgcaggtacaacagcaatagcaatgatataactgtgtgtcacactatgttaagttgctgtagggggagggctctttcctctctgggactgagtataattgtgactcttattggaatcacagaaggatttcagagatgggctacatgtgcatgtaggtaaaccagggattctgttcatatatatctatatctttctctatatatctatatctataatctatcatctatctatctatcatctatctatcaatcatctgtctaaacttcttatgaatgaagcatatcatttgtgcctaaattcaaattattttactctaattcaataatttttatttcattaatatatatactcagtaggcttcaattattatggattgggggaccatctggtgaacaaaggaaaaatccccttaaagtaaccttttctgatcttgaaggggaattttcccagaaacagctaccaataaaatggcatatcttcatttccagccggactgaatgtaccctttagtctagttcttaaactgcattttcgtgtagtgccacccctgatgacaatgctaattttctggtcaaggatgtttcatttgattcaagagttgggtttctttcaaatcccagaggactagggaatacttgtgggaaatcttttttttttttttttttttttttttgagacggagtctcgctgtcgcccaggctgaagtgcagtggcgcaatctcggctcactgcaggctccgccccctggggttcacgccattctcctgcctcagcctcccgagtagctgggactacaggcgcctgccaccttgcccggctaattttttgtatttttagtagagacagggtttcaccgtgttagccaggatggtctcgatctcctgacctcgtgatccgcccgcctcggcctcccaaagtgctgggattacaggcgtgagcggaaatcattttaatgtatcgaaagtcttgcacttcactgttgtgaagaaggccaggttagagcagggttaaatattctgcaatctagttgaatcatctcaaaactgaagcactctgagagaatgcagactccttttctgacctctcagcttttatatttcatcttggcaacaaagagttttactgagaatgaatacgtagttacacgcctcctgagtttctgtggtaaaactgaagaagtgagtgtatccaattgtttaaaataatgatggatttctacattaagcaatgacaagccccaaatggttttattttcatgtgaattattcaggttaaatctttcaatttcacctcctagagaaggtacactggaaaaagccctcccataatttaaccttgagcgctgagagcaatttaagtttcccttctgtaaccggttacctctctggttgaaaacaatatagctgtctgttgctgcttcacagaggtatatgattttgtacaaaggattcctctaattgactcaaaccctgattaaatgacccttagcccagtagtgcatactaaagaccacacatgttggcaagagaagataatgactatgccttaggccttttcctctctgtaagcatacttttcgagtaatcttatctgttttcataattttaattaccacccaatgaagatgactcccagataacactggcacctaggtgtctctctaacatcagacttttaatgtctattttcttgatattttcacctagctatactaccggaacccaatcttaatgtgtccgaaactgtactcaccatcttcccatgattgtctttcagtgagctctctctgttgggtttctttcttctatcagtaaatgggaccagcagccagctacttgcctatccagtcatgaagtgaaagcatccttcttccaaatattccttgccattatcaattccctcccagcctaactcttactttgcctgaattcgtcattattttttccatccctttgccctagttttttcaggccccctctgcatagaaggtgcttagtgaataaatgagtccaaatatttttccattattagaggctttaagctaattgctattttgcaagtattgggttttcttttcttttgcttttccccccaagacttggtattggtcataggtcctaacttgggtgcctttctaaggtggtcttactctagttcatgatccttggatttactgggaaaatgggcggccctcctaactaaattctacagttttttgcagggcctttaaaaaagtcagtcatgtgatcaatgctatcacctctaaacttgattttttttttttttgtaataaagttgtgttttcattttttggtaaatataggcatttaagttcatcttttatttttcacaattaatgctctgaattgtgtaacagaagaatatagcaaatagtggttttgtagttttatgtggcagtaaaccgtaccctgtcttgatctttgccccagttaacctcttttctattaatatgtatcacctagtctttaaatagacaggctttctaatccccagatggcaaaaaagaacccatttatctcacataattatgtacctactacttttgtaacaatagaattgattctctgatagaatgattgtatactgtgactacgtttagcttcaggtccagacttctaccaagagcaagaaaaggtttctgttgttcattgaaccaagtggagaattggttataagagtaaagtaacttatttttgatttccaatctacaaagaagagtttttcattcaaggcaaaagaaaatgatcaatgctaagggaaacaaatccacgctaagttaagttcaaattaagctctaatgcagcgctttatcagctcatatgtctgttagtgtgaaagtgatgcaagaataagaagttctaaattgtccttggtaatgtgctaatatacctactgttctattcctagtatttttgatttttaaaactgcgtattctcattaactcatagaatcccagatctattttccttattttgcattataaagagcaaaatttattaaaatatgtcatattagtaatatttgttattaaatactatccataaaaatagagtactttctagaaatttgaaattcttaatctatattatctatatttaccctctctactttttcttgcagtgattattggtataatttcaagctcttttgagtttctctacaacctcatcaataacaatacaaattttaacccagtctttccatacccattctcagattaagctagtatttttgttactactcattactatttttatagtaaaacaaccttaaggactatttcaaataaatagcaacctaacatagatttgaagtgtcaaaactgtgctcttgaaatgaagcccgactatttgcatttacaaagaggttactgcaaaagttgctagtagtcaacaaagaagtaaatttatacagttgttactcccagacataagtgcttctttattcttttctgggaatatttgcacatgccaaattattctcagtctttatcatttatatcatcaagaatattcagaatgccttatttcacatcacacacacacacacacacacacacacacacacaccccaaagatacatttttgggttaacaaagtgaacatacgttgatgattcctgttggcataagtaagtgttggatagatttaggtggaaatatatgtctttctaattcaaatatctaaaaatattttaaatgttttaaaaattgaagatggtatttaaaaagatagtgaccatatatttatttatatattttttattattactttaagttttagggtacatgtgcacaatgtgcaggttagactggattaagaaaatgtggcacatatacaccatggaatactatggagccataaaaaatgatgagttcatgtcctttgtagggacatggatgaagctggaaatcatcattctcagcaaactatctcaaggacaaaaaaccaaacactgcatgttctcactcataggtgggaattgaacaatgagaacacatggacacaggaaggggaacatcacacacaggggcctgttgtggggtggggggagggggagggatagcatttggagatatacctaatgttaaatgatgagttaccgggtgcagcacaccaacatggcagtaaccgtatatttaaaaaactacattcagcagaaatgctgcacaaaatttctttcattgctttgtggcattcatgtcttctcaatgtcaaggtcaggaggatttgtttctgttacgaggagatttctagaatccctcaaaattcgcttctgcaatatggctttgatttgggagcaaaacttcagaaagagaatgccatttcttttaaaacttaaaagtgtacttatgcttcaattaatgttaacaggatgagggggcgggtggtctacagaagataaagttttttaggtcaggcagattcttccttaaaaattattacaggccgggtgcagtggcttactcctgtaatcccagcactttgggaggccgaggtgggtgggtcatgaggtcaggagatcgagaacatcctggctaacacagtgaaaccccgtctctactaaaaaatacaaaaaattagctgggcgtggtggcggacgcctgtagtcccagctactctggaggctgaggcaggagaatggcgtgaacccaggaggcggagcttgcagtgagccaagattgctccactgcactccagcctggggccacagagcaagactccatctcaaaaaaaaaaaaaaaattattacaggtgtctatagcactgtaaagctttatacatatgaggtggtcaatacatatttgttatatatgaaataactaaataaagcaaaataaaataaagacatggagtgctttggacaagctgcttaactgctctggttctcagtgttatcatgcataaaaggtagataataatacggtctctgacttaagatggttccacttagatttgttgactttatgatggtgtcaaagtgatatgccttcagtagaaacagtactttaagtatccatacaaccactttgtttttcacttttagtgcaatagtcttatgttctaagactctcagtggatgcctgaaactgtggatagtaccacaccctatacatacttttttttttttttttttttcggagacagagtcttgctctgtcatccaggctggcgtgcagtggtgcaatctctgctcactgcaacctccaactccagggttcaagcaattctcctgccttagcctcccaagtagctgggactacaggcacatgacaccacacctggctaatttttttatttttagtagagacagggtttcgccatgttggccaggctggtttcaaactcctgacctcagatgatccacctgcctcagcctccgaaagtgctgggattacaggcatgagccaccatgccccgccactatgtttttttcttttttcttttttttaatctgacaactgggatgtctactaagtaactgatgggcaggtcgtgtacacagcgtggatgtactgaactaagggattattcaaatcttgagggggactgagcagcacagtttgaaatttgatcatgcttagaacagtgtgcaatttaaacttataaattgtttatttctggaattttccatttaatatgtttggactgtggttaacaatgggtacctgaaatcatggaaggggaaatcatagataaggggggaatattatatagtatttaataaattgcatgagctatacaacactttattataaaataagccttgtgttagatgattttgtccaactgtaggctaaggtaagtactctgagaacgtttaagctaggttaggctgaactgatattcagcaggttgggtgtgttaaatgaatttttgaatcatgatgttttcggtttatgatggatttattgaatcataactccattgtaagtcaaggaacagctctaggacttatcttagaagattattgtgaggattatattggacaatgcaggcaatacaacttggtaccgggccaagtacatagtatcctttgtataactttgtaccgtgccaaggacatagtaaatgctcaataaacattaattgttatgatgattttccttataatgaaggcaataattttataaatttcattagtgctttgactcatagtataatggggaaataatattttattgaatagttcagtgcttgttagcaaagattttctttagatataagaccagaaaaatttcatttgcttttacagatttctctgggattttagttagtattggttgccaaaatggcaactttgagtgttaatatattaagaatgtaattggattatttgtaactcaaaggatgaatgcttgaggggatggatgctgaattctccatgacgtgcttatttcacattgcatgcatgtatcaaaacagctcatgtgctcctaaaatatatacatgtactatgcacccacacaaatttacaaattaatcttaaaatttaaaaaacagctactactttgtagccatatcattactatgtgaagaagctacattgtttgttggatttcatttaaaactgccttgaaactcatgtatatgtcacccatggtgatgcatccttaaatttcctaaatgatttctttcatgaactttaacctacctcacctttctaaacaactgggaatatatcaaataaaatgagcattctacatgagattctaaacttattataattgagtttatattgcacatgacaaacatgaaatcaatcttttcataggcaactccaaattctctgccttcaaattgtcaatgtgttgagtcccttcaactcaaacatgcatttggaaggtcaggactgtgtcattagtcagcacttgaatctcagctaggttgcttatctcttatgtttcaagaacttatatatcatattgtctatgatggtttcaaaagtaacattataatccaagtagaagaatctgacaaacttctcttgttggctaagaaactggaaaaataaaaataatgtggtatattttccacagttaatttttataaaaatttgagatgtcttttctcatttctgatgtttaaatatccattataaaaataaaaagtggtgattgtggataatagtaattatcgtataccagcaaaataaaaagttggttaccccatgtgtgtccactaacattttgtttacttagctagctagagaataagttctaatgccccttaggattactcttttcattcagctctctaatgaccatctctttctatgatataattttctattatagctatgctacatttatattcctgtattatttgaattttattaaattctctctttcaataaatatatattgagtgtgcattctctctctctatagaccccatatatagagaccacatattatataatatatatatatataaatatagaccttatatagaaagaccatatatagagaccatatatatagaccatgtctacacagacacacatacacacacacacacacacacacacacacacacacacacacacacacattttatatatataaagagagggagacagaatgtaaatagcatggcactagtgcaatgactgggtgtttgattactgaacaacacgacatctagtttgacatagtttcccaattgaaccctttccactattacctttttaattttcttctattttctgctactctgttcaagtaaaacacagaaattattttgccaatatatagttgaaaggtatttagaaagctcagaaacaaatgtcaccatcagaattccaacagtatattttatgttcacccagaaagaaaacaaaagcaaagaaaaaactatccaaattagaaacgctgcagaagtataatgagtactgagtataatccttcagaagtattatggagtttgagttatttttcttaagaagaatgaagcccacacatcattgagttccagattttggggaaaagttctagcccactgcttttcggcacttgaatcggcttaaagggaattgtctgctgtgcttgatggtttggctgattccagaagctgctggatgttctgggctcaatggagtagaacatcataggctaaaactgattcatgatccacttagtggagaaggaaaaagtttttacctgggggagttatcatttcctctaacattgtgtcctggggtgtggcttgaaataatttcaaaaaacattcccaagtggaaacatttttctcatgtttccaggatagtgggtgatgtctttgtgtgaaaagctagtgccacagataaactgttaagttttagtttatcgtaacaacttcattctttgttttctgttaacccttatttaaaatgctctgaaatatggcttgtaagtctggaaaaatctctcccttttctccaagttattgacctaaaagtgaatttaagaagtctacaaaaatgcctttgatggcccagcgcggtggctcacacctgtaatcctagcacttgtggagaccgaggcaggcggactgcctgaagtcgggagttcgagaccagcctgggcaacatggtgaaacccccgtctctgttaaaatataaaagaaattagctgggcgtggcggcgtgcgcctgtagtcccagctactcaggaggctgaggcaggagaattgcttgaacttgggaggcggaggttgcagtgagccgagatcgcaccactgcactccagcactccagcctgggtgacagcgggactccgtctctacaaaataataataataataataataataataataataaatgcctttgacttttatagaatagaatattttgcaaaatgctttcatgtatgctatcttatttgataggatggaggtcccatgaaagagaaccagccaatggcatggcttctaaattacagatgagaaaactgagaccttaagaagtgacttgtcttcattggctcggctcttcagtgtaccaagctgagctctctgagtccacgttttagaccctttctgtgagaattcgttgcctctgacacttatattacttctttcatgtaaaatatttttctgcccctatgtattttacctacccatcttgacttgataatcaaagtgaaaataattgtaaggaaggcaaactttcttaattgttttctacatatgttgaaactttcttataggttcatttccgtagattgattatatttcaccttttaaatttcttttctgtgtttagagaaaaattgcagtgtatgaaagtcactgagagataattatctgcttgtaattgatggtaactgcttggaattttccagggagtatgtggattatggctggtcatcacattaaaatctgtctcatggggttccatcgtgctatttgaaaaacctgtgagaaatagtaagaaactattaagaaatttcaatgtaaaatgacccaagtggcttactatagattctgtctgatatttttcatttttaatatgaagactgggatttgtgatttaaattttatatagtaaaaatctgtctgcagaaaatgtaagctttattttccctattctttattgttatgcttcctcttttttattagagagttataataattagaatgcaaagaatctctttctccagaagacctttctgatgaataccagcaatttcattcttctgtccttgttcatagtttccatgatcacaaattatcttttgttttctagctaacatatttatactttgtgcattttttccacctgtccgccccaaaaccaactctccatttagatcctcatggatgtggccttgattttgtttccttaatagtcagtgtgacagaattttctgaattcttggtctgcaaagaatcagagtatactagtgaggatggtaaaattaaaatttattagacataccatagtgcagtgaaatataatacagtatcaaggaagtagacgaaatcctcagatactctacatttctctagcttagagattccatttctccctaggcagaattgttaaaatcaattttattgtgaatataatggacatatgaagaaatgcacaaaataaataatattggtatataaagtacatttatgtgaccactacctaggtgaagaaatagaacattgcaggaatcccagaaaatctctgcattacctatcccaactctgctgatttttatgttatccacatcctagcattcctttaaactttacctcacttgtgtagtctgtagtaaatgctgtcagtcttctattttgcctcttcacatctgctttactaaatgctgtggggtttgcatggcaaaaactcacagttgcccacttatctggagaattacccttggccaaatgggaatcactaccaggcatgtcatgcctcctctctccctgcagcctcagtattgactgtagcacattgactgtcccttaactcaaggtgggatgaactgtgtgatgctccaatgtttcaccttggaattgaaacaaagctgttttttaaatgagaccttactcttgcaggctttattgctcctctcttgataccgctcctccaagaaatgaatcaattgagcaagaacccatctcaggctctgattctaagatcacacgagattgtcaacaaaggagatagggatttggggagctaccttaaaaatctgtccatcacacatccttagccaactcagactagttttgcctattgaatacatattgaattttatatatttgagatcatacactatgtgcttattttgtctgttttttctcctctcattctttttcatgcgcatacccgattttctaaatatcactatggtatttttaagatttgtctgcattgctgcaggtggttgcaatttattcatttttatttctgtgtaataaaaaccaataagttattttttcattctatttttggacatcttgttggttttgattgtttccacttgttttgcgattgaaaactatactattatgaagataattatgtttttatcctgatgcacataacctcacttttgtatgaggcagtgcttcttaaagtttagcaagcataagaatcaccagatgggcttgttaaaacctagatttctgagacacagttctggggtttctgtcccagaatgtctgttacgggatttgcattctaacatcttcgtaggtgatactgatgctgctggtctggggtcctcacctgggagaaacactacggtagagtatattcctagttgtgaaactgttagctcaagagtctgcatatgttcagtttagtagttaatacctacaatttgccagagttataccacattgtgtatacctacagcgacatacaaaaattcttgttgctccatgttgtggtcagcactaattttcaaattcctaaattttaaatctagtaaaattgtattgatatcacagtgatttaaattcatatctctgtgattataaaaagactgagtatccattttatggcttgctttttcacacttagtggcatattttcaaaaagagtaatccttaattttagtatatccaaactttttctttcacattatgaaccatgatccacctaaaattgatttctgcatgtgttataaaattgagaatcaatttctttttgtttatatacctacttcattgccccaacatcatttatcaaaaagtattttctctgtcatagtcaggtgtcatttatatgtgaggtcctttcttggttctttagtctgatgatttgtctactctctttctctgccattctatcccacgatcttagttagttcagcttcattttaccacttacagtagttaatatagtagtatatttgtatttccggtgaacttaacagtttttcctcatgcaatgactatttctgtaataattctctttgccttaatatatattttgtttaatattactgtacttatgttagctttttctggtgtttaccttatcttttattttgtatcattttacatccaagatttatgtaaattccagtttcaaatgtgtacagttgacctatgaacaacagaggtttgaattacaaaactccacttatatgtagattttttttcaaccaaatatagataaaaatagagtattcacccaatgtgaaacccatgtacctggagggctaacttttcacatatgtgggttatgcagggctgactataaaacttgattacacacatatttatgtataagtaggtggtcctggaacaaatcccctgtatacagagtgacagttgtgtaaaagatttgtagctagtttttattttttaaaatcagtatatgaatcattgctttttaactggaacatttggttgatttacatttaatactattactgaaatatttgggtttaaattgattatatgatgatgtaaattggttatatgattataatcacttatgtgattagtaactattttacctgttctatattatgtttttcttgttgctgcatacaaagacgcacacatacaaacatacacacataaatcacacagagacatatatttaagagtttggaagttacaaactttttccctattcatgagtgttactctagagataatataggcacccttgatttacaaaaaattaataattatctttatctgagttcttctttccaaaaatgccagaatcttagaacacttgtgattcaattacccattttaatatatatgctattattctgtgttttaattctctctttatgtgaagtcttacaggacacttttgcttttgttttctatactcaaagtttatttatatttacaaaatgtgtactattttctttgctcatcatgccttcctgcatttctgagcttaaatctccacgaaagtggtaagaatggttattttattgtcgatacctgataattccaataactggattcccactgtgactctttctgttgtctgttgttcctcctggtttggcttgtcttgttttgcatctcttcttctttctttgttggatgttgtataaaaaaattacttctagaaataatttaaggcctaaaattgtgttgttttttgtttggaagatataataggagccaaagcagcaacagaattcactcgaaagggattaattgggttaagggactatttacaaactgttgttgggtaggaaataaacaagggcagttgaatcacccactcaagtggagaggctacccacctgtgaagctttagttatagacagatacaacctactgccagaactgtagcatgaaagcaggaatggggtgtggcacaaataccccaatttctttatactgccaccctcagatctcctcatcatgcttccctgtgtccaaaaccaaccagaagccagagtacatgggagtctggatgatgtagtcaattaggggtcagtgaacctaaagcaaagagcagagaagagaagggcagaaatatatagattaagtacagtggatatgtttttcttctaagctccttgctaaggccaaggcttgagtttctcttggacgcctcagtaacccattgggttatactccaacaactcattgtctaggtggatccctctagctcaggacccagagaggtggtgactcaccagagtgtgccatcttggtgggcactgtacttcacctgctgctcactgagtccgctgaaagcaaagcatgacctttcagctgcctccagtcaatctgtaaaatttccagggcagaagcagtgctcatctctaatgttctctgatctccacttggtgattactcattctctttgcttttactaggattttgcagagggatctaatgattttgtctgcagcaggaggattgaacagggattggcaaatgatagcccatggaccaaatctagcccaatgtttttataaataaagtgttattgaaaaaaaccacacctatttattaacatactttctatggctacattcatgaacaaccacaaggttgagtcgttgtgacagagatggtcttgtccacaaagtcttagtatttattatctagccctttgtggaaaaagtttgctgaatgctggtatacatgcccaccattattagaagccagctgtccctcctacaagacaatttaagatatgtataatttactcatgtgaagcatcttcatctgtaatagctaattaaattttagtggtaaacttgactgggttgaatttcttttccttattattacagatctatctaatcatggtgatattaatgagatgttcagcgttcaaactgaagttaattggaaggaaagtaagtagaaagaagtagtctaggttattggaaaaaaaaaactaatcaaactgccactgatagagataaacgtaaaactataactttaaagtgattaaaaatctgattaagtgacttaattaaatgtgcacacaagtaaatatgggctcgtaaccatttcaatactattttgataacatctagcacctacgatgtggctgatattgtgataggaatttttaagtgcatcatcctaatcaaattccagtcttcgttgagtttgttataatccttctcattttacagatgggtagactgacttccagaaagtttaagcaacttgagtgtgatcttgagcttgcaggtagcagtcttgggatttggatagactttagattaaaagcatcagaaggacaggaagaggccaattactgtacttccttagacaacttggctgtgtagcactgatagattttgttcatgttaaacatagtaacaattccatcactgactttttgtttcagttgtatactaggaaaaaaaaaatcaaatggcataggcagaaatatttccttctaagaaacagtaggaggaatctgattgatttggactaagggatcctgacaactcaacagtagccactgaaattgcctttctgactgaagtgtttaagcctggcctagagcgctgcagtcagcttgcacctgctgcatgaatcctttgctatgcttcagaatcaatgcaagtctttgaggtatattatgactctgttatgtatttattatgttcatgaatatcaaaggagtggaggacaagtctggaggcttcagacaaactacagataagctctgggaccatctaattgcatttttaaaagtggtattttatgtgtattctttataaaactttttttttttctaaatttctaggaggctatttgttccttaccctgaagttaacaactgggaagttttttgtctcttaaaattcaattgatttttaggtttgtattcctttctaacgtcctcagttgctttccaagcaagatatttgtacttaggacttatctaactttgacaaagatttgcccagagtctgagaccaagtgggaactaatttagccccagaaggaggacttcattttgactgaatggtaagtgatagaaaatggggttgttgcagaagtcttacagacttaactttagcagctgttaagtattgcaatagatttaaaatatttttgcttttaaaagtaattaagtaaaagatacataaataattctaagtaatgttgtatcagtaggtatgtgtatacattgtaatttgtctgaagtgaaaaataagccgagtgggttaccaaaccactagaatacttccagtgttacagtatttcatctttctttcctcattttctgcttcaccatcccaggtttctacttctcaatatattagtcatgaaaatatagaaatatagggaaggagagtatagaaaaggcagaaatatctcttaaacaaagcaaaagtttacttttttaacaaggaaaactatcaaatcatcactgggtaatcaattcatttggagattcaaagatgtaatctcaacatcatgtagcaggagaggttgacctctgtttttaataatgtatcttttaacaaacatacagtaaatgtactgtctctggaaggactaatgtacataaaagtattgtctaacaagcttaaaaatagaaaaatattttgagtgggttgttttcacgtctcttctgcaggacagatagaaaacaaggagacttctagagtatttttgatatgacaatgaaattgtcttacatgttcttaagggtggagaaaaaaattggaacaaagaacattaggacacataactttgtttacaataatctgttcagtttcaaaccctcttccagttaataactaccctagcacacaaagataccactaaccaagggtagctactatcctgacaattccatcatcatgtattagtttcacttactttggaaatgtatacacatggaatcacacagcatgtatcaactcttttgtgtctgcttccatgagattcatccatgtcatcatatttttagtacattctcatgtacttgtaatatttattgtgtgcctatactatacagtattaattttactgttgaaagatatttggtttctagggccatccctaggatatgtggaatcctgagaaaacttttttttgttatttgtattttggcagggtccctgtttgtacaaacaatttgattgaaatatattattaaaatgtatagacccataccaatatagaaatgtatcaataaccatttagagtagtaagtagaaaagaagtgcttatctatttgtttactatccaatcagtagtcatagagattcttcataatgtccaggtatctttctgttcaggtcgaggaaacaactctttattgtcaaaagccctgctcctggctaatttccttgtttctgctcctaggacaaggtaacaacactgttattattcaccatgccatcattctgcacaggctattggtattgaaacaatatagatcatcttacctttgcatttccctaatactttttattgcatgctcattatgcatgatatagcatcatctgttgaacatctgtgaataatggctcctaatgactctctcaaaggttgtgactttacttcattgagtatggccacatagaccagtcttagccatagtatgcaggaaaatgccaacaataatttattttctattcatgctaaatttactattcagaattttgttgaataaaaatataacaatgcatcttctgagtgagtttcttaatccttagttctagtttgattgcactgtggtctgagagacagtttgttataacttctgttttttacatttgctgaggagtgctttacttccaactatgtagtcaattttggaataagtgtgatgtggtgctgagaagaatgtatattctgttgatttggggtggagaattctgtagatgtctattaggtccgcttggtgcagagctgagttcagttcctggatatccttgttaactttctgtctcgttgatctctctaatgttgacagtggggtgttaaagtctcccattattattgtgtgggagtctaagtctctatgtaggtctctaaggacttgctttatgaatctgggtgctcctgtattgggtgcatatatatttaggatagttagctcttcttgttgaattgatccctttactattatgtagtggtcttctttgtttcttctgatctttgttggtttaaagtctgttttatcagagattaggattgcaacccctgctttttttctttccatttgctagaactcaggattaagaaattcactcaaaaccactcaactacatggaaactgaacaacctgctcctgaatgactactgggtacataacaaaatgaaggcagaaataaagatgttctttgaaaccaaagagaacaaagacacaacataccagaatctctgggacacatttaaagcagtgtgtagagggaaatttatagcactaaatgcccacaagaaaaagcagtaaagatctaaaattgacactctaacatcacaattaaaagaactagagaagcaagagcaaacacattcaaaagctagcagaaggcaagacataactaagatcagagcagaactgaaggagatagagacattaaaaaacccttcaaaaaatcaatgaatccaggagctggtgttttgaaaagatcaacaaaattgatagaccgctagcaagactaataaagaagaaaagagaaaaaatcaaatagacgcaataaaaaatgataaagggatatcaccaccaatcccacggaaatagaaactaccatcagagaataccataaacacatctacacaaataaactggaaaatctagaagaaatggataaattcctcgacacatacaacctcccaagactaaaccaggaagaagttgaatccctgaatagaccaataacaggttctgaaattgaggcaataattaatagcctaccaaccaaaaaaagtccaggaccagacagattcacagccgaattctactagaggtacaaggaagagctggtaacattccttctgaaactattccaatcaatagaaaaagagggaatcctccctaactcattttatgaggccagcatcatcctgataccaaagcctggcagagacacagcagaaaaagagaattttagaccaatacccctgatgaacatcgacacaaaaatcctcaatagaatactggcaaaacaaatccagtagcacatcaaaaagcttatccaccatgatcaagtgggcttcatccctgggatgctagttcaacatatgcatatcaataaacctaatccagcatataaacggaaccaaagacaaaaaccacatgattatctcaatagatgcagaaaaggcctttaacaaaattcaacagcccttcatgctaaaaactctcaataaattagataatgatgggatgtatctcaaaataataagagctatttatgacaaacccacagccaatatcatactgaatgggcaaaaactggaagcattccctttgaaaactgacacaagacagggatgccctctctcactactcctattcaacgtagtgttataagttctggccagggcaatcaggcaggagaaggaaataaagggtattcaactaggaaaagaggaagtcaaaatgtcactgtttgcagatgacatgattatatatttagaaaaccccatcatctcagcccaaaatctccttaagctgataagcaacttcagcaaagtctcaggatacaaaataaatgtgcaaaaatcacaagcattgttatacaccaataatagacaaacagagagccaaatcatgagtcaactcccattcacaattgcttcaaagagaataaaatacctaggaatccaacttacaagggatgtgaaggacctcttcaaggagaactacaaaccactgctcaacgaaataaaagaggaaacaaacaaatggaagaacattccatgttcatggataggaagaatcaatatcgtgaaaatggccatagtgcccaaggtaatatatagattaatgccatccccatcaagctaccaatgactttcttcacagaactggaaaaaattaaagttcatatggaacaaaaaaagagtctgcattgccaagtcaatcctaagccaaaagaaaaatgctggaggcatcacgctacctgacttcaaactatactacaaggctacagtcacctaaacagcatggtactggtaccaaaacagagacggagaccaatggaacagaacagagccctcagaaataataccacacatctacaaccatctgatctttgataaacctgacaaaaacaagaaacagggaaaggattccttatttaataaatggtgctgggaaaactggctagccatatgtagaaagctgaaactggatcccttccttacaccttatacaaaaattaattcaagatggattaaagacttaaatgttagacctaaaaccgtaaaaaccctagaagaaaacctagacaataccattcaggacataggcatgggcaaggacttcatgtctaaaacaccaaaagcaatggcaacaaaagccaaaattgacaaatgggatctaattaaacgaaagggcttctgcacagcaaaagaaactaccatcagagtgaacaggccacctacagaatgggagaaaatttttgcaatctactcatctgacaaagggctaatatccagaatctacaaagaactcaaataaatttacaagaaaagaacaaccccatcaaaaagtaggtgaaggatatgaacagacacttctcaaaagaagatatttatgcagccagcagacacatgaagaaatgctcatcatcactggccatcagagaaatgcaaatcaaaaccacaatgagataccatctccttgattgccagttagaatggcaatcattaaaaagtcaggaaacaaaaggtgctggagaggatgtggagaaataggaacacttttacactgttggtgggactgtaaactagttcaaccattgtggaagacagtgtggcgattcctcgaggatctagaactagaaataccatttgacccagccatcccattactgggtatatacccaaaggattataaaacatgctgctataaagacacatgcacacgtatgtttattgtggcactattcacaatagcaaagacttggaaccaacccaaatgtccatcaatgatagactggattaagaaaatgtggcacatatacaccatggaatactatgcagccataaaaaaggatgagttcatgtcctttgtagggacatggatgaagctagaaaccatcattctgagcaaactatctcaaagacagaaaaccaaacaccgcatgttctcactcataggtgggaactgaacagtgagaacacttgtacacagggtacggaacatcacacactggggcctgttgtggtgtaggggagggggaaggatagcattaggagatacacctaatgtaaatgacaagttaatgggtgcagcacaccaacatggcacatgtatacatatgtaacaaacctgcacgttgtgctcatgtaccctagaacttaaaatataataaaaataatttaaaaaatgcatcttctaacgatgtctgctcttgaactattttgactataatcactgcaatagtaaaacctgatacgtttcagtgttgataatacccttgccttccatctctcaccagtagaaatgataggccagtatccatcaggagaacaagaggtggctccactcccacaaggaaagtccctgccttggtcagcaaagcttaaagccatccccagggagcattatgttgctccatctctcagaagcagcaaaaagcatagctcaagaggacccactggcattgcagagcatcaatgtggaggagataggaatggccagccccaaagaactggctaacatgggaggtacagtctgtggagagggtgagggattgcactgggtgctcatgcagaatatttgctgccaactccaccgttcttaggtactatagactggaggtggcactaaggtaagaacatggatgtatgagagtgggtgtaaaggcctacaaaggtagctcaacttcaagggttggcagtaattttttactaacctagctccctgtgtctatcttgtgtcacctaaaatcagtgtattagcaccattctggtgacttaatcttatataatactgtgcaaaaaaacattttaccaggtaaggtgacatagaccttcttggggtatctggttgatcctcacgagtgttgtagagggttggaaagcacccagaaggagggaaacaggaagcagaacccgtgtaagtcccagtcttggctcaggtgccccacactggtgacatggccactgccagttgatcccacttatggaaaggtgatagaaaattacaagggagatgctttatagcatggggtttttgaggcattgctaggtaaagccctatttgctagagtctaaggccagtactgttgggttgtctttagttttgtctgttatgagtaatgctactattaacattcttttggtgcacatgtgatctgattcctgttggccttatacctaggttagagttacttgattagacataaatgtacatgttcacatgtagtagatgctggcagttatctgggggtttgtatcaagtcattctcagtaacatgagagtactaattctccacatctttgtcaacatttggtgaggtcatgatcgttatttaaaaaaatagctcttctgatagatttagtggtacttaattgtgggtttcattcactttttcctggtgaataacgatgtagaatacattttcatttgcttgtcatcttgataccctcgttgatgaagtacatgttcaagtcatttttcaatttctgagcctactcaatacacttttttccaatagaaaaagtaagtctttttctaactgatttgtagaaatcttttccttattggtttgtagagattctcaggatatattctttgtctatacttttgtttgtattgcacatatctataacttgtgcacggcttcctttttcattctcttaatgatgtctttgagtcacaaaacttttcaatttcaatgaaatctaatttatcaacattttcctttattgttagtactttttactacttgaataatctttgtttaacccaagggtatgcatatattctgttttgttttgttctagatgttttattattttaattatttttgttgtttcagcatcctttactgaaaaaaaatattctttccctggcagcattattttggcatatgtatagaaacgcaagtgattgtataagtgtaagtgtgattctagaatctcttttttgttacaatagacctttttttaaaaaaaacaaaaaacaaacaacaaaaccttatgccagtaccataatgttttacttactatagctacataagaagtcttaattcttaggagtgtatgccctccaaatttatttttttcttaaatatttcttcactactcttggcctttctgatgtcctttataaccgtgtacatcaccaggatttcatctgggataaaattccttctgtctaaatagcttctgttagtttttgtttactgcatgtactctggctgttttattcaggctattctcagatttatctctctaaaaatatctttatgttgccatcatttatgaaggatatttttgttagatattgaattctagattggcaatattttaaaaaatagtttcaaattttttttcaaaaatttggttttgttttgttttttgctctcatcatttctgaagaaaagttagctcttggttttattatttgtcatttgaagataatcttatttttttccattttattttcacttctagatgcttttctaaacaaaatttttattttagagggtttttagatttacaaaattattgaaaacgtatacagataatttctatatatcctgcaccaagtttcacttactatgaacattttatattagtatggcacatagcttacaatttgtgaacctatattgatacattactattaactgaaatccacattttatgtagatttgcttattaaatccatcttttgaatcttaatcttagttattattgttcagttctagaacatgtatttgattccttttattggttctcattctcaggtgaatttaccaccttacatgcattttcttgatattttaatgatcattaattttaagtctctgtctcatatcttcggtctgtgttacccattgctccgtttctattttttgtttgtttgtttttgatcatatgatcttcagtctcagtatgtcttttgattgcatactggacattgtatctgaatacttagatgatgttatctttatccaaaaaaggattacattttatctcacagacagagcacgggccaattatcttacaagagtcaaatcctggtaacagcctttgttagggcagtctttccttcccttcccctctcttcccctcccttcccctccccttccctcccttcccctcccttcccttcccctcccctcccctcccctcccttcccctcccttcccctcccttcccctctcttcccctcctttcccctcccttcccttttttctttcctttctttctttttctttctttttttttttttttgagacaggctctggctctgtcacccaggctggagtgcagtgatgtgaccttggctgactgcaacctctgcctcccaggctcaagccatcctcccacctcagcctcctgagtagctgggactacaggtgcacaccaccacactcagctattttttgcattttttgtaaaggtgggtctcactttgttacccaggctggtcttaactcctgagctcaagctatctgcttgttgtggcctcccaaaatgttgggattagaagtgtggataactgtgcccagcctgtccttatttttattgggtagccctttaagaactggtttaaaatcctgcattgtttactagaaaccttcaccttggcagaccctgacgtcatctcgtcttcctagcaccacaagacttgacatatctggtcagcttttcagatttctagtcttcctttctacttgtgttcttggtgtcttgcatatgcagcttaagtgtcagctaatgtctcgtgggaccattttacatacaatttctaacttacttctatgtagttcctttctctctgagatcttggccctgcaagccttggcatctccaaactgtaacttccgcctccccaacctagttaaactgcctccagatcccagtactgctttctgcctctgttccttatgctgcaaattggcaaatgctccagggaaaaagcagaggtaaattaaagtttaaccacagtgagcttactttctgtctgtgatattgatcttttaagttctatactctttgtttgatttgatatcttcaagcaggtttttttgtatctattcaaaataaaatcagcttttattgttgatcttagagggaaggttaatctgatgcatgattgccaatcatactacaggtgcaatgaagtcataattattcttaaactaatattttgactattccatgtctggaagtttattggtcttagtcggtatctagtctcaacttgtttccatcttttgcctccgcctttccttctcttttctattttttgtattttgtcatttttctcatcctttggcaataacaaacttctctgcttgccttatgaggagtactgttgctcttttttttgaagctttgaactctgttgtcatcctaactggcaggatctgcttaacactccaagctcttaattttccaagtgcagacagttccctttttaagagaaattctaatctagttgctaagaaaaatttctcccactacttgaatccaatttctataagtgtatatatcagtttttatatacataatgcgtaattccaaagagaaattgaagtagcttcacagaaggaagtcgaagtttttaaccaaagtgtatttttgtatttatcttgctgtcaatttgaagagtaatattttatatattccagtatgttttaagatcttaaaaaatgtttaaaactttaaagtttccttgaagcttcttaaaatctaaggatatactcattgacttatgatggggttatgctctgataaactcattataagttgaaaatattgtaaataaaatgcatttaatatatctcacctaccacacatgatattttagtctagtctaccttaaatgtgctcagaacacttattagcttacagtggaacaaaatcatctaacataaatcctatttttataatgaagtgttgaatatttcatggagttcatttaatactgtactgtaagtgaaaaacagaatgattgtacggctatttgaagtacagttcctaccgaatgtatgtcactgttacaccatcaaaaagttgaaaaattgtaagttgaatcattgaatgtgaggaccatctacagacctattatctatctgtctatctatctatctaggtagctatctatctatctgtctatctaactatgtctacatgtgtggataggatgccctttaagtgttactatatatatacatatatatacatatatatatatatatacatacatatgtatatatatatatatatatgtatgtatatgtatatatatatgtatatatatgtatgtatatatgtatatatgtatatatgtatatatatgtatatatgtatatatatgtatatatatgtatatatatacacacacacacatatatatacacacacatatatatatacacacatatatatacacacatatatatacacatattatatatacacatatatatatacacacacatatatatacatacattcatgtaagtatataaatatgttttttaatttcaaaattaaattgcaaatgaagcattgatactatgaatattgccctcataagcctaaaaattcttccattttatttctttttgcccagtgctctggattcactttaagaacttatcatttaagctgaattttaatgtatatatgctgttcactcattcaggaaatatttattgagtggtaagtcagtgccagacattgtgcgaggtgctaagcatactgtggtgagcaaaatacagcgggtccctgtcctcatgaaacctacagttctgtgggaagactagatattaataaaatgacataaaaatacaaactatttaaaagtaaatgggcagcctctataaaagcatgtattcagggaaccaatattggccaggcattgctaaatgaaacctccatgttgtgttattaaaattttatcaaagattatgcatattgtctgtcatttccctgaataatcagcaaggtaaatgattttcagtcacagccgaataaaagatttgtttcaaatgtggtacagaatttctaatcaccacaagaccatgacattaataaaattccagtgcatagcagtcatcccacacacctacgtatggtatggataggatgccctttattttaagtattattctatttaatggcacatgtggatagtgtagggatagagaaaaagagagttatttgttatataatactaagtaaatttagttgttcagtgtactattgtaaaatttcattaatgctccaagttggtgctgataggtagaaggatggatgtgctagtatttataggacagatcacacttacttctagtacttgggcataaagttcactatatgtgcaaaactgatgaagattgaatacctcagaagagagtagcagccaaacacatttgtcacacaaattgtttctaattttgttcttgtggccttgccaagggaacaatataaacaagggaatggaggcataaatgtgtatagtatccttggcaaatgacaaacacacaaaatacagagaaatgtagaatgggttggaaaaaattgattatacccacatcatacattgaaggatgtctgatgttggagcaaagggaaagcccccccttctgccctctgaaggtttgctaaaatgaacaaacaacagagagattagcaagagaaaaggtacaagtttactgtgcataagaacaggagccacacaaaatatgagtgcattagtctgttctgatgctgctaataaagacatacctgtggctgggtaatttataaagaaaaatatgtttaatggactcacagttccacatggctggggaggcttcacaatcatggtggagggcaatagaggagcaaaggcatgtcttacatggcaggaggcaagagagcttgtgtatgggaactcctctttataaaaccatcagctctcataagacttattcactatcatgagaacagcatgagaaagacctgcccccatgattcaataacctcccactgggtccctcctacaacatgtgggatttataggagctaaaattcaagatgagatttggatggggacacagctaaaccatatcatcccatctctggcccctctcaaatctcatgtactcacatttcaaaaccaatcgtgccttcccaacaaccctcaaagtcttaactcatttcagcattaactcacaggcccacagcccaaagtatcacataagacaaggcaattcccttctgcctgtgagtctataaaatcaaaagcaagttagttacttcctaggtacaatgggggtatgggcattgggtagatacagctgtttcaaatcagagaaattggccaaaataaagaggctaaagaccccatgcaagtctgaaatccagcagggccatgaaatcttaaagctccaaaatgatctccctgactccaggtctcacattcaggtcatcgctgatgcaagagatgggctcccatcaccttgggcagcttccccatgtggctttgcagggtacagcccctctcctggcttatttcacgggctggcattgagtgtctgtggcttttccaggtgcatggtgcaagctgtcagtagatctaccattctggggtctgaaggttggtggccctcttctcacagctccactaggcagtgctccagtggggactctgtgtgggggctttcatattgccttagcagaggttctccatgagggatccgccctgcagcacacctctgcctggacatccaggtgtttccatccatcctctgaaatctaggcagaggttcctaaacctcaattcttgacttctgtgcagctgcaggcccagcaccacgtgtaaaccatcaagggttggggcttgtgccctctgaagcaatggtctgagctctacattggacccttttagccatggctaggatgcaggctaccaagtcccaagactgcacaaagcatcaaggctttgggccaggaccacgaatccattacttttctcccaggcttctaggcttgtgatgcgaggggctgctgtgaatacctctgacataccttagagacattttccccattgtctttgtgattaacatttggatcctcattacttatgcctatttctgcagctggcttgaattcctcatcagaaaatgggtttttcttttctatcacattgtcagcctgcaaattttctgaacttttatgttctgcttctcttctaaatataagttccaattccaaaccatatctttgtgaatacataaaactgaatgcttttaacagtacccaagtcacttcttgaatgctttgctgcttataaattttttccgccaggtgccctaaatcatcttgctcaagttcaaagatccacaagtctctagggcaagggcaaaaggccaccagtccctttgctaaaacttagcaagagtcacctttattccagttccaaacaagttcctcatctccatctgagatgagcagcatttggtcaaagccatttgacaaatatctaggcagttccaaattttcccacttcttcctgtcttcttctgagccctccaaactgttccaacctctgcctgttatccatttccaaagttgcttccacattttcgggtatctttacagcagcaacccactctaccagtaccaatttactgtgttagtctgctcttacactgctaataaagacatacctgagactgggtaatttataaaggaaagaggtttaattgacttacagttccacatgacggaggaggcctcacaatcatggtggaaggcaaaggaggagcaaaggcacctcttacatggcaacaggcaagagaggttgtgtagggggactcctctttataaaatcatcagatctcatgagactcattcactgtcatgagaatagcatgggacagacccatgcccgtgattcaattacctcccaccagatccctctcatgacacatgggaattatgggagctacaattcaggatgagatttgggtaggaacacagccaaaccatatcagtgagactcaaagaaaagccagagggctgaagcttaaatagcacactctttattaagggaaacacacgtaggggaatatagccaattttgaggagtagtaaatatttttgggggaattgaacaggctcaaagaacaaacaattgtttgcaaataattttctttggaaactgaatgggactgaaaagttacagaaatcttacggggagaactgcactgcggacaaaagctgtctctttatgtgcataaggactcttaggaaaactctcagagttgtctttagaatagattatgtctgtctgggcatgatgatgacttttagcctcatcccttctcttctttgatggttaaccattcctggctacttaatcagattcctagttggggaactttaagacaattgtattacttttggaagaagttatcctcagtcagatatggtagcttcctgaagaagcacttcccagggcttgtgagtggtggggagaagcaagagaaagttagaaagtccttggttctgaggcagcctctaaggtcttccaactttttaaaattcaaaagtgctcagcatgccaaagcactatactttgaggtattgttctctgagccctaacactggctaagaatcgaattggtagggactaagggagccactgaaatgtatatgtgaatgtgcatgtcagagaaaatatctgttattttgtaagattactctgtaaaccctgagaaaatggattgaaaataggacagctatggactgcaaaacttgttgaaatagatcgtagcaatctgagaaggcatgatactcaagaattccaaaaatatcacctttgattaaagaccatctctttgcttttttcactcttggaagaagttcaacaattgaggaatttaatgaatctgatagatttgaaagatacagattaaaaaaacctcaccttttggatgattggtctgtatttaataatttggggtttttaggtgatttcataatactttaagaattttatggtctgacttttctttttgactccctcaaaccatgctgcttcacaacttaagaattaatgtaaatatattaagaaatccccatctttgtcaattgctacagaaccctgcacagttctgatgtacactattttagaaaccgccctaattaaaatggaaacccattgtgtcagtatgtctgaaggagctagagtaatgtgcatttgaatgtttgtttgaatacagcttttaggctattgaaatttgagactgaggccaagcatagcagcgtgggcccagtgaaagaccaaagccaggcatgaatatttactgacaggcggttaagcaaaacagccactctgctgtttgtcttttcactgtcctgaatatttgcttcttattaatcttttaggacgtattcttcctttgctgaatccattattaaacatagaacagatactgtgttagcattgtttgttcttgctcaggttgacggaggaaaaatgtgttagatgtagttaaaagaagttgtattacttttttaattgtgtgaatttacaaatagaacaggtttctaataagataacctatatttccagttgtttttaggtgagaaaagtttgtatcttaacactagattgtaaaaaattgttctcacaaattctctaaagtctccctctgctttctgggagtatccatagaattttaaaagaaattatagagctcggtgtttgtgatataaaaactacactgaattttatgtttcatgggccagctaaggattgctcttctaggatgatttcaccatatttattttggttgtaattattgcctcataataataaaaaatcatatattggatcataaacattaagtatcaataggtctacaattctttttctttaacaatcttgcaatttgccaataaagtaactgagacctggggaatttaataacttgcccaatatcaactacctataagtaaaggcactgatatttacatttaagcctgtcttcaaagattctatgtttttctattttttctattttctatttttctattttttctaattcaccgtgctgcttcctcatagagataaatgtcataccaaattatttttcttcttctgagaagggaaggaggatgaggcatgaaggaggtacgactcaaaaacatgaagccataagcccttattgtaatagtaaatggcaaccaatcttccaatggcctgctgattaatgtctcaaaataaaaaatcagatctggtgatagcaaattcttggcaactaacatgaaaaaagcaaaacacaaaacaatttgaagtgggattctattgttacttctacatgggagatttatacttttgtctctttgttttcccaaagtgttagcttcagacaaaccaaaactccacttcagtttgacctgaatgtgttgggggaagccttgtaacttactgcctgatgggtgatgtcatggtgagtggcatgaacatggatggagtcagtgatcccaaacttcccaaagcttggtttgtatttcaagaatgtagatgtctatccaaaaggaaagacgcattcattggcaagtgagaaaatgtaggcattttaaaagtcgatattattaaattgtgcaattggagctacatcagggcttaacagctaaccaactctctactgtttggaacctgtttttgtctgaatcccaagctgaaaattctaatatgtagactagaatagcattgtggaaaagccttaattgtaaaactggaataaaagagcttatattttttaggagaatacaaagatagtcttttaaaaatgtactttatagtttgacaatttatggcaatttctgaaagggaaattggcctcaatacttcatttcaggtttcagcctctaactatgtgacaggatagggtatcctcacaataggatgccattttctccacatctcacttggggaaaattcatccacttatgtttccttctggaatctcttttgtccctgaagtcaaattcatgaatagctcagcttaatctcagtggacccaacacttctgttattgtagaatgttagtgtgatagaaattaattatgtaattcataagaaattattagccattttatccttctattacaggtgaactggggctacagcaggcctgtaaaaattcagtactccctgaggctgatgggaatggctactggatgtggttctgctgtggtaaaccttcgtctgggtagatattggaacttgaatagcccaatgtcaatgtatgtggaggcaacatgtccattagcattatttataaaattccatgactgctgacaaatgctgcctccactgctgaggttctgagagtttcagaaccccctcatgaaatatcaaaaaataatcacaacatccgctagggcccattggcaatagaattctaggtaaggcctctttagcagcttctcatcaagactaatagcaacccttgtgctctgtaaccataatgatgtttgttcctggcaccctacactgcccctgcctaccatttcccatgactccacacttctagtatcatgccctcttcagcttcctctcacacctgagattcttagttgctcccacactctactttccttcagagtggatcgtgcatttgtaccactgccctgcctggcactctctccactgatcttaggatcaccattatttattttttcttttaagctgcttggaaaatatttccctttagctcatttcacaggatctatgagctcttaataatgcagctgatttaattttgttactcagtttttttcaaatacgattgtttctatggtgtggctctcacctgtcaaagatatataagcagctgaagagaggatagggaaagaagtttgttttaacttcaagcataattttacctggcttctggctcaaagccctgctaagacctggtgagtctcattctttacctctcagttgctgccccttcaggtgctgtgttgcctccctgaacttgactgactgccactggcatcctttctcagtcaggctctcagtcctgtctccatttgatctataattgtgagtaggacttgggactttccctaagaagtttgtttctttggaaaactttaggagatatctagttgtctgattaaatttatttcaggattctgtgatagattttttaaaaaaaaatctttaaaagtgttttattttagaatagttttagatttactaaaagttgcaaaatatagtacataattctcttacacttctcacccagtttccccattgttaaaatctcatattgctatagcacatttttcacaactaaggaaccagtttggtacactgctattaactaaactcaatgctttattcagattttgctatttctattattcttttatttatttacttttttgagacagggtcttgttctgacaggtgaggttggttcactgcaacctctgcctcctgggctcaagtgatcctcccacctcagcttcccaaatagctgggactacagatgtgtaccactatacttggctaattttttataaagatggggtctccctatttttcccagtttggccttgaactcctgggctcaagcaatcctcctgccttggctttccaaagtgctgagattacaggcatgagccaccggacccagactttgtgattacaggtgatctgggagatatttttgacaagagcataaaggatgtatgggagagtgttatccgttatatgttagactcagctctgctcctttcaaaacaacctatgacaattacttcttggttgacaattacattattttttaggtgtatcatgataaaatgacttgaaagagtgaccatcaagagcaaaaattgtgttttcatatagaagctctttgcatttttggaacaccaaaataagaggaaagattaaggtaacccaagtcttacatcttttgctgaaaactttgctgagaaaaagtgggcttgggcaactactcctggtactctgcctcccctggggctgtagagcaaggtttctgacttcaggcaaaactatagtgactaggaaagcagtaggaatttaggtgagacttataaataagagagaagtcaaaaatcattttggaagctggagaataactacttgaaaatatacaaagctattaaaatccccaaggaaatttgggttggtcattaaagaaacattcttatatatattctgtaccttcttcaaataaaaaaatctgtatagatgttctgaagatgctgtgtgtgtgtgtgtgtgtgtgtgtgtgtgtgtgtctgagtgtgtttgagctggcaggatgacattcattaagcaaataaatatcgagtacctacttgtgtaccactatgttaattactggggatactgaataaataagactctgctcttgccttcaagaaggttatggcatgggtggtggtgatcttacacataacctagcagtttttcttagctttctcttccttcaatttttattctatgttatctgacatgaaaaaatgcatctagttatgggtaatatgaccattgtcattagcttgtcattatctgctaaaagaaaatacaagcatacatttttatcttcactaacaaatattgcttaagtttttgctctctgttgcacatttgccagccattaggcaaatagaaatactttaaggcataccgtatcccttttctagcttgtcaccaaaggtattgtcctaaataagaaaacagtgatgcaaggtggccttagttccaaagaatgttacagatttaaattcttcagcagattaagagagcagacaatcatttatactggaactggcaggcaaggttttatggaggtaagcctcagactatgctgagaaataaagccctacatgtgtacaaaatttttaaggattgaactagaccagccaagtttataaaatacgctttttcccttttcttcagtgttgctcattttctttcatttcttgccttctttatgtcatgatgactgcgttatagtgaaccattgttcatttctcattagttgcattaggataagggttaagatggattaagatgggcaccagcagccatgccaccctgagagtaattaaatgtaacacagcaagtataaaaattatcctggttgcttcaagtctctgagatttgattcaggccttgaacttgccctgtaccaatgattaactaactaatcatctggatattgtgccacaagatgtcctttcagcctgatgcctagttcatggtggaaatttacactcatgctccactttttcttggtgtccccaaatgttgttttacctgaaagatataattgggacaatttatgtcataattctataataatatttcaagtttaattttctaatagcctttgtcacatgtatttttatttttaaagtatggatggcacatgaattatgctatagtcatacacacacatacacacattcattcatatatatgtatgtatatgtgtgtgtgtgtatatatatacatatatatacacatatatgtgtgtgtatatatatacattttataccccacaaagaggtgaattctttaaaggaaatgaaaataaaaatttcacagggtgtagggcagagcaaatgctcatcacagactcatctgacaagtctctttcaaggtcctgtccgcacattgaagattcactctttgctcaatttgcatccttggcccaataaatgttttatgacctccctctatgagcactcacagccggaaggaggtaatgcaaaattgatctgtatattaaaactgctgagccaagcgggcttgctcctggaattacactgattatgtgtatgtgattcaacaggccctactgaaacaccgtagtatttgaaaaagatacccatcagctgcattttttatatacacagttttcttcttttcctcctccctttaaccctgggggccaactcccatattcacatctcttaactcccatttggactcatgaataaaaatacatgctttcaggagaaaagatgcttcactattatgctcagcagtctattatttctggagtacagtgaggagcatggaacttgaagtcaaacacacagtggttagaatcccagcttcaccatttatttgctacatggatttgggcaaattattatatctctctgggcctgatattactatttgaaagtgcagataatggcgttcaactgcctgacttgttacaatgtaactagtatgactaggttttgactatcagtgaatataaaataagacccatatcctttaatacccatgttatgatggtgtgaattaatactgccatgatagattcccctaaattgtgccccaattatttctggaaatgacactacattctctgttacatgcattaagaacagactcatttagtttcttcattctgttctctttggacaatctcccaaaatgtttcagttgcaactatttttatagagtgcctaatttgtgccaatatcttttctagcatgtgggttgtgtaataaataggatagatgaggtccctgttttcatcaagcttatagatggtggcaggtgggagtgtgatagttgagtaagatagataaataattatgtagaaggacaaatactctgaagaaaataaaacagcaatcctgtagaaattgactggcaacattagagatagtagtctggaaagtgttctctgaggaggtaacatttgagttaatacctaggtggtggagatggaactcactaagtgaagatcggaggtggatgaagaacatttcagattgaaggagcaacaagtgcaaaattctgagaaagatttactaacttagagcaaccgaggaaaggagagtatagctgaaatatagtgagaaagggataaggtgtacaagtgtagtctgagatttgtgcaagaaccttatgtttggccttgtagagcttcaaaggacaatcagactggaagatgttgacatgttttaaacaggtaatccacgtactttttgaaaatgatttatgaatatatgatgttctgaaattcagaaaaaaagtgtttcagtaagtcaagagtgtttgactatgtaacacacgactgcgaagtgaagcaaaaagagagacagaagagactgtaaatttggcaacatggagattattgacaaggtcttgataagagcttttcatttgagtctagagggtgaaaactcagttgaaatgagttgaagataggataggtgttgcagaagaggatatagacaactttttaaagtatatttggctgttgaggaaaataaagaaaagactttctgaaaggatatgataggtccagtaaaatttgttttttaatggcagatactagagactgtgtatttgtcaatattaataacccttgcagaagtatacatttatgattcaagagaaggagggaatcattgccagagtgaaatctttaagagggtatgagacaatatctctagaacacaggtgatttgcctggcatttgatgaaaaagggactaatatcctattgtagtagaaaagaaagcagggcatcttttgggaaattaaagacaatttcacctgattatttccactgtctcagtggagtacaaggtaaggttattatgtaagaggaaacatagagaaaaagaggttttgggggattatggagagaagagaaaatgtgaaagtcactgaggggagagggaatttgagcttacgaggaaatacaccagtctttccaagctagtatattttgcaaataaagtgaatttaaagtgagacctgctggtgaggtgggaggcctctacccctattgctgcaagacctcctaaaaacactgctcattaacaaaggctttgctgataattgctgctgctgctgctgctgctgctgctgctgctgctgctgctcctgctgctcctgctccagccatgagaagactatatataccctttgctgcttcattccaagaataaaacaagcactttattaagccacccatggagcaagaacaggctgcaactttaaacaaaatttaccgatgctttagatatggtagaagaaaataatggtgatataaataaattattttatgtaactactcttggaattcaatggagcattttttcatgcctataaatcaactggatgccatatggtagcaagggccaatttacttccccagagaatgcccttgaaagtgactgctctatgtccaagcaccaactatgccaaggatccatgaagatgaagttactccattctcatccatgtctacgatttgtcttctaactcccaattttctgtctccaggatcttcctcctcgcaagttgactcatagtagtaatttgcttttcatgggtgtgtttttatttctaatatacttctattgtggtaaaatacatataacttaaaatttaccatctttaccgtttttagcatactgtccagtggaattaaatacattcataacgttgtacaaacatcacctccatttgtatccatgattctttccatgttgtaaagccaagcctatattcattaaacaataacagctcattttctattcctccattccctggcaactatcattctattttctgtttctatcatgttgactgctgtaagtgtcaatcatactgtattttctttttgtgaccagcttattttgcttagcgtaatgtcctcaagattcatcaatgttgtagtttacgtcagcactttcaatctatttgggtatttggatctaaaatgagcctcttgtagacagtgtacagttggatcatgttagttcacctattctaatctctgtcttttgacagagttaaactcgtttgtatttagagtaatcactgacaagaagggatttatttctatcattttcctattgttttttatattattgcttttttatccttcattttctgcattttttttagtgtttagttgatttttagtggtgaaatgtttaaattcctttctcatttcctttggtgtatcttctatatgtagtttctctgtggttatcatgagtacgtgtaatattcaaaagttatactctaatttgaattaatatcagattaacttcaataacataaaactctgctctttcatgacttttccccattcctattgttgttcatgtcaaaaaatatatccctatacattgtgtaccctaaaatataatgtagtaattcttttaaatgcattaatctcttaaattatatagaaaacaaaatgtggaataacaaaccattgttataatgatactaattttaagagtaataattagttttaaaaaatgtatcactctcctaaataatgtagaaaacaaaaattaagttataaaccatgattaaaataatacttttgttattttccatgtacttacttttatttagatttttatttattcatattactttgacttgcagtctagtattctttcatttcacaaagcaaggcccccttaagcgtttcttgaaggacaggtctagtggtaacagactgtctcagcttttgttgatctgggaatgctttgctttttgaaggacaatttttgctagatgtagaattcttagttgacagatattttatttatttatttatttatttttagcaatgtgtctatattggctcattgccttcgggcttccaaagtttctgatgacaaatctgctgataatttcattgagaatcccttgtatgtgataaataatttcacttgctgctttcaatattccttctttgtctccagctatctcaagtttgattataatgtgtgtcagtgtggggctctttgcattcatcttaagtttattgtgtttcttgtatgtttatattcatgtctttcatcaaatttggtgttttcaagtttcaggcactatttctcatgttctctctaccctttctcatttttctccttctgggacttccacaatgtatatgttggtgggcttgatcgaatcccacaagtgtcttatactcttcactcttcaaaatttttttcttctgtttctcatactcagtaatttctattgttctattttcaagattgtcagttctttcttgtgactgcccaaaatctgtctttgaacacctcaagtgaaatttttatttcagttattgtatttttagctccaggatttcttatagatttaattttagagtttttctatatatctttgttgatatctctgttttgttgacacattgtcttcttgactttatccacatctttctgtagtttttgtgtatatgtaagactgttgttttaaagtctttgtctggtagatctgctatcagacctactagaacatcagggatagtttctgttgatttatttttttctttgaataggtcatattttcctgtgtatttttatgccctgtaattttttgttaaaaactggacatatgagtggtaatgtggtaactctggaaatcagattccctttcttcccaaggtttgctgagtttcatttttcgtttgtttgttttccagattgttgtaggttgcctctgtgcgaataatcaccttaaggtgaaaatttaaggttttctgaggtcttttctgagcctgaatttttccctggcatgcatggtcactttctaattttctttaaatgtgccattggttttgaaatgtccccgtgtttagcatatggatcccaaacggtaaaaaaggagaaagatggaaggggaatagaaaagggaccagtattttaaatctcctggaatttacttcaaccagaagttcaggggggagtggggaagcacttgcaacaatggaaagagtagcagcagcaatggccacccacttgtctgtctccacttctgtgatgaaaagtggcaatcagtgatcagagatttctgacatttggaggaaagggtgctttgtgtctggcctggctcccctaggtcatgtgcttgctgctctaggaacatgtgcacagctgcctgccacagggctgagggatgggggattggtaatagctaatatgctaagagctaaatgaactgaatttaactgcaatttatcgttctagctttctcatggatgtttcaagccttcaattgattccagagtttcaaaatagttacatcaggcaacttctgacagtgcctttattgccttggtgaagagataggttcctggtgctccccactctcccatcttcccaaaatcctctcaccaattcacctttgaagaaagtctatcttaagcaaaatgaatgtagtcttgctcaatgtctgactgagataataataatcagtaaattttggattattatcaatgtcacagtctgattatatactttttatgtcactacagtaccttgaggtaaaaaacatatctgtatattctttctatagatctctccatcacagctctttacacaccatctcagctgcttaagaacacaaataatttcaatgagcaacagtattttcttaatccactcccagtccaggaatacagtttgctgaaatacagtttttatgcagggcaatttacattgacaaattgaaatcatggcagtgaacattttacatttttttcacacaaatatgtgtcatagctttctatttgtagaattatggcttattcaagatgtttccccaatgacaacaacaacaaaagggaattgaggtctctccttccaatgatagataatcactctaagtttaaatggcagttctcataggtctccaaaaaaatcttcaagttgagttgcaatctaaggaaggaacttgcagaataattttaaattccacatatataatttgtctggaacgtgactaaaataaaataaagtcccagtttagtatattttaaattatatcccaagaagacatagacttttgttataagtgatcttatagtgttattatacctagatcataggtagatacctgggcaacatgtgtactttccacctatattattttcaaaatataaaaataaattattataatatatattactattaggtagtacaaaggcctaaatttgcattatggactgcatttctgcctctctattggcttattttctgaagtgtattgcctcaatgtattaaaaattgccatttggtacaagaagaattcatcttgaaaatttcccaatagatttatttgtacaattggtttaatttgaacttcagcatttatttaaattaataaattgtaatagtgaatttttatgacaccactttattaaaaataagacttaattgtggttaataatgtaattgtggtttgccacaattataattcaaacataaacatttagttaaatgtttacactggtgtgggtaaagttacagtaggagtaaggaaagagaataagagagaaagggagaaaaatgtatttacaatgaatggcagtgggaaaataaagcatacgatattgtcatgtgggttggtaactgtgatcaggaaaaaaaaaggaagatctcttaatgattagaaagaagatgaaattgcaaataatgcaccaaagctcagggctgcctaatacagaatagtagccatgaaatggaaagtgttggcctgctttaagaaacatcaatctttttgatattcatgcattgatttagtcattcatttactcatttatccatcaatttttaaatcatgtttagatgagagcactgaggaaaaattgtccaaattttgaaaaaaaggtggtgagataactatctggttttatgtctttccttttagagtcggctccgtatgtgaatagtaattacaattaattctgccacttcaaaaaaaaagatttttgtccttcacaacaaaaatctatattacctctcttctacttgatatatggctagtgtgaattgagatgtgctaagcgtaaaacacacacaggatttagaagtcttcataataataaaaatgtaaaatatcattaacatttatgttgattacatgttgaaatggtattctggatgtatagcattaaataaaatgtattattaaaactaattttactggtttctcctgcttgcttttactgtggttactagcagtttaaactttcaaatgcaataacacacataaccaatggaatagagtaagacagcccagaagcaaacctgtgcatatatggtcaactgatctacaacgagggtgccaagaatacacaatgggaaaataatggtctctttattaaataatattgggaaaattggatatcttcatgcaaaagaataatgttggatgattatctcacaccatacatataaatcgactcaatatggattaaaaacttaaatatacctgaaactgtaaaaatcctagaagaaaacacaggaaaaagattccagaaattgaccttgggaatgattttttgaatatgttactaaaagcacgggcaataaaatcataaatagacaagtgggattatatcaaaataaaaaactacttcacagccaaggaaacaacaaaatgaaaaggcaaactaggctaggcatggtggcttatgcatacaatcccagcattttgggaggctgaggtgggaggattgcttgagacctgaggccagaagtttgagaccagcctaggctacatagtgagacctcatctctactaaaaattaaaaaaaaaaattagccaggcatggcagtgcatgcctgtagtcctagttacttaggatcctccccacttcagcttggatcacttgtgccccggaggtcaaggctgcagtgagctgtaaacacactactgtaccattgtactccagcctgggtgatagagaccctttctaaaaacaacaacaacaacaacaaaaaaacaaagaaacagaaaacaaacaacaacaacaacaagaaaatacctacatagtgggagaaaatatttgcaaccaaatatttcataaggggttaatattcaaaacctataaggaactcccacaactcaattaaaaaaaaaacacacttaaaaaattgggcaaagaacatgtagaagcatttcttccaagaaaacatacaaatagccaagaggtatatgaaaagatgctgaacttcactatttatcagggaaatgcaaatcaaaaccataatgagatatcacctcacacctgttagcatggcttttgttaaaacccaaaatataacaaatgttggcaaggatacagagaaaagcgaaccctgtaacctgttggtgggaaattaaatttgtgtagctactatgaaaacagtgtgggttttcatagggtgaaacaggcggtgaccctgaaaactaacaatagaactatcatatgatccagcaatcctacttctggatatatatctaaagaaattaaaatcaggaccttgatgagatatgtgcactcccatgttcatggcaacattattcacaatagacaagatatggaagtaatctaaatgtccattagtcaatgggtggaaaaagaaaatgtacataaactcaatggactattattcggccttaaaaagaatgatatcctgcatttgtgacaatattgatgaacctggaggttcatattatgttattatataatgatcatgaaatcatattgtgttaagtgaaataagcctgacacagaatgacaaatattgtgttatacacttatatgatgaatgtaaaacagccaaactcatagaagtggagagtgaactagtggttgccaagagctggggactgaaagaagtaggtaggtattaggtaaaggatacaaagtttctgtcatacgagataaatcctagagatctactgtacaacgtagtgcctatggttaattatactgtattgtacagttaaacctttcctaagagagtagatctcatattcagtgtcatcatcatcatcatcatcaacatcatcatcatcatcgtcatcatcataaataagaaggcaggagaaagttttggaggtgatccatggatttatgacataaattacagtgatgatttcatgggtgtatactcattttcaaacttaccaagttgtatacattaattatatcagcttttggtctatctaaaaaattgaagctaatcaaaacatttatctttctactagaaaaaagttacaaatgcagctcagattatattgccattggacagaagtgctttacactcttctgcccccaaaataataattgtcggaattaatataggaaattaaaatacacataaatagatattacagaattatctttaatattataatttataatacatgattttatattatatttaaaatcactattttaatgtggctaactagcaattttacattatatttataatctacagtttataatatattataaatgtaatataaaattctgagatagaatcttcttttttaaaaaatttaatttaaagtcctgggatacatgtgcaggatgtgcagatttgttacataggtaaatgtgtgccatggtggtttgctgcacctatcaacccatcacctaagtgttaagccccacgtgtattagctattcatcctgatgttctccctccccgctttccccaacaggtcccagtgtgtgttattcccctccctgtgtccatgtgttctcattgttcagcttccgcttatatgtgagaacatgcggtgttgggttttctgttcctgcattagtttgctgaggttaatagcttccagctgcattcatgtccctacaaagggtatgatgtcatttttttatggctgcttagtactccatggtgtatatgtacacattttctttatccagtttatcattgatcggcttttgagttgattccatgtctttgctatcctaaatagtggttcaatgaacatatgcgtgcatgtatctttataatagaatgatttatactcctttgggtatataccctgtaatgggattgctgggttaaatggtgtttttggttctaggtctttgtggaattttcatagtgtcttctacaatggtttgaactaatttatattcccaccaacagtgtaaaaatgttcctatttctccacagccttgctagcatctgttgtttcctgacttagctattttttaaaatagccattctgactggcatgagatgctatctcattgtggttttgatttgcatttctctagtgattagtgatgttgagctttttttcatgtgttttttggccacataaaagtgtctgttcatgtcctttgcccattttttttctcgtaaatttgtttaagttccttgtagattctggatattagatctctgtcaaatggatagactgcaaacatttttctcctattctgtaggttgcctgttcattctgatgatagtttagtttgctgtgcaaagctctttagtttaattagatcccatttgtcaatttttgcttttgttgcaattgcttttgatgttctggtcatgaaatctttgcccacacctatgtcctgaatggtattgcctagattttcttctagggtttttatagttgtgggttttacatttaagtctttaatccattttgagttaatttttgtgtaaggtgtaatgaagtgttccagtttcagttttctgcatatggctagcgagttttctcaggactagttattaaatagcaatcctttctcaattgcttgtttttgtcaggtttgtcaaagataagatggctgtagtgtgcagtcttatttctgagttctctgtagaatcttatttcttacaaattttctcacattttttgtgtttttctttttgctcatcttttctactaaattgggcttataaatttgaaaaaaatagaacattcctccttacttttattttattacctacctctctgacatgtttcaaggtgttatatatagcactacatatgatagatcctgaggatctattgagaaaatatagttctataggtggatctctgtttcctagtgctaagttattttctatttattgtcatcccttgggcagcacaattctttctctgcctatgtcctctccctctgtgttgtactttatgtgtatgtgtactttggattttgtggagtttcagaatgtatgatatttaagaatgaaaacaacctcagttatcaaaaaataactccaaacaaaactccaaaatccattagctttactaaggaataagttatcagatagatactgtagggattgtgttaaatatcagccaagaatcttgttatgtttgaaataaagcagcatctaacactgttggcatgaatgaagctgacactttgatacaaaaactcactgactacaaatttaaatattaaagtataatgaagttgtaagtgtctgaaaaattgcttttcctcatgcacagtaggaattttcatcagcgtgaaattttgcagccatttctttgaaacactataaaagcttaattgacagttgtgtgattgggtgataattttttgatgttttatttactttttctatggattaaaatcttcccattattacaaaataattttcatgcatttattttttaaaaacatataaaatgcaaatcatattgctaaccccaaaaatgtaagctattagttgatttgtaaacatggaagtgtctgttaaatgtccaggaaagttaagattcttaccttctacttatgtattttatacaaaattatagtcccaatttataagtatttatgtttaaactatcaatatatgtacatatatgctaataatagtttataaaataaatggaaacatatctcatgattataatctttacttatttttatatttgtcaaattagaaattaatgttgagggttcacaaataaaatatatgtaaatttactacaaatacttacatttatatatgtttctgtattaatgaacaagtctttgcaggatactgtttcatcatttttcctaggataattactcataatacctaagctttgggataaatatatttacatttaatctattttttgtttaggtgaaatttgaaaatattagctgagtttttgttatatgcaaggtgcttctttttcttacttaatagaaccacggattttgatgttttattgtcgttatgttagaaagggtccttgtaaaatatttgaatgtgataggatatctacttactttcagaaagttcagaaagaaattagttttttgtactacatttatatttttttctgtgaatttgaaatggttaaaaaatagaagaaaagactgggcgtggtggctcacgtctgtaatcccagcactctgggaggctgaggtgggcagatcacgagatcaggagaccgagaacatcctggccaacgtggtgaaactctgcctctactaaaaatacaaaaagttagctgggtgtggtggcacgcacctgtagtcccagctacttgggaggctgagacaggataatcgcatgaacctgggagtcggaggttgcagggagccaagatcgtgccattgcactctagcctggtgacagaacaagactctgtttgaaaataaataaataaataaaaataaaaataaaaaatagaagagaaaaaagacttagttggtagctgagttggacaaatcacttcaactttgtgagcttggtgtctgcattagttctttcttgcactgctataaaggcatggatgagactgggtgatttataaagaaaagagatttcattggctcatagttctgtggctgtacaggcttctgcttctagggaagcccaggaaaggtacaatcgtggtggaagatgaaggggaagcaagcacgtctccatggcagaagcaggaggaagagagcaaaggtgaaatgctgcacatattcaaacaacaagatctcactagaactctatcacaaaaacagcaagggggaagtccacccccatgattcaatcacctctcaccaggcccctcccccaacactgaggattacaattcaacataaaatttggatggggagatagagaagaaccattccagtgtcccatgtgtaaactggcgatattaatacttaaggttattttaaaggatcaattataagtcaattataaactcatgattttccattttatttcatgggctgtaacttgtttttctcattatacaccactttgattttcaaattgtcccatatttgctagtagaaacccctttaaattgaaagcccagtttcttaatatccttgcaatactacagtttcaaaatttaaaagtatttaaattgttatcagtatatgcacatcaaggaaaagtatggtttagttaaggacattttcagatatctcaggatagatacccagagagtggttggcaagaacccaaactattctataactcctgaaggacattgttgcagaggatgcagcacctgcaggaggtgtctgtgatagtgagtggtggagaagcaacctaaagtgttgtttgctgtattcataagtggtaggcaggggtaaacctctgattaaaaaaaataatggtaaaagacattttcttacttgttttaacaagtattaattccaggaagaagaaatagcatggttagaaaaatagaattttaatatttttactcagattctcaggaagctgaagagatgaaattaacagaaggaaacatgcaggaaggcagggttgtaatttgcttctctttcctacctttaggcaaaatcagactcaagctattccagacacataatgttatttcttagtttaaagacttctagaaataggagatttcagaacttggtcaatattccatttcaatatgtagttatgcttactgcctgaaattctgtgtctcttaagttcaatactatgtacaatcttaagattaaaaactctgttctcattttgtactcaaagaaaacaaaatttctggctatattctcttcaaagtgtctataagagagtagttttaaaatttgtatttaccatgttcatttccacttccaaggggaagggacctaatattttctgaattcctattctctgccagatatacaactttactaacattttttgtcagtgccaagggctattatgggcattttatatgtttgaatttgtttggtttccagaactaccttctgtctgcagtttttttaataaaaatcacagaggttgggttaattccccacgtttacacagttttgtgtcaacttgactgggccatgggatgcccagatatttggtgagatattatttctgagtgtttataaggatgttggtagatgagatcgatattttaataggtggactgagtaaagaaaattgccctccctaacatagatggacctcatctaatccagcaaaggcctgaatagaataaaaggctgagtaaggatatatttgttctctctacctgaatgagctggaacatagatgttctgctggtttcagagttggccttagactggaacttgtatcactggctctcctgattcttggacttagacttggactgcaacttatgccattggctctcctgggtttggacttagcctgcataattttatcagccaaatttcttataatcatgttctcttcctttctctcttatgtttctctggagagccccaactaatacaactattaagaggtagagcttggagtccaggccatctgactctagcattcttgctcttaactaatatactaagctgtctctgatttgacaaacataacataattatcactacttggcaaagtcagtgggatttttttctctccattttatagaagaagaacctaagacttagaaagggtaagcattggttttgaggtttatttcgccaaagttgaggatgcacccaggaagaagaaaaacacaagttacagtgggttctgtgacctgtgctttgttctgagcagggttttgaggactgctctaaaggggaaaaagtgagcaggataggaaagacggggaaagggtggaggtggtaaggataggcaatgaggcaagtggtcacagtcttgtgaagctttgattagtgccctcttaatccacatctgacatgtgaaaggaggggacagaggaacagtcaattacgaattcatttggtactcggtaaatctacattttacataaggtaaagtaagcatgagaaattacagctatctgttcgataacaaaaggttgtctcagggattgggaagggagaatgtaagttcccaaatactcaggaagctatgtgcttggaggcaagggtctccaatgacctgagggcagcctgaagaagagtcatatgtatgggcaagttggaggcaaacatcagcactggggagaggtgtaccaaaacagcaaacggatctgagggaatggggcagagccatggtgcaatgaagggtacgcttcggatagagatccctctgatgccaacacctatgtactttttccattaccctattttgcctcctgtttcccttgcactagtcagcctcccactactcctggcattagcacccacagacctaagggctaagttaccctacagcttgggaacaaatgtcacttaaagcagtgagagaatcaatacacccagctccatttcctagaaggtctagtagccttctagatttataatcagagccaggggtttaagaaagtggttttgggccaggcgcagtggctgacgcctgtaatcccagcactttgggaggccgaggcgggtggatcacaaggtcgagttcgagaccagcctggccgacatggtgaaaccccatctccactaaaaatacaaaaaaattagctgggcatggtggtgcacacctgtagtcccagctactcgggaggctgaggcaggagaattgcttgaaccgggaaggcacaggtagtggtgagctgagatcgcaccactgcactccagcctgggcaacagagagagactccgtctcaaaaaaaaaaaaaaaaaaaaggaaaaaaaagaaagtggtttttacatattataatttataagattttttttaatttatttattattattatactttaagttttagggtacatgtgcacattgtgcaggttacatacgtatacatgtgccatgctggtgtgctgcacccactaactcgtcttttataaaactttattaaaaacatttaacacagtataaaaatgaaactaattccttaagaaactacccagatctctgtccttcagggcagtaatgcccctgtgtgcactttggaggcctattttccaggactttactgcatagcagctgctacctgggttacttgtgatcctgatagaagtgagtcccggaaaggtaagtgacctacagccgataagtaccaagtaccctgtggaattctgccatatgaatgcacaggacacaacagatgagatctctgaattttggttttctacctgaaagtctcccttatttttctctgacgagtcagatttattttcctctaagcttgaattatgtaaagatttgtggtcttgtgtaggctgcaatttgacaaacagagacaatagtgctaagcaaaggtgtgaagaacaactttacatttttacagcatttttcacaaccattgaatcctgatgcacttcacaggaagtagcaacaactttttctatagattctattaggatgtgaattttgatacccaattctgaccttctgaagttcatttaatggtgtgggaggctccaaaatggttatctttagactttttttcttttttgcattttttgaacgttttcctttgatgtttctacacatctctccaaatgaaagcaaatatttattcatctaatgatgtactaagcaataggggataaaatgccaaacaggaaatagttttgaattctacttttgccactctttttgtctaggttttttatctataaagtataaattatatatccccatctcaagggtaatatatgcacattgtgtttcttctacctcagtaaaacactgcatacaaggcccttagaacagtattttacagtcagtcaattattactgttaggaactgactatgtgattatcaggcactgtcccagggataattaaaattatactatgttactgacctcaaaaagcttacttctagtaggagacagatgtcatacagaaacagatataaaaatttgaaatactgataaaaaagaaaagaaaagatagttgattagaggtggggcaattttaactggagtggtcaaggatgaggtgacttctcaagttgggacctgaagaccaggaggaagccatgcaaaaacctggggttaagtcattccaagccagtagtgcaaatgccctgaggaaaggataagctgacctgtttaagacccagaaagaaggcacgtggactgaaggtgtggaatgagggtagactgaggttagaaaaagagcatagggaaacaagtggcactagatcacctaaggccttgtactcaatgggagggagtttgaattttattgtgactgctgtgcagagccacataatgcttttaagcaagttgggagttagtaattggatttatattggattggattgcatagccctaatttattattatgaataataaattcataataatgtattagtccattttcacactggcataaataactaccagagactgggtaatttattaaggaaagagatttaattgactcacagttctgcatggctggggaggcctcaggaaacttacaatcatggtggaaggcaaaggggaaacaaagcacctcttctcatggtggcagtagagaaagggagtgaagagggaactgccaaacacttttaaaccgtcagatatcatgagaacttactatcctgagaacagcatgagggaaactgcccccatgatccaatcacctcccacccggaccttcccaggacaattggagattacaatttgagatgaggtttgggtggggacacagaaccaatccatatcaaggacagcccataacagagttaagaatggaatcagagagaacagctgagcatttgcaatggtggtcaagataagagaagatgtttcttattggagtaaggtagggagtaatggttaaacctgatgtactttttgtggtagaatttgttaggctggatgtgggaggaaaatatgtcaagggtgacatgagttttggcttgagcaaaatgaatatgtggtggtgccattttctctgaggagaaaaaaacttggattgggccaacagttatgctttggtcatgctaaggataagatacttgttacacatcaaagcatgaagcagccaactaaacagttgactaattcacttagggagatttcaggaccgattgtatagccatgtctcagtatccacagggaattggttccaggacctcctgcaaaaaccacaatctgccaatgctcaaggtactttataaaatggcagagtatttgcatataacctatgcacattcttccatatactttagattacatatagttataatacctaatgcaatgtaaaggtgatgtaaatagttattactgtattgttttttaaaacctgtattttttattgttgtgtaatgtttcttcctaaatattttctatctgtaggtggctaaatctgtggctgtggaacccatatatatgaaaggctgactgtatattcttcaattagattactttcaaagtcataggttagtggaaatcctttaggaaaaatattatttttagcacctatagaagatcaggtgttccaagtgatatatatggttttaaaatttttaatacatgaattactaaacatttttaaatttaatactgcattttaaatttttcttgtatggcttataaccaccgcagaagatagaaaatgttattttgattttactgatggggactagaggtacagagacgttaaataacttgctcagttacatacttagtcgataaaaaagtcaaaatttgagcctaggtaatctgaccccaatttacagtccctggagtataaaggaaaaagagggactagaattcagctctaatgcaatttaacattttgaagtcacgtcacaggagctagagtctgtgagataactaagaagggacagtcaatgaggtgtgagagagtctaagtgaggatgagttgtacatgcctagaaaagtcattccagttaatgacctcccactaggctccacctccattaaagttaataaataagagattaatgtatcaaatgttgtaaaagcacctgctttggctgcatatacattcaatttaaaataatgcaatttattaagtaaatatagccaataattattatgtatttaaaatattcagtacagtactaaatatatttagatatttagataggctaaatatctgagtacatttaatttttacaaaaccctgatacatcaagttattcctactgtacagatgaggcaaccgaagcatacagtgctaagtccccaaggttgtacagttggtgagaggcagagctgggacccaacctaagcagtctgacagtagaaactatgctcttagccggcacaatttaccaagtctcttaaacatgatacaaatgtacagtccataaagcaaaatattaattaccttgagtacattcaattaaactctcttcatcaagagttatcataggaaaaaagagacaaatcacaaactggaagtataataacacatataaacaacaaatgactagtatctagaataaatatagaactcttaaaaggattaataagtgaaagacagccaggcacggtggctcatgcctataatcccagcaccttgggaggccaaggcaggcagatcacctgaggttgggagtttgagaccagtctgaccaacatggataaaccccatctttactaaaaatacaaatttagctgggcgtggtagcacatgcctgtaatcccagctactcaggaggctgaggcaggagaatcacttgaacccaggaggcggaggttgcggtgagctgagattgcaccattagactccagcctgggcaacaagagtgaaactccatctcaaaaaaaaaaaaaaatagtaaaagacaaagaattatccagaaaaatagagccaaagacatgatcaggtgtatttcacaaataaatgtaagttgtttatcaacttattaaaagatactcaatgattataaaaatgtcagttaaaataataagtaatcctttgatactcagcagattggcaaaggttagaatatcagacaatcataaacttggtgagaatacgaaacaattcacattgcttatggaaggcaagttggcataattacttaggaaaatattttagtattatcttgtaaaatggaagatgtttacaaggaaggcctcaggaatatcactgctaagtaattgatctagaaaaactcttgtgcacgtttaccagaagacatgtataacatgtttatagcagtgtgttaggtcattcttgcatggctgtgaaaaaatacctgagactgggcaatttttaagaaaagaggtttaattggctaatggttttgcaggctctacagaaagcatggcaccaacatctgcttggcttgtggtgaggcctcaggaagcttacaatcatggcagaagacaaaggggcagccgacatatcacatggctagagcaggagcaagagaaagagggagtgagggtgtgccacacaccctaaaacaaccagatctcaccagagctcaccatcataaggacagcaccaagacatgagggatctacccccatgatctgaacactttccaccaggcctcacctccaacactggagaccccatctcaacatgggatttggaggggacaaccaaactatatcatttcactccagccacatctcatgtccttctcacattgcaaagtacaaccatgccttcccaatagtcctccaaagtcttaactcattccaacatgaactcaagagtcccaaagaccaagtccaagtacaaagtctcatctggagatgagtcatttccacctatgagcctgtaaaatcaaaacaagttatttactcccaagatacaatgtgggtacaggcattggataaacattcccattccaaaagggagaaattggacaaaagaaaggggctataggccccatgcaagtctgaaaccctgcaaggaagtcatcaaatcttaaaactccaaaataatatcctttgaatttctgttctaaatccagggcacactgaattcaggacacacattcacctgtcttgaatccagtgcaaggggtgggctcccaaagcctcgagcagttctgtccctgttgctttgcaggatttatctcctatggctactcttatcatgggttggaattgagtgcctgtgggttttccaggtgcatggtgcaagctgccattagatctaccattttgggagtctggaggagagtggggtatccaaccccatatttcccattagtaatgccctagtagaggttctctgtgatggctccaccactgccgcaggcttttgtctgagtacccaggctttctcatacattctctgaaatctaggcggaggttgccaagcctccttcactcttacattttgtgcatgcatagtcttaacaccacatataaactgcccaggcttatgacttgcaccctctggagcagtggtctgaacagggccctttgagccacagctggagctggagcagtggggatatcgggagtaaccgcccaaggtggcacagggctttagtactcaggcctggcccatgaaaccatttttctccctaggcctctgggcttgtgatggaaggggctgcctcagaaatctttgaaatgtctttgagatctttttcccattatcttggtgatcagcacctagctctttttttagtcatgcacatctctctagcaagtggtttctccacagcctgcttgtattcctctcctgaaaatgatgtttctttctctgccacatggctaggcagcagatttattaaacttttatgctctgcttcttctttaaatgtaacttccaaattcaagtcatctcattgctcccacatttgagcttatgttgttagaagcaattggccacctcttggatgctttgctgcttagaaatttgttccaccaggtaccccaagtcattactcttaagttcaattttccaaagatacctagggcacagatagaatgcagccaagctctttgctaaggcataacatgcataacgtttgcttcagttctcagtaagttcctcatttccgtctgagacttcatcatcctggacttcactgtccatatcactatcagcactttgataacaaccacttaactagtctctaaaaaacttcaaacttttcctcatttttctatcttccactaagccctctgaatagttcaaaccatctccctgttactctgttccaaagttgcttccacattttcaggtatttttatagcaatgccctactcttccataccaattttctgtatgaagccattcttgcatgctataaagaaacacataaggctggataaattataagaagagaggtgtcattggctcaccgaagcatggcaccagcatctgcttggcttctggtgaggcctcaggaagaagcttacaatcatggcagaagacaaagtggtcctcatatattacatagtgacggtgggtgccagagagagagagagagagagagaaagtgggtggggaaggtgccgtgtacccttaaacaaccagatcttatgataactcacaattgtcacaacattaccaagccatgagggatctgcccccataatccaaatatctcccacaaagccccatgtccagcattggggaccacatctcaacatgagatttggaggggaaatccaaattttaccaggcagatttaaaaaaataaaaaaaaaattaaaaagaaacaaaatctagaaatggcccaaaatgttcattgacaccaaaatgaagaaataaattgtgatatattgacacaatgaaaaatttttcattgtcactgttgttgcattgtcattgttttgttttctttgatatgttgtttaagatgagttataagaaaatgctggtatgttgatgcaaataattgaaaagagagtactgaattgatgatgcagagaagacaaggaataaagttcttaagaaggcaagagaaaatgaaatccaaagctcgcgtgtgcatgttgttcttaggaacagacagacgggaaacaggtggacaggttgtgaatgtagcaatgggaaggtgaggtagattctctgtttgcatctatattctctacaatgtttgatgtgagacatcatcggttgattacattgtgaacagttagattgttggagaatttagagggagataaagtttaaaacaatttccacacatcttctgtttcaactttagtatgtttttttttcccatgcctgagtttcagagaggaaaaaaatgttgctttctccagattctaatgatcccttgaatttcttggtgaattggaatagctttaaaccttttactgcttcaagcactatcaatcagagatgtctcacacctgtcatttttgaacctgtagcagcaccctagtcttctttggcttattttaggagtaaacatacaggtaaaaaatgagtgcttgttcaagagtttgtattttcattcatttaaaacattgagcacctaccatgtgctataaattaactatgtgctgtaatatatgcatgagcacctctatatgcttttaatatttattcatttattcattgaaaacattgagcattcatcatgtgtattaaattctagcatggtggcaaaaaactggtaaatatgtcagatagggataatttctatgaaggtaaattaaacagagtaaggggtttgagggagtttggcattttatattggcctgctgaatggatgggctttagagaagaataggaggagaaagattggacataaaagagatccacaaatctttacagaaattttgcaaaaaagatagagtgaaatgtaaaagtagctgcaggggatgcggaggtcacaggtgactttattttattttatttcagatgggacaccatgatagttaattttatgtgtccacctgactgagccatggggtgcccagatacttgtttcaacattatactgggtgtgtctgtgagggtttttctggatgaaattaacattggaattggtggactgagaaaagcagattgccctccctggtgtgtgtgggcctcactcaatctgttgaaggcctaaatagaacaaaaaggctaagtaatagaaaatttgttttctctctgcctgactgactatctttgagctggaacatggtctttttctgccttaggacttgagccagagcatgcccatttgttctgcttctcaggccttcagtctcagactgaactatatcaccagtcatcagttctcctaggtctccagcttgctgactgaagatgggacttctcagcctccataattgtgtgagctaattcttctgtctgtctatgtctctctctctctctctctcccccccagctttggttctgtttctctggagaatcctgactaacagagatagaacagagggttgtttttttttttttttttttttttttggtgtatgtgttaattggaattctctactggagagggttaatacatgatcgggagagaaaccattgctggtacgatatttttgaataacagagagggagtggtatctagtgcatcaaaagagaagttatgtgtagaaagttcatgtaagaacaggaagtaaagaaaaacaggtaaaggtccaagtatgtgtatgtttgaaatccagtggtgaaaccttgtggaaggtctttttaaattgccataattccttcaacaaaatagaaagcaagttccacagctgagagtgagcgtgaattcaggtgttgaaagtctgataatggatgcataggtatttagtagaaaaacgaaacaattttaaagaaaacatgtaccagcaaattatacatacaccaagtaaataaattcctgtacaactctaaagtttaatttttgtgtcttcattccattatcttcactaatgtaatattgtatttaaaaacttgtaacaatagagaaaataggattttaccctttgtataggctgggtaataagcattaagcattaaaaggtaaatggagacagtgtaaagaataaaagtttttagtaattcacaaagagatcactgtctcctgaatacttccttttcagacagattgacttgataccctgaaattggactacaggacttgacatatcttcactttttttctctttttaaagaaagtcaagccatgtgatttccatttttttttctgaagtggggaaatggtttaacatttatatatgtgcaagctttatccttataatcctagagggttaaggagaccttggtttacccatcacataactttcatttgaccgtgggtggctttacttgtgtatttctaagtagtcctgctacttccagatggatagtaacctatgatctccaatcttgacctatgtacctgtctcccaaacagaaggctgtgcaagtgtacaaaaacatattcatgctaaagcacataatttctagttttgatatttaaagaactaaacttttaactctcttggtgctaaggtatggagagtacagggtgctgagtcataactaggtagaaacaagtaagagtggataaatccaggtgaagaaataaagcaactcataggaattgctagaaatagattgagtttagtttttttccttccacttttgcctttctttcagctgtctctataaaattaagatctgaaatttgagtggaaaaagctgtttgctacagtttcatttgcccattcaggtgaatcttctaatccaaaatcaactttctggcttttattaatttctggaagcaacattcttaaagccaaatatcccatcttattgttaaaatacattaacttaatttgaaaagcattttcacataagtagattttgttccaaagatgtactttatatatttttttaacttgtattttttttccaggggtgtgtgtgtgtgtgtgtgtgtgtgtgtgtgtgtgattgtagtgttatttttcatttggtggaggctgctctctgggatatgagctgttttcattgtgtgtttgttggtatgtttatacaaaaaaagagacagataagtaccacccagaaatgagtgacaatagcacttcagggtttttgttgttgttgatatttaattttattttgcatatatattatttatgaaaactttataaatcttgtcaaaaagcatttcaggagaattggaaatggtatcacaagaaaaattgcctggtgtggatcaacaggctttgtggtctgttttataaatgtgcttttttgttgtttattttataaatcatgtatgtagaaagagaaaaaaaaagaatgatttattaaatgtttatgagaaactctagtacaccctgattttaaagtgcaaggaacagacaattagctcagggatttgtcattcaggttattgatcacaataggagtctaaatggggggaaaacatgaatttctcttcaagacaacagtgttgagatgaaataatcttaattttgaattcccttttcttctcaaaagtttattatcatccagcttgcagcactgagacctttagcctttgaccaagaaagataagaattattgaggggggttatatttatcttctgttaacagtttccagaggaaggaagacatgtttttgtctccttcttgcttaagaataggagtatgtagtgttatagatcttgtttgctatgaaagaagaataactatatcaatttgattgaaggtgtcagaaatgttttgggaaacaacagaagcagagttctgaggtgggaaaggtttgacatatagccacgacagtgcttgcttggtttgtgttttgatttaatgcacccactgggtttttaagcttattatgccagaagagtgaattgcgatttgactaaagtgtgttttgtggacatttgtccttgttttacctccatgctcatataaacaaataaatgtaaacttgggatttctgtgaagggtctggaagacttttctccgtgagtgagagttttaggcattttatgtgctctcatttggatgaaaagaaggggaaggagtattttaggtgacagattgttttaataaaaggtatcccctacccatggagattctctgttgcatgtttggctgctgcagcaagtatttgcagtttaatggaaataaatagctaaaaatcagggctcacactcaagaaagtcaatgacacccataattatccttatattcttaacttttttcatttgtttacatttttgcattttgatgaggaacttcacttccaagtgccttagttttcatatccacatagtggggtccataatgtgcttttacaaccctaccaagaggatcaatgaggttcgtgtacatgaaggggcttaataaatagtatgtgatttgagctttctggatgaaaagtactacgtgagtacaaagtagagcagcctcccataggtaatgcctttgcctggataactctgattataggctttatctctgcaaagcagagatttttcttcttgattccttcctgagctaaggtgcctatttcctcagtaccttttccttttgagctcgcatacaccaatcaagaaacacacttgcaaaaagatttgtttacttaagtgcacacatggtcaatcacataaatggaaatatgaaaaaaacccaaaacagtgtgaaaggaacgttcataacacatcaagcccccagatggctctcagaaactctgacatctcaggtggacccacattttagaatatgtattttcaaataaaaagaatgtatcccaggtaccttaaataaaatacagaatatgagctgttttcattgtgtgtgtttgttggtacgtttatataaaaaaagagacaggtaagtaccacccagaaatgagtgacaatagcacttcagggtttttgttatttaaatttgactgccttatatacctctttgttgtatagctttagatgaaagtgataacaagaaataattttataccacactttaaactgtttacaaaacattttcacaaagattatttaatttgtttctcacaacaatcttatgaagcaggaaaaacctcggaaaggttgtgtaacttgtcaaaaaatatcctactgttaagtggcagtatgtagtttagagcaaacatcctcagtggttttccacatttccagagatggcaagcgagtttactcacacattccatatctgatcagtgagtggcagctgcctacagtgctgtgctcaggatgtttaatctatatccagtatctgagggaaaaggtgcaggaattgattagtgatagccactctgtatttgggcagagatggggtcatgagtaatacatatcttccaattcccaaatgtacaccataatgtgtgtttttaaagtgttttgaataatgtgtttgcctctgtagtattcaagtaaaataggtatctctgaacaatttgtaccaggagtgagtagtggatctgctaattagctatgatatgcaaaacatagtcacttgttctggaagaatttcgtggaactactcctttatcttgatttctgatttggaaagttggcagatgattatcatatgactatacatgtctttgatccttttgtcagtctcttgtatttatttatttacttatcacaaaaactcttccacctttaaaaacttatgctggatttttcatttaaaactcctttaaaaactttaaaaactttcatgtaaaactcctttaaaaactcatgctggttttcatgctgggtgtctgggttaggtgaactccatttaaaatagttgatgtgagtataaaatcaaaatatagaggcagtgagtaacaaacttctttctaaaaacttattggtaaaatgaaggagaaagaaagagagataacatgcaatagaagtaatgtggcagagaatcttctgagtttccagatattctatcagggaggtgacagtctgttcttaatattggtagacagcattgattgctggataaattattttggaagagcattaatattatgataaataatttaattctgtcaaccacaggaagtatcctatcttaagagacatatcagaagataggtcttttttgcttttaggaaaataatatgactcatacagttaaaatgatttctgatcctgactatatctgggtgcatgaccatactgatattttcccatcagtttgcagacaattggcccactttggtgatgagtcattcagttccatttccaatcttggcattgaaaaatacatagatatttctagtataaaagaagatatttccatactcttgcctgaaaattaggtttagagctatatgatctgttattttgttactttcatcagaaggttttttgcaatgatattttaataaaaattgctctattacatttttacagttgggaagaacctttaaagcatgaagtagaatccatcactgtatggttggcttccaaatttgtatctcctgcccagacacttcctttaagtcccaagcatatatcttaatacagaaggaaatttggagtagagaaagccagaaagatggatatcatctctgacactttcttctccttgacaccctataaccaaccatcacccacattttatgatgttccttccttaatgtttctaaaatctcaccatatcacttgggctgcagagttaatttccttaggtttactaagtttagaccaagctactgatctctcctggacttttagttttgttctgattttccaacaagtatcgttgcccctttcctattcattctacagaataagctttgcaaatgaagctggtgtggattctttgccacaacacttgagtataagaacacctttatttctatgaacaaattgactctgccacaagacccagcaactttgggtatgggaaattcagtctcagtggagttaggttaggaaagccagagtcagactgtcagagctcaaatactgactttacaagctatgggttatcaagcaaattacttatttcttaaaatagtcttaatttactggtacttgtaagtatcaattaagatcattccaataaagcttttactgcagtgctgggcatgatgtagtgaagaccattctcagggctgcatgggcagccctcactgtctgctcccaaccctatagcattcatgcttggtcacacctacaggaactctgacattggttctccagctcaaggttcatatagtccaccttccataggcatcctactctgaacgattgagacctgggattctactacgcagtgcaccccttcccacccctgagctctacctctaacctcatcccttctcttagtctcgggtatgcctgccttcgtggattggatcagactgcatctgcctcttcatggcaagaatttccctcctcctctccttttctggaataagccagtctaataccacataaatgacctgcttgggtgaatgttggagggtaggggatcagaagaggggtggaatagtggggaattgggaaggggaaaggaggtggagataaaatgactacttacccctttggatgaacaatcttggccgtcctttccttgtatcaggatgggaagaaataagctatgttttattttttctttaaaaacagctcattttaacacaaactcaactctcacgtcacctacttttattaggcatcttttacagctcagttccatctaggcacagaatctctgcgtctaccatctccatgttcttttttcttcctttgcctcattgacttccgctagtccttcatatctcaagtcaaactgactcagataatccttctctgatgcaccaggtgatgaaaaatccacctgttatatattttatatttctgtgtgtttctccacccacccattgtagtttgaagtgatcttttaaatgtatatgtaatatctgtctcccaccagactgaaagctctaggagggtaggaaccatatctgtaaggacagaaattcttgacatcaacagcatgcttggcataaagtaacttaatacatattttttggctaactgaataggtaatttttcatgagcactaagaattcatattgtctgtagtaccctactgccctttagaacttatttttacttttaaggattttatatctgcaaaggacagcaaatatgcagtaatctattcttaattatgttatagctacagaacaatttcatatttgcattttccagttgccttcattgatcaaaattagaaattaattattactactttctgttttctgcattgtttattacaaattactggtatttataattaatcttttgataaagcattataagtttacatattgattcatatgcacacacacacaaagatgaaaacttccttttttaggatgatattaactatggattatctcaatctttcttctcttctttttcttctctctctaccgtttctctctccctgtctctccctttccatgttcctccccactccttggcacacaaacatataccccttgatctgaacctgtaaccataagaaatgatgggagaagccatccataggtgaactgttgagcttcaagttaagatacgtgtgatattaaaatgttctctttgaacttacagctctccattgtaattttaaaatttgctttatcattttaaaggactaattttatttggcagtccttccaagatcctgctcttaaaatcactttggaaattaacaaatgcatttggttttcaaatctgctcagctgggcaccttcagctccaaattgctctgaatttgcttccctcatcctcttcttgccaccctacttaactcagagaaaaaatgaatttccagcagagtagaaagagaccagttcagagatctctgctcttctctttgagggtgaatttcattagacaaatttggcaggaatattatcagtcaattaataattaataaaatgtgaactgaagtcaaattaatcttcagagtactggaaaatcagttgcacttctgctaataaggactcagtgtgcatggaaatcttactggagactgagtacatctctacattgtatagttaacctgattttttccagcccagtttacttattggcattagtataatccacacagggaagtcacaataaccatgataaagtgatgttagagataattaccatcctctttagtttctcaaatattcagaaggttcttcagccctcttgtaggctgctgaactttaatgttaggatgaagatgtgcaggtgctttttttgtaaattttgattttattgtcttaagtacagaaataacagagacattagagaatggcagaaaacaaggaaaaaacttatattataacatcgctctaacacatccggtatcattttgatgtggacccttcttaggtttttcttcctgtgtatttttacacagtggtaatcacaatattacatatttatttccccttgatatttcagaaattcttccacattacaactgagaatttttaaagtaccaaattagattatctaacaaatagatgtggcataatttgcctaaacatgtcctgttgttggatatcttggctgcttgcaaccccttcaatattctaaataacattgtaataactaattttgtgcaagtattttgctttattttcctaaaagagattgacaaagtggtattatcactgcttggcttttgaatggttgagattaataacattcctcttctacatgaagtgtcatggcatcccagaaggagagaattgtgagtttctgtgataattctatagaagcttcattcatttggatagtttcaaatgccctttaagcaatcttttgtatttcacctttcttggaacctgctgaattatcttcatctgtagaaagagaaacaacagcagcagcaactacacactgagtacttatgccaatacactaagcccttcatttacattatgttaggtgttcttacaaaaaattacctgaataggtattattattacacctactttacaggtgaagaaaggaaaattcaagatggctaggtaactttctaatgtcataccaggtaaatgctcctgaactgggatcaaaccctagtctggtaatacacttcactgatcacgcatgtaatggacatactttttcacaatattgataacaagtatgaaagcttcatgctctttacatttcaagtgctaatcccactgtttgttgaagttagtaagtgctatttcatcaggtgagtaagaactctggagatacagtaatcttaacaaggaatattggatgtaattaagtaatagattatatttttctcggtatctgcgtggctacattgaaaaatgtgtcataaaaagaccatgtcttttgcattcattgctacattactaatttcaagcacagtattaacacagactggatatttattgtgtgttgaatgagtaaatactcaactctaaatgctaactaattctttccaagcaatttattcactcctagcatctgatctgtttactgtgccttgaccaagtaaatttctcagagtcctttttttatccaataactccattacagtacttgtaagtttctcagagtccttgtttatctgttaaatctctttcgtcatattaaattaaaataccttattgcagattgcaaaatatgtcacttagaaaaacaaaacaaagctaatagtaaaacaaaaaagttaccagtcctagagcctatacatgtacttgcaaatatgaaaaaaagcttaaaaatttaaaatcctgtagaatcaaaatgaaaatgtaaattaatatataaagtataacagcgctgtatagtcaaatgcaattccactcaactcttaaaatattatagatacattttattgtggtaagtaggtgtatttttttgttgttgttgttgtttcaaatgatgtggggtgatgccttcaatattaagagttcccaggactgccaaagtcatacactacatatcactgccgcttggtttgaataaaaactcattagtcctacactcattcctctggctgttgaaggcctgattctagtaagtctgtcttgctgctgctggttgaagattagtggttggtgagcctaaaggaaaaatacgggcctacacttccagttaaatcctacttataaactagtacagacttttcctttttttctcttatttgagcaaatatgtacctgcatctaagtttcctgaaactattttctgcttagagactatcctttagacattgtattagacacctcatgtgcaccatttctcataatctcactcttacctcttacttcagttattgtagcaaccaatatcaggcagacttctccagcttcacacagttcaccaagaagcacctctcttgctttctgtttggggcttctttgatgctatataggacacctgctggaaatttcctggtactgaaacatgtacaaaccacatgttggggggtctgggccaatcaggaagaggagcttgtagacaaatgcttctcgtttcttaccctgcacagatggtttgaacacatatttcataaagctcctcaaaaggccctttaggaccaaacgacccaactcagtaattcatctttgtattggctttcctcccttccatttatctgccactcatttctgctctttcaaatcacattcccaaaataacttctcacatattagcatttgtttcagactttgcttttagcaaaactcaggataagacagtcatgtctgtactatgtgtaactattaagacttttccaagaaacatttgatgagttaagtttaaggtgactggaaaagtcatttgggtcatgcatctttgttgatattccacttccccacaactgttcagcttgttaaaacaatttgcctactgtctgagaaaattacagaataatcccttatttctcaaccaaacttaactctcaaactatagaaatgttaaatctacctcctgaattaatatattattaatcttgatcgaaaaagaaatatgttcgctatttaataataccactgatattttgatgcttttgcttccaagtagtatttggtactgctttttctggtttgatgaagtttcagattgataggaattttacatgtgaagacagactagctacagttcattgtgtcattctctcaaatacaatattcttctggttccttgatgacacattttttcaatctggatatttagaaactccttattctgatatcatgttgatgcccatccttagcttttggaaaagtttgctgtattggtggaaatgttagcctatctgggtccagagttcatagacagccttgagtcagctctgcttgtgggcttgttcctggttctccagctgtctgtctgattgatttgatctctgcttattgtctgccatcagagtcaccagataataaactctattcaactgcagggctatctccctgtcacctacttctggacatctggaatacttgacacctgtctgcctcagcttccccccattcccacactattcttcctttagtttgttactagcctttcctaacagcctctcctctgtcctgtctgccctggtgggggcatcctaccatctgtgtcaggtcttcttgagactggtcatttgtgttgttgacaaaatcctggttctgaaacaaagagtactactatatagttgaaatatgtgagaagcagaaggctatgggtaaataataattaagcaatattttacataaagactaccccacccaattttttcatttatattctgtacagaaatctttggtttcaggaaaatgtagtcagaatgaaaataaattatgtatcttgtttgggaataggtatggtgcttcattaccaaaatacctaacttacaaatgggagataattttacagatttaaaaatgggaacatatttctttcaaaaacattttctattttggcttgaactttaagaaatcgccttcaatgattggttttcctttctatggctactcttgatctcagcattggtttctctctctcctaatagaagatgcttcctcccatgctccatatccaactagctagttactgatgttggctgtggcatttttttttcttttatttttctgaaattggagactctggttgtgactcaggcctgtcgtcctataaatatgtactgtggatctcagtgggaaccagagactagagagtaggactgcattgacatagaatccttgtgtgactagcacttctgatagaacatcattaacaccatctctgtatgaagaaaaggtcttaattcctttttaaaaaattttattttgaaattgacagattaaaattgtatgtatttatgatgtacaacatgatgttttgatatacatatgctttaattattcttaattaaaccacccccctgggtggttcttcttcatttgttgtactttctcatccactgatggcagatttatcaattggatgatatgtttgtgggagaggaatattttttgttcttattcttatttggtgttttgctttatctgataagaagtaacaattttccacttgaagatatacacacatcttcctcattcctagtgcgtatatggaggaagaaagctcagctgtgacaatgcagaacatatggtaagttgcttgtagaaccctttctgctacatagcaatctttggtacgctgttgagaaaaagcctaatttgcgactccaagcagctatacttttgcttcgttttgtatttttgagcattgcgatggaaatgaggccaaataaggtgaagcagaaaaattatgccttttaatcaaaattttctaaaactatggttgcccttactttctggtgtctgagtggttagggggttttctattatccaaacattaattactcaacctgaaattatttagacttaaaggagaagttatactcgtctgtaattatggctgtttgatcaatgattctgacatttttacatgttcactattgtgaacaagaaaatcaatttttaagatttgctgtttaataaattacaaaattaaaaattaatctgattgaatattgcatatctataataaagaaaattttagatgccattttatccagtaagggacagttgttcctttcccaagtcttgccacacacagtgagtaccagatttaatattttgataacactttgataatgtcttgggataaaaagttaaaaatgttgtcaagtatttccacataacctcattcagctaatggggttgaaaaaccagtccatctctaataaatggatattgccaattaaaaagatttccccaaagggctctaggtttcatgaaactttcattggcaagttatatattaagcagtgaatcctaattttcaaatatagtatttgaattataatgtttacatatggaatattttataatttataaagagtctatttagtaaatagtgtttaggctgagatttagaacaaactaccctctaattctttttttccataggttattgggggtacaggtggtatttggttgcatgagtaagttctttagtggtgatttgtgagactttggtgcacccatcatcaaagcagtatacactgcaccatatttgtagtcttttttgtctctcgccccctcctacccatccccccaagtccccaaagtctattgtatcattcttacacctttgagtcctcacagcttagttcccacatatcagtgagaacataagatgtttgtttttccattcatgagttacttcacttagcataatagtcttcaatctcatccaggcccctgtgaatgtcattaattcattcctttttatggctgagtagtattccatcatatatatatgtgtgtgtgtctatacatacatatatatatctctctatatatctatctatgtatatctctctatatatatatatctagatatatatatgtgtgtgctttaaaaacagaagtagtgacaacatttagaatagatagggtcaaaatgataattgcaataatgattgtgtgtatatatatataccacagtttcttttttttattattattatacacaatgtgcaggttagttacatatgtatacatgtgccatgctggtgtgctgcacccattaactcgtcatttagcattaggtatatctcccaatgctatccctcccccctccccccaccccacaacagtccccagagtgtgatgttccccttcctgtgtccatgtgttctcattgttcaattcccacctatgagtgagaatatgcggtgtttgggtttttcttgcaatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatacgtgtgcatgtgtctttacagcagcatgatttaaagtcctttgggtatatacccagtaatgggatggctgggtcaaatggtatttctagttctagatccctgaggaatcaccacactgacttccacaatggttcaactagtttacagtcccaccaacagtgtaaaagtgttcctatttctccacatcctttccagcacctgttgtttcctgactttttaatgattgccattctaactggtgtgagatggtatctcattgtggttttgatttgcatttctatgatggccagtaaagggtattcaattaggaaaagaggaagtcaaattgtccctgtttgtagatgacatgattgtatatctagaaaaccccatcgtctcagcccaaaatctccttaagctgataagcaacttcagcaaagtctcaggatacaaaatcaatgtgcaaaaatcacaagcattcttatacaccaataacagacaaacagagagccaaatcatgagtgaacgcccattcacaattgcttcaaagagaataaaataactaggaatccaacttacaagggatgtgaaggacctcttcaaggagaactgcaaaccactgctcattgaaataaaagaggatacaaagaaatggaagaacattccatgctcatgggtaggaagaatcaatatcgtgaaaacggccacactgcccaaggtaatttatagattcaatgccatccccatcaagctaccaatgactttcttcacagaattggaaaaaactactttaaagttcatatggaaccaaaaaagagcccacatcgccaagtcaatcctaagccaaaagaacaaagctggaggcatcacgttacctgacttcaaactatactacaaggctacagtaaccaaaacagcatggtactggtgccaaaacagagatatacatcaatggaacagaacagagccctcagaaataacgccacatatctacaactatctgatctttgacaaacctgagaaaaacaagctatggggaaaggactccccatttaataaatggtactaggaaaactggctagccatatgtagaaagctgaaactggatcccttccttacaccttatacaaaaatcaattcaagatggattaaagacttaaacgttagacttaaaaccataaaaaccctagaagaaaacctaggcattaccattcaggacgtaggcatgggccaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcacctactcatctgacaaagggctgatatccagaatctacaatgaactcaaacaaatttacaagagaaaaacaaacaaccccatcaaaaagtgggtgaaggacatgaacagacacttctcaaaagaagacatttatgcagccaaaaaacacagtttctttgtagactcgttgattgatggacatttgggttggttccacatttttgcaattgcgaattgtgctgctataagcatgtgtgagccagtattttccttttcctctgggtagaaaccaagtagtgggattgctggatcaaatggtagttctacttttagttctttaaggaatctccacactgttttccatagtggttgtactagtttacattcccaccagctgtgtagaagtgttcccttttcactgcatccgtgccaacatctactatttttttcttatggccattcttgcaggagtaaggtagtattgcattgtggtttttatttgcatttccctgatcattagtgatgagcattttttcataagtttctggacatttgtatatcttcctttgagaattgtctattcatgtcctcagcccagttttttacgggatttttttttcttgctgatttgtttgagtttattgtagatgctggatattagtcctttgtcagatgcagagattatgaagattttctcccactctgtgggttgtctgtttactttgctggggtgtttccttgatgtggtactcttccccttttcctatggatgtggcttcctgagaactgagctgtcgctattgctatctctcttttgggtctagccacccagcaagtaggcttgctggtactgagggttttctgcacagagtcctgtgatgtgaaccatttatgggtctctcagccgtggatgccagcacagtatttggggtgtctctcgggtcctgcaggagcaatctacttccttcagagggtctgtgggtcctctcaggtttcctgatttattcctgcagtcagtaattctggagctaaaattcgtgatgtgagtctccacatgctgctctgttcatctgagtcagagctgcaatctagtctttcctcctgtctgccatgatagaatcaaaagatcaaactatcctctaattcaacactaattttggactcagtggaggactcctataatcccattttcctatccgttattttgattctagttctttattccaaagacattacagttgtttccccacattgaaaggtaaaacatggaatgttagaataaagatagactttggaattataagaaaataaggttcaattttgcctttgattcttaccagagatgtaatattggttaatttaccaattcttgttcagtaaaatttttctctcatcattattgctatcatttagtgaggaaaaaatacacggtaggtcttttctagaaaattataaacatctcaattaattttcataacaccactatgaggcagatattgtcatctgtatattttatctaaggaaactgagtctcaggaaactatataattcttttattttcatgcagtaaatgccagagtcaatattcaaactcagccttctatattcctttctgtcaatatcagattcctcttatcttggaagcatgttgtgagaatttagtaagataatctagtatattttcaggcatttagcaaatacctgcaaatattggtatcctgtttaaccttcttcattctacttctagtcatttgctaatttctgctttttatgtctcttttagcattgttttctcttatatttctcattgttttccttattctggatattgctttttccttgaattattttttgtggccctacttcctagctttccctcattttccctctactaagttatcctccatattctaatatatagctctggccatatgactacttccaaatcctccttctcttaaggcttttcagaaacctagactaactccccattacttacaaagaaggttttaatgtcttagcatcacttttagagccctcccaaaagtgaccatgcacgactgttccaagcttagttatattcataagagcaaactaactactctcactctccttgagcaaagagtagaggtgtatgcatatgtctgagtgtgcttctctaatatttctcacactattattttcatctgatgtgtcttccctttcactccccagtcctgatgttgcctgccatttctacccataagttttaaaaaaccagttgaaaactagttatttcatgaagcctctcctgttcttagccataatctttcttctaacttccattcatagaactttgaaattctattatattacttacaatgtttttcttatactaaaattggttatgtctacatattcctctagtgttaagtttatctcccttgaagatagacatcatgtcttgttcatctttttaatttttttgcaggactatgaacaataccatacatctagcataatcttaataaatggaatttaagtaaatggatgctcaaagaagagacattctggaaaagggaaaagagcaaaagctttggaaatagtcagaaatggtttcaataatacatctgccaggtgccctggctcttgactataatcctagcactttggaaggctgaggtgggcagattgcttgaacccaggagtttgagaccaggctgggcaacatggcaaaacgctgtctctacaaaaaaatacaaaaattatctgagtatggtggcacacgcatgtagtccagctacttgagagactgaggtgggaggatcacctgagcctgggcaggtcaaggctgcagtgagccgtgatcataccactgtactccagcctgggcaatggagtgagaccttgtctctcattctctctctctctctctctctctttctctttctctctcaataataataatatatctgccacttaacagcttagttaggcctttgcttttatatctgtaaatggggacagtagtgtctatctcagatgataagtggtaagattgaggtcgtatatacaacagcatataaaagtagtgaacactatagcatgtgatgtatggtaggccctgttctaagcactttgcctgttgattcatttaatccttgttatagccttatgaagtaaatactattataagcttatctttagaatgaacaaactgaggttgagagatattaagtatcttgcccaaagtaactgctgtagtttgagtgtgtcccttccaaaattcaggtgttgtaactgtgatagtgttaagcagttgggcctttataagatgattaggccaagaaagctggtttccttgttaatgggattatgcccttttctaaaaagtcttcctgcaaaattcagccagcttgctgttctgctttctgccatcggaggacacagcaaaaaggccctcagcagaccaaatgccagcaccttgatcttggatttcccagcctttagaattgtgacaaatatatttctgttattcataaattacacactgtcacatattttggtgtaggagcacaaaatggactgatagtaagtgaaagaactaagatttgaattcaagaagtcaggctatagaaagcatgtgtttcagcattccatcttggtagtctactttccttctttataagttaagaatagtttttatctaaaaataaattgaaaggggctcatttatcaagtgcttgtaatgaatgtcagtgacccaggtagaatatggtctctgcccctaacaaggtctcagaatcatgggggaagtgggcaggtaaacagtgtgacaaatcctgtggcagcagtatgcacaacgtgctatgagaaaacaaacatatctcctagtcagcaaggtttttcttttcagggtgtttttacttttatagaagactttcttctctctgtttctgaggccacaaaaatgaagtgacttagagcagtcttcacatgaggtttaggactccaggtgctaaatagtctacgatttccaaagcttcatatttttatccttgtctgtgttatttagctcttcgactttttcaaatcagatgggctacttaatgaattgtcatctgtagatcaaatgaaactggaggggagacagttttgatatttttctattcaggctccagtaaggaaagtgctgtatatctgaaacaagatagtgggtgaacacatctggctttttgagcttgtgttataaatagaatatcaaacgagttaagagaaatagccatgtagctatgaggctctgtgcaacaggatttaatgtcaaaaatggttcatattatgattatttttttcaccactctatcctcatcaagtgtctgaaagataccaggaagcaaatacacagaaataggtatatatttcaatagtaattatccaggctaattaaaagtaaaatcttgtatatagaaagagaatattatctggcaaccagccaaccacagagtaccagttttgtcagcgtagctcattttctttcagaatgtgatatgtctagaaataaaccttgaagaaaaatgtgagatggggaagagaatgaagaaaaaaggtcttgtttagtataggaacctgtccatctcttgatgcttgccatatgtgctttgtttttatatcaccagtttgcatatttatcatggtttctacatattgatttgcagttttcacactcagcctcttacatttctctcagtatataggtagacaccctgtcacagtgaggggagttctacttgctgtttaatgggtttctcatagtcagtgatagattgagcatttgtgatattccaggagtagaggtctcaacaagtcagaattactccaaaagctaccccaggaggagtggaaaccctttacaagagtgtaatatctctatttaagtatgtcttcttgccaggagtggtgtctcacatccataattcaagcactttgagaggcagaggcaggaagatcacttgagaccaagaattcaagaccagcctgggtaacatagaaagacttcatcttaacaaaaaataaaaaattagtcaggcatgtggtgtacacctgtagtcgtagatactagggaggctgaggtgggaggatcacttgaggccaggagtttgaggctgtggtgacctatgattgcaccactgcactttagcctgcgtgacagagcaaggctctgtctcaaaaaaaagaaaagtgtatcttctttatatttaagacatcagaaaaataccacatcaaaaaaaatcatgtgctttacgatttttgctcctcattttcctaaatccaagttgaagtgtgaggtatgacttgatgaggtaagacacattgagcgtcgtgtggttcaatagagcagtggtgtctacgctaagatgaatatcagaattacgttaggtgcttctgaaaaaaaatactagggcctcaccccaaatatattaattctgttggtcatgggtacaatatacagtttgaaagctcttctagtgattttaatgatcaagcacatttaaaaccattgcagttatgagcttagtatctttaaagtgtcacacgattctactatgcagctaggaatgagagcttctgttttaggagttggaaagttaaatgtagggataaagtgtggtataacatgagtattggactaaactaaatagaggtatctaaagaccagagagagaaggtagtagatttggagtcagcaatgtataaagctccttcctctttaaatctctaaggctttaagtagcattaagatcaataatcctacaaaacatttcatttatcactgatgtccatcaagctatatatctatatcggcatggtcgtcagagatggggaatatgccagacattttggagatgaaagagaatgcaaagggatttccatatttgtccaaaaccagggagggtggaggtgttgggggataatggatgaaactcacttttactgagtagctgctatgttccaagtattttgctacttaataagtgctactgatgaaaatcatagtagtaactaacacttttatggtgcttatgtgccagacactgttcttaagtactttatctgtactaattgaatacttacaaaaactttacaaagtagaaaccattacatttccctatttaaagatgaagcaactgaagcacaaataggtatgtaacttgctctaacatcacagagctagatggtagcagagtttagattcaagtaatggcagaccagatcctgattctctgcttttaaccactttcaataagtggacttagttgatgagtctagaattcgtgtataggtggataaaagaaagattgaaccgctttctgaggaatacacagaattctggctgatgggagggctggacactgatggtgatcacatgactcattagtgtgcctctgaactaagctcttttcttaaaacaaaccgtagacataggcaaagaaagcagtcattatggatagattgtaagagcattatttaattgtgaggccattctcttaaatttatcagtgacatgatttattttcctatatccttcattcttagcacacacacaaatctcctttctagacatttgactcttgtttagtttaatttttcctttccatgtgctatttttctacctatcacctcaggcacaaatacaaaaggtcaaaccaaaaaataaacaccctgtgtgatatccagtaaagtcaaaacaatgtaacagaagatatccatctttattcttttatggcacataatacattcattttcactatctccaatttggtcatctatctatgtcattgtgggcttgctgtaatcatcaaagagtaagaggtagacatgttttacatgcatcagctggctagataccctatatcttttatggtatgaacacacaagtaagaaattcaagccaacaaacaaaaatcctgccatcttcatcagcaactaaccaatgtgcacacttgggtggagatcccacctttcacctatgacctgggaatttttagatggctccagtttcttttagtcacccttatcctgatttcctgttttcttccgaatttttaaaatctctcctgtgtacctcatttcctaacctttcgttttatgtgcattgaacctattcttgcattttccccaaagcaatattagcaaaggtatttctgtacctcatgattttaccgagggcttaggagcatcagaagtaggttatgttgcctcctagtactgcaaatggacaatgtttacattttagatgtccctgtttttaaagcccctaggcgtgaccgctaaggtatttcacaataaccatcttttactcagggtcttcatcctcctgctttcttgacaggcagcttctcttcttcttacggtgtgtcacagctacccaaattctcatttttcctgtcattttttcatgtcttatttgtgagttcttggaaaagtaggctgtggggatttgccacatgacaacctttccttcatctgcaaagaggtggacttgaagtactatcagtactcttagaacagagatctcatggcctggactattccatttccaaaagatcttgtacataagttccaacagatgagaaaatgataacatgaggtgtcctggaaaatgttcacatcttcctctaggatatgggaaatatgcaggcttgctattttgaattatttcttttagagaatagaggaggcaagtctctcagtggcccacatgagaaataagaagttataattggaagttactctgcacaattatcctggttataaaagaaagtactgagtcacctccctactggggaaggttatgtttgcggagttttgactataaagtaacctccctttgcctagtcaactcaatccagagggcaagggtcttcgctgttctgagttttgtaagcaaaaaaagaaatcttaccagcagattgctgggacagctttacaggtaatatctgattattctttaatccagaatctacaaggaacttaaacaaattcacaagaaagaaaacaaccccatcaaaaagtgggtgaaggatatgaacagacacttctcagaagaagacatttatgcggtcaacaaacatatgaaaaaaagctcatccatggtcattacagaaatgcaaatgaaaaccacaatgagatatcatctcatgccaatcagaatggcaatcattaaaaagtcaggaaacaacagatgctggaaaggatgtggagaaataggaacgcttttacactgttggtagaagtgtaaattagttcaaccattatggaagacagtgtggtgattcctcaaggatctagaatcagaaataccatttgacccagcaatcccattactgggtatacactcaaaggattataaatcattctaccataaagacacatgcacacgtatgtttattgcagcactattcacaatagcaaagacttggaaccaacccaaatgcccatcaatgatagactggataaagaaaatgtggcacatatacacaatgggatactatgcagccataaaaaaggatgagttcatatcctttgcagggacgtggatgaagctggaaatcatcattctcagcaaactaacacgggaacagaaaaccaaacactgcatgttctcactcgtaagtgggagttgaacaatgagaacacatggacacagggagggcaacatcacacaccagggcctgttgggagctgaggagctaggggagggatagcattaggagaaatacctaatgtggatgacaagttgatgggtgcagcaaaccaccacggcacgtgtatacctatgtaacaaacctgcatgttctgcacatgtatctcagagcttaaagtataataataattttttaaaaaagaaacgagactgttgaaaaacctttctgactggtatctatgtgttggagttgtaaatcttttactcaatgcctcaagaaaagaatcaactaattatctatggctttggcaagaaatcttcgctgatatttgtctaaagctttctaaaacttgccccaagccccaaagtccaagtccaactttcatttgcaaagtaattcagagctcccttatttcttccttacttcccagtcctttctctgtgctattcttttcacttcataatcattcatcaagaggtttagtgaaacaaaaaacacctctcaccatttgattcattctatgtctactttctataatataaataactattttacccctccatgttacagagtcatgatgcactgcactgcacctttacatttgaaattgcagtctccctcctgagcctactttttgttacattcgttataacatatcttccttttcctcctcattattcttttggtagccatttttttaaagcactttcctaccctatttaaatattttcatctgaaagatcagaagtcttcagagtattttgagacgcattggctgaacctattcccccacttccccacctcccaaaaaatgtgagtagagacaatgtagcttgaacatttatttgggcttccaaaattgaattgaggaaaacacccaaggtgcctgctgcctgctcaatttcttgaccaacctacactattttgtgaaatacactaaatgaattgatttcataccaccgttgggaaagaataaacaatgatagggtttaaataatgaaacattaatatggaaaaaattattgaggtgtatgaagcttatcgctttgaaaaatattttaatcatagtagacaaaaacatgctcttgatataaccactcttgtgaacatttctcttagaatttggttaaaaagaaatattccttcagatgaaaggaggggcttccctgttttctttattttaccattaaaatgacaaatgggatgttatgaagcatctgatatcactttttatcatgtttgatgtcctaacaattattgttcgtttatagttatcagaatcataactgcaatacatttttgtgtaaactgccttgatgattacacacagtactggctaaagagacttaatcaaaattacccaacatccggctgaactgttgactttggcctggtaaatttttttttttttttttttttttgccatttagggttaaacatttcttttttgacttacttttcggtgaccagatagttaattctaagtgaaacagacaaataaagcagaagtgtgttaggtagaaaattgtgaaattttcataagaaaatttgtgaattccataagagcaatacaccagtcttaatattaaatccaatctgtcctaaggaaatgccagatatgtttttgaatcaccaaaatgaaataatgatagttaaaaaggtaagttgaaaataaagaatttttaagagaccccaaaacccgaaggaaggaaagcaactgtggttaggagaaataatagctctacctattaattagggataaataacttcagcaagtactcctttaaagttttttctgtaaagtaggggactagagcatgcaactattctaaagtatctttcagtgaattagtttccatctttaagtagttatataatagtataaataaaataatgaatacagtattaatattaatgatgagaattaatagtggaactcatttggtaaatctattctaattgataccagtacaaggctcagacttaacagaaataaatgattaaagggttaacaaaaatctcttcaaaggaatctcttttttgttgcaaataaaagcaggtttaaaattctctctgtgttcaaaagtcaattattgccaattttacaggctcctcaaacatgagattttcatttagcagagccaactttactctgtctgccaaaagcccataaaatggcccttttccatctggtaaatgttccacaatgaaattagaactgttggaaaataatggaaatctatggacatgtgtatactgttactgagacgtgaaaatttgttagtgatatctgatataaattacttatttaagtgccattgttaactcttgtaggtcagtaaagcctgagttctatattagagttcatgcaatttcctaacttcaggtagaagttattcaaaccattccagaaaataggatgccccatgtaatcaaatagtgattcttaaatatgtgtgatgagtgtcattaatcccttggaagaacaaatgagaagtattgattttcaacccagaaaaaaagatgctatataaaaaaatagaagcaacttcagcagttagatttaaaaaaacactattccaaaaaggtttttgaaagagggattttatagagtcccttaaaaatatatttaacatttctcaaaaggaaactcttttttaagctcaacatgtaaatttaaataatttcccatagattcatttactcaactctatattactggcatttccccctttgaagatataaacaaatttctcatataattttttactacctggtgaatgggccacaaaggagatagctcaactagtaaaaatggtttgccttttcccatgtaccgagaaaaaaaaatcaaaattatatatatatatattatatgtgtatatatgtgtgtctgtgtgtgtgtgtgtgtgtgtatatatatataatttgtatgcgcccataattcagggaaatgagttggcatgtgcataatgtagatatgattataagcttgagagaagaaaagatagttttaatatatgaattttaaatttataaaatgtaaatatgtatgtgtatgttagctcttgcctcctagctccttgtcaggaagagaaaaccccaaaactcttatcctctgaatcataaaaaaaaacttattttatcagatgttcttaattgaagtaaaatgatccccaagggtagaaagaactcatgaaagttcacagaggaggaaaaattctgagctagataagaaaaggacaaggagctggccactgataaaattaaaatgtatggaaacaattagttactattccctaaaacagcaaattggctttctgaagatgctttggggaatttcaatttgtttgaacctgtaaatgctcaatttgatcgtaagctcagtgaatatttcctaaaagtttctgtagtgccttgttttctaactgtattgaagaaactatcaatctgaaggttttctctcctctttgagggactggtttcacatgatgatgacaagaagtcttttcaaactttatgctcagagaaaccacaagatgggctgtactggcagctgctctggagagcagactttgcagtagactgtgaacatcatttctcctctttcacagcatggggaattccagctctttctgaaatctgttcaaaatattcctgtctttctattttacctccaaaccgactcattttcagacctgcccttggttacctttgattgacagatataggctttggaaaccattgaaatcttatttagaaaggactgaaatcttatctcaatgaattctttagtccctgtttggagaccaaaggctctatgtcaaaaggattatagatacctgtacttgcaactggggtttctacggcagatttataactattgggttatttcagggtttccaagttaagatctgatggagagaggaacatagagaggcagctctaagatggacaatgcacccataaatttttttctgaaaataagaatctcttttagatatgtcatagttaataaaaaaatagagtaatacaaatgaagacttaaattgatgaggcacatgtgtaaattgataaaggaagtttgatgcatcataacattgaaatttatctaaattcaatattgttaaacattcttaaagatcagatgaattatacatgaagtatatggattatttgtccctggcaaacaatggtgacatttctgtctgtcacttagcatgacaaggttagcatgttttattcaaaacttttaaacagtaaaatgatttgtatgcattactcttgctttggactgtcagggaaagcagaaagcaacacagttattctatgacattgagtcagtatgtgcataaaaaaatgacagaacaggattgcctcagacatctataaagctcatactttggttttctaatcatcttgtagaaaaacaacaaaaccataaaggcagaagcatttcctcacattcaaaaaaataccattgcatacaggaatataaatatgatatttgtaatataatgaatgtgggatatttacgagtcggaatggatccctggaaatagcatgctttgggttttaagaaaatttaatgacagaatatttttttttttcagtaaataggataagagtcaggctatgttgtctctttcacagttaaaatattctgcagtaaggaaataggatgataatttgtgagacctttgaattttttgctctctgtgtgcgtaggatgggcacatagaaagagataaataacagagtagagggcattgttcagctcttaggtagagacaggggacagaggactttagtaatatgtttactatttctgttacagttgtctatcattggagggtgtcaatgttaaggcctgatagtgtggttgagtggcaatccctgaagcagccctcagcttgctccttctcttttccctgacttttctgtgtcaagtaagttagacaccaaaggaaccctacacttcactgtttctgggctcttcttcctccttcatgaggttctagagcagaaatgagctttgaggggattatgctgggataaaatagaacctaggggtcttggtacgatattaatatctaatatccagagactaaaagtcttttttattgtcttttcattcacaagtgacttagggatgctttttgagaatatattatgaaccagtgactctgccaggaataaaatgatgtctaagacaagcttttgactttgcaatgcttacaacagaggaagaaagctctataagcaagcaagcacaatgctgtgttacaggtgttattgtggctaattgtgcagggtgagtggagaagaagtgggttacaaacagagagagggggccagaatattataccttactgtgtcctgttcttcccctccatatcttgggaaggtaaccacagagaatagtattttcttatttcattgcattcaatgatatgtttactacagcttcaaacacattaaaaccccaccatgtggtcacaaaatggcatgcattttgtgtttcctccatatctgaccatgacttggagaaaagtaagctctttagaggatgtattaatagttcatgattattattacaactgctagatataattgatcattatatatatcaacacctaattgatataattagacaactggtctaaagaaaaggttgagctatgcatatttttcctggaattatttaatagagaatgcttaacaaaagaaagaagaaattttactgtatactccctgtgctgtgatatgcattatgtaccttgagcctggaaatcatgaatattaacatttaccataccagctacatgattagtaattacccttccatggtggccctgacaatttattattatataaattttgttatgcacaatatctatttaacctgttcttaaccctttatctcaacctctacctgactactgccttccccagaatctctggcatgaattgcaatggttagagagagtgtaagaactaagtagttttcaaggagatttatcctgactcagtaagcaaatttatagatagtttagaagcaaattttaatgatgtattgcccaacagggacttacaggtgccaccaaacttttgggatgctatgtagttttgctgggctgtcattttaaaaaatgttgcatccctagtggaaaatatttctagaaatactatgacctttccattttttaccatgaaagtgaggtgatctaagagtagccatcttccaagtaaatgtggtgaaactttagtttgaaatattcatcatgcttctgttttgaacagccaaaactctactaaaattcagtttgctggtttattcagcttattcattttatgcaaatctcaatgtgcatgaaatgaacaaaagacttcatttctattcatatgcattgttagttttctattccatttttattcccaaacttgtttttctctttttcagtattagcactttattcattctttcaacaaatatttgtggcatccctagcatgatgaggcaccaaaaagaatgataccatccccgcatggtaatcggcatggcccacaggtttcatcttgaatgcctttttgagtgcactattagaggatgtttggagatttctttaggaaacatctatgatgaaaagaaagaatgatctcaattatgtgtgtccgctatgagcagggtttcaaggccgattgccgtgccaactcagggagtgggaagattgtccaccagggggtcaggcagatgtggattctgattttgactctgctccttgaaagttctaactggggcaagctacctctgattctgagagagattcctcatatgtaaaaggagaatacctgcctcacagtgtggttaaatgagtttccagagagtggcaacaccttataggactccctcaataaatgattgttcttagcacctcttctaggatcctacaatctaatgcatttgtaaatgagcaaaaactttagtaatactgaaacgttggctaaaataagtcccattaatgcagggacaaacaaaatgttttgatttcttggaaggtttgatgaattgtggattgcctgattccttttctctttccaggttttgtcttagatgtaacaagttcctatcatgggagtctgtaccatacaaccacaaatacacaatggtatggagaaagggagagagagaacaaatgagttgtaagaatttaattggcaaaactgattatccatgctgagtttgctcctattgtttttaaagacacatgttttttatactacatggccccaaactcaaaatcactcaaataaacactgatctgttccagcactggaggaaaaactggctttgttagacttaccgagagatggtgtgtttctctccaatatggcacctttctaagggattctcaagggtagttttgataatacatgattattgacttatttgcagtataacacttaccttgactgcacttttttgcttttacacattgtaattcatttcatcttttacttatcttgaatatcaagatttactttctctatctttttttttttcacataagctctgtatgtgactctacctgtttcttggaacaggtagttccaaggtttctttggttacttaatgactattttgttattttatttttccaaaacatgtcatagggttgtgtctagaactcaggtcattctgtataatgtttccagtaggttttggaggttaagatattgtttccttagaaatacctgatcaagatttcatgtccttacagttgcacatataagttttgtagctggagtaagctcagcagtgtttttaatgtcacaatagtaatgtgctccttgcctgttgtattagtccattttcatgctgctgataaagccatacctgagactagccaatttacaagagaaagaggttaattgaaattgcagttccacatggctggggaggcgtctcaatcagggtggatgatgaaagtcatgtctcacatggtggcagcaaaagagagaacgagagccaagtgaaatgggtttccccttatcaaaccatcagatcttgtgaggcttattccctaccatgagaacagtatgggggaaaccactcccatgattcaattatctcccaccgggtccctcccataatgcatgggaattaggagagtacaattcgagatgagatttgggtggggacacagagccaaaccatatcattccacccatgacccctcccaaatctcatgtcctcacatttcaaaaccactcatgccttcccaacagtctcctaaagtcttaactcatttcagcattaactcaaaagtccagtccaaagtctcatctgagacaaggcaatttccttccactcatgagcctgtaaaatttaaagcaagttagttgcttcctagctacaatgggggtataggcattgggtaaatacagccattccaaatgggaggaattggccaaaacaaaggggctacaggccccatgcaagtctgaaaaccagcagggcagtctaatctttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcgccgttttagccgggatggtctcgatctcctgacctcgtgatccgcccgcctcggcctcccaaagtgctgggattacaggcgtgagccaccgcgcccggccagggcagtctaatcttaaagctctaaaattatctatttttgactccatgtctcacatccaggtcgcgctgatgcaagaggtgggttgtcatggtcttgggaagctccacccctgtggctttgcaaagtatggcccccctcctggctgcttttgcaaactggcgttgagagtctatggcttttccaggtacacagtgcaagctgttggtggatctaccattctggagtttagaggatggatccctcttctcacagctccagtagctggtgccccagtagggactctgtgtaggggctctgaccccacaattcccttctctactacactagcagaggttctccatgagggccacacacctacaagaaacttctgcctggatatccaggagtttccatacatcctctgaaatctaggtgtaagttcccaaacctcaattcttgacttctgtgcactctcagactcaacaccacatggaagctcccaaggcttggggcctgcatcctctgaaacaacagcctgagctgtaccttggcccctgaagccactgaaacacagggtaccaagtccctaggctgcacagagcagggggaccctgaacccgggccatgaaaccatcttttcctcctagtctaccgggcctaggatgggaggggctgttatggagacctcagatatgccctggagacattttacacattgtctttgttattaacattcagctccttaatacttaggcaaatttctgcagaaggcttgaatttctcctcagaaaattgaattttcttttctattgcattatcaggctgtgcattttacaaacttttatcctctgtttcccttttaaaattgaatgcctttaacagcacccaagtcacctcttgaatgctttgctgcttaggaatttcttcttccagataccctaaatcatctctctcaagttcaaagttccacaaatctctagggcaagggcaaaatggcgtcagtctctgctaaaacataacaaaggtcacctttgctccagttcccaaaaagttcctcatctccatcggagaccacctcagcctggatttcagtgtccatatcattatcagcattttggtcaaagccattcaacaagtctctaaagagtgccaaactttccatattttcctatcttcttctgagccctccaaactgtttcaaaccctgcctgttacccagttccaaagtcacttccacatttttaggtatcttctcagcagtgccctactctcctggtaccaatttactgtattagtctatttttatgctgctgataaagacataaccgagaatgagtaatttacgaaaggaagaggtttattggacttacagttccacatggatggggaagcctcacaatcatggcagaaggtgaaaggcacatatcccatgtcggtggcaagagagaatgaaagccaaatgaaagaagtttcctcatttcaaaccataaaatctcgtgagatttattcactgccacaagaacagtatggggggaactgcccccatgatgcagtgattcagttatctcccaccgggtccctcccacaacacatgggaattatgggagtacaattcaagatgagattttggtggggacacagaatgaaccatattacctgttttttttgctgccaactcaaaggatcttttgtctggtagctcaaggctccaaggctctaatgcacaataaaatgtgaagaccaaagagcaaacaagttctctttatcagttatttacatctctgtgtgcatgaagtgtgctaaataaaggatattggaaagtaggagaaagctgtcctccctgaaaatgcctgggttggggtataagcccagctttcctactttacccctttgccaaggggcctaaaaccatcaaacattctcactctacctctgccctcatttttctggctgtccttctttctttcttttattctctgtcctatggagtattctttctaatattgatttttaattttttaaatcgagatagggccttgctttgtcacctaggctgaagtgcagtggcacagtcatgactcactacatcctcaatcttctaggctcaaacaatcctcctacctcagcatattgagtagctgggaccacaggtgcacatcccacatccagctaatttgtattcttttgtagagatggagttttgtcatattgctccagctggtcttgaactcctaagctcaagagatctgcctacctcagccttccaaagtgctggttacaggtgtgagccaccatacccagcctaatattctttattaataatgacacactgatgattgaagtgtaagatgcaagtaagaggtaaacattttaaaaacatctctaattctcacaataattctgtagggaaaatttttttcatgttaaaagtgaaaaaatctgaaacagaaggagaaaataacttaccatgtaatttagcaaatggtagaaacagatgagaatccatatgtccttttccaccatcatatgctgcctttatttgtacactatacgtgtttgtaaatgtgtgcgtatgagagagaaagtgcatgcgtgcaagcttatcaatctttctatgtatatatacattttttttaaccaagtctgaatgcatagtttttgctgcagtgcccgaaaaccagtgttgccaggttgttcactccgcatgtggcctccctagaatgacttgaaattttataagttgcaatttacacaattgatgcattcttctcttgtatcatttttacagacataacagaatttataccattttatttttcaaataaatgatttccaggggtgacagttgctttaattcttactggctggtctttgaaggcataacattattttctttaacattatttgttccttcctataaggcgcaacactatgctcatgttgtgtccattgaagcagtttctcatttttgaaattttaatgccttatgggatgaaaaaaaagaggagaggaaagacccagtagtgatttaagactatgattccgaattgaagcatcttgctacttagaggaacaccatatttcatagtgtatttgcagaaatgcttcatggcacaaactcctatttcatgtccttgaaggccaatggcgtaacagaatttctgtttcagtgcctatctgatcaataatctccatgacatttcctagttgccatccatcttgtggtacacttttactgtgttgatgtatagtgactaatatctacatgtatatattttttgtctcctgcaactgtaaattatttaaaaaatatttctacaggtgcttacatctatttatataaaacatattttccttgatttcattggatatatatatatatatatatatatataaatttcactggaaaaaatatttggaatttagtgtaattccctttgggcatggcctttgagtaaacatatgtcaatagagcactgtctatgtggcagacaatattctaggcactggtttcaaaaatgagtaggacatggaccctacctttccagagctcacagtcttcataaatctgtggaaacaacatgaaatactgcatagattttgttacctttaggcctcagtttgaattttctttttaccacttgttaggtgctggacattcaatttctcaatgatatcatctgtaaaattgaggtaataataaatatcatcttaaggcttatgcgaggattaaatgagttaataaatatatgcatttacaatgacaccaggcacatacatcccaacaaatcctggatattataattattattgacattagtactattgttgtgatgtaagaaacaagcagctaaagattataatactatataatgaatgagtgtaagatagaaattttttcaagaggataaaatacaaaactcctttgtaagctgtcctaggagacatgaaacaaatgagttgaagaagaccgtattttcactagtcatatgagaaaagttataacactctaggcagcagaaatagcatttgaagagtcaggaaggctgagaaagcatgtcccactaagtaaaatattactgagctcatgtgtataattggggagtagagtatagggcaaagggtaaggtcacaaaaaggtctgggtgatatactaagaatttaggacttcatcatgttgacattggaagccacgaaaggatttttttaaaaatggaactaatataatcagatttacattatagacagatgatcctatctccattacagaggatggatcagaaagaacactagctggaggaaggtaagacttgaggatagaaggctgttatgattggtcatgtgagagctgatcaggttgtcaaataagactctgtcaacggaaatggaaaagttgggatgcatttaagacacatttgagaagctgaatggacagtactggaggatcatttggatgaaaagggaacatagaagaagaggggcatctaaaatgatactcaagttgatgttttgaacaattgggtggatgacagtacttttgacaggaataaagcacagatttgaaaggcagaccagagacacaagggaggttggctggggatgaaattctggacaatcatcaattcaggggctggtggagaaagaaggaacagagaagaagacatgtaataaatgtacaagtaagagaagaaccaagtgttacagaatctaagggagaaataaatgttaaaaaatgtttgttacaaagatggagcaaggtggctaagtagaagcctacagcaattatcccccgcaacaggaacaccaaattgaacaactatccacacacaaaaaagcacattcaaaacaaccaaaaatcaggtgagtgatcatagtacccgaatttaacatcacattaaagaaagaagcaatgaggagggtaggagaaacagtcttgaatcacctacaacacccctcccccattctccagcagtggccatgtagtacagagagagaatttgtgctcttgggagagggagagcacagtgattgtggggctttgtattggaaattagtgctgttctatcacagagaaagcaacatgggggcagaactcaactgttacccatgaagggaccacttagaacaactctagccagagatgagttccaacaagccttgccactgtgggctacagtgctctagggttgtaaataaacttgaaaggcagtctaggccacaagaactggaactcctaggcaagtcctggtgctgtgctggcctcagaactggtggacttggagtgcatgcaacccagtgaggcaccagctgggatggccaaatgagtgcttacatcatcatcaccccctcccccaaacccaggcagtgatgcataggccctagcccctagacaacatctctagacacgcactgggccagaaaggaacccattgcctggaagagagggatctaggaatctagtcctggcaacattcatcacctgctgactagcgaaccctcagataccgaataatcagcagtgatagccaggcggtacttgctgtaggccttaagcaacattcagagccatgctggattcaggtgtgacccagcacatttccaactatgatagctaaagggagagactccttctgcttgaggaaagaagagggaagagaaaaaaggagtttgtcttgcagctttggtactagcttagccacagtggggtagaacacaaaatgagttcctgcagtccctgattccaggacttggctcctagacggcatttctggacctgccctgggttagatgggagcccatttcattgaaggaggagaccaaggcctggcagcattcaccacaagatgacagaagagccctgggatctgggtgaactttggtagtagccaggcagtacttgttatgaacctggggtgatggtgggtatgaggagagactcctctgcttgaggaaagagaaaggaagagtgggaaggactttgtgttgctgcttgagtatcaactgagttgcagtagaataaagcaccaaatggattcctaatgtttccaactccaggccctgcctcctggatggcatctctggatctgcacgggacagggggaactcaccaccctgaaaggaaagaaacaagcctgtctagatttgttacctgctcaacgtagagcccttgggccttgagtgaacataagcagtaaccatgcaagggtcactgtgagccttaggagacacccagtgctgctctggcttcaggtctgatccagtgtggtctgagtggcgggggccacagggatgcttgtgtcaccagtatcccaactccaggcggcccagcaaagggactttgtttagggaaagtaaaaaggagaaaaacaatatctgcctggtaatctagaaaattctcttagatcttacccaagaccaccaaggcagtacctcttcgagtctgtaacagccaaaatattactggaattggggtgtgccctaatgcagatatagctgtattgacaaaagatgtagattataacacccaagtccctttgaatgcctggaaagccttcccaaaaagagtgggtgcaaacaaacccagactgcaatgactacaataaatacctgactcttcaatgaccagacactgacaaacatctggaagcataaagacaatccaggaaaacatggcctcaccaaaataactaaataatataccagtaaccaatcctgaagagatagagatatgcgacctttcagataattcgaaataactattttgaggaagcccaatgaaatacaagattacacagagaaggaagttaggattctatcagataaactcaaccaagagattgaaataattgaaaagaatcaggcagaaaatttggagctgaaaaatgcaattgacatactgaagaatacatcagagttttgtgacagcagaagtgatcagacagaaggaagaactattgaacttgaagacaggctattagaaaatacagtcagaggagacaaaagacaaaaataataaagaatgaagcatacatatgagatctaagaaatagcctcaaaagagcaaatctaggagttatttggccttgaataggtagagaaagcaatatggctagaaagtctatttaaagggatcataacggaaaacttcccaactccagagacagatagcaatatttaagtaaagaaggttatagaagaccaagcagagttaacccaaagtacattatgtcaagacatttaataatcaaaccccaaagatcaaggacaaagaaaagatcataaaagcagcaagagaaaataaataaataacatacaatggagatccaatacttctggcagtacccttctcagtggataccttacaggccaggagagagtggcatgacatagttaaggtgctgaaggaaaaaacaaacaaaaacttttatccttggagtagtatattcagcaaaaatatacttcaaacatgaatgagaaataaagactatcccagacaaacagaatagccattctgaatacacaatgaaaacagaatagctattctgactggtgtgagatggtatctcattgtggttttgatttgtaattctctagtaatcagtgatattgagctttttgaaatataattgttggccacatgtacgtcttctttaaaaagtgtctgttcatgtccttttttcccttttataatgtgattgtttttctgttacaaatttgtttgagttccttatagatgctggatattagaactttgtcagatacatagtttgcaaatattttctcccattctgcgggttgtctgtttactctgttggtagttgcctttgctgtgcagaggttcttaattttagttaaaccacatttgtcaaattttacttttgttgctatcacttttggcatctttttcatgaaatctttgcctatttctatgttcatgatggtattgcctaggttgtcttccagggtttttatagttttggattttatgtttaagtctttaattcaattaaggttgatgtttgtaaatatatggtgtaagaaaggggtccagcttcaatcttctgcatgtgactagccagttatcccagcacaatgtattgaatacagagctttcccccattgcttatttttgccagctttgtcacagatcagagagttgtaggtgcatggtctcatttctggactctattatgattatgtcccattaatctatgtgcctgttttgtactagtaccatggtgttttggttactgtagccctgaagtacagtttgaagtcagataacataatgccttcctcttcattccttttgcttaggattgccttggctatttggactcatttttttgttccatataaattttaagagtttttttctagttctgtgaataatgtcattggtagtttgatagaaatagcattgaatctgtagattactttgggcagtatggccattttagtaatactaattcttcctatccatgactgtgaagtgttttttcatttgtttgtgtcttttcttatttatatgagccgtgttttttaatcttattgtagagttcacctctctgatttcactgtatttctaggtatttattccttttggtggcaattgtgaatgggattgtcttcctgatttggctcttggcttggctgttgttggtgtataggaatagtagtaatttttgtacattgattttgtatcctgaaactttgctgaagttgtttgccagctgaaggagcttttccgccaagactatgggtttttcaagatctagaatcatgtcatctgcaagcaggaatactttgactttctctcttcctatttggatgcccttaatttttttttaatcttgcctgattgttctggctaagacttccaatactatgttgaataggaatggtgagagagggcatccttgtcttgtgccagttttcatggggaatgcttctatcttttgcccattcagtatagttctggtgggtttgtcatgcatggctcctattattttgagatatatcccttcaatacctagtttatggagagtttcaaacatgaatggctgttgaattttgtcaagtcttttctgcatctattgagataatcatgtctcaatcatgtatttttgtctttagttctgtttatgttatgaatcacatttattgacttgcatatgtagaaccaaccttgcataccatggatgaagcatagttgattgtggtggattagctttttgatgtgctgctggatttgaattgtaagtatattgttgaggattttttcatcaacgttcatcagggttactggcctgaagtgtttttgttcttgtgtctctgccagattttggtatcaggatgatgctggccttgtagaacaagttggggaggaatgccttctccccagttttttgaaatagtttcagaaggcatggtaccagatcttctttgtacatatagtagaatttggctgtgactccctcaggtcttggctttgctttggttggtaggctatttattactgattcaatttcagaattcattatcggtctgtttaggaaattatgttcttcctagttcagtattgatagggtgtatgtgtccaggaatttgtccatctcttctgggttttttagtttgtgtgcctacaggtgttcatagcggtttctggtggctatttttatttctgtggggtcagtgataacatcccctttgtcatatctaattgtgttaatttggattttttctcttttcttcttttttaatctagcttgcagcccatctatcattaatttttttcaaaaaaccaaccacagtatttattgatctttataatcattggtgacttaatttcctttagttcagctctgactttggttatttcttgtcttctgctagctttggggttgatttgttcttgagtctttcattcttttagttgtgatgttaggttcttaatttgagatctttctaactttttgatgtggacgtttagtggtatgaattttcctcttaacactgccttatctgtttcccataggttctattatgttgtatcttcattttcattagtttcaaagagcttcctgatttctgccttcatttcattacttatccaaaagtcattccgaaacatgtttaattttcatgtaattgcatggttttgagtgatttttcttagtcttgacttctatttttatggtgctgtggtctaagagagcggttggtatgatttcatttcttttgcatttgctgaagattgttttttgtccaattatgtggctgattttagaatacgtgccatgtggcaatgagaagaatgtacattctgttgttttggggtggagcattctgtagaggtctattggattcatttggtcaaatgttaagttcaggtcttgaatatctttgtcaattttctgttacaatgatctgtctaatactgtcagcggaatgttgaagtctcctactgttgtgtgggagtctatgtctctttttaggtctctaagaacttgctttataaatctggatactcctgttttgggtgcatctatatttaggataattaggtgttcttgttgtgttgtaccctttaccattatgtaatgccatttgtcttttttgatcattgttggtttaaagtctgttttgtctgaaactgggattgcaaccctgctttttttctgttttccatctgcttggtatattttcctccattcctttattttgaacccatgagtgtcattacctgtgagatgcatctcctgaagacaacatattattaggtcttgcttttttatccagcttgccactctacacttttaagtggggcagttagcccatttacatttaaggttagtattgatatgtttggattggatcctgtcattgttttgttagttggttattatgttggcttgtttgtgtggttgctttatagtatcactggtttgtgtatttaattatgttttcgtatgagctggaagcagtctttcctttctatatttcatgctcctttcaagatctcttgtaaggcagatctggtggtaacaaactccctcaacatttgcttatctgaaaataatcttatttctccttctcttaggaagcttagtttggctggatataaaatttttgattgaagatttttttttcttaaggaatgttgaatataggcctccagtctcttttggcttgtggggtttcaactgagaagtctgctgttatcctgatagagatccttttgtaggtgacctgccctttttctctaactgtcattaacattctttcttatatttcaactttggaaaatctgacaattatatgcattggggaaaattttcttgtgtagattcttgcaggagttctctgtattttctgtattttactcttggcctctctagcaaggttggggaagttttgaggaataatatcctgctttctccccatccctttcagggatgccagtgatttgtggttttggcctctttacacaatgccacacttatcagaggttttgtttattcctttttattctttcttctttatttttgtgtgactgtcttatttcaaaaagctagtcttcaagttctgagattctttcctcagcttggtttattctacttttaatatttgtgattgcattgtgaaatttttgtgttgtgttattcaactccattagatccattaggttcttttttgtaccagctatttcatccttcagctattgtattattttcttgtggttcttagtttccttggaatgggtttgctgttctccagaatctcaatgatctttgttcctatgcatattctgaactctctctctgtcattccagccagctcagcctggttaaaaactcttgttggagaactggtgcagtatttggacgacagaaaacactctggccatttgagttactggagttcttgctttggttctttctcatctctgcatgtgcataatccgttaactgcaatgtagatttagtacagtcaacgacttcttttctggatgttttcacgggccaaggctttgtgtaggatctttatttgaagctgacttcttatctttggtttcagagtgggatatgttagtaggcatttttggtgttgaagctttggggtgtgatctagtagatggtacttaggtgtattggtcagttggttgactcttgcttggttgtgtggctcccctatgtttcctcacagttgaagccatgttccctctcagtgctctgaaagtgtgagtttctcttccccttgaatgctggctgcagattgcaacttggcactcctcagctgcccactgcagctctggggtgatctcactgtttatgttccttccccatcttggaggtagcagaggatgagatcttagtagtgtttgtagccaagggtctttgcttatcttctggggggatccaccccagagagatgcaggtcagcaattgcccagtgcaatcagaccaggatggaggttctgtgctatgggcccaagccaggggtttcctgtctggtgatgaacagttggtggggggctaggtgggactgatgggggatggactcctctcctctggttgactgtagcttggaggtatgaataaggcacttagggtctttgtttctttgttagtccaaaggtagcaaggagagttccactgctaaggtagtggcagagaagctttcatttgctctgggggttctttccagggggttgcagaactgttattgacttgatagctctggcagggggtggctagggccccaggcctagagaatctgcccagtgaggagatataggaatgggcacctacataacattctggccatttttccgtaagactgctgtcgtatgctgggggcccactccagttcctagtcattgcaaatatttcagtacctgaaggtattaagagtgaaagctgagaaacagcgaagatgttggcccacgaacatctctgggagctctgtcctagagagttacggacctgttgctggtccaaacactgtaggaggtggctggaaactccagctgggaggccctacctagtgatgaggaatgagatagggcacctttaaaaagcagtctggccacgtttttgtagagaagctgtgttgtatggaatactgcttccacccctggctggtttggactgttcaaagcccaaaggctggatgcctaagttgccagaacatcaaagatatcagcccatccctccctctgggagctctgatccatggaggtttcaaatctctgttggccagaaaacaccagggggaaggctagagaccccagctggaaggtcctgacaagtgaggaggaatggaattgggtacccatttaaaaaagcaatctggcagcattttcatagagcaactgtactctgctaggggaccgcttctgttcctggttggtttgtactctccatagcccaaagactggacagctaagttgctaaaacagcaaagacagtggcctgtccctccccttggaagctctgtctcccggaggtgcaatgctgctaccagtggctggccagaattccaagccattgagtcttatcttgtgaggtgccatgaaagtggggcctgcatactattactcttcagtctcctggattccacccctttcctaggagtatgtgtgggggtctaacatcccactttaccttagttgcagctactttttctggaaggcccagaaagcctggatatctaaggcccctgggtatccgcatgtgcatgagtggctgttctgctgagactctgcatagctatgtgtgtcagctatgtgaaagccctggtggagtgggttcacctggggatatcctgacccaacggttgcaaagatccatgggagaagcatgcactcctggggccacacatttactcaccacttccttgtgttgaggaggttctcctggcttcatgtcactccgtggtgggctgtcattctgccttgcttttctccattttctgtggttcaagttgttgccttgattagtcgcaacgtgtgtacctgcatgtttcattttaagatgtgtatttacttgtcccttctgttcctctccatgagagctatgcacactagcagcctctagtcagccatcttggcccaaggtttcaatgaagaaattgtgaataaaattgaaaaaattcttgaaagaaatgataatggaaacacaacataccaaaacctatgggatatagtgaaagcagtcctaaaaggaaagtttatagcaataagcccatatctcaaaagagtagaaaaacttcaaataaacaacctaattatacatcttaaggaactagaaaagcaagagcaaactaagccccaaactagtcaaagaaagaagtaataaagatcaggcataaataaataaaattgaaatgaaaaaacaattaaaatgatcaactaaacaaaaagttggtttttttaaaaagataaaactgacaaatctttagactaattaaaaaagagagaagacccaaaggaattatatcagaggtaaaaaaaaaaaaaaaaaaactcctatctctcaccatttacaaacatcaaatcaaaatgttttaatgacttaaatctaagaccttaaactatgaaactacttaaaagaaaacattgaggaaatgctccaggacattggactaggcaaagatttcttgactaatacaccacaagcacaggcaaccaaagcaaaaatgaacagacaatatcacatcaagttaaaaaacttctgtatggcaaaaaaaataattaataaactaaagaaacaacccatagaatgggagaaaatatttgcaaacaattcatctgacaagggattattaaccagaatatttaaggagctcaaacaactagattagattattagatgttttctaatggatagtttccaaactattagatgttttctaatagtattggaaaacacctaattatctaattaaaaactggttaaaagttctaaataggctttcctcagaagaagacatgcaaatggcaaacacatatatgaaaaagtgcttaatatcattcatcatcagacaaatacaaatcaaaactgcaatgagatatcatctcatcccagttaaaatggctgttttccccaaaaaaacagtcaatgacaaatgcttgtgaggatgtgaagaaaaggaaactctgaaaccctgttgatgggaatgtaaattagtacaaccactatggagaacagtttggaggttcctcaaaaatctaaaaatagagctaccatatgatcgaacaatctcactgctggatatatacagaaaacaaaggaaatccgtacatcaatgagatgataactgcactctcatgtttattgcagcactatgcacaatagtcaagatttgaaagcaacttaaatttctacaaacagatgaataaatgaagaaaattgtggtacatatacacaatggagtactattcaggtattaaaaaaatgagatactgtcacctgcaacaactggaggacattatgttaagtgaaataacccagacaaagaaaggcaaactttgcacattctcacttatttgtgggagctaaaaattaaaacaattgaactcaggaagatagagagtagaaggatggttaccagaggctggaaatggtagtgaatgtgagagcagggagtagagttggttaataggtacaaaaatatagttaggaagaataagatctagtatttgacagccaacaggatgactgcagtcaacaatagcttattgtatatttaaaaattgtaaaaaaagagtataattatattgtttctagcacaaagtacaaatgtttgagaggatggacacccaatttaactggatgtggttattatacaacgtatacttgtatcaaaatatctcatgtaccccataaacatgtatacctactctgtagccacaataattaaaaatatataaaaaataaaagatttgttaaaattagaaggtaattggtgatctcagtgcatatattctaaagttaagaagaattaagtaaggggaacaaaatgaagattagtgaaaactattgtcaagtagcttgactatgaaggggcatacaaatgaggttttttccctcctctttaggatagactttagtacttttatatgctaagagaaatgagtcaccagaggaagacagatatttaaaaaagatgatataataaataattcctttcaggtgaaaattgtatagaaccagaacaaaaggataaatttttaataagaggacagtgtcctatttatgtacatgggagaaaagaatggggtacatggagatagattgtgtgtgtctggaatacaaattttactgtgttcatatctgatggtttctattcataaagtagaaggtgaggttatcttcatgagtattaaaggttttattctttttccatcaccattatgttttatctaactccttctagaaattatgttgtgtaaacaaaaaggatttaagacatgtcccaatcaatttagaaagtttattttgccaaggttaagtacacgccagtgacaggcacagcgtggttttatacattttaggtagacatgcgacgtcaatcaatatgtgtaagatgtatgttggttcggtccagaaaatcaggacaactaaacatgagaagggggcttccaggtcataggtagataagataaggttgtggctgggcacggtggctcacacctgtaatcccagcactttgggagcccgaggcaggtggatcatgaggtcaggagatcgagaccatcctggctaacaaggtgaaaccccctctctactaaaaatacaaaaaattagccaggagtggtagtgggcgcctgtagtcccagctactcaggaggctgaggcaggagaatggcatgaacccaggaggcagagcttgcagtgagcagagattgcgccactgcactccagcctgggcgacagagcgagactccgcctcaaaaaaaaaaaaaaaaaaaagagagagagacaaatggttgcaatggttgcattcctttgagtttccggttagccttccaatgaatatacaatttacaggaatagtcatatatgctttagtctggcttagggaaacaataggtcaaaggaaccaatcagatatacatttgtctcatgtgagcagagggatgactttgagttctgtctgtccttggtccacaaggaatttccctgtgggcaaattttgtgggagatctgtagctgttttattttctagctatcttatttacgaatagaatgggaggcaggttgcccaatgacagttcccagcttcacttttccctttggcttagtgatttggggatcccaagatttattttctttcatagtagtaaaataaataataagtattttgaagaatctctaggttctgtgaatttcttgaggtatttctaaacaatgtttgtgtctgtcttccaatgaagctttaccgactgaagtgttatcgttagtttcttctatttcgaccctctgcctcttttcttttttattgagagggctgtatagattcctgtaagtgctaacagtcatgctgttattttggtcaaagtcacctgtgtgctctctgagcatattacctgaagaaaaaaaatcaatatttgggatcagcagtatctccaatctgtattctttattaagactcctggaagggcatgtttgctgtcctgtactgaacacttgtcacacctacgtaggtgcttgctaaagtatcactgaaggaacatttctatttatgcaagaactatatttaaacattggattgtatcagatgaatacatggagaattagagaggttaagtacatttcccaccatttcccaattttaagtgaggctatgcctcaaacgttctttgattctccaaagttcaagtttttattctcatggaattgacctaacacccttgtctagtcccaggctttatgctatttaactatagttctgtcttttgcagtaaaacaaaataattctatttgtccttccacagagcaccaccagaaacaactgaatcttattgttagcaaagattaatgagctctgcagaggcagaaagagaacttaattttctaacagcaatctgcagatcggggagatgcagcctttggtgcaaaatgaaagtgggctctgaggacggggttggaaagttggagattataaaggtgcaaacttcagggcaggagaggagaatcagaagaatgaggaacagagtcttgatcggatgaccattaagcccaaatcaccaatctctcttaattggctggttccaggcgattggttggttggctccaggtggtcatttggaggtacgctggggaaatttccagcagtagcctatctcagaactcacaagaggaactggtttgacttgattgtagaaaggaagggcctgtgacacttttacacagtacgtgactgcttctcagtcagctatgattgcttgcttctattttaactttgagcacctcagacatgaggaatccattttgtctttcagctggggacatactttatgatttcccccttttggttgaaacttgccataggcagcattgatgaccaacttatgttcttgttgcatattattgccagagtggtgtagctagctgattggagtccatgtagtccctccctgggacccatgtggctgaggaacttatggccaattcaaagaagttgggccaagtaaggcaagaaggcagataggcatctgttagctctttatcagtgtctcttatggatgtttggtggtatcagttaagtctatgaataaaacctagaagtgtcatgtgataaaaatccatgtcggagaattggcaaaacatttgtaaaacagacaagaacaatttttaaaagaaactagctgcctaggcttcataggagaaggatctaagacagaactgtggatgacaagaacttagagtaccatagttaaagatgcaattgataagataatatggttacttctgtgacatacaacaatttaacataaaaaccataattatgactaataacatataccaataaatataagaatttaggaatattatacaattttggaacacataccggtaacacatttatacaaatacaaatcaaagttaaataccaattttaaaaagttgtcattgtgtcttatatgattttaacatatcaaacaagcctaatatgtctttcttggacttcctggggttcctgttatgtccaagttagttcgggacaaaaaacttgattttagaattttccatttaattttggaaagtttaaatatcaaaggtttaaaattgttgatcaaagtagaattacagatcactaggaaatatagcaaaagagtttaaaggcacaaagcacaagaaattatttggataaaacattaactggaatctctttcctaggtcatttatgtaaaaagtaaagaaaaatctgttttataattttctactaaagaacagatgaatcccctaggaataccctgtttttctgacattatagcccaactctggccttacatcagtgtgcttttatattcataattgtcttctagttttaaccaatttgatcacacaaaattccttccatgggattaatcattaacaaatttttacaatttgtttagtccttttagtttgtcctatattttttgtttttgtttttatttttggcattctatcttaggataaaaatttaccttccttcctcctcattattttgacgacacagttctttctcatgtcaaaaaaagaaaagaaaattacttttgcttttgaactttttttttttaccaaaaacatatttttgaaaatatactctgtatatttttaaatatctcttctatctagtagttttaattacatatattaactacaattttaactcttagtaaacctagttttcagagaaaaacctaaggagtaagtaattttgaactgttttatgttagaatttgtggatgaaaagaattgcataacttttagaatgaaatattttctcaaaattttttgtttattaacacatctacaaatatttagcttgtcaaagtatataaactcaaatatgtttaataattaatgtttctgaattttaacttagatatgacttatacattttatattacttattttaatataacatgaccttaagattttaagttattaaaaataattttgaaactgtgacacaggtaccctttctaatgtcttccccagttggcctgggtcccaactacccatgtggcactgaaagatagatacaaagggcagggcccatctaagtcctgaatttacaaaccaggagtagagctcaggacagagtacggaactgtggagatattgcctggaaaattcaactttttcagcatggtctaggaggggaagttgggccagggagaatgtggccatatttggcttggctctgccttgcagctggtggtccaggcactgaggacatgtcttcagccctcatcatggccacctgtcctctggattctccagaatccagagactgtcttcacaagctcacagcaaaatgggtgcaatgctttgggcgaggccagaaggcaacccttatagctttagctcacagacaaagcaagaaagtatcaaaaatactagagaagtgagagttttatgacctttaaacatctagcagcaacggccaaaacctgtctgaccagtacacccaggaaaaatgtctgaattatatttaatactgataattctgaagatattctaattttattttgacaataattttaaactagttttgtttaccaaatattactaaagtcatatgagctaaatgtatttgagttagtttctatttttctgataaaatatttttagatactttaaaatattaattagagctctttcatatattttggtagcaaaatatcacatacgcataacacatataaacatatagacacacagacatacagatagaagcagaccttatagatttataagagtcttcattttctagtattcaaatagtttttctcctccttatagaatattatatcctaaatgattgttagcaaggcaacttaaaatttgtacttccaaagatgtaacttcttatatgaaaatttaaatcacaaaggcttagatctaaacaccattatttgctgagacaaagaaataggtaaggcctagtcaagacaagattgccaggaaaagtatcttaaacaaaagtaagggttgttatacaaatttaagccaatgtcttcgccattgtaaaagtttctagttgtttacgtgcaagaaggaagatgcccttataaatgttaattttttatagaacagatttcttttacaaagactttcacaaactagccagctaaatgtctgaaagtatttttgagaccagtctagttaaataggtgtgtgatttttgtttgttggtttgtttgtttttaaccttagtttatttcttgattggatacctgacttcagggtagagccctttaataaggcaaaatacaaaacaacaataacaataacaacaacaaaacattttccatgcctggtcttagcatggatagctctaaaaaagaagcagttctatctgatgacctactgtttataaataccttatctagtatttctttctttcttttaaaccaaaggtaccttttctggtaactcaacaaaaccagtaagttttaaccaaggttatgactgaaatgaagatgaactagggatctccaaagagatgaaaagcagttttcacaagatccaaaaccatcccaaaggtagctcaaaggtaagtctcattagccacaaataaaatacaactcacatttctgtctggccatattttctaggttcacagcttcttagctgagtgcctgtgcaaaaaggcccataaaccctgtgtgccccacagacagaaaaagacaaaataaaattctgtccatgagagagaaaaggatcaataaaaatgggcaacctgaaaggccaagagtcatgtatgtaatttaaaacaaatggaactggtttcctgactgggcctcaatcctggaccatagccattaatcacagaatcttagccattagactatagtgtgaaacgctttttgtaaatcctgctggggatccaaagcaggcagtatgagtgtacaaaaaattttaactttgctttaggtaatagttttcctctttaggtttgtcaagagaatttctaagtcaactctgacactattatgtgtgtcttcaaaaaaaaaatattttcataaatgcaaataaggcaattgcttaaaatgagatatttctactttttttctatttttaaatttaggagtctagtttaaaagatccatcttctggccattcacagttagaattcctaacggtgtgcttactccaatatcaactcaacccaataggcttttcatggaaatttcaggatgtagttttccaggtttaggatacacctttctgagttaagaaagaggtgtttactggagcaggcatagaagagacaatctcaaagatagttgtgtgtatgttgcctctggtaacccacaatttttttgggtccactagtcacagacccattaatctatgacacttggtaggccctcctggaattggactttcccagtaccaatcaggcaacaagggtttagatgactaaagcccaatagggatgggctttcctgagagcttgacacattcagaaaatgtttttaaaaagtgtgttaataagaactgcaaactgaagagtctgcaggactggcttgaacaaatggtcttttaggagttttaggctcatgttgtaccctatggttctctgctttattacagaacaacacaaaaacacaaagacaaaagaaaagacaatctgggagacaaaagattttaaataatatgaatattcatatcaaaaagtagcatacaacacaccagagtcactacatccaagactagtcatacaaatcattttctccaattaaaaaagattttgtggaggagacagtgatttttactgtctgtctgcttgactgaatttcacagaaagagaagccagaagccctactggtaagcaattcttacctttctgctggcttatcaggtctcaggttaccttcactgcagctcccagaagagcagaggggctttggtcatgctgctcatagtgtcaaaactgtaggagtagagggaaagcttcccctttgcccactgaaggttcaagtaataatcaactcacaaagggaatccataggagaagtggcatacaaatttattaacttgatcacagggaataaccccagagttattacctacttcttgataaatgaaaagtctcaaggaaaaatccttctgtcaagtagaacaactagctggatataataactcaggactgtcaaccaaatgggaggaccaagactcaggaaagactcacccagccacctctaagtgtggaggagccactgtgagtcctcataatgttccagaagaagaaggtggtggtgagaaggggaaagtgatgggcggggggcggggtgagatgcaagtaggggagcagggagacacagggtgctttgttttaaggtctgagagcctttcatgttttcacagatgttggttaagtcttcagatttgtctccttttacaatttacagaggttccaattgtgtttggagctttcaaatattcaaattaaagaaaagactcatttttgagaagtcagacttctctttgttttagttttgtctgtagatactacaatttagatgcatttctcgggtcaattattatccaacctttgttttaagtttgaaaaaccaccagagtgcctgatggtggccagtcagagactgttcctttagaatctgggtcacccataacactcactttatgaaagtgcccctttgaatgcagctgaagtgtaagtgtcctcacaaaactgaattgtgagtgtaccttacaaagtgcaagcatatccccgaagtgtgggcatactctattaatggctaccccatagagctggatgggcagacttcctaaagaaaataaagtctccaaaacttcagcccaaaaatgggagaccttagattcgaaaagccttgcccaattcctccccgatgcagccaggaagtactgaacataaggggctcatgtaggcacctatgccttggtccaactggcattgggaaagaggtttggggccacttcagatcccatcctcctcatcaacaaacgttaacaaaagatcaatgagacctgcagaggcaaaaggagaactttattttcaaaaagcaatctgcagatcggggagatgcagccttcagtgcaaaataaaagtgggctttctgaagagttttggaaagttagagattataaaggcaaaaactgcagggaagagaagaggagtcaggggagtgagggacacagccttgattggatgacctttaaaccccaaatcatgtcttccttaatcagctggttccaagtagttggttggttggctccaagtgctctgttggtgatatgttgggggaaatttccagctgtagtctatctcagcactcacaagaggaactgtttggcttgattgtagaaagaaaagtcctgtgacacttttataacatcttactgagaacacagagtacatgaccacccctcacccaggtagggctgtctgattctatgttaaatttgagcacctcagttagccatggggagtcccttttgtctgtcagccaggcacgtactgtaataccatatttgtctttctgatgcatatcatctttaactaccttgagttttccttgaagataatggtttgcaaactctttcaatatcctggcatcctctgtgaataaactttagttcttagtcttagggaagctctcataaaataaaaataacatgaaattctagctgagattgagttttgttctgacaaattccaggatttgaaacctgaacaggacacttagtctctgcatctcttttattcatttgcagatgaaaatggcacctaagccagcacaaggtttttctttttaaacaggtttattagtgtattataaagtgcaacatttcaaagtatacagttcaatgttttttagtacacagttggctctccatgttcccaggttctctgtatccacagattcaaccaactatggatcatttacagtgttgtgcaaagaacaccatgatctaattttagaacattttcattctccctacaagaaacactgtagccattagcagtcactactcaccacccccagcttccttccccaccccaccttatcctcagtgctaggtaaataccaatctgctatcttttgaaatatatttgtctgttgtgtgcatttcagaatagataaaatcatataatttttcttcttttctaactggtttcttttacatagcctaatgttttcagagttactccatgttatagcatgcatcagtaattcattttatagccaaccaatatacattgaatggatatgatacaatttgttcatcagttgatggacatttggattgtttccatttttcagctctaatgaataatgcaactctaaacagttgtgtataggtttttatgtggacatatgttttcatttctctggagtggaatcgtaggagtgaaattgcttcacatgataattatgcattcgtatggtaactctatgtttaacattttgggaaactgccaaactgttttccgaagtgactttaccattttaaattcccaccaatgagcattttatgagaactaaaagattgagttaatagtcagaggaataaataaatgcttaagcactatccatagttattcttattatcttgttttgtctaacttctcccagaaagcaagcagcatgtgtgtgtgtgtgcgtatacgtgtgtgtgtgtgcatgcgtgcacattttaacaaatctcccagtcatcttgaggatttctttaggtaattcctagagttaatgtttgtggcttatgagctcatgttttgttattaaggctctggtgaggcaaagaacagatgtgagtctggtatgttcaaattagctctccagttacctacttgcattgtaactatcctaaccttggccagtcatctctcaggaacatgccaatgatttcacacatgtggatcagacagcagttgtggtcagtctgactaaagaaatgactgggaagaaaatttattctgtttgtcccagagatggagggtgatttgtgctaatttacaggtaggacaatactaattacactgacagaaccgagtactaccaagaagttcatgagcacatgactcagagaaggagcttgtccttcactgtctctatttcatatgagactgcattcttagaggcaagaatcacatcttagcctgttactgtatagaagtacatatggacatagtaatacggacatagtattacataatcaaaataggaaattctatacctattagaaatatatttcatttgagtttatctatacatatttagaacacaggaaattactttttactaaacatttagctttgtcttaaatatttctcatctaatatccaaactattcaaagtacttttttattttttaattttcattttaagttttagagacagggttttaccccctcatccacattggagtgcagtgatgtgatcatagctcactgcagcctcaaactcctgggataaagccctccctccttagcctccagactagcagctaggactacatgtacatgctgccacgctcagctaggattttttttttttttttgtagagacagggtctcactatgttaaccaggctggtctataactcttggcctcaagcaatcatcccaccttggccccctgaagtgttgggattacaggtgtgaaacactgcacctggccaagaaatactttttattctctttattacagatgaacaaaactaatactcaaatcacctaacacccagttcctaggatagatgagcaatgagcactcactaattttttcaactattaaaccaaagaaataagcaagaatacgtagtcactttgattttaaaaagatgtttctattttaatactttatgtaataggaaattattcttagtgacaagccttattaaatatttaggtagaaaggtttatttagaagtatttgcccagatcaattttttttaatagattattaaggtaaaaggattctaagattagatatggagataataattttcgataaagattgatttgagacactctaaaatttcccaaaatacataacccagagccttatcaattatacaagggtcttcagtggtgttcctgaacacatttggtggacaagtctacaaaataaaaacacctcagatcattcatctaattcctttggttaaatatctcttttttgaattcccaacccttgaccacaccacccttagagctttgctgaaattaaccagcccttaccttcctggttataagtgtccttgtaccctttctggagtgatattaagacaaacaatcagttttcaataataaatagaggatacatcagtgtaaggatgtctagtcaagggtaaaggctaaaggagagtacaatccagtaaaccgcttttacaggatggaagtgaggcatggaaaatatggtaaggtcatcacaaaatttattcactgaatggtcactgtatacttacggtgtggcatggttattatcatgtctatcataggactattaccatgtctatgataggactacagctgtctgaacaaacgaagtaatggttcaattgtttaacttctatttagatttatttatttatttatttatttagttctatttgtttcagttctatttagttctgtttgctgcactaatctggcaatacccagagcgtctccttctcagaagaaccataagttctctcctctgagtatctgaggcatcagtaccagagaagctgtgtccctttggtctaagtcccagctttgtaaagttcccctcagaagcttctaaatattgatagttccattcttctcctttgtttccccaatcttagggtggtagcttcagttactgcttctgtgatatctttgtgttctcttttttcttttcagtttttaaatacccgggtaacagttctttttgttaaattcactctattaaaatcacttgaatattttctgtcttctgattagaccctgatgattacaatcacagaggagtagactatagtgtatgggtagttgataggtcttttcagatactaacacttgaatgtgaaagaaaataaattaaatatatttcactgtgctgtcttctttatatttccttcttgaagagtctctgcccttatattttactaccattaatagtcatattctggaatgtgtgatcatggccacagctgactggaccacagtgggcacattacttagggacaacagattccaggctgatcaattgtctttgacagtgtttgacataaagtgctctgcccaaagatagatgagctgagccactgagccaaaaggattctttttcggtgatttttgaaccaagagtcccagttcaaagctggaccaaaagaagcatacaatgctgctaaatcagattaatggcagagcattagtagctcatgaattattgccgtggagtttttcagagacacttgacctatgaatcactcccttttaccctcagcaaaagcattttcataattaagacttggtttattttgcaagatagatatatccttgtcatttgaatgttcaagcagataattgatggctgtcaactttgttgtggaggggatttcttcaatgaaagctttcaggatagaatataagatgtgtatgtatttctgggctttgctctagacccactgaataaggatatcctaagaatgggttcaagtcatatacattaaaaatagcagtaataacaataagaacaactctctcctctaggtaatgctgaagttgatcaacaagacgtggaaggaaaagaactatatggctattctggctatcaattgctgagtgacaaactatcctaacactcagtgtctcaccatttttattatatctcatgactttctgtgtcatgaattcaagcaggtttctgctgagtgattcttcagtgccatctggcatggagtagggtgaatttaactagatgctagtttcatctggagcatacaagatagcttcactcatatgcctggtgtcttggtggggacagctgagctgctcttcctctctatatagtttctgaacatctgcttgtagttttgccagcaggggagttgaacatcttatgtggttgcttggcgtcctgtggtggctaaggacactcgcatgttaacaatcctcttaaagtgtaggcttgaatctggtatgtaacactttgagtgttctctactggttaaagctgttaaagtgcagcccagatttgatgggagggaaaataggccccatctttcaatgagagaagagttaaagaatttgtggccatctttaatccattactatgacatcttaaagtattgtaaattatatctttaaatcctgagagaatggcatataagaaggacaattacaagatctggaagtcataagaagacagccagcgagacagggcactggtaggcaaagtgatgactggtgtgttttctgttagaaaaagatgcacaggatgacgaaggaaacacaaacagaaggaagtgcaccggggataattttaccgtaggcagagtattatttatgacttttctaatcgtaatagcccactgggatactatggcaaagaatttgagtctgtaggttatttgtgaattggaagtgggtattctttgctaaattgtcaccaaaggtatgaaagtaaatgctatcaaccacgagtaatcatgatagcaacaattatactaataaattcaactgacattttttcaagttaatatgaatatatgcattctttccattgaaataatctacatctttaactgagaaggaaagaaaggagaaatgtttaattaacagtcttttaggccaggtatggtggctcatgtctggaatcccagcactttggggaggttaagttggaggattacttgaggctagatgttccagaccagccagtgcaacatggtgaaaccatatttcttcaaaaaataagaaactagctgagtgtggtaatatgcgcctgtagtcctagctactcaggaggatgagggaggaggatctctagggccaagcagtttaaggctagagtgatgcagtgagctataattgtgctacagcactctggcctggatgacagagtgagatcctatcttaaaaaaaaaaaaaattcctttagatttttaaaagttatcacgatattgattcttcctatccaggagcatggaaagtttttgaatttgtttgtgtactctcttatttcctttagcagtggtttgtagttctccttgaagacgtccttcacatcccttgtaatttgtattcctaggtattttattctctttgtagcatttgtgaatgggagttcagtcatgatttggctctctgtttgtcttttattggtgtatagaaatgcttgtgatttttgcacattgattttgtatcctgagattttgccggagttgcttatcagcggattttggactgagatgatggggttttctaaatatacaatcatgtcaactccaaacagagacaatttgacttcctctcttcctatctgaatacactttatttctttctcttgcctaattgccctggccagaacttctaatactatgttgaataggagtagtgagagagggcattgttgtcttgtgccagttttcacagggaatgcttccagcttttgtccattcagtgtgatattggctgtgggtttgtcataaatggctcttattattttgagatacgttccatcagtacctagtttattttttgagagtttttagcatgaaagcgtgttgaatttttatcgaaggacttttctgcatctactgagataattgtggtttttgtcattggttctgtttatgtgatggattaagtttattgatttgcatatgttgaaccagccttgcatcccagggctgaagccaacttgatcagggtggataagctttttgatgtgctgctgctttggtttgccagtattttattgaggattttcacatcaatgttcatcaggatattggcctgaaatgttctttttttgttgtgtctctgccaggttttggtatgaggatgatgctggcctcataaaatgagttagggaggattccctctttgtgtattgtttggaatagtttgagaaggaatggtaccagctcctctttgtacctctggtggaattcggctgtgaatccatctggttctaggatttcttggttggtaggccattaatcactgcctcaattttataactttttattggtctattcagggattcaccttcttcctggtttagacttggaaggctgtaagtgtccaggaatttatcaatttcttccagattttctagtttatttgtgtagaggtgtttatagtattctctgatggtagtttgtatttctgtgggatcagtggtgatatcccctttatcattttttattgtgcctatttgattgttctgtcttttcttctttatttatctggttagcagtatttatttgttgatcttttcaaaaaaccacctcctggattcattgattttttaaagggtttttcatgtctctatctcctttggttctgctctgattttagttatttgttgtcttttgctagcttttgaatttcttcgctcttatttctctagttcttttaactgtgatgttagggtgtcgattttagatctttcccactttctcctacgggcatttagtgttataaatttccctctaaacattgctttagctgtgtcccagacacagctttagctggtacattgtgtctttgttctcattggtttcaaagaagttatttatttctgccttaattttgttatttacccagtagtcattcaggagcaggttgttcagtttccatgtagttgtgcagttttgaatgagtttcttaatcctgaattttaatttgattgcactgtggtctaaaagactgtttgttatgatttccattcttttgcatttactgaggagtgttttactttcaattatgtggtagattttagaataagtctgatgaggtgctgagaagaatgtatattctgttgatttggagtggagagttctgtagatgtctattagatccacttggtccagagctgagttcaagttctgaatatccttgttaattttctgtctcgttgatctgtctaatattgaaagtggggtgttaaagtctcccactataattgtgtgggagtctaagtttctttgtaggtctctaagaacttgctttatgaatctgtgtgctcctgtattgggtgcatatatatttaggatagttagctctttttgttgcattgatccctttaccattatgtaatacccttctttgtcttttttgatctttgttggtttaatgtctgttttatcagcgactaggttggcaacctctactttttattttttgctttccatttgcttggtgaatattcctccatccccttattttgagcctatgtgtgtctttgcacatgaaatgggtgtcctgaatacagcacaccaatgggacttgactctttatccaatttgccagtctgtttagttggggcattttgcccattaatatttaaagttaatattgttatgtgtgaatttgatcctgttattatgatgctagctcattattttgcccattagttgatgcagtttcttcatagtgttgatagtctttacaatttgatatgtttttgcagtgactggaacgagtttttcctttccatatttagtgcttccttcaggagtttttgtaaggcaggcctggtgttgacaacatctcttagcatttgcttgtctgtaaggattttatttctccttcacttatgaagcttagtttggctggttatgaaattctggttgaaaattattttcttgaagcttgttgaatattggcccccactctcttttggcttgtagggtttctgcagagggatctgctattagtctgaggggcttccctttgtgggtagccaggcttttctctctggctgctcttaacatttttccctgcatttcaaccttggtgaatctgacaatcttgtgtcttgcggttgctcttctcaaggaatattgttgtggtgttctctgtattttctgaatttgaatgttgccttgtcttgctaggttgggtaagttctcctggataatatcctgaagaatgttttcccacttggttccattctccccatcactttcaggtacaccaatcaaacatagatttggtcttttcacatggtcccatttttcttggaggcttcgttccttccttttcattcttttttcctctaatcctatcttcatgccttatttcattaagttgatcttcaatctctgatatcctttcttatgcttgatcaattcagctgttgatattcgtgcatgcttcacaaagttctcgtgctgtggttttcagctccatcaggtcatttatgttcttctctaaactggttattttagttagcaattcctctaaccttatttcaaggttcttagcttccttgcatgggttacaacatgctcctttagctcagaggagtatgttattgcccaccttctgaagcctacttctgttaatttgtcaaactcattctccatccagttttgttcccttgctggcgaggagttgtgattctttggaggagaagaggcgttctcatttttggagttttcagtctttttgctctggtttttcctcatctttgtggatttatctacctttggtctttgatgttgatgacctttggatgggttttttttgtgtgtgtggacatcctttttgttgatgttgatgttattcctttctgtttgttagttttccttctaacagtcaggcccctctgctgtaggtcttctggagtttgctggaggtccactccagaccccatttgcctcggcatcaccagcggaggctgcagaacagcaaagtttgctgcctgttccttccgctggaagcttcatcccagaggggtacccgccagatgccagctggagctctcctgtgtgaggcgtctgttgaaccctgctgggagtcgtctcccagtcaggaggcatgggcgtcaaggacccacttgaggaggcagtctgtcccttagcagagcgtgagccatgtgtcggtagacccgctgctctctttagagccagcaggcaggaacgtttaagtctactgaagctgctcccacagctgacccttcccccaagtgctctgttccagggagatgggggttttatctataagcccatgacttgagctactgcctttctttcagtgatgccctgcccagacaggaggaatttacagaagtagtctggctacaggggctttgaggtgtgctccacccagttcaaacttcctagtggctttgtttacaccctgaggggaaaaccacctattcatgcctcagtaatggcagacacccttcccccgcaccaagctcaagcatcctaggttggcttccgactgctgtactggcagtgagaagttcaagccagtggaacttagcttgcgggactccatgggggtgggatcccctaagctagaccacttggctccctggcttcagccccctttccaggggagcgaacagttctatctcactgacgttccaggcaccactggggtatgaaaaaaaactcctgcagctagcttgatgtctgcccaaactgccgcccagcttcgtgcttgaaacccagggccctagtggtgtaggtgcctgagggaatgtcctggtctgagggttgtgaagaccatgggaaaagcatagtatctgggccagaatgcattgtccctcacagtacagtccctcacagcttcccttaactaggggagggagttccctgaccccttgcacttcccgggtgagggaataccccaccctgcttcggctcgccctctgtgggctgcacctactgcctaatcagtcccaatgagacaaactgcctacctcaggtggaaatgcagaaatcacctgccttctgcattgatctcgctgggaactacagaccagagctgttcttatttggccatcttgccattcatgaaaatggccatactgcctaaagtaatttatatattccatgctatctccatcaagctaccattgactttcttcacagaattagaaaaaactactttaaattttatatggagccaaaaaagaccctgtatagccaagacagtcgtaagcaaaaagaacaaagctggaggcatcacgccacctgacttcaaactatactgcaagactaccataaccaaaacaggatagtactggtaccaaaacagatatatagacgaatggaatagaacggacgcctcagaaataataccacacatctacaaccctctgatctttgacaaacctgacaaaaataagcaatagggaaaggattccctatttaataaatggtgttgggaaaactggccaaccatatgcagaaaactcaaactggacccttccttacaccatataaaaaattaactgaagatggattaaagacttaaatgtaagacctaaaaccataaaaaccctaggagaaaacctaggcaatacctaggtatgagcaaagacttcatgactaaaacaccaaaagcaattgcaacaaaagccaaaattgacaaatgagatgtaattaaactaaagagcttctgcacagcaaaagaaactatcatcagagggaacaggcaacctacagtatggttgaaaatttttgcaatctatctatctgacaaagggctggtatgcagaatctgcaaggatcctcaacaaatttacaagaaataatcaacccatcaaaaagtgggtgaaggatatgaacagacacttctcagaagaagacatttgagcctggcatggtggctcacacctgtaatcctagcactttgggagaccaaggcgggcagatcacaaggtcaggagattgagaccatcctggctaacacggtgaaaccccgtctctactaaaaatacaaaaaaaaaaaaaaaaaaaaagaaaaaaaattaccagggcatggtggcaggtgcctgtagtcccagctacttgggaggctgagacaggagaattgcttgaacctgggaggtgagggttgcagtgagctgagatcgtgtcactgcactccaacctaagcaacagagtgagatcctatcttaaaaaataaatataataaaataaaataaaacaaaaaaacaaaagacatttatacagccaacaaacatatgaaaaaaacctcatcatcactggtcattacagaaatgcgaatcaaaaccacaatgagataccatcacacaccagttagaatggtgatcactaaaagtcagaaaagaatagatgctggaaaggatgtggacaaataggaaaggtttttacactgttggtgggagtgtaaattatttcaaccatagtggaagacagtgtggtgattcctgaaggatctagaatcagaaataccatttgacccagcaatcccattactgggtatatacccaaaggattataaatcatgctgctataaagacacatgcacacatatatttattgcagcactattcacaatagcaaagacttggaaccaacccaaatgcccatcaatgatagactggataaagaaaatgtggcacgtatacaccatggaatgctatgcagccttaaaaaaggatgagttcatgtcctttgcagggatatggatgaagctggaaaccatcattctcagcaaattaacacaggaacagaaaaccaaacaccgcatgttctcactcataagtaggagttgaacaatgagaacatggggacacagggaagggaacatcatacaccgaggcctgttgagggctggggagctaggggagggatagcattaggagaaatacctaatgtagatgatgggttgatgggtacagtaaaccaccatggcatttgtatatgcatgtaacaaacttgcacattttgatcatgtaacccagaacttaaagtataataaaaaaagaaactatttttaaatgacatcataaaacatagtagtgttactgttataatttttcttggaagctgaattgattgcatttctcccattgtaacttaagtcttctagatttcctttcttaaagatagaacaagttattctttctgaaatatataaagtggcaaacttgctttcttctttctttgttttaaaattatttcacaaattgcatgtgtgagatatgaatatgctgttggtgttatttacatttgagagcagattaaatatgtttttgtttatattaattatgaaactctagcattggggattgctatttggttttgttttactttttatatattgaatttttattcttggtaagatttgattattactttgctccaagctgctgagttgctcagaaatgaaattgacacggactccttagtatcagatatgttgatttgaattaacaacacagaagggtgtttaaatgaaaatgtaatgtcatttagtaaattaacatgtggaaataaaaacctcggactaaaatctaatttaacaaagtttcttgaagtttgttttgttgaattaatgactgggaaactaagttcattttgttgataatctctcaatgcagtaataatactaaagttgtaagagcaacaggttacatcctaaccaggtctcctctgcctcaagtacagaatctccaatctatctataacactgttttcctggcagctattctactggcaaactgaacagatcaggaaagtaattatctcttatggaaaagtcatctattttctctatggattatgagtaagggacaccttttgtgcttcatctaaaatctgaaagtaaaattgtactctctattccaaccactgctgcaccaaccagttctgcataggtttccagcactttcatgcacatgaacctgacagcatcctaccccactgcatcttggcgcattgtttggatttgagctgagtgcttccattcctggcctacaaattatctgatacgacatcatgggtgacctatggggactacgttctatttgtgtgtgtgtgtaaactaaaaatttggggatgggagctgattggtaaaagccccccttttttttttgtttttttgttttttgttttttttccagtggacggatggtggctagatacgtttcttaaccctttccggtgatcactgagggatggagcaaccagtttcccatagcagagaacaagtacatacatttattggcttgatttttttacttcactgttttattcttgttcctcagtcctgctttctgggattacattcatgaataaagtactcacacataaacccttgtcttagatcggcttttgagaggaccagctctaaaacaagccctgtaaaacttgtttctgccacttatattaccaggaatgtgttggaatttaattaggacatgtttcctcaaaattgcaccaggagtatcacaataaatgaaacttggtgttcacacagagtgccatctatctttatctggttttagtcttctttcagctggtatatctatgacctttgttctattggcacacaaacaagaacttttggagaaatagtgcttgcttatgaagttaaatgttggagaaaggtattttgaactttggatgtctggaaatttttaattaaaattttagttaattttaatttctccccaaacaatagattggcattgtctgatgaaaatcacaccatattttcttctctgtgcaatcctaaatattatacatagaagaaataaactttagtttgagccagggtttaagttggagatggctcgacttgccaattttgcaaatcaccaaaatttctttctcaaacccaattctgcatcctgtaatttcagttttttccaagtgttatgtagaagatatcattctaagaataaaaatagtcgtgaatgtacatctggaataaatacatatataactcactgcggtaaagctttaaaaggccataggctaaagtatttatataatcctccaaattataaaatggtcaccctagtgatatatgggtagtatagcactttatttatatagttttacaatttctttttcatgttattaaatatattttagagaacagacaacttgaagtttaagataattatatagtttcttattttattgagagatacaagagaattttgaagtttagggctgaaaaccaacatctcagtcacctagaacatttgaatttattggttgatcagtgtgacggttgagtgtcaacttggctaggtgtggtggctcatgcctgtaatcccagcactttgggaggccgaggcaggcagatcacttgagcccaggatttcaagaccagtctggccaacatggtgaaaccctgtctctactaaaaatacaaaagttagccctgcacagtggcccatgcctgtaatcccagctacttggtaggctgaagcacagaatctcttgaactcaggaggcggaggttacagtgagccaaggtcgcaccactgcactccagcctgggtgacagagcaagactctgtcacaaaacaaaaacaaaaaaagtaagtgttagcttgattggattgaaggatgcaaagtattgttcctgggtgtgtctatgagggtgttgccaaaggagattaacatttgagtcagtggactgggcaaggcagacccaccctccgtctgggtggacatcatctaatctcctgccagggcagcaggaataaagcaggcagggtaagatggaagagccaacttgctgattctttggccttcatctttctctcatgctggatgcgtcctttccttgaacatcagactccaagtttttcggcttttggactcttggacttataccagtggtttgccaggtgctcccaggcctttggccacagactgaaggctgcactgttggcttccctccttgtgaggttttgggacttggacttatttaccactggcttccttgctccccaacttgcaggcagtctatcgtgggactttaccttgtgactgtgtgagtcaatcctccttaataaacttcctttcatatatacatatatcctattagttctgtccctccagagaaccccaactaatatggtcagatttctggctatttgaaaaacttaaaacattatagaactcagaaaatgacagcatagttggtagattataaagaacatttgaaaataagtataaaaactattgggaagaataatactgaaaattaatattaagtattttataaactaggcactgagataagcactttatagggaggtgttattattagttccttttattttttcttttgatacattttagatttatttttgaaattgctagatgaaatcgtgtgtatttattttgtacaacatgatgttttgaagtatctatattgtggaccggttacatctagatcattaacatatgcatcacctcatacagttattttcccggtatgaacacttaaggtatgcctctcttagcgtttttcttttttttttaatactttttttgtggggggaggtggggtctcattctgtcacccaggctggagtgcagtggtgtgatcacagctcactgcagccttgaactcctgggctcaagctattctcttgcttcagcctcctgagcagctgggactacaggcacataccaccacgctcagctgattgtttaatttttttgtagagatagggtcttggtatgtagccaggctgatctctatctcctggcctcaagtaattttcccatgttggtcttcaaaagtggtgctggaatcacaggagtgagccaccatgcctgggaagcatttttcaataatacaacatgtcatcctaaactatagtcatcatgccatacaatagcactggtgaatgtattcttcctatctaactgtaattttgtatcctttcacatatttgcaaatgcctccctcccacccccaaccttttcagcctctgataattatcattctactctatattcctatgagatcaattttttatgattttatatatgagttagattatatggtatttgtccttatttgtctgatttatttcacttaacataatgtcctcgaggctcatccatgttgttgcaaaagacaggatttccttcattttatggtcaaatagtattctattgtatatttataccacattttctttatccattcatctgttcatggacacttagtttggttccatatcttggctattgtgaatagtgctgcaataaagatggggttgcagttatctctttgacatatcaatttcatttccttagtgtataaatccagtagtgggattgctggatcatgtggtagttctattttcagacttttagatgtgggaatgtaacactgtccttcttacactcttcaatttatcttttattattttgctataaccaggtactatgatctccacctgaattcgttagctcttatgaaggcatttttgtgcatggatggatgttcaaattgatgtttctgttggggggatgatagctggagagttctattttgccatcttgctctgccttcctgttagtccctctttaaagatgaaacaatattgaaactttaagaaagttaatcaatttgcttgagtttattattgagctcttaagttgcagaattgaaatggccatttattttctgactccagttctgatactctgaacggctgcttccctagagaaggcccaaacgtgataccactctccccaggacaatctgattgtgtggtttgctgatcaaattgactgttggtggctgtgaaagctgactcatctgaaacaaaagctaaggatcgtaagagaacactcagagaatgaaaaagcgtcataagatccaggggtcaaagagaaagaaacatagagagaagaaaagtggaaagaaaatagaagtgagaaagaaaaggagacaagtttctattaaatagtataaatggtagcagaatgtccatggcaatagagatttttaaaaaaatgatagccaaatttgtgggaaagaggtagggttatactgagcagtggtaagtggatctattactatattactggatgatagagtacaaattaatagtggatttttaattccatacattgaccttcctttatttaagaaagcagagagtaagacagtttttattagacagagtctgatgcctgttttcattatatattagaaagcttcgtcacacagaaagttatccttcagatacctgcaaatttgtaccacagcaaatagcactttctttagtgattctgatgtttaggtgtcatgattattcaaggttcttggcatagaaagcatcaggaaatctttgatatgatgcttcaagacatcctgtatttccaatgagctagcacttagacatttatttcttaaacaaatgtgactcttggaagtaatctttctatttttaaatattcttttgatagaaaaatttatatttcagccacagtaaatgtctgactattggaagctttattatttatttaaagttatataatattactattaataaacattaatagtagtgtactctaaactttattccattttttctctcagaaagtcattcctgaaatattagttactgtatgtagatcaattatattccctttgatggattctttgggttttactttatgaatataacacatattatttattaacttcctcccatggtttcctgttccctgtgcacttatgtaagtgttcctctggtatacatacctagaaactggattgctatgtaagaaattaaatacatgtattattttactaagccctaccagattatactcaaaatatgtacacacatttgcagtactatcagcagggcagaggcaagatttcataaatattctctatatgctatttaatatgcaatttctacctatttagagatataaaaggagacattgttattctattttacatttctcttattagcaaaattgaatatttcttgttacaattagtagccatttgttgctttgtccttctctgtcttacatatttattgttttgttagcagttttcaattggatttcctgatttgctcctgctaatttatggacatgatgtgtattatgttctttacttgggtaattcatacggcgggtagcttcgttaagatttttacttatctgtctggttacattatctacagtgtacattactcgagggaattttgaatgtgatttagtaaacccatcaactttttaatttccttttgatacatgcttctagtcttttcaaaaaatatttcccagcctggcgcggtggctcacgcctgtaatcctagcacttcgggaggccgaggtgggcagatcacttgaggtcaggagtcaagaccagcctggcaaacatggtgaaaccccctctctactaaaaatacaaaaattagctgtgcatggtgacgtgggcctgtaatcccagctactcaggaagctgaggcgggataaccacttgaacccaggaggtggaggttacagtgagccgagatggcaccactgcactctagcgtgggcgacagagcaaaactgcactaaaaaaaaaaaaagaaaaaaagaagaaaattcccattatcaaagtcatacaaatgttcttatgttttcttatacagttttacctttcacacttagaccattatttataagaatttactttttatatggtaggagctggggatctttctttttcctcttcataaagtgttaaaatatccccaacatcatttaatactctttcccaggttatttgttgtgccacttgtaccatttattaagttttaacattgttctctttatctgttcttgtcttagtatatttgtttcagttactgtcttttgaaatgttctaaacagggagattcacctctctttgtccttgaaaaatgttatcctatgtattatcagacctcatacttccctaaattctagggagaattattgctgagatattcttaaaattatgttatttaaataacattatttaaatgttattacacttatacaaattgtataatttggggagaattaacctctttatgatgtaatgctctcttatcaatgaacatggtatatttgcttaggtctctttaggtatttttaaaaagattctttagtgaaggtcatcctataccttaaatatttcctataaaagatagtgttaattatattattattatattattattattatagtttttcattattaaaactattttattattttattattatagtttttattattaaaaacattaaaaattacattttataattggtaatttctgctatagaataatgctactgatttttaaattttggatcttgcatccttgctaactcattataaatttttatgacttttttttttttttttgaaacacgatctctctctgtcacccaggatggagggcagtggtgcaatcttggctcactgcgacctttgcctcccagacttaaaggaacattttacctcagcctcatgcatagctgggactgcaggtatgcacctgattaatttttgtattttttgtagagacagggtttcactatgttgcccaggttggtcttgaactcccgagctcaagtgatctgcccacctcagcctcccaaaatgctgggattacaggcgtgatccatgtcctgcttttataatttttcttttggtcatgatagatgttctatgtgaataatcatattgtatacaaataatgtcaaaattgtttcttcactttctgtcttgagtattattcttatgcattggacaggactttcagtggtgcaatgatttttttcttgattttaatggaaattattataaatttttccattaaatatgataattattagagatttctttgtagattactttattcaggttttgcaaatttcatttttctccaaattttctgagagctttggttatgaatacataaaattaatatatgattcctctatctactaagattaccatgaactttttcctctcctatactctattaatattatgaataacatttttagatatttgagaaatctattttgggccaggtattccttgacatgactccttgtttttctaatatactgtgaattcagttaactagtattttagttagtattatttttggtcttatttcataagtggaaatgatatgtaatattcttttaatattctttgattttttgtatcaagattatattagttccacagcatggtactggtacaaaaacagacatatagaccaatggaataggttagagaacccagcactaaggttgcacacccacagttatgcgatctttgatgaagtttacaaaaataagcaatggggaaaggactccctgttcaataaatggtgctggtatagctggctagccacatgcagaagaagaaaactggaccctctacctttcatgatatacaaaaatcaactcaagatgaattaaagatttaaatgtaagacctcaaactataagaaccctagaagaaaatctagaaaatatcattctggacattagctttgtcaaagaatttatgactaagtcctcaaaagtgattagaaaaaaaacaacaagaaaaaatgacaagtggaatctaattaaactaaagagcttctacatagaaaataaactatcaacagagtaaacagataaccaatggaataggtgaaaatatttgaaaactttatatctattaaagatctaatatccagaatctataagaaatttaattccacaaacaaaaataccaaattttatttaaaaaatgggcaaaagacatgaacagacactttgcaaaagaagtcatacaagcaatccacaaacacgaaaaaatgcccaatgtcactaataatcggctaaatgcaaatcaaaaccacagtaagatatcatctcacatgtcagaattacattattaaaaagccaaagcacaacagatgaggctgtggagaaaagggaacacttatatgctgtttatgggaatgtaaattacttcagcccctgtgaaaagcagtttagagatttctccaagaacttaaaacagaactaccattgatccagcaatcccattactgtatttacatccaaacaaatatgcattgttacaccaagaagacccatgcacttgtatgtttattgtagcactattcacaattgcaaagacctagaatcaacctagatgcccatcaatggtggattggataaagaaaacatggtacatatacactatgaagtactatgcagccattaaaaagtgaaattatgttctttgcagcaatatgtatgcagctggagaccattatcataagcaaattaatgcaggaacagaacattaaataccacatgttctgacttctacgtgagagctaagcattgggtactcatggatatgaagatgggaactatagacactggggacaatgagggggcagaaggtaggggagcagggctgaaaaaccacttattgggtactgtattagtctatttcaaacttccctgagactgggtaatttataaagacagaggattaatttactcacagttaactgggtaatttataaagaaagagagttaattgactctcatggctggggaggcctcaggaaacttacagtcatggtggaaggggaagcaggcacatcttacatggtggcaggtcagagagagagctagcaagaacggggaaaactgccttgtaaaaccatcagatctcatgagagctcacagcagcatggggaaaactgcccccctgatccaatcacctcccacctgatccgacacatggggattataaaaactacaacttgagatgagatttgggtgggaaaacagagccaaaccatgtcagggacaatgtactttgcttattatctgagtgatgggatcattcacactgcaaacctcagagtcacacaatatactcatataacaaatctgtaaatgtaccccctgaatctaaaataaaagttgaaaaatgaagataatattagtttcaaaagttttttttattattttataaaagaatttatatacattaggagacactgttcttcaaatgtttgtggaatttacttttcaattgctgagtacaggctttttgctaggggtggtggtggcttgaatggaaagcactaattcattttcttaaattatgttactttttttaagttttctattaataattgagtactatattgatgtttcatttttttccacaaacttttccttttactgattttcaaatttgttgcatagtttttcacaatattcttcaatttaaaaatatcctttacattagctttttgtacttttttctagttttactatctctttttgatctgacctgtcagacattttcaaagaccaagcttctgcttattatttctattttttctttgttttattgattcatgatgttttgttattattatttccttctttttggtttctttgagtttactgtgttctttttcttgaatttcttacatttactattttgcctttttccagcttcatgagtttgatttaatttctcttgcatcttgggtttgttgttttgctcatttattttcaatctttgttgttttatgatgaatgtatttacagcaaaacttttttctttttttagttgtatctcatgtattttgaaatgtaatacttcattgtcaagaaacaattagattcttttctcagtacattagtggtatatatattttagaaatttctatgcatttggttgctttaaagctattcttttttaacttatctccaatgtttttgcactgtggtttgagtatatataacctttaagatgtggattctttggccacattatttgtgcatgttatatatggatttttaagaatgcttcttgtatacataagaataaactttattcaggaaatattggtccatatttttgttttttaaaaaaaaaattaagaaaagaggtttaaggctgacagttctgcacactctacaggaagcatagcattgacaactgcttccagttaggacctcaggaaacttaaaattatggcataaagcaagggaggaacagctgtctcacagggtgagagtgggcccgttttttcttttgctttacatttctttatccctctccctttatactatctccgcatacacaagctcacaagaatatgctcattggttgtgatatttaaatattttctatttttgaaaaaatttctgctaattctagcaatttgagagtgatgtgttatagttgttcacatgataattcaggtaattaggcacctcaggtctagaattagtcatttaactccaccttgatgcaaagaaacaatgaaaaatgtaatcttcctgtatgcctaagtagtcagtgaaagagtttggtacaagcagaaaatttcctctgccacagagccctttcaaagtgagggtaaatcctcccttagttttggaaagattcttggttacaatttcaccaactttttaatcctctttctttactctttattttctcttttcgttttccagttgaatagatttcaacaattctgttttcaaaaattcttgtcttctttttttctttatgtttttcttctactttatctttttctcgtgccttctgggagagttccataacccagtattccagttaagtaatgtaattttggatatatttattctgctactccattgaattatttgtttcaaaaatcttacctcaattttagaaatatctgattgtcttgctgcactgagttatttgttttgaaatcttacttccattttagaaatattatctgatcatcttgctgcatgctataaatatgttccttttactgtgtaagtatattttacttttttaaaatgttttaaatttatttactgtttctaccttttagttatttttcctcaattaaaagtatttccctttgttgtcttctagaatagttcttgtgctatttaaatgtttcttaatttttccttatatgcctatctctgtttcttggaaataaagtagacaatggataacctggcctgcaatctatttggtggatttaaatcttaatggtgagttgaggattgcatttaccactgcctttcttccctatcatggagtactttccagtctctctacccagactactgctcttgatctggggtggcaaccttccttggtatttctccatttctaggatatatgagggttcctcaggggacagctggctccccaatccttgttttgtctttctacagcaactgagcctcactactgccctcaatcctatcctgcagcctccagttagagatccaggtttcctgccctgtgttactaataaaatgggcaattacttgggaatagagatttcaggatagtagatggaaggaatttgttgcctttagcaataagatgtctgatattgtgaagtggtatggtgtagtaaaaacacctgagattaaagaagagaggaatctatgcctatttcttcttttattcatttatttatcaaacattaattcatgcatctgttcatttatttaatgcatacttactgaggacctattgtgggccaggcactgttacattgcactataaatttggtaggaagcattttttttaaaactgcttttatagtttggaggtatgggtagaggaatccatgtataatttattagggagataagtggtattaaggaaaacaaagcaagtatataatagagaatctcagaggctaggaaggcaagatttgagcagagacctgaatgaggagagtatgtgagtgggttcactcagtctctaccatttataagccacgagactgtgggcaatgtttgcatgtcgagtgaatgcgacattgtttgtaaagacacattgcatgacactgagtaagaagtcaagaagtcagagctactaataatacacattattaataaatcaaaactagtaattgaaatgctttttgtacatatcaactaactttcctgttattaaaaattatttctaatttttcggaaattccagaaagattggcagtaaacaagtaataaaccttcttattcattttgtttttatactggaaggtcattagtcacagtcttaagtatggacagtaaagttaaaaaattcaattggcaggaagtgggtgcatcttaagggccatttaagaaagtgtatgaatttatgaactttatagtgagaggatgactaacaaaagctagctaagtactttctgattctagaaaaaaaatagagaattttctctctgtctttgtttttctctctaacatgttaaattagcagaagacttcaaatagtttggacacataaacattataaccaaactctccagtgctttcaggattttgatatgcataaatatataagggagctgaaagacacccattccattttccaacacttcctttgcccttgtccacacggaccttgcacatctcattgctttgtagtcacatttgaccaaacaggttattaattatgtgtcttaatctcctatcattaacttcagaatgagtctgaataaactgactgttttgtaagtctgtcaactttaagagttgaaggttttccaccaaagaagaaactcaaaagtttggaccaacctgtctaacatcactttccagagaagtgtccaaaatatttggagaagcttcaatagtgcaataaatatataattattgaactttgctaccttaaaggaaacagtactcatttagataggtgatccaaatttttacttttttccccaaaggcaattttacctagactgttatatataaaagattaaaaacagattttattttatttttttttaatttggtggagagggatgctaatggtgaaacacccactgccatctactcaggttttccctcacttgctaagggcagcccgcaggggtccatggaatgtcatttgaaaactatgaatttaaatacctgatttctgtgactctaacttgcaggtaaagaagaaaagatggttgtggtctccactgattctttctccatagcatgagtttacaatcctagatgaatgtgttattacctactataaattttggttgttgaggaaaaagacagggatatttaagtggtataatgaaggatttcagtaacatgtgcagcttcctagccattcaacaatctctgtcagagagtagatttacttgagatggcgtaggtgagagttaaaaaataatcattccctccctgcactagatacttgcctaggcataacaattttgcaatgctgagatattttacttatgcataattagttttgtccatatgtcctatctttattcgttgattcagcatacatatatttataaaaacgtaccgtatattgagaccagtatgagggcttaaagattaaataaaaaaagagaaagagataagtttctaggcttttggcacttagagaaattacaaaatatattttacattaaaatatttataattatgaaggaaaagcatcttttggcagaggaagtcattattttcaagctggctagaattattagaaaaaagtgctttgcgggaggaggttccaagatggtcgaataggaacagctccagtctacagctcccagcgtgagcgatgcagaagatgggtgatttctgcatttccaactgaggtactgggttcgtctcactggggttcgtcggacagtgggtgcagcccatggagtgtcagccgaagcagggtggggcatcgccttacctgggaagcacaaggggtcagggaattcccctttactagccaagggaagccatgacagatggtacctggaaaattgggacactcccaccctaatactgtgcttttcctacggtcttagcaaatggaataccaggagattatatcccgtgcctggctcagagggccccatgcccttggagcctcactcactactagcacagcagtctgagatcaaactgcaaggcagcagcgaggcttggggagggacctccaccattgctgaggcttgagtaggtaaacaaagtggctgggaagcttgaactcagtggagcccactgcttctcaaggaggcttgcctgcctctgtagactccacctctgggggcagggcgtagctgaacaaagggcagagaaacttctgcagacttaaacgtccctgtctgactgcattcaagagagtagtgattctcccagcatggagtttaagatctgagagcagacagattgcctcctcaagtggatccctgactcctgagtagcctaactgggaggcacctcccagtaggggctgactgacatttcatacagccaggtgcccctctgagatgaagcttccagaggaaggatcaggcagcaacacgttctgcagcctgcactggtgatacccaggcaaacagggtctggagtggacctccagtaaactccaacagacctgcagctgagggtcctgactgttagaaggaaaactaacaaacagaaaggacatccacaccaaaaccccatctttatttcaccatcatcaaagactaaaggtagataaaaccacaaggttgaggagaaactagagcagaaaacctgaaaattctaaaaatcagagcacctcttctcctgtaaaggaacgcagctcctcggcagcaatggaacaaagctggacggagaatgactttgacaaggtgagagaagaaggcttcagacaatcggtaataacaaacttctctgagctaaaggaggatgtttgaacccatcacaaagaagctagaaaccttgaaaaaagattagacgaacggctaactagaataaacagcatagagaagaccttaaatgacctgatggagctgaaaaccatggcacaagaactacatgatgcatgcacaagcttcagtagtcgatttgatcaagtagaagaaagggtttccatgactgaagatcaaatgaatgaaatgcagcaagaagagaagtttagagaaaaaagagtaaaaagaaactaacaaagcctccaagaaatatgggactatgtgaaaagaccaaatctatgtctgattggtgtacctgaaagtgacggggagaatggaaccaagttggaaaacactctgcaggatattatccaggagaatttcccctacctagcaaggtaggccaacattcaaattcaggaaatacagagaatgccacagagatactccttgagaagagcaactccaagacacataattgtcagattcaccaaagttgaaatgaaggaaaaaatgttaagggcagccagagagaaaggttaggtcatccacaaagggaagcccatcagactaacagcggatctcttggcagaaactctacaagccagaagagagtgggcgcctatactaaacaatcttaaagaaaagaattttcaaccccaaatttcatatccagccaaactaagcttcataaatgaaggtgaaataaaatcctttacagacaagcaaatgctgagagattttgtcaccaccaggcctgccttacaagagctcctgaaggaaacactaaacatggaaaggaacaactggtaccagccactgcaaaaacatgccaacttggaaagaccatcgatactaggaagaaactgcatcaactaacgagtaaaataaccagctaacatcataatgacaggatcaaattcacacacaatattaaccttaaatgtaaatggacttaatgctccaattaaaagacacaatctgggaaactggataaacagtcaagactcttcagtgtgctgtattcaggagacccatctcacatgcagatacacacatgggctcaaaataaagggatggaggaagatctaccaagcaaatggaaaacaaaaaaaagcaggggttgcaatcctagtccctgataaaacagactttaaacgaacaaagatcaaaagagacaaagaaggccattacataatggtaaagggatcaattcaacaagaagagctaactatcctaaatctatatgcacccaatacagaagcacccagattcataaagcaagtccttagagacctaaaacaagacttagattcccacacagtactactgggagactttaacagcccactgtcaacattagatcaatgagacagaaagttaacaaggatatccaggtattgaactcagctctgcaccaagaggacctaatagacgtttacagaactctccactccaaatcaacagaatatacattcttctcagcatcacattgcacttattccaaaattgaccacatagttggaagtaaagcactcctaagcaaaagtgcttaggacagaaattataacaaactatctctcagaccacagtgcaatcaaactagaactcaggattgagaaactcactcaaaacagctcaactatatggaaactgaacaacctgctcctgaatgactactggttgtgtgacaaaatgaaggcagaaataaagatgttctttgaaaccaatgagaacaaagacacaacataccagaatctctgggacacatttaaagcagtgtgtagacggaaatttatagcactaaaggcccagaagagaaagcaggaaagacctaaaattgacaccctaacatcacaattaaaacaactagagaagcaagagcaaacacactcaaaagctagcagaaggcaagaaataactaagatgagagcagaactgaaggagatagagacacagaaaacccttcaagaaatcaatgaatccaggagctggttttttgaaaagatcaacaaaattgatagcccactagccagactaataaataagaaaagagagaagaatcaaatagatgcaagaaaaaatgataaaggggatatgaccatcaatcccaatcccatagaaatacaaactaccatcagagaatactataaacacctatacacaaataaactagaaaatctagaagaaatgggtaaattcctggacacatacaccctcccaagactaaaccaggtagaagttgtgaatccctgaatagaccaataacaggctgtgatgaggcaataattaatagcttaccaaccaaaaaagtccaggaccagatgaattcacagcctaattctatcagaggttcaaagaggagctggtaccattccttctgaaaagattccaatcaatagaaaaagagggaatcctccctaactcattttatgaggccagcatcatcctgatacccaagcctggccgagacaaaacagaaaaagagaattttagaccaatatccctgatgaacatcaatgcaaaaatcctcaataaaatactggcaaaccgaatccagcagcacatcaaaaagcttatccactatgatcaagtggacttcatccctgggatgcaagtctggttcaacatatgcaaatcaataaatgtaatccatcatataaacagaaccaaagacaaaaaccacatgattatctcaatagatgcaaaaaaggccttcaacacaattcaacagcccttcatgttaaaactctcaataaactaggtattgatgggacatatctcaaaataataagagctatttatgacaaatccacagccaatatcatactgaatgggcaaaaactgcaagcattccctttgaaaactggcacaagaaatggatgaactctctcaccactcctattcaacatagtgttggaagttcgggccagggtaatcaggcaggagaaagaaataaaggtattcaatttggaaaagaggaagtcaaattgtccctgtttgcagatgacatgacccagtcatcccattactgggtatatacccaaaggattataaatcatgctgctgtaaaacacaagcacatgtatgtttattgtggcactattcacaatagcaaagacttggaaccagcccaaatgtccatcaatggtagactggattaagaaaatgtggctcatatacaccatggaatactatgcagcgatgaaaaaggatgagttcatgtcctttgtagggacatggatgaagctggaaaccatcattctgagcaaactgttgcaaggacagaaaaccaaacactgcatgttctcactcatatgtgggaattgaatactgagaacacttggacacagggtggggaacatcacacacgggggcctgttgtggggtggggggaggggggaggggggagggatagcattaggagatatacctaatgtaaatgacgagttaatgggtgcagcacaccaacatggcacatgtatacatatgtaacaaagctgcatattgtgcacatgtaccctaaaacttaaagtataataataataataaaaaagaaatcttattaaaaaaagaaaaaagtgcgttgttataatatcatggaaataatgatattcattccgtagtgatactaagtgaaactcagccttctcagttacatacttggaaacttttgatgagtgagaagaactatttgtggcaagcaatcatgttctttgcatgactagtagcaccagccccatgataaataaatactttgtattcaatcctttatttgctggctaatgatttgcaaatcaagactattgaccatgaagatcctactaaaagggtactattccaagagcatagcttgggggtcattaaattctacaactttccccattaccaaaaaacaaaaacaaaaacaaacaaacaaaaaacaaacaaacaacaaaaaacaaacaaaaaaacagacattatgcaaaggcagtttatttcctgaatgttttccaaaaaatatgatattcttctaattcaacccttgtcagccccagtgaatgacagttcagagctgttttttctctgtcctacttagatgcaagttttcaggagagcacaacattgcccttagactagattcaaaattttgttaaggatgttgtgatttattattccggatgactcacatgaaacaatctcttaagagatgactcagtggtatttaaagaaatttcgttatgttaaccagaaacaattttgttggcaagagtacttcttctttgaactgttttataacattggctaacaatatattatctgtgaccaattgctttgtatgctctggtgctgctggtcctttaggtgatgcttacaaatgcagtgataatttattagctcaggccttactaattcttgatttgggacaatttccaaaagaaattaactgaagtttactaattcttatcactcaaagaaatggattgctgaacaaaataacagtcttagtaagagttttggaaagattttgattgagaaagaaaatatactggcacttaaaacatctggttgaaaattattattatcaatatctttacctgtaccttttaaattattggctgggtgatcttaatttccttttctgtaaaacagtgataatgattataccaatttcttggtatttcaacaccttcattcatgaaattgtggtactgatggagcctgcatcatataattattatgtgtgataatgggttaatatacataaagcgctttagtacctagaatatacaattcttccaaaagtttagctgttttaaaaagttattattagcaaggtgctcattactctttgttagtaatgtaagacattttttctgggccttgttcaaccatcagagaaaaattatagttataccactattaattataatggtgtgaatcaaatttatacaatttacagtgatataaataaatattctaaaataggcatttcactaatatagattttcttggattaatgaaaaattcgtccctctgttactgttcttatgggaaaaatctgaattgcacttactaattgtcccacaatttttgtgttttataaccccaattgtatgctggaaagagcatcaaaatgaaaactggaaaattacctattaggtataatgttaattattggggtgatgggtacactgaaggccaaaacttcaccatactcaatacatgcatggaagaaatctgcacttgtaccccgtaaatatctgtagaaaaagttggaataactgttttgttcctgataattttttctagcttcttaacccctttttcctcagagcccttatccttaactttggtaataataactatctgaaatattttatgaggataatgtaagattaactgttgtgcttctgattaacttttagacaaaagttttggcttaaccagcctaccttcctccttctgctgtctgcatcgggtgttgtttttttttttttgtttttttttttgttctttttttggtggagaggggcggtggtggttaacacctatacttggagatactgttgtaacgccaattgtcaaaaaaagtacacttttaatttttaataagtttcaagaaatgtatgcctggaattataaacttgaactgaggcaccaagacaaaaaaccgatagatgtttttatatctccaggggggcatctgatccagatcaccagaactgcacttgttcctttcctttttgtgtctagttcagtgacttccattgtttctgtttgctatgtttgctataccatattattccaaaaaactcctgtttttttgttttgtttttgtttttgtttttgttttggtggttgggggtgggtcatttacgcaaagttggtttctattgctttcaattaaaatccctaactgaaatagtgtccaaagatagtattttggtgagaaagttgtggttccaggaattgattgaatttagccttgtaaaagtcactgagcttgtcagaacttggcttccactgaagttagaagtgatttgggcttcttggttttggaagttcattctagctctaatactactgaaaatgtttatggtataaaatagaatattaaatattatctgaataaactaaaagtatttatatacatgagcaccttactaggtccatatcaacaattacagcactttcttgtgctatgttgttagatcagcagagcacagaggaaatgcatttgaagcaatggcttgaaacagtaagaacatagttacatcagattacaggaacaatatggctgacttttcccttttgaggggaaaaaagcctgagggaacattattgacagtagcaaataaaactttcctgcttctgagattttattttctcttttattctcctacctacactgtaaaagagtagttaagacaactaccaattagttgtcagttcagagcaagcacaaagatggaaaaccaaccctaagatgcccatagtactggcttcaaaaccttctaatctcatcaaattgttcataaaagtattattaacctagctggttatcaatcttggtcttcagagctattgattttttttttttatgagagaagaactatttcttttctagggaatgagttgttacttgaattttcaaatgagactcatttttatttactttggcaggcacttccagcgttgtttcagaagtaagttatttcagggagggagatgaaatggggagatacagtcatgcatatggccttttactaagattcactttaaaaatgaattttataggttcttaaaagggaagtatcttaaaattaaggatagtatttatttgttgaccaaggttgctattaatagtacatctagtaatcaatgatgtcttagcacccaggaaacacaggacacaaatatatgcatagatagataaatatataactatacagctagacaatatatgtaatccactgctatacacacagcaaactactaggttagtacgtttttggaaatcaaaaattaaaactatgaagtagaacaaaacttccaaaaaatagaacgaatggaagttctacatcaatgaatcctgatgagtttatttgaggcaccatcttagaaggaacgtcatagtttgcagaacttataacttgaataatatcaagggctcactagataatcaatcacctaagttgatgttgatgttttagtaacattggtgtttagtcatattacctctagcttgaaaatgaaggtatgatcatctttccttttggctaaaggatgggatatgctgaatagttaatgaaacattattcatcttatgctggagttagtgaaccagtacatcttatactttatttatgtattgaaaccaaaataagaagaggacatcattaattttaaggcagtctttttttataggttagttctatagcaaaattatggaggacaaaattttaacatggaattaatattttaaaataagtatattcatgctaattttgaatatttgttgaaaaaaatttgtattttgagaaaatatttttttcaaagcttttggtgaacatagcttttggaatgcttctctatgtagatattcttatattctggtgtgttctgtcccacttaacctgacgctacacaaccctgagttgaattagaaaggaaaattatttctgaatctgcacactgccctggaagctatcagctagatttttccacaaatgactcactaagaagcatagaaaatgatggtgcgcatgaaaaagaacaattgttccatttttagaagaatgaccaaaaggttcatctaagtggcttaattttgaaggcagaagaattaaatgtctgcttgtgatcttggctctctttttaccctcaacaaacccttggaatgctccctgatgcctttcttaatgcaggtcttggatcatcagatgagagagctataatggtgactaaatctttcatatcctcaaattattaatcactgacctgccatttcttataaacagatattataaattacaaaatattatacattacaaaaaggtaaaaataaaaagatacaaagattttagtcagaagttcttttcctgtacttgacatcttatttaacacaaagttgcacatatggacaaaaagagcttaaatcttggttttggaaatgaaataaccatgtaaacatgaaactcatcaagtcaacattgtctaagaaatgatctagggccaataataagaaaattcagttttaatttataaactcaaaatttgttttagaacttttttttttttttttttttgaggcagattcttgctctgtcccccaggctggagtgcagtggcatgatctccactcactgcaacttccatctcccaggttcaagcgattcttctgcctcagcctcctgagtagctgggattacaggcacatgccaccaggctcagctaatttttgtatttttagtagagatggggtttcaccgtgttggtcacactggtctcgaactcctgacctcaggtgatctgcccaccttggcctcccaaagtgctgcaattacaggcgtgagccactgcacccagcccagaaccatttcttatggttctaaaaccattataatgctcattatgaatgtatcaaggtgctgccacatcagaaatcatccacaagaatgttaaataatgttcggtccaactttaacaagaaaagtaaggaagtgaatatatttcactaagatttggtagtcagggttaaaacaaaaaggatattctgattaactgctagttaactagattccttggtttataagcatttttgtttttatattgcaatttaagaatttacttaaatgttagttggtttaacatttgcttaaatgttagtgtaaaagtcagtgctgaagtacaacaatagtagaaattcccgtaagacaacttcttaaaatttcagttctgtgtcttagttatcaagtgattctgggcaagcaatatcctatcttcaggtctctattttcttgtctgtgaaatgaaggattagaagttacttccaaattctaaaattataagactctggataaaagtgctccacttttataatcttttttcttatgttactgaatgtcactgctttatagagactgtatccttttcagaacaggaatgagggaggcctcagtttttagcagctagagcaatgctagtgtgccaaaagtgtggagtaaattttcttgtcattagttttaaatagcaaggctctagataagattttgtattttatatacttcaaacacattaagcttttacttcctgttaccaaaaatatttcatactttataaataaaatattattaaatacactgaaaattttcacggttcatttagccaatgaaagaaatcagttttgtatgtacaagaatagcttttctctgactatcttgcttgtgaaattgaaccttcttactttcatacattatttgtgaatgaaatcaatagaaagcctaaaatccaaggggcggaatactttaccaaaggaaatttcaatacttgtcaaacataaatgtaagacaaaaacactactttaggcttatgtaaaattcaatgaagccaaatgagaaagactgaaagggagaaatgaggttaaggaaagaaaaacccaagtgtgttagctgtgagcagtctattcaatagatgagactggcactggtgcaggctatctcttctcactgccctctctccttgttggtggagcttgactgcagtatgcagctagtgaatagctcaaccctttgataacaaaacttgagaaaggcttctgggggcttttgggaaatatttatctcctgaaaagagagaaggaaaggaggagaaagaagagagtgaaggggagagggggagagaaacagatacacaattctcttaagttatgttttatctacgtgagatttctgaaattgtggcaatcatcttgcagcgtaagtagacaaaacaaagaactaagacggtaatccagtggaatggcagagcaggaagataagaagcctggatccctggatatttgaagtagtccctgaatgacctgcctttggctttgtgttgtgggagataattttagttattttttaagctattctagttgactattgtgctgcttgcggctaaaaggggtttaattcttctatctctagctacttgctcactctgggtatcgtttgactttttcccatggagcacatccaatatttactcctctaagattgttttaggttgggagaactgggtgacttgttggaggtggaggtggccttttagttccaagttttactccctgttgtagcctgaaatagtggttttggccactctgaaagttcatatacctgtactcagaacatttaattggatatactataaaataaacaaaaactaaagctcaatgattacaattgtagcaatagtgttattatctgtaatattttgtagcggagaaaatgagagatgacattctctgtgattagtaaccagtgccttaaagaaagtgagtaaaatgatttactgaagacctaccattaattcacagcatattatcatgaatgagtcatttaagttgttgtttccacattgcactactttgcccttgtcggtgctgattttgtttgttgtcacattagtcacttgttcagttatttttggttctcttaaattttctaataatccctaatagagtttagtcagctaaatacttttgttggataatatatgcatgaacacatctgagagttggacagaagaattttaatttttgctaattagtgtaaaactttacttcatttttttctcagatcagttaatatttatttttgcatctcagctgattttctctccagcctttcaaatctccattttatcaactataataaaaatatctgataattctagtttttgccacagatactttattcactcatttaatcagaaatatatttcaagcatctaatttgggctaatcatatcagtactgggacatacaatggtggagaaatgaaatttattttctgtcctttcagaacatatagtctagtgtcatttagtttatatcagggttttagcatgattttatataactgatgacaaatgtacttttttttagaaataattgtctagtccctatggccatagtctctcctcttaagtcagttgtagaataggcatgagtaaagcccaatttcaaattggtataaaggaatgcctccattatggagaagaaagcatgctgtattcatctgttctcatgctgctaataagtacctgagactgggtaatttataaagaaaaagaagtttaatggttggagaggcctcacaatcatggcagaagatgaaggaagagcaaagggacatcttacatggcagcaggcaaagagaagaatgagaaccaagtcaaaggggtttccccttatgaaatcatcagatctcatgaaacttgttcactaccatgttaacagtatgggggaaaccacccccatgattcaattatctcccactggatccctcatacaacacatggaaattatgagaggtaaaaatcaagatgagatttgggtggggacacagccaacccatatcacatacaaataactcacttttacagtttacaacaaaacaaaacaacaacaagaaaatattttctgtccagaggaggcataagtatgcattttaaggtatcaggaaaaaaggagagtgttaagctaagcagatgaatatgcgtttatctttccatttgacctttcagcagtatatggcacagttgaatacttcctctttctttataactttccttggcttcccctacacaaaattcttgaattttatccaatctctattgctattatttcttagttattttgaagatcttctttctttgatggattttttatttgtttctattttacaccctttacaaacaaaaactgggcaatgttgtcccttcccatggcttcaattgctatctaaaagttaatgtttcccaagcttttacttagagtgtgttgtctctcctgaacattagcctagacccacaaattccactgattatttgatatcttaacttggatatttgtctggtcactgaaaagtcaacatgtttagaatattttctctaatctcttcttcctcttatgcttttatcaaaaaccatcacctttccttctttgaaactggcatccaaaatgtcaccaactccctttagtactatctctaacattactcagtttcaaccactttcctccatctccgtcttcagtatgccaagtcataccctgaatgtcatcactcacctgaatgaccagactagtctcctagctggctagtttccctaatgctgctcatgattctctacaatttattctcaacctggaaagctgagtgaacttactgaaagacaaacctaatttactctcttcatgattaaaaccttctctcataagttaaaattcatcttcttaacatgacttaaaatctggcccttctagtttgcatctttctctgccatccgcaatagcaattgtctgaatgtattatattacagtaccttgcatctcaaaatgtgtgtgtgtgttttcttgaacatttgttttctttttacctagatagatgctgtatgtgcttcaaatctgtttctatgttaaagtttcagaaattcttcatggattatcccgccaccctcaccttcatgaagttgggtttgtgtgtccttgcaatgattctccatagcagtctctactcttagcacagtatattatagtttctgtatttgtctttgtaccgtaccaaacagtattatctaagagagcaaggaataggcctgaatcgttgaatattttacccccggcacaatactggcacatgatcaatacttacccgttatttgtttaatgaaacaaaattaaatgaaattaattattaattcaaatacagaatgattaacagaatcatgctaacattgagatgtctttccatttttgtaatgttgaataacatttcttttggcatagagagttactaaaaagtgtcaaactcaattgttgaattttaaaatctaaaactcttgaatcacatttgtgtttttttttctttaacctatctctttctctcatgtttattaagtctgtgatttttccaagtatgttagttggaaggtataaaataatctcttatgtctgtttttatccctagcaaatttttatactcagtgatccctaagggagagttcctagtgtatagaaattatgttaacctggactgccattttgttcttttaattccagatgaagtgtggctctcaaatttcccacagaaagagaagagaaagaaaatatgagagatgaaggaaatggactagaagcagtagtaagagagtttagcgacacaatttagatgatgatgtgctatgacattcttccttctcctgtgtttcttgaccctctgtaatccataaacctatacccatatcagtagtgactctgttcatgctgaaatttagacttcccacatggcctagggcagtagcttgcaaagtggttcacagagtgaccgtggcaggtatgtgtaatttttaagagtttcctgaagagtcctgatttgtagccacttttgggcaccattgaccatacagtctcttctctgcatactgcagactaaatttctgagccccagttgagaaatgtctgaaattttttgcacaggtcacttagtctgtacagttttggaattataagtttatataactctcaatctatagaaaagagaattctatatctaaaaatctatatagaaaattcaactaaatatcacaaacttaaattcaactaaatatcacaaactttataagggatgttctataggatttgcgatctttttattggtgtggcagtatatatatatctacctgtcttattttttctagtatatacaaactactttaatatgaggtgtactatcttgttctttttgtatcccaatatatagcagaattcatggcacacagtagatacccaaccaaaatgacttttaaataaaaggattaataatttttctattcatgttcttatcctgcttcatacaaggctctttacctatattatgccatttgggccttcaagctcatctgaaaaatatatactaagtcatcactgctagtacagggctttccacattaatcactcactcttatgaaattttgcaatgttctctttaccaaagttatttaagtgtatgtccatatatcccataaattttaaaatctcaagggtagtaatgtgtctttgaacccccaaagcacaacccctctttaataggacagattctactgaattgattcatcattaaaaaaaagaagccaaagtgggtttggtgccaatccataaaatatgactgtaattgattgtctcttgtagacctgcctttagaatagttctttgtacccattatatgtccttctctaacattcattattggacaacattagtccttggatggatcactgaatgctataatcataagtaggtaatgcattttgcactcagttgttcattatgctttgataatggaaaaagagtttctttaaagtcggaacgaattatcacaagtggctctttttttcccaagtgccaccaacactcaattaccctggaactgattctgtagttttcaggttatacaggccattacctcttcccctcttcttgatgtctacctttgcaccatttcactgctcattagtgtctggaggaaaaaaaaaaacacttgagaaggcaaggaaggtgaaatacaggttggtcattttgtacttgttagtagccgtgataaaagggttttgtgggaaatgtgattagtgaaaagtagtgggatacagtctggactgtgctctctatatgtgggtcatatttcaatcttatatcatcaattagcttagaatatttagaatttgcttatagtaaaagttgtttaaagacacaaaatctctctcctatttttttcataaaataatttaatgacacactatagatgtgtgttctttaatatgtgtgacactaagtttgtgctatttagtacatttaaaaatactatatttgtgataggtaggaccatcctagaacccatactttctattgcactttggaatatttggttagagaatggtgaactgaacagagctgccattcttgacatttttatccaaagaagctatcttttgctccaaggaactatgtttcatcttctgaaagtcccaattataacttagttttcatgtcttcctgcaattagcatggataaaatacgttgtgaattttgattttggacacaaataaagaatgtgcttaaataataattaaatccatgtgtcttcattcattttgtcttctgactggagagagggaattcctgtgtctctttcttatagtctgatgtaaatgatcattgaggtgacctttatatttagcaaaaatgggagttgaacatgaatggtaggtgtagtttatgattcatgagataatttaagaagaaatagtgaataaagcagtgactacctttttctctgtaaatcatggaaacaaaaacatggggcaaatttattttcttcatgtttggattctgaattatgaaatcactgctgtgttgtaatatagatttttctcttagtcatcattgtcctttaaagttcattttttataattgaatattctaaaatgttgcaccacatccttattgaaaatgttaggaaaatgaacagaaaatattccaaaaatccatgcaactcatttcttgagaagagtcactaggatttttttttttttttttttttgagacggagttttgctctgtagcccaggctggagtgcagtggcgcgatctcgactcactgcaagctccgcctcccgggttcacgccattctcctgcctcagcctcccgtgtagctgggactacaggcgcgcgccaccatgcccggctaatttttgtatttttagcagagatggggtttcaccgtgttagccaggatggtctcgatctcctgacctcgtgatccgcccatctcggcctcccaaagtgctgggattacaggcgtgagccaccgcgcccggcgagtcactaggattttacaaggtttatacttctctttggaaatgctacttatatttctgtttccccagatacatggaaatgtaagtggatggtctcaaattattttttaacaatgttttgatatgttctgcttaaacagtagctttgctcctcttatcttttcctttctaatatattaaaataagctcctcaaatatttaagttctctttttatttttctattttatctgttataatttgctctttgcagagcttgtctgctttaaaaatgtatgcattgctcttttatatatatatatttataaacactatatatttacacacacacacacacatatatatatttatacacacacatttatgtatttcaggtagtttgagataatctgggtttatctcaagcctattagttgtaaagtaatgaacataagcgctagaacttatacagatgagcaagtcataaaaccaagtgtcaaacttaaatagctaggaaacaaagctcttcattttcttttcatgaggactaagctggtaatcagtgatctcctctaactctttttcctttacatgactggaacagtgatattgcacatcttaggttttcctctctcctttttcatattctatccctgttcaacacatttttcttcaccaccgagttcatatggaattcttcctcttaacatccacagagcaatttcactttcacttgatatactgtttgtgtcacctgaaccttaacttattcggtcttatatttcccccttaaatgttgaggacagcattccttaaagtgttctatagaatagttgttctataatacagtctcgtagcaaacagtttcaaggctaaatttgacaagtgctgtatactttatacgtttctttgacatttataacaaatattagcataggatctgaaacttcctgcaacaaatcagtctagcttaactttataacaatcttcattttatgttttttttaacctttctttttctaaagcatctgataatgtcttatgtagactttggtatatgctaattttgagtgtggtaaagaaacttttcttaattatcagattgattatttcacatatctatgttaaaagttagtgtctttcacattattttaatataaaaaatacttttcttcttacaacttgatttttaccagactcttttaccaaatagttataaacatagcaactccacttttctcccaatgaataggaagggttgtcaactcctctggcagatcacacctaaactggtagttctttttaattaaattttaaatttttaatttctgttggtacatagtaggtgtgtatatttatgaggtatatgagatgttttgatacaggcacgctatgtgaaataaccacttcatggataatggggtatccatctcttcaagtatttatcttttgagttacaaacaattcatttattcttttggttattttaaaatgttcagttattattgatgaaactcactctgttgtgctatcaagtagtaagtcttatttattttttctaactttaaaaaaaaaaaactattaaccatacccaccttatctccagccctcgttacccttcttagcctcaggtaaccatgcttctactctctgtctccatgaatccaattgttttgatttttagatcctacaaataaatgagaatgtgcaatgtttgtctttccgtgactgacttattttcacttaacataatgacctccagttctatccatgttatagcaaatgaaggatttcgttgtttttatggctgaataatattccactgcataaatgtaccacaatttctttatctattcatctgttttggacattttggttgcttccaaatcttagctgttatgaacattgctgcaataaacataagagtgctgatatctctttgatgtactgatttcctttctttagggtatttacccagcagtgggattgctagatcatatggcaaatctatttttagttttttgaggaacctccaaactggtctccataatggttgtactaattgacattcgtaccaacactgcatatggtaaactggtagttcttattaagaattaggtaactattttgagagcaataaatattcattaaaaattgccatttttaacaagagcataattcaattattaaaataaaacaaacaaaatgccaagcagaagttattagatgcagtaaggagaatggtctggcgtgaaaattaagggaaaaaaatgaagaaggtcaaaaatgaggctattttaataatccaggagaaagtttcaggttgtgtggaataaggtgtaggtgacataaattgaaataagtgaatagattttagagatgtataggaggtaaaagaaacagggtgaagtaattaaatatacagtaatagtaagaaagataaaggtggggtgctactatatttctagcttgaaaaagcattgattcgaattagagaagtactgggattggagggggtatggcatgcagaaaaccgtgctttaatttttgaccaagttgaatcagagctgactttaagaattcagggtgaagttattaaataggcaatcagatatattgaccatttttttctcaatagagaaaaaaatgaaaacaagtgaattcattagaatacaaatggcagtttaagtcaggaccatgtgtgagattatttaatatttaaaaataaacacataaataattttatttattttttaacttcattttcttttcacatgccatgagattattgagctacactaacaaacaccaaatttcttgctgttagtaactaaccttctcctatgaagatttgtattcagctaagtggtaattatctcctaaaatacaccaaaatgtttctaacctggtgattttaatgtttcattttaatacttgttatcagtgcattcagcagagatgattgccagttcctggaaataagttttcatacactcaaacacctttgctctgttttaaatctaatttctctatgcgtggactatctatgatgccctcttgcctactcaaggacatcattacggatctattctctctttttttgcctacattatcattttttttcctctctacttgatcagcatatatgtggttttgcactggattgatttggctaagctgtaaataagtttgcaggttagtgttgatcaagagaaatttgcttgagatttggaaggttgaagtgatgcataagatgttattacctgaaggtcagtgggaataaatgtggtgaaagacatgtgcatagataccagtaggtttcagatttcctcttctcttccttgttatgtgaaacagatgcagaggttctggtaggtttcagcttgactacatcttctcttctaagcacttctttctggctaccagccctgttgaccaccagtagcctcaggcccaaaaccatgtgcaaaagctgtagatttcataatcttctccattagctctctcttgtggtcccactcaaacggctggatgtgcctggctttccagatttcctctcaaattctcagtgtccaaccactccagtattttggaaggctggttagttatttagttactttcattttaccctccaactccccttttggatgcctccttcctcagattcttcataaatatgtaaagttttattcctagaatcatttattatataatattcttagtagttttctttccctgagtgaatcgcgattgatgaagtatataattatgttgctctagtattaatggggagaaatgctgaattcctctgccagttaccaccagctttcattacttttccttgggtcaaaattccttaaaattgtttttatacttgccttctccaaatctcttattctctcctaacccattctgattcatgtttcatttctatcgtatcacataaatagttgcatcaaggtcaattatgatatccacatttctaaatcaaatggtcaattttatgccttctgttacttgaactatcagcaacatttgacaaagttgattacgccatcctccttggcatactttattcacttgtcttctagaatactgtacttttttggtttttctcttatcttgactattcctcagccttttttcccagtttcttttgttctccacactctcttaatagttgagtgcctcagggatcaatccttggtcctcttatcttctctgtgaaggttcactcctttcgtgatctaattctgtttccttcctgtctacttacagatgatgccccaaattttatatccaacccagaatatctcaaaatatagactacatactcagcatctccacttggatatctaacaatcaactcaaaatcagcatatcccaaacccctatttggactatttttccaaactcagatctatctgcagccttctccattttgtttgatggaagctctatcccctctgtcattatattcaaaaagtctagattagtcatcataactattccctttctctcacatctgaaatggctagaaaattgtgttgactcaactttaaaaatatgtctagaattcaaacacacaccctaccactgctcttggtggagtcaccatcttttcacctgaggttactttagtaggctcttgtcagaattctgacaattcttacaaatttgtctatctgcagtttattataagcacaacagccatattcacccttaaaaacataagatacatctctcattcccttactaaaaactcaactgatctccattttttgttaaaataaagctaaaagtcttacaatggcccacaagatcctacatatagtgaggcttcctcacttatctctttgcgctcatctcctacttctgtgctacaacgtcatttccttctttactgttcctcaatcatgctaccttgtggcttttgagtcaattgatattcatttctcttaaaatatctatttgtttaacttccccacctcttttacacatttacagaaatctgattttcttaataacaccttttctggcaaacctaatgctacctaccctgtcccaatgctgacacttgaatgtccctttcaactagtcaattttttttctttttatatagcgtttatcactgctaatacaagatttaatttagttactcattatactttctaattttctgcctatctcagctaaatattaaattctatttggatagattcttcatctatcttggtcattgatatataccaagtgcctacgatggtgtctggctccaaagaggtactcaacaaaggtatgccaccagatttttgttaaagccactcttaaatacagcagcctttggatattagctctaatactattttttcttggtatgtaagagatataatgcaatctctattttctgtatcttttgcttcttgatttgtgaagttgtcttctatgtaatttaggaatgctttgacattgcttgtttgtcactattatcctcaccctgtcaaaatacaggagagttggaaatctcctttgaatatgagacagaacaatttagaatatagaaaatgttgacttacaggttttcattgttactcacctttcatactgatgttcctttcctatggctggccgatagccatcatagttttttcggcatttttttattccttacattattagctgaagtgctttaccataccactattcattgtcaaattgtatctctctgatattgtaaatacttttgatatataatacactctcctgccattctctttgttaacactccaataatggaatgaaccctcgaggttctggttatgcccgctaggttatgacctcctctccatgtaagcacttgtaatgttctcaatcacatgccatatgccatacatttatgctttgccacctcagtaaatgaataacatttgtctctcaatgcagagaaaaaattataattctgcattattttaaatctagaaaatatatagctatatatttgagtcaaatatctatgacctattttacctagagcaaaaccacttagtgtattttaatatttctaaacttttggagagtaagagaagaacattgtaaaacaggaaattttagtaattaaaactaaaatgacaaattgggaatattttaattatttcataaatatgaattatatggcaaatattttctaagtggtaatgattattaaaatgaaggtgaacattagaattgattaatctctggaggggaagtagaaaaaaactctgatagcaccatacacagactctaatcattctatgttggacgattcttatagttctttttttttttttttagacagtctcgctctgtcaccaggctgaagtgcagtggtgcaatctctgctcactgcaacctccgcctcccggtttcaagtgattctcctgcctcagcctcctgagtagctgggattacaggtgcctgccacctcacccagccaatgtttttgtatttttagtagagatggggtttcaccatgttggctagtctggtcttgaacccctgacctcagatgatccacctgcctcggcctcccaaactgctggaattacaagagttagccactgcccccatccatagttcacatttttaatgagccatttcttttccaaccttagcaatggctgctgcctcttacattgcatagttcagccaggcccagttgctctcacttcctccagtagacctggtggtttcatgccagacgttgttcttactattccaaataacctttctgactttacctgcaattgcccccattgtgtctgtttgttagcacttatttatcttttaaatttaagtgttgcctttttttttcctgacttctacctgggaaaagtgttaattctttcctttggaaactgcacataattaactgtataatagtgagtgcatacagcttatttctttttcccaactagactaaatatcttgaaggaagttgcaatatctttgtcgttataatatgtccagaacatagcacatgcaagatatggtgtagttatttagttaaatcttcaggtgactgatacaatggctgaatgagaaaacattgaaataataaagaaaataaagaatacgtttaacaattctgggttgcatagagcagactggatgtgattgatacaattagcaatggctttccattaaagtatacaaagatgcaaaaatggtcacagtattttaaagtaaattcaaataactatctagaaagaaaatggggaaactgtgttgattcttcactccggtctgaggtctaaataaaaaaccccaagatgcaaagaaaccataacctgataaactaagcaagctttcaattcactggaaactatctttggtttgaaccaagatttctggtccattattagcagcagcttatttctgtctgtattcatttaaagactaacctcccagtacaaaaaagataaagaagggaatgagtgagagcctgtatacttggatgcttttttaaaagcattagaagaaaaaagcttcagaaacagggatagaacacaaggtgttgggattacatatgccaggatatgtcttgaatgttttacgtggctaggagatagagcaactgcattttattctctagcttcattacataaactgccattctgagccaaaaaaaaaaaaatccacttatagttttgtggaccaagagttgttgaatgtttgttaggtctcataaactgcactagatgctatacagagcaacttgacattcagattagattataagatccagaaactgtcagaatgtctcctatgtgaagagtaagtgaacaaatgacacttcactcacacttttgtcctcggaccctaagctgatacagattttgcccactcaaagagatggaaataagacctttaaaaggagggggatatgctaacaagagagaaaaacaacatttccctgaagacaaaaaaaaaaccccaaatatctgaaaaatgactttttatgagaagtaggtggagacttgaggagacatctgcatgggggaagatctacaacatggagtagacataaatcatggaggagaattaacttgagcatcagagaataaatcttccctctcgttttaaattcaccattgaatgaacaaaagaatataaaaatagaaggaaaattcagcatttttaaattttattttattattattatactttaagttttagggtacatgtgcacaatgtgcaggtttgttacatatgtatacgtgtgccatgctggtgtgctgtgctggtaaaattcagcatttttaatggaaaacatgggaggatgccatctatatgccagaaaccccaaggatggggctatattaaatgaaggcaatggggagatccttacaagccttttctagggaaagtaatatgggatgataagaactaagcaaagatggtcatggcacaaacgaattaatattttcctaatcagttatattaagactgtagttgaaaacaggttgttaaacatgagagaaatatataaattctttatgactatagaatagcagtattcagaataggttacttagagaaaacaagagcaggcatgtctgtttcaagcagagtgattacagggtatttccagacatggaagcaataggagtaggagacagagacccaggaagttggacagacaccccatgtggaaaatggagaatagagcagagtgaaataattttaaaagctagctcctatcacagaaaatttacccatcagaaaggacaatatgactatgatggctctaaatgaggcaagcagttttctcacaaaaggaataaacttgcattaagccagttctcagctagaaatctgaaaagagctttaaatagcttctaagaaaacactaagaggatcaaagtaaaattcatctttgtaactgctagtctagaatgtgccttctcttcaattatgtgtaaacaaaacaacactgaacagaatcttttatatgaaagataaatgtaacacatgaggtaaggaaagagtagttttgaggaaaaaaaattacgagagtgaaatattttaaaagaaatttcatgttgtgttcttaaaataattttaaaaatatggactctgaaataactcaggttcagatcaagaaaaagaaaaaatacactagtagatagctttttacaggaaagaataaaaacaaaattgtaatagcagaattaaagactgaaacagaaacaataatggttaagaaaatcagacaagttatatgtggatggaaaaagcttaggaggctttcatagaatgtataaggaaagaaataaagagatgaaataaacaaaggagaggctgaggaagaagcagagaataaagatctaaaatatgaataattatttcattctgaagaaaaagccaaagtaaaaagaacagaaacaatataggaagaaatactaaaagaaaaatttccagagattaaaacaaacaaaaaacaaacttagagaggagaaggatggtttctacaggctgggaagggtaatgggggagggagttatggggaagtgggaatggttaatgtgtaaaaaaaacaatagaagtaatgaataagacctactattcactagcacaacaaggtgactattgtcaaaaataattttttttttgtttttttttttgagaggaagtcttgctctgtcgcccaggctggagtgaagtggtgtggtcttggctcactgcaacctccgcctcccgggatcaagcaattgtcctgccaaagcctcccgagtagctgggactacaggcacgtgccaccatggccggctaattttttgtatttttagtagagatggggtttcactatattagccaggatggtcttgatctcctgacctcatgatccacccacctcggcctcccaaagtgctgggattacaggtgtgagccacggtgcctggctgtcaaaaataatttcattgtccatttaaaaagaaataaagagaataattagatttttattaaacacaaatgtttaaagtgatgattaccccacttaccctgatgtgattattatgcattgcatgcctgtatcaaaatatctcatctaacccataaatatatttacctactatgtactcacaaaaaataaagtaaaataaaatgataaacaaacaaaaaaacccagatcatgaatttgaaagcagttcaccatatggtagtaaatattgattttttttaaaaggctacctatgccttgaactattttactaatttgtttttacttctgggttttaaaaattgtataatatttatgcagaaaaaaaacaaggaagaaaaatcggagttgtaagtttggtctaatacctatttggaaatatgagaggtatcaagtaatatataaatacttgaaagaataatgctgtgaacaacaacacaatatataattaaagtgtccttatatgtgcaagcatataaagacatttttctttttggaggtaggggagagtgtaacctggaattgtaaaccatttactatcagtaccacaacaagtagcagaaagcaaggtagacaaagttcaaatatactccctttgtatttctgttctattattttattctatctatctatctatctatctatctatctatctatctaatctatctatctttagagacagggccttgctttgttacctgggctggagtgcggtggcaccatcatagcttactgcagcctggaactcctggactcaagagatcctcccatctcagtgttccgagtagctggggctacaggtgcatgccactacatagggctattttgaaattttttgtagagatagattcttaccatgttccccagacaagactagaacacctggcttgaaggaatccttctcctttggcctcccaaagtgctaggattataggcatgagccaccatgcctagcctggttatattcctttaaatccaacattggtggtactattgtttatgacaattggaaaatttatacagtcaagtattttaaaatttaatagtaaatacctggagaattaaaaataagataattacattgtaaattactacagtaaaatgaaagggcatcctccacacatgctgataactttttgccaccaacacccttgtctctcatgtttgccccccttgctccatggttttctctggagccatgggaactttctgagtctacacgtaaggtatcctgagcatgccaggaatgtaacactctcagaaacaatccttattcaatgagaaatagaaatcagtggataaaatcctcaacttccttgtccctcagtgaaacaattctgagatacagtcattatcttcctcagggaattttaattaggattgagcctcagatgctcacacaggtactttctgctttcacctgactgttcccggccccactttgttccttctttccttgtactttctgtgatcacctcccaaataaacaactcaagggtaccttgggggaatctaaagtaaaacatagaaaatagaatatagaaatcaagaaagcattttaaaaaggaaaataagataaaattaaatttattttgacaataatttaaattctctcactggaaagatgttcagattggatcaaatttcacactgactggaagagacagtactaaaaccaactgacaaagatagcttcaaaataaaagagtgggcaaaattttgattaaatacaaggcaaaataaggatttgttaatataaatgataaagcaggcaaaacagacctttttatataaatattagttaaatctaaaagttttgtatcagacatggattcatgtctgatagctttcaatagcttattactactttcaatagcttactgctatcattaaaaggaacaataaattaaacattcacgaacggaaggaataattttacagattgaaaaggcataaactaccaagttatatatttgtagataacacttactggtatattgacatttgagtatgttagaaatgcagtaacatcctagatccttcaatctattaaactttaacaatattaaatggtaaaagaaattatactagtccattcaggctgctataacaaaataccataagtgggtgacttataacttacagaaatttatatttcatagttctggagtctgggaagtccaaattgaggcagatttggtgtcttgtgagggcttactttctggttcataaatcacacctagctgtgtcctcacataatggaaggggtgaggaagctctttgggcctcttctataaggacactgaccctatttatgatgcctctaatctcatgacctaatcatctcctaataccctcaccttgaggacaagcatttcaacatatgaatttggggggacacaaatcaggaacaagctatggattcccatcattatacttttcattaaatgtcactctgaaaatttttggttcatatggaaataaactattaggaaggtttgcactgcactgtttctcaaggtagataataaaattgcataatacaaaacaaaagacagcaaactgagaagctattagaacacaagtaaccgaagtgaaaaaaatttgcaaatattctaaaaataaaataaaaaataaaattccattcataatagcatagagaccttaaaatatttgttactgatatgaggaaatttacaaaaaaattattattgagtgacatctaataagacatagaaaaattatatcatactttggattaaaaaaaactgagtcttgaaaaatttcaaaaatccccaaatgaattacggggttaacatatttaaataaaatttattttggaaattgaataaaggctttctagattagtttatctgggaggaccataaagtgtggcagaactaagaatttcagaaaaatgtttaataatacattctactaaaaatataaagtgtgtcatattaattaaaagcagcatagtacaattttttaaaatcagactattttgtatatgaatttaagtgtcatcaatatgcagttagatcaataccttaaaatacaaactaagtataactaagatgaagaaaagaagtattttaaaaaaaagtaaaataagggactcaggaaggataggctaaggtcagcaaatgtaacgttgttgggtgatatgtgaagctgtttctgcccctttcccaacaatgcttggtggcttgtaaggctgaggttaagaacatctgaaagcaggttattagggaaaactctgagcactgaactgaatatccgtttgctgtccatcagcatgaagccttgtgtgttgtattgatgacacgaaatggaaagcatctcaagctatgaggactgaaaaagaagccaggaaccatgaagttcttcaggttggagcacattgtttcttctcattagggcaaattatgaaaagagtaggaattaattttccagcattgtgtataaaaagaatttggtttagaataaaatatcataaaataaatacacagcaaaaattttaacctttcctagaactaaaagatttgcatttctggaattataagagccagccaaatgcctagcaaaatgaagaaaaatgttcactcttgtgaattcttagaataccaacaataaagagaagatcctaaagaattctggagaaaagtcaatcaagcaatcagacaaacaaaattggattttatgtaaaggatgaaggtcacaatggcattgaatttctcattggcaaaactggagagtggaagacaatgaagcaacattttgaaaatctgtaattttaatgaatttcctctggaagctcatccaaaaaatgggaggtaaagaaaggagagaagggaagggaatttacagcatgatgttgaagggaactcccaggatagtgattatttggaaggctagagtgagagctattccaacaggatattggaggagtccagggtggatgtttcaaaaggaaaaaaatctccaggtgtttggccaaatggaaataagtcttagtgttctgtatgagagtttggggataaactgaagctaaatacatagaaaactaaggaaacagaaaatgagataattattatatccaagaaaaatagagagaaattttttaagagcataaatataaatctagtgtacattttgcctcataatagttttcagtcacctggttacataaatatggataccaaacactgatttaaaataatatttgaggtgatagatatgctaattgaaacattacattgtatccatatataaatacaattatttgttaatgaaaaataaaacctttaaaaagtttttacctaaaagcaaaaaaaaaaaaaaaaaaaaagcaatgctatacaagtatattgagaaggtaggggatgaaaagtgtgtatgctagaggaggtacaggagttaaatcttaacattttaatgcatgagttaatgcataattatttttaattttaaaaatatgaaaatattgatttctctcacacacacacgcacgcaaatacacaaacctgttaaaactgttgaaggctattctccctgtagaatgagatttaagggtaagtagggtacaggagtgaggattgtgggtttttttttcgcatcatacattcatatacttttatcttgcataaaaatggtataatttgtatacattgttttatatgtctttttctgtacttaaaagttttagattaccagaacacacagctcctctccttggtaaataacctagggaaaaggttaagaacctaagtaggtgggaaatacaatttatactgtcaaggatacctgggcataaatgcaaagggatcatgacatcactcccaccttgtgaagccagcttgtccattggcctggtgggcaaagtgggcagggagatgtgggtggggggtaggaggtagactggaagaggaggagacaccttggaagttatcaatgagggtgtttttttttcttttctcaacttttattttaggcttagggtgtacatgtgcaggtatattacatggataaattggttgtcactggggtttgggatacaaatggttttgtcatgcaggtagtgagcatagtacccaataggtagtttttcagtcctccccactccactcccctctacactctacactcaggtaggccctggtgtctatttttcccatttgtgtgtccatgtgtactcactgtttggctcccactcggaaatgagaacatgcagtatttggtgttctatttctgaattaattcgctgtggataatgatctccagctgcattcatgttgctgcaaaggacaaatttcttttttttttgtggctgtgtagtgttccatggtgcatgtaccacattttctttatgcagtccaccattgacgggtatctaggttgattccatgtctttgcttttgtgaatagtgcagtgatgaacatgtgtgtgcatttgtctttatggtacgattcctctgggtatataccctgtaatgggattgctgggtcaaatggtagctgtcttttaaattctctgagaaatttccaaactgctttccacagtgaccaaactaatgtacattcccactagcagtgtataggtgttcccttttctctgcaactttgacaacatctattattttttcacgttttcataatagccattctgactggtgtaagatggtatctcattgtggttttgatttgaatttctctaatgattagtgatgttgagtgttttttttttcatatgcttgttggccacatctgtgtcttcttttgagaagtgtctgttcacgttcatgtcctttgctcatttttttttttttttttttgaaacagagttttgctcttcttgcccaggctggagcgcaatggcacaatctcggctcaccacaacctccgcctccccagttcaagcaatgctcctgcctcagcctcccgagtagctgggattacaggcatgcactaccatgcctggctaattttgtatttttagtagagacgaggtttctccatgtttgttaggctggtcttgaattcctgacctcaggtgatctatccacctcggcctcccaaagtgctgggattacaggtgtgggtcaccgtgcctggccctttgctcatttttaatagggttgtttgttttttttgcttgttgatttaagttccttatgcattctggatgttagatctttgttggatgcatagtttacaatcccatacctaacatcatgctaaatgggcaaaagctgaaaaaattcctcattccaacaagacaagcatgcctactctcaccactcctattcaacttagtaactggaagccaattactctttagccagaggcaagagaaagaaataaaaggcatccaataggaagagaggaagtcataaccaagaaggttaaagatctctacagcaaaaattacaaaacactgctgaaaaaaatcaaagatgacacaaacaaatggaaaaacattctatgctcaggataggaagacttaatattgttaaagaggccatactgcccaaggcaatttactattaaactaccaatgtaatttttcacagaattagaaaaattattctaaaattcatatggaactaaaaacaaaacaaaagaaagacaaccaaatagccaaagcaatcccaagtaaaaagaacagggccagaggcaacacactacttgacttcaaactatactacaaggctaccataaccaaaatagcatggtaaaatacacatagtctatgtgtactaaaacagacacatagaccaatggaataggtcagggaacccagaaataaggctgcacacctacaactatcggatcgtcaacaaagttgacgataacaagcaatggggaaaggatttcctatttaataaatagtgctgggataactgactagctatatgccaaagattgaaactggatccctacctttcaccatattaaaaaaaatcaactcaagatggattaaagacttaaatgtaaaacccaaaactataaaatcgctagaaggaaatctaggaaataccattctggacacaggacttggcaaagattttatgacaaagtctccaaaggcaattgcaacaaaaacaaatattgaccagtgggacctaattaaactaaagaccttctgaacagcaaaagaaaccatcaacagagtaagcaatctatagaatgggactgttggttttcattataagctatgaagtagaatttgatttttaaaactatatatgtatattactttgatataaataaaaacctaaaaaggcactaaaatgcattgtagaatcaaagttatgagagagtaaagaatggcacatttttgtgacttttgtcctagcaactagatctgtaggtccttcctaagttgggctatgtttcccagagaggtaagggcaaaaaagactccttaaggatatatatctgagttagacttatctggactcataacaaatttcataagaaaacaggagtttttgaagtttttaatagcaaaactttagaaaaaataaatttaacagaggttaattgataaaataatgatttgagaatcagaaagcaccccccaccactcaaaccagaatagattcagagagactctatcactgccacatggtgggaagaaatttatggacagaaagaaaaagtgatgtgtagaatctggaaatggaaatggggtacagaaacagctcagttggttacagctcagtgtttgccttatttgaacatggttttcacagattttgttatccaaggtaggtcctgtatccaatctcccagggatatgagagatgactgtattttcctagttagctgagaggaatctagtgtcctgagctcttcttggctgtttgaaaaatggctctgtatctggaaatgccatcagctacatagctaaagcttctggaataatggtcttcgttctctgaggctggctgtcgagattagtgaatgaactctggggagtgacaagatgtcagagaatatggtttgatcatcctcacacccagcccctttcaaagaaaaacatattgagctaaaagacaacatcatcaacaacaaatcagtatattagaattacctgaaacagcttctaatcatttcagggcatgggtcaatattgtggataatcaccaattagaaacattgcttcattctagccagtttcttcaaggaatgtcttccatccgtgctatgcattatgatggaatattttgtagaagtgctatgtaaacagcttgtaccaccacagaacacggaaattcttaacaaacatgtactgcttaagtgcatgctaatgccacttttttcattttgtcaatgtaatacagcatatttaatgcattcagtatagtctgttgcgactgaaacagttatcctttagtgtcccagaagtctaattacaagctagctattctctttatctatgttctgatagcttctctattagaataaagaaactgtgtaatagaatgacttttgactgtgtgtttcaatgttaataagatgaggtttaactgcttctacaagtttatctctcttctaacactttgttgaaatgagacaggacaaactagttttgttacattttatgtaacattttagtactacctgctacctaatggtaaagagcaatttttattgttttcctttgatactttttttaaaaattcaaatatttgatgagtacctacaatgtttcagacattgttataagcagtaaacaaagtagaccaaattttattctctcatgatcttattctaatggggagatatagagtacactagcattaagtaaaatatgtagtacattgtaaggtgatcgtattatgaaggaaactgaagcaggaaggataattagctggcttgtaattcagtagaatacttgacttggaggtgaaatggttccgctgtgtctccacccaaatctcatcttgaattgttactcccataatccccatgtgttcttcgagggacccggtgagaggtaattgaatcatgggggaaattttttcctgtgctgttctcatgatagtgaataagtttcatgagacctggtggtttttaaagggcagttccgctacacaggctctcttgactgctgccgtgcaagatgtgcctttgttcctccttcaccttctgccatgattgtaaggcctccccaggtaggtggaactgtgagttcattaaacctctttttatttataaattcctcagtctcaggtatttattcatagcagtatgaaaatggactaacacagaggagaagtgtgttttgaagactggcagctacttactgatgtctaaaattctaccattaatgattttatgcttatatattattttacctcagtcgtgaacaaacgttccctttgaagggcttggtggaaagtatactgtaacagaagacaaatctagattttagtttcactcaggctgcctttgactttttttttttaattttttcttcccatattatccattcactagacttccaatagcatctaagggataatgattcccaattcatttctctagacttgacttatatcctaggcttctggactttctaccctaaatactccatacatatctcaaaaatcagcatattcaaaattaaactcactatcctatgatttacaacttaacacacttgatcattttcctgaattcccaatcttgtttaatggcatcatggttaaaatttctcatataatccaaagactcagtgttggtcttggttgttggcagatgggcattcagtggtggccatagccagattggccatggtgagtggaaatccacgtttctgagtccatgcattgtctccattcctgctaccatggctattttttttatgagcccattgggcaatgacaggggtggcaggggaaagaagctgactggtatacacagaatgagtcatcctatcctcttgattattacaatcctcctctggagaagccatcttgtggtgagcattcctatagaacacaaatatgttcagaggtttctttttgcccattcagagagactgtccatatatctcttccccaaatttctttgtcaccaattttttaatcatgttccttccaattacctgaccatgcagtcaaactatgctttactggccatgaattggtatgcaatttcatgtctggccatttttcctttcaagcaaagtgaacaaccaagtgtactgctcaaaattctgtccacttggaagactttctcttatcactgtccttcagggatttctcagagagggactataatgctgcagctttccacttttggtggtgcttgtgtcttacagagaaccatctgtaaactaggtctgagtcttctcttcttctgtcatctaattgttaggaacttcccatgaggtcataggcacagtctgggagggagaaggcagtgtagcaggagtggggactctgggtatttgggctaattcttcttgtaacttacttggccttcagggcctgcttcagcctgatcacatatgtgccacttctatttgatgatggagtgttgctgtgcacatccaactttatggctttttgggtcaaataaaactcagctgatgagaggcagatcaggttgcatggtaacatggtagcccatggtcaagtgtttagtctttactagggcctagtagcaggccaagagctatctctcttcttctgctgcaggtgatagcagggtgttactccaaaataataaaggactgtgtttaattttacttataggtgccttcccaatccttcaaacaacattcctatttggcagtgatgattcagggaccattggatctgctagatcatatggcccaagtggcagagcagtctgtgcagcaggctgggccaattgcagacccttctttttttccaagtcccatttaaaactagcagctttgggggtcattcagtaaatgggccagagttaacaccctcacataagacatatgtgtgtctaaaatctagagggccactagacattgtgcctctttcttgcttgtaggatggggcaaatgcccaaacttatccttcaccttaggatatctcaacattctccatatcctggaaattttactgaagaagacttctgattttagttagatttatttcccactctctgacatccaattgtcttattaataagtctagagtaggagctactccttgctaactaggacaaattagtataatgacatcaatgtgatggattagtgtgatgtcttatggaaagagaaggcaattaagatccttgcaaactaaactattacatggggctggagagtggttatatccctgatgtaggacagtgaaggcatattactagccttgccagctggaagcaaactactttggagggccttatggacaggcatggagaaaaagatatttgccaaagcaatagctgtgtaacagatacaagggggtgtgttaattttctcaagtaatgaaaccacatctggcacagcagctgcaattgatgtcaccacctggtagagtatataataatccactaccattcttcaaatccatctgtcttctgtataggacaaataggagagttaaatgggaatgtggtgggactcaccacccctgcatctttcacatccttgatgatggcactaatctcggcagtcccctccaggaatgtagtatggcttttagcatagtacttttctgatagagatagttctaatggatcccaattagcctttcccaccataacagacctcattccagaggtcagagaactagtgtggggattcttccagaagctaagtatgtctattgtagttatgcattctggaactggaaagatgccacagaatagggttggggacccactagacctattgtgagaagaacctgagctaaaactcagttgatcatctgacctctatgtgcctttacactgactagtgggcctcagtgatgttttgggtctccttgaattagtgtcagttcagaaccagtatccagtagttcccaaatgatctaattatttcatttaccctaatgtacatttactctagtaaaaggctgtagatgcctttggggaaagctgggagaaagactggtgatatctttgacaatgttcttctcaaggagtcctgtcctcacgtgcattcaagggattctacgtctgtaaactggtttaaaatttggaattgattgaggggccataactgtatttttttaaagtttacattagacttttacctggaaatgttctgctcatacatatcaaacaatttggtatactttctatctgtttcacttttagaaacatcatgatcaattaactaatgccataattctacataagttaaactagtctgactgttgctttgattctgcttttcatcattggtaaccctgcccattgtgacttcgtggttgagttctgcaacctgacccctgccatcctgggatccagttactcttttaggtttcccaattcagtgacagtagctcatattaggaggactggcatacagagaagaatactcacagagctcttattgttgaaatatatgtcttctgcatccttccaatgtgggtgagtagggtttaagtgacaaatccacataaatatttcaaatttgctcatgctgagccatcttttggtccatgtttcagccaactaaccaatcaaacagttagagccctttctaattccctgagctgcaacattacatgcaaaatctccacttagtgtgtccacgtcgatgaattcggactgatccaactttatgttccgtccagtaacatcccacacccttagcatccattcccccacacattccctggatttctttctgtataaatcaggaaactgaagtagttcctttgaagtatggctcacctcttcatgtgtcacacattgtacctcacttggaggggcctgctgggatttgaatctagttgtacatctagaagcaaagaggcatgatgggggtgagtcctgaggagaatcagcattgccttgcatggcaactgcctcagggaaggtcattactgtttcctcagacattgtagtgctaataccctcaaatagagatggaaaggacaatgccactgtgaatgaagaggatgataccactggaggtgagtatgtcacttccactgaggatggggatgctgcttttgcttgggttgaggagaccagttcctctgagtgtagggagacctcgtcttccactggtaaaaaataaaaaacactcatcagatttacaggtttattgtccccagcttaataatgatgatcccacatatccccattccaatttacaggattctattcccaattaatgccctcactttaagagtagacaccctgtgagctgtggaatacggcttgtgttttaatttagctagtaataagatgaggttctgcatttgatcttcagcaacttcagccctgcagctacaggagataaagttaatcataagtggttagaggtattacctgcaggatgggtacatgagctcatgaagagctctgtaagacacaaagtatgggataaggatagaataacaacacattaagtcctacggccaaaaaaaaaaaaaaatgccagaaaaaagattgtcagagaaaagagattccccacattatgactgcatacagtactgccttggtatcctaaggatgctaaccctcttttatggtcatagtggaaagaaaggattgcactagtggcattttgaacaaaggacaatgacaaatagagcaggagaggaaaaaaaggaatctatttcttaccttattggtcaaaattaggagccctttattctaatgtgaaaaaaatcactgatactcatccagaatttagttttaaggatcttaggcaagatggttagttggaaaagtaaacattctctttgaaatcaagcagatctaggttcatatcccatctcttccagttgctgctatgtaatctgagaaaatcacacatcttttctgagtattagttatttcaaacatttaatgcagaacttattaagattattatgaacatcacattacaaaagtgtaaaacatagacctatgacatgatttatggggtatcatatatacccaacaactggcattagtaataattacaacagcaataacagtgaggtatttcattaatacccaaatctttaggaagagaaaggatacaaattttgacaccattcatgaatctacttgaagaagatacttaaaagaaaataaatgtatttgcattattatctttgtcagtcaaacttaagatagcaagaagggaaaggcagccagagaaacatggaaatgacctatatcattttcagtgtaccttggtggctgatacacgtatcttaagtccagtagacttttgagcaaggtacatttcatggtctgtctagaaatacacaagcactattaatagtcctgtttgtattatctgtgaagtttccagagcacataatttatagttatgagtctacagtgtcaacctatttttaatccaaagaaaaaagattgcatgtatatttatttttcaagaagtaaaagttaataggagagaagattcaggatatcttgtttatacataaatttacatgttgaattatctatttgcagaaggtagaatttacattttgacaaaaaagtgttcattagttttaatttctgctgatgttgaaaataatccaaagtacaaaagcaaaaaaaaaaatgtgtgaactcttgaaccctccctgaggttttttatgtttgctgatgtgtaggcacagtgatggtgtcaggtgttcatggctgtggaattggatgtacagaactaaagactccaggggtcctattggcagctcatgatctggcaattggtgaacattaaaatgagaaactctaccatcatatttatgttcagtaaatcaggaaatttcactggggttctagtcaatttttttagctgtctcttttgtaaataattttgctcaggtattagttctaagacatgaatttaataccataaatgagaataatgataatgctggttaatgtttattaatttttaatatacgccaggtctctatgaagtgctttacatgcattacattatttaatcttaaagctgacactattacttaggtactattataatacacactataaggaatctgagagttacaggtaataagtaaattgatcaagatggaacacagatctgtggcaatgttgtttgtgagcatatttttttggcatattcacaaatgcctaattcttgcttgagaacagtgtattaatagaataatagttaagggcatacttaagaacctggaatgaaatctttaattttctgtgtgaccttgactaagatttttacttctttaggctttattttccatattttaaatggggaaaattctaatagtttctatcatgtagattatttgtagtgtttagataaattaattacatgtgaaagatttatgacagtggttgacaccgagtaaattccttaaaaaaggcccgctcttatatctaggcatttatcagaaaattaaaaagaaacattataaggaagaactttaaggagctagcaactgggtaaatcagactagatattgaaaatggaacccactttacaaattaaatccatagacaaagttcagaatgagcttcgacttaagggaacttgcctcaaccatctggttcaaactcagagtccatcgcttccacaaagatacatgctggcccatctgaattgacatctgtgtgcatactgaagtcctggaggataattaggagagaaaactccaacagcattactgacataagcctggggaactaagccataaaattctctatataaacaagtggcctatataaccacagaactataaattttggtcttgccccaggagtacctgaaatggccagatgctcaaacaaaaataaacatttctgaagtgcacagcaaacaaggttttaaaaatcacacctctctgctataacctttactcactattaggctgatgaattcatgctaccttgtttcatgacagctgtggatgacatctcatgaccaaagcatagagcatttctctgatttaccacagattttgtaacataaagtttttattgaagtatagcatatataaaatgcatgaagccccagtgtatagctcaattaattttcacaagcaagtgtatctatgtaaccaggatccagatgaggaaacagaatattactggcatcaagaaactctctatggcccttctagtcactaatttctttcaaagatgaccactatcttgattcgtaacactggatattggtttttgtctgtttttgaaagggaatcatacaatgtgtattcttttatgtctgacttctttcattcaatgctgtttgtgagacccatccacaatagtttatttattgtcattgatgtctagaataccattatgtgaatacaccatagtttatccattctactgatggacgtagggattacttctacctttggtagattacttctactttataaatcatgttgagaaaattttgtatgtgtatttggtgaacatttttactcattttaataggttatatatctgggattggaattgccagattttagtacaggagtagagtcagattcaatagagacaaattatttttcagagtcaaagtaccagttttcagttccttgagtaatgtatcagaatcgggttaatatttttctcattaaattaaaaatattgacggaaaatgcagatattaggcatggacttcaaagagaatgacaagtgtatacatttgcatatcacaacttcaattaagatataccaactttccatcacctcagagttgtcttgtgcctgttccactcattctgcaccccagataaccactgttgatttctatcattctagaccatttctgagtattcttgaatctttataagaaaggaatgatattcctgggtcgggcttcttttctcaacctaatgtttttgagattcatctgtgttgttgcatgggtcagtagacattctttgctttttcggagtaaaattctgttgcgtgaattgtactgcaatttgtttttccattctatgttcatgaacatttgggttgtttcaagtttgagattataatataatgagtaaagttgccataaaaattacaatacaagtctttttgaagacgtgcattttggtttctctggtgttaatattgagggaaaaaattgcttggtcataaggtaggtacattttaactttataagaaactaaaaaaacaattctgcatagttgaccaattttccaacctcactagcaatattagaaagttcttggccaggtgcagtggctcacacctgtaatcctagcactttgggattccaaggcaggcagatcacttgaggccaggagttcaagaccagcctggccaacatagtgaaactctgtctctactaaaaatgcaaaagttagtggggcattgtggtaggcgcctgtaatcccagcaaattcggaggctgagacatgagaattgcttgaacccaggaggcagaggttgcagtgagctgatataatgccattgcacaccagcctgggtgacagaatgagtctctgtctcaaaagaaaaaaaatgttctcgctgctacaagtctttgtcaacatttggctttctttgtctttgtaatttaatcgttcttatgggcataaaataataccattttgtggttttgagatttatggtaaaaattacattgaatgtcttttaataagcttattgcccaagcaagtatttgctaaaatgtctgtttaaactttagtccaagttttttttttagttgggttgtgtgtttttacaatagattttgtggaaatttatatattctggattcaattcttttcttagaaagatttaagtatttcattctaatctatagcttgccttaatggtgtattttgaagactagaaattttcaattttgatggagtccagtttaacccttttctttttcatacttattggcttttttatatcctctcaagaaatctctgcctatcacacagtgcaaaaataatctcctatatcttaatttagaagatttataattttacctttttaatttagcactataattgatcttgaattaatatttgtgtgtggtctgagataggcatcaaggttcatttttcttctaggtatttatcaagtttttcaagaaccatgaaaaagactctctttttttcctctttgtatagcctcagtgcatttgttgactattagttgagtattcttgcaagtgtttttctctggactctgcattttattgatccatgtgtctatttttatgtcactaacatattgtcttgattactgtaactttatagtgaataatgtaatcaagcagtgaattttccaacattatttctttttgagtaaatttatttgggcaaatacagattcttgctactccatatacaatttagaagcaacttgcccctttctgaaaaaagcctgttgattttgatttacactgtaacacattcatatggtttggctttgtttccctacccaaatgtcacgttgaattgtaataaccaccacatgtcaagggcaaggccaggtggagataacggaaccatggagggtggtttcccctatattgttcttgtgatattgagtaagtctgatgagattagatggttttataaataggagttcccctgcacaagctctcttgcctgctgccatgtaagacatgcctttgctactccttcaccttccaccatgattgtgaggcttcccaaggcttgtggaactgtgtgtccattaaacctctttcctttataaattacccagtcttgagtatgtctttattagcagcatgtgaacagactagtagacacacctatagacacatttggggaacatgaacatatttataatatgaagtcttctaatttataatcatgatacatctctttatttatttatttatgttttcttgaatttattttagtaatgtgcagtttttaccattgaaggctttcatctgtgcttttaaacttacttttaagtattcttaaaactattaagaagacttaaacactcttataaatgaaatgttaaaaagtctttgtttcaattgttactgctatattgaaatataattgcttttgggatatatgccttgtattctatagccttcattatctttttaactctagtaattgctttgtattttatttaggaatttctatgcaaactattataccttttagttgaaaatagtagttttacatcttcctttccaacatttatgccttttgttgttgttgttgttgttgttgttgagatggagtctcactctgttgccaggctggaatgtagtgacgcaatctcagctcactgtaacctccgcctcccaggttcaagtgattctcctgcctcagtctcgcaagtagctgggactacaggcacatgccaccatgcccagctaattttttttttgtatttttaatagagatggggtttcaccacattggccaggatggtctcaatctctagacctcgtgatccgcccaccttggcctcccaaagtgctgggattacaggcatgaaataccatgctcggccaccttttaaaaattgtttaatgcaccgaataggaattgtaatattgtactgaacaaaagtagagagtgtattttttgccttgttccgaattgtaggtggaaaacatccaattttttgctatatttggtagatatactttatcagattgtggaaatattcttctatttttattttctgagtttttattgtgcatatgagttaagttttatcaaatgcttttattcattaaggtgactacaaagttttcttttacattattctattgctagaataatgtaaatcatactgatttagtttcttttggatattaaaccaaccttgcattttaggataaaaatctcttgattatgatgtactatccaatttatacattgctgtattcaatttgctatttgttaagtatcattgaatctacgtgcatgaagagtactggtctataattttatttttccaatatacttgtcaggtttttgtgtcagggtttcttttctttttctttcttttttttttttttttgagacagagtctcgctctgtcgcccaggctggagtgcagtggcacgatctcggctcactgcaagctccgcctcccgggttcacgccattctcctgcctcagcctcccgagtagctgggactacaggcgcccgcccccacgcccggctaattttttgtatttttagtagaggcggggtttcactgtgttagccaggatgttgtgtcagggtttctatggttttatacaattaatttggaagtacttccttctctttaattttctggatttgtacagaatttatattatttcttccttaagtttttgttttcatccttgaaactatgtgtgcttggtgttttccttatagataatttcaataacaaatgtaattcctttaataagtatagggctaaacaatttttcaatttattttattaattttgaaatgtgattttcatggcattagtccattttatttttttgaatttttgcataaatttgtttataatattgccatattatccttttaagtatctgtaggttttgtaatgatatgttctataacattacaaatttggtaaattttgtttcctctttttttgacctgcctttctatgggttattaaatctttttaatcttttcaagaaacaatgtttggctgtgttaattttttctgtttgcttgccagttttatgctatttatttttttctagttactttggatttatctattttatatttcataatttccatgtgcaccttggatttttacttccccaatttaagggatgtagaggaggatacagtagagaaagggagaggtctgtctgcccattttgccatctgataggctcttttgaaaaaggccattgcagcatatatgctaagttaatttagtcattcctcccaacagaatgtttgacataaagctatcaattatcaacacagcagcagccctatttgtagtgaagtgtagtgtcccaataggataacagtatactgcttctaagtaaaggaagggattgtctgtaagcaccgagggataaaataataaaagtaacaacattacaagtactactcaaaaaaccaaactaacatgcattaaatgcttacaattatcctggagctttacattttcgtaggtattattttcccagtttacagatgatgaaggctttaaacagttaaataatttggtgaaggtcagaattcataagtggaggaattaagattgaattccagctcttctggacatcaaagcctctttgtttaaatatttccattatatcaactcaattatacttcaatgttgttaaatttttattgacataccaacaacataaaactcttaaatatacagcttgatgaattttcataaagcaagcacaactaaattaagcaacaaacttttcagcacccagaagcctcctttttatgttcttctaggcattatgctcttgttactgccctgactttgaaaacattgattagtttacttgtttttgtacttttggcataacacagtatatattcttccatgtctggcttcattgtttcaatatctatgaaaatcatccatgttttgtatagtcatttgcagtgctttattatattttattgtatgtatataccaggatttatttatccattcaactgttgataaccatttggttagttttcaggttcagtctattaaaaataatgttgcagtgaatatattcttatgcctatcttttggtatacctgtgcatacatttatagaatagaactgctaggtcataaaatgttcatgcatatgttcaggtttagtgaccctgttaaatagtattccaaggtggttaatcaaaaagaaatttctttagaaaggaaacttaaatactttcataaaggaaaactagtatccagaccataatgcgaatatttaccatgaaataaaaacataatttaaacaaaaactttgttaatattgtgccacctagagtaatttttgctgccataaaatgtatatcttccatacgttgggaaattcagatctataccagttattagtaattaatcatgtattgtctagtcttgttatattgctttggctgctatttacaattttgaaattagatgcaattatctgtcttatttcttttctttgaaatggcagagacattacattatagttctttctatctcatttgtatcactaaaaatttcactcagtaaaaagtcttaactattgtatttttgttattgttggcaagtttaaagctacctgtttgctacattttttttaacctttgagctgataaagagtactttgacttgtatgcttgtgtatgtttcatttggtgcttattgagtatagtcacaaaaaatgcttaggcactggagtcaacagagatggatttgagtacccttacaccacccctttgccgtgtgttgtttattccacttaataattctgagtctcataattatattttattaaataagaattataatgcattgtatcataaatttatatgaggattaaatatgataatggactttacgcttttggcacaaagtgggtcttcaataaatgataatttacatccatagattttctctcctttattgaaaattaaataattaatatatctttatcaaatatgaaatttgtttctagaaattactttctttaatatatataactttatattttaatatgcatcaatctatatttaaaatatatcttaattctcaaagtttatgccacttctaagagtgtgtatatttattcctcctttagagtaatttaaatagagagaatctgacttattaatgaactgtgcaacagcttcataatggctaaccttgtgtgatggtcagtataacctgggctttgaaatcaaagaatgtagaagcaactatggctctaccacttccttgctagattgacaggttatgtgacctctttggattttgatgtcctaatctacaaaataaggataataatacctatctaggtgcccaatatacaatacaaacgtgcattaaataataatttttcattgaaactctctacttttgcttttcaaataatgacccaacatactttacataatggaaggaagtctcttctaagcaagagagaaaatactttactagagtttcagctaggaggcacattaaatggagtgtagttttttagaaaataacaagctcatcttttttagattttttttttcttcattgtgctaagaaatgtacaaatgagattcaggatcatgaagcatttctcaatgatttagaatctgaaaacttcaaaaaattagacacaaaattgttttcttagagtactgagaattaagtctgttttgtatctttctgctttactaacaaattcatgtttgtgtgtcatatatttgtctgtaaatgaaacaataaaatacattgttcaagtacctgattgcaacatcattgtcacacctgggatgtgatgagtcctctgccaagtgaacatgtccttgacctgaagatttcatttcaggaatagataccacattgatccaatatttttaattgctggcaatagcacaagtggctaatctttcttcgatctttcaaaatgtcaattttaatttgcaaatttaatacatgcaaaagtatagaaataatcaaaatacttattttaaatgcaagttaaaaatgtgcttatttcatttgtttcagagatctgtggctcagaaaattagaaacaccaattttagtaagctcattagttaagttcaagttaagaaagcattttaggtggacaaaagctggaatgaaatttgttaataaatagaagttacttagaaagtttgatttaattgattacacagcatgagtatatgaattcagaagcagtgggaaggactatataaaaggaaaggacacagataaaaacaaacatatttggatctggaagctgtctgattgttgatgtacatttagttgtccttctctggtggttcaatgaacactagtttcaatagtgttttaagtcaggtcaggggctgtcaaatttcagcttcgatcttgaaaaattttatctgatttaatttgggtggcaaacacccaagccgacttcttcatgtgcaaagagtagaaaactacccagttacttatgaactctgtgtaacacttgctaactcccacttgaatatctgccattatttaatgcttatctctgggaattcctgattttggaagccaatggataaaacaacagttgtgcatgctgccagcagaaataatcaccattgaattaactggctaggaaccaactttactattttctctagtgcttataagctattatatttatcatttaatgaatacataattccaaatataaatgtctcaaaagtgtctaataagaccaaatatacaggtttgatttcagtatttggcagaatactgttctatgagaaattttccattattaggaaaggcagcacttaagaaatatttccattactctttccactcttactcgcaaaaattgttttgtctgattggcaaagtgagggtctgggacctgttgttccaccttttgtttttgagcttgaggcagctagctgggtaagtgtgttacagaccaaatcttatcaccagctgagtccaaaggactggagaaggggcagggagcctacctgaaattacaggtttagggaactcgcaataaagctgctaccttgatcaccttgatctcgactcctctatcttcccctgaattgggtctgaactagaagaaagaaaggtaagtgatttattggttccctcatccctcagcctaagtcataaagttatgattccaatggacatattaagagattatcagggaactctatattggctatgaaagctgagctgctaccatgaatggagtcagtcatttgcacactgcaggaatttggggccacagcgatcagcattgctggctgtacttgatgcaggatcagtggggagagctcaataaatctctcgctctcacaggagagtgggagctattgatcgccagtggctccattagctctgtatgacttcactggaattaaaatctttagggcttgatcctcccctcagatagctatatgtacacagggcctaatctaaccttgtacaaagtggtgagatttttttttcttctttcccctcccttacccaacatctaggtatttgagatgagcaagcgctatcctgcagaattttaataggcctatgtttaaagtagtgtctctgacctttatgaaattaaggagcggggagagcattgccagtaagacttaacagatcatttctgtctgctggccaatctccattggtgtatgtctatttttttctaaaggaaaaacagcctttcacaaaaccagctccaaagctcatcaagatgcaattgaaatgttgaaatcaggtaaatcagctcttattaaacatgaggaactgaggcaagaagacgcaagttttttgtttgtttgtttttctcactgtagaggtttttatcacccagatgcacaaaatgtggccttgttataataataatgtcctaaagtatttatgttgcttttctcttaatttttgaatccatcaatagttacaaactaaaacttttttctttgatgctatcagaggtgtagtactgtgtatggctactgaaaattcaagagcctttcacttgatgaaaaaacaaagagcaatgtatctttttccaaagtagcattatcttcctgttacctgaaattcagagatagatattgacatggccatttctcatggggattaatacttatccatctaatgggtccatttaaaagcatatatatggagtctgagatttggaataaggctttttgtcaaaaggacacctttatcattgggattgtttgatggaaaatcacaaagccatatatttgtgggaaaccacttagaaagataatgtaaaatatcatggcaactgttggcagaattttaaaaatacaaaccacaaacacatattgtaaaatgtattgacctatatattgtctagacatactcaaggaactatttccttttagacagattatttgggagactggacactatctgtttccagattaaaatttatgctagcttacagataaacgaaaggtagtctaattcaaactttgtattgccttaatgctgttagatagactagatgaccctgaatttccttttaaccttatgattagagaaaatcacttttctaaacaaaataaactgttaaatattagagcttatgaaaatatatttgatcaattcaaaaccatcatatgtggtggccttaattgtagaattcaaatatatctcttagtcaatgacaccattaatgattatttaatgggaagcctaaactaagccctaaaatagcttgaatagaaatggaaaaagtttattcatttacatattcatagtctgcttttaaaaatcacaaaggttttaaacatgaattagaaataaaattcctatgtcattattctatagtcttatgggagaggtaagtaagagcaaaaggactccttatcctctatccgcaaggaacagataacacacacacgtacacacacacaaatggaagtatattcatgggaacctgaaagaagcaatttgagatgactgatatttacaatttagtggagcaaggactgaaagaagaatgtgtcttgcaaggggcacatgagtgatgggttttgcaggggatgtgcaaacactctgcttttagaaataggtctgatcttaactggcaggtgaccgtgtggcagatttgaaagcattctactccacttctcctcaggatacaaagaggtatcttgaaaaagaggaaaggataagtcaagatttaatgatttaaatccttgagacaaagcattttaaaaagtgaacttgagttcctcttcacgtgtttaagaagtgggccttatgtttacaatttagtagatggagtgcctgttgtttcacagtacagtcctaagctctgtttcttgcttagcactgaatggttgcttcatgatgggtaagtcacttaacctttctgtggtgtgttcttctcatctgcaagtagagatggaaatgctcactggggatgtgttgctaagattaggcaatatgtaattgtgatgagcattatacatgctaactaatgatgataatgctgtctattagagtgaatatttggatcggagggcctaagcagttttgtgattgcatttcctgcagagagagaccttagcaaatgattacctggtccatatgactcatgttttataacagaataagattatgtcgtctcaaatccttcccctttccccccacagatcacctattaaatttttttttttggaattaaatacaaaatcattctgtctaggaggaggaaatgaacagcacgtcctgggaaagtcgtttctgccagctcctctaattctttaagttataattttctttcaagaattccaaatttaggcattgagccttattgcaattttcagtggagttacgcaagcttatacagccagatcatgtctgaaggttatcaatttgttaaacctgtaatgtcaagatctcctttctttccaatttgtagagaatgttacttccttagtaatcttattttttttctctctttctgtcttctaaacccacctcacttgctcagattcttaacagggttaaaaatggtacagccagaaggaaatatctctaatcgccacctctgtaatacagacacaagcattttcttaagggccaagagactgctaccacctctcggtttcttgagatgttcctaatggcatgttgctatgttctgatgtgagtataatggcataagatcacagcaagaaaaatgcaccttcccctcaaaagcatagatctcactagaaaataagagaaaaaatctctttactttggtttttaataaaatcatactttccagaaagatggaggtgagagcagaggcatgaccgcttaatttcaaatgtgaattttttttctttcttaaaggagacactatggtaattgcatctcgtgcacacttagtaattattcatttcaaaatctactcctgtgaattatgcatgtttgaggattaccacacaacccaatgaagtaattaaatgggtacttttcttcccattttacagatgagtaaaataggaccccagaaagaaacaattgaatgttcaaagctttcaggttttttttggtaaccaaaaaagtgctagagtttaagccttctaatataaacacatttttattatgtatacaagttttgaatagatttatttctgaatctaattctaaagaaaaatggagtttctgagagtcttttcaactttaattttaaatataataaatttcagaataattgttatgatttattctgaacagtttaggtggaatgatataatttcaggggcatgagaaaaaatgtcttctactcctccttaattatcatgccatatgttcatgaagggattttctcttctttcattccaaattagagagaaggcttaaaaacaaagtcctctgatggagatgacacaatgcctgagacttgtgggaagccctgactcagaccttttcctgtaagcatgttaattgaagagggagacaggatgtgtgcaaagcagtagttctgccctttaaaggggagctaagagtgaagaatagtgactcaggtgatatacaaaatggactttacttagattacaatttagctcaggggtatcctctggagaacttgtctgtattgattggagcccatgctgtgtcaatggaatgcccttccttggatataccaattgctgcatatgctggaacatttggcaacccttgggggcccccacactgttttacagccagtgacaacacaggcagcacagacgggcaaaacatgaaatcagagagagcaaacctttcccccttatctggaatctacacattgatttacttatacaaggttttcaggtcgaaatggcttatctattatttctctaactggcctagtgtattctctaaggctaagcttaggtggtattggtattcacgaactctttacagtatatccgaatgcttctgcttgtatactagttcttaattgtggtatgcagtctgtgacaaccatctgctgaggcagtcacatttctctcgcattcaaacccattgaaattaaaatattgataagaataatttcacaaggtggtaaagttaatagaggaattggagttggtatgctttttgaatttaagttgaacatttagagttttctgtaagcactggcatgaggttttatgctgctgagcatgggtcatttgtaaattaatgcttctatctataatgaagaataatctcttatcatggccatagagtatgcagtacatagctctgcaactttagcagatttttctcattttttttgtatgtgtttcctagtttttttttaagagagaacataggtacattcagaatagttgtatttatgagaaggatgttactaattttttcaacaaatatttattgagatcttaccaagaatttctgctgagaaattcttcagaacatttagttaagatatgttaaaatcacatcattgcaattttactgtaatggtaaaggcccctagtgggccaattcaaagactcattctaggtaggaacattttcaaagaaagtagaatgactacgtagtaatatttacactaaatacgaaaaccagcatacgttctgtcaaagattaggcttttgtctgagagctgattggctgggttgtgtaattagtctcccagaaagctaattctgttaaataatttataattctgttgaagtttattataaaattgctgaagcatgttatcaggaatgcctacttcttccttgagagaggtttgagaccatttttcttttgttcacgtgacagagagtatgccaagtgctagggctgcatagatgagtggatcaagatctgagcccctggaagaagttagaaaataatctgaattaacagaaaagcaagtatgtcagagcagtaaaagacagcctgtgttggcatcaggaatgattccaaaggagagagtaagaaattgaatagagggttttgggtagtaggtcagctaaatgaaagaactcttcttggagttaaattctgacagataagtaagtttttgtcagggggatagaaggaaagtgtagggaagtagaacgtggaaccaagaccttatcttttagaggggctaaaaaagcataaattaagtgttctgcattgcaaaatgtttggagatctggatcttgtaagcagttttcatggagcttatagtctagtaggggaaaagattagacgattaaaaactcatgcatatgtcttttaaagaatgagaggatactatgaagctgtcgttggtaatattcaaaccaaaagcttaataatgagcacccagatttaagaaagtaattaggaaagaacatttcattagaaagaacacttagtctcgtgagtgacagccaggaattaggaaagaactatctgtgtcagaggaattaaaagattacatcatttttggaatagggtgagtgaaaggctcaattaactcaagagtgtttagttgaaattatttagcagccaatcaatgcataattcacacataatccatttacatttttagcaaagtgataagtttagataataatctagattagggtaataggttacattctagcccattgtctagttttgtaaataaagttttattagaatacagccatactcattcatttatgaattattgatagttgcttttgttttagaacagcagagttgagtagtaatgaaagagactccatggatccaaagcctacaatgtttaccagctgccttttctcagtaaaagtcaagtcctgatcaacgtccttgtggtttaatataaagtgcactcatacacatagtcacatgcacacacacagaacgttgcttcagtaataattttcatgaattgaaacatgaatatgtaaatcctgattggtggtgagtggatcctctattattactaaaattctctttttggaaacagttctttgggctacaaccacccagtggttgtagacaaccctgaggttgtcaatttttccaaggtaatgggtaagaaaaacagaaaagtctggactatgagggaagagtttagaattgctagttttgttagattgccttagggtatattaattctataatcatttttacaaataaatcctcctcatctttaatttcaggaacaaaaatatattgtaatgtgtagagcttttgtcttagcaagctacatggtacattattatatgtaactgacaaagtttcagaattagaaatatacaattacaggtatctgcatatttcatcattagtaatgcaatgcagctaaagggtcagtaaaattttaagaagtttgtattttaaatgccttcaaatattgaatcttgattttaagtggaaattataacagtcatatatttgagaagtaatacacaattaatctatttttatatgctgtatcatgatttgcaatttcgaagtacagaagaaatagaaaatacatgggcaactcaaaccaaatagtaaactctttaaaaaatgcttttagaataataacatataaattataaacactacacatacaatttaatgtgtaacaataaactaaacctctgtgtatctcctacctcgcttaagacacaaaacgatatgagaaaatttgatatcccttgtgaatttcctaatcatcttccccgttttcccagcagaaacaataacttccttaattttatgataatgatttgttttcctttgtaattaaccatatatgcatgtattcttaagcagtatgttatttaattttctctgttttaaaaattttacttaatctcataatgcttgtatttttctgcaatttgcttttttcattcaacatttaagatttttctacattgatgcttatagctatagtgcattcattttcactccctggatggataatattttatttatgaatatcctgttctgcatgtgacaggatatttaggttcttttgaggtgttattatcatgaccaatgcatctttgaatgtttttgcacatatctgaatgaatgggtacacaaatttctctaagaatataggaatagaattgcttggtcttgattatatgcaacttcactaaataatgccaactgcaattgaaccaattgacttcttcactagcagtgtacagggattcctcttgcttcaaaacctcttcaaaagacagtgttatgatactcttcactttttcccaaagtagtggtgaattacatttttaaaaatgtaatatccttgtttcataaatgggttttattgtgtcagctttgttccatttgcgtgcttaaccctgtgctattattatactccaaattatgtagtgtattcataagttttgataacaggtagggcaagttgctttacatgtcttttatttatgaaattattaattataaaatttttaagaaacatttataaaattatttagtttggtcttgtttttagaatttggcttgtttcttgaaacaagttttggcttgtttttagaaatttagaaattgttaattagacctttgtattggaaaacagcgacactaagtacagaaattttctccagtgttttgaagatattttactctcacccgtattccatttctgatgttaagaagccagcaaaagtcaaattaccattcccttgcaataggcagtttccccccaaccccggctgctcttacgaattttatttttatatttgctttctagtagtttaactgtaatatgtctaagtttgtttaaaaattatctcctgattaaaatttgttggttgtcctgaatcagaggattgggatctttcagcaattctgccaatttcttagatataaaatattcatttttttaaaactctggataaatgtatgtgggatcccctcacactgttccaggtgccctaacccgttttccatatttttcattgctttccccctatggattcactctccattttggataactttttcagacctatctttctagtcactacttctcttttcaattgtttctaattttgattttaactcacagattaagattttattttcagttattatattttcactgctatttatttcttctcaatattcctggtcaatttctaaagacatttatcattctacaataatttgaataacttcctttattttttaaattaattattttatattttttatctggcatttttattatttattatttttcctggctctgattttgtaatatgttgcttctattaattgatgattgtagagcactagttttgtgagttttaaaaacttgaagtcccattgtttggaactatttctgtagggattctagaggtccgtgtagaggtctgtgtttaaaagtgtcatatctcagcaaggaaatgtgtttacttttgacaggcaaatgggtgcagtaccaacctaggaataacttaacacctcagctgagagtttttcagtcaaaatggatcagaagtataagttctgatccaaaaactcttattagtatgttccttgtggttctaaaaaaatcttatggaagactgtgttggtttttgctattctaggcagagccaaagctaagagaggacttctttccccctctagttcacttaatttgtatgtgtgcatgtgtgtatctggggtgtgtgtgtgagtgtgtgtgtgtatgtatgtatgtttcccatctacagactaacagtaaacttaggcttgtttcctaaccctttatgcctgtggctagttaaaaatcatgtcccagccacaagaaattgaccaatgtccatagggcaaatactatcttcagcaaatgcttatttacatagaaacaaacttctgtgtaatttctggccttaaatttttcctttctttattcacattaagcccatacttcagaaaaatattttccatattttatccagaatcatttgttatatactaggagaggtggtttctttgtgtatagtctactgcattgccagaaaaattattggattttatttttcactgcactttaaaattgtgcttaaagggaaagtttacccgcaaccatagtgtatgtggacatcttcgtgtatgcatttctgaaatatctctgtcaattagaatgtaaaaagttaagtttcttattacctgttatatataaatgctctatgaattgacaaattattcagctctgtcttaataattttgataaagtaaactaatacaggattttggttatagactaaaactcaagctagaattatttgtaagtcttttcagatgacagaaaatagatattttgaccctacataaatatgctgttaaacatggaaagatggattaacatgcacctgaagcaagtttgtatttataaccttttgataccagtgatatttaattgggaatactagcaaattgaggttttgcgatatatataaaaaactgtcttgcaagaatatgttcataaagaattagaattctttatcacagcttgtaaaatgttaagtaacctagataatagagtaatataatttttacaatataatattgatttagttaatatcttgcttaaatattgcaatagttgtccttatattgaacatgataaaattgtatgctttatatgaaaaaaatcaattgacaatgtgaaaatggagttgagtttttcataaatatgcagatattattttctgagccttgccaaatgaattacgatgattttgatctgtaattttgaaatatttttggataaatattgaaatgaaattgctaatatagaaaagtttcatgtcttttcctattttttcatcttactggagatatatgaaaatgactcttattagttaaaactttctatttcgatggttgcttatttgtactatctgttggaattctatttattttagttgttatgaaaaataatctgagtaataaaccagacagtttctacggttccagtcaccattagtggagaggaagtggtacaaataagatatgccttggccaggcgcggcggctcacgcctgtaatcccagcactttcggaagccaaggcgggcggatcacgaggtcaggagatcgagaccatcctggctaacagggtgaagccccatctccactaaaaatacaaaaaaaaaaaaaaaaaaattagccggacatggtggcacccgcctctagtcccagctactcaggaggctgaggcaggggaatggcgtgaacccgggaggcagagcttgcagtgagccgagatcgtgccactgcactccagcctgggcgacagagcgagactgtgtctcaaaaaaaaaaaaaaaagatatgcctctaagtagccctgccaagacccacttctgtgaccattaaatagtacatgagcaacgctttatgaaaaagaacacacacacacacaaaaccaccaccaccaccaccaggtatcctctttttcctaacatatcaagtgggtaaaagaaatgaagagttattgaagaaaaagcaggaagtactaaccagcacccacagtaatgatcacccctattttaaaactaatccttctaaattttgtagaacttagctaattatttttcctttttggcatagttgtggcaaagtacggatgcagttttgctcagcctccttaataatgaaagtatggatgaaaatcttgtggggaaaactcaaatgcaccctcaaatgctccagctgttggagagtgaaaacgtctggccctgatgcctctactatatcatttgtttctggatctaagaacccaaactactgatgttaaatgtactttaatacactttcagtttttatacttattatgttatttgactattttctacaagtagcacaggataaattatatgtggcagaatttttaggcacaaagcatagtaagggtagaattgtcatatactctttgttttgagtcctgagtgagtggcgtgtgtattccaggctgttttagaatctgagtataacataaagagcaaggtttaaaaagtgatcctggttcagccaaatccctctaaaggttgctgttcacctagccagacagatttaggcaccagaatcttgactacaaatataatcttgcattttatacacttataacctttataccactccaaatattcttgacatttttgaacaatatttcatttaagcatttgcaaatacacaaatctgtaaatatcaccgtggaatatgactcctacaacattacaataaaatataactaaatttttgacattgtctctatgcctgctactgtgtccagtgatgataaatcaatagcaacaaagcaacactgcaatatagacaccgattacttgcctagactctgtctttagttaattcgctcatttttgcatagatgagagtagtgtgtttgatttgtaattgtgcctggagaaaggaaaaatttctaggaattgtggatctttcagttgacttgttcatacacagtaatatttactttagttatcacaaaatacagatttaatattttaacattaaccaaatgggatgatgaagtagaaaagatatttgcatatatgggaggaaaacccttgagttttcctcaagatttttttgcatgtaaaccttgcacccacggattgcattttcctccggacagatttgcagcaacatagtgtttgagagcgttgtcaatggacaaaaaatattacctttctaaaccattgtctctcagatgtatctttatatttgtacgtgcatactaaataaactataattcatatatcaatattgtaatagtgtgatactgacattatttcactggtatgtcctagaaattggtaaactcttatcgagaagtaacaaacagtaatgtgtctgtccgagcgggttcaatattcttatcttaattttctgcttttagcgtcatcatttggagtttgtttatcgacttctgtgtttcaaatgtacccatgttttttggtaatccatgttgggacagactttcttgaatcaagaccaggagaactcctaggtgctctctttgtagtctcaaatttcaaagactttttctaccctgtctttggagctttagttatttttgctcagatttcttagagcccatttgatggaatgctaataattaagaaatgtaattttcagggggtaaatacttctttgacatatattctgtgaaatatttcgctaatattcagaaatgggttctatttgtgctgttgcagtcaggtaggttttgtcaataccttgaatttggcaaggagatgtcaacctccagattaagtaatatgtcaagacatttttcccattacccaaaacatcaaaacagaaacataaacatgaaaagccatgactcactcctaaaaagaattctacaacatctgtttcaggctgctgtggagtgggactggattatgtaatttacctatctcaggatgacttttgggaagaatatgctctatgtaagaggaacaacatataaattctattttagattagatactaggaataatgctcttaaaattatttttatttttaaaatgtatataaaaagttattaagaaatttgcaaagaaatgggcttggttccattttctcaatctttcttttacccctctcaccaatatccatgaagatttctaagctacaattaatcatatcattgttaaatactatttattctttttcaccatactgtatattcttgcacattttaatttgtgtagaaaatctctccctagaaattctcccatttcttcagagtcttttctctattgcatcaccacaggcaggtctcttctttttcacacttattacattatagcttctggatcttgaatattaggtcaacttttttcataatttttcctgattttttcttatgtttttattctataaatattgtccaattcactatattctaaagtatattgagaaagtctcattgtaaaaggcaatgggtaacaaataccatccatgtgaacaattttgcattttctaaataaattgcctcaatttatttccatcatttttttcaagtgcctcaggcatcaatgaaaataggctcattaattgctaagtgagtaatttttctacaagtatagtcttgttttatacattcatttgtgcatttactgtgcgtgaccagattcaccaaacacaagcctagttaccaagtgaaatacacttttcctggaaaagtgggtattagggtcaaacgaaattcccacatgaatcatagcatcacttatgataattgctggaaaagcaaaatgctgacttatttacttgaatgggaaagcctagagtaatctacattgttagagaaagagtatgaggtggatataaaagcttttctcaataattcttggcacaggttgaacactttccctagataatttttcctggtccctcagtgaaaggtgatctttttgatttttcatagcataatatctttcgttctctctcatgtatatttcttgaattaaatttatttagatgcctgtcttatcttccctctacaatgtgagggtttttgttgttgttgttgttgttgttgttgttgttgttgttttgatggcatagactgcatttgatccatctccatagaacttacctggatcactcccttggacagagtaaatactcaataagtaaatacttgagtgcctgaataatttaatagttacattaaaaagtattcattgtagaaaggtaggtagagataaaactgaagaaagaggaacttcttcatgttggtttacttctttcccattctacttttatgcaaagcacaagtacctccattgattatttggatcttcattcattgaacgggagcgatgcatcagacacagaaggatgtgttctgccagttttgagctgcttagaattcatgtgttcagaattatgaaacagacccaaatatgttggcttatcttaggcaaaacacaatttcccagcttttaggaaaataaaggagtttggaaaactgagagacttgtaaaagactcagcagtctagtggttcttaaaagtttttattttgattgctgctgctactactgtacttcttactggcatttatagtaaattctgtatttgccttgtgcttcaaagtaatgtgtatgtgttgtggttgttatattctggggtcttgggcatttgtgatatgaataaatgaatgtgattcagttaacttcctgattgcttgttatgtggaagatccttcaaagtgtctatgttgtgtagagggagaaatatcaacaataaaattatggtctagtagagacaataggtatatttatagataatgttacaagggaattaaactattatctatcttgtgtgatacagatatttgtctattcaaaggcaaggagatgggccagaaattttgagtctgtttagattctgtggagctctgactttataaatttttaaacagaggaagacaaaagaagtttgaattctaattttgttttaaaatcatcatgtataggatgcaaaaggaagacataaacatttttggtaccataatgtaagaagggtaacttcctttacctatcttctcattatgccaaaaagttggaaccacttatttatgccaatttttagccgttcttgagggggtcttattgtacaccacaccatactagtaccattttaagttgtacacaatctcctaaacaataatctatgaaaatcatattggcagagtagaaaattttatcttgacacccaagaggtgtaagagagttttgagatgtcagctgttattgaatcagattctattgattgtacttgagtatcagcattaggtggttaaaaatgagtaagctactgacatacagcattagctctgtctattgctagtgctcactatgttttagaattcaagtgttttaccaatatttatagcatataacccacatagcccctataagagagactctacttttatctcattctgtagatgagaaccaggagcaaagagaggtcaaatgtgagtttaaggtcacccagtttataggtgctgctgaagttaggatctaacaattgcactctggctccagagtctgctcttaacctttgtggaataccattgtgtatttatgaacatgtgattaaatctgtggctaataaatgttacttcttagcatgagaaaatgattacaattcttccttatcttgatttttataaattaggaaaatagaggacttattagaataatatttggattcctattggtcgcttggaggtttcagccaatatcagaatgcttttcagtagtaataataagattggaatgatttctattttcttgctactatgccaagcagttaataagcattgactattttattttactatatatgtatgtgtgtgtgtgtgtatgtgtgtgtgtgtatatatatatatatatatatatatatatatatatatatatgatggagtctcactctgtcaccaggctggagtgcagtggcgcaatctcagctcactgcaacctcctccacccaggtccaagcaattttcctgcctcagcctcctgagtagctgggactacaggcacacgccaccatgcccagctaatttttgtatttttggtgggatggggtttcatcatgttggccagcatggtctcgaattcttgaccttgtgatccacctgcctcagactcccaaagtgctgggattacaggcgtaagcccctgtgcccaggctacagcattgactattttaatccacaacaacccttttaggtattagtctcatttttaagataaggaaagtgagacttagaaaggcaaaaacgtgctaatgaccatgaagacagtaagcagcagaaagaggctcaaaggcattggatccttaaatctgtacttctaagatctaagattagctcctttattatagtgattgtctctgtaaattaatatttaaagagcaaatcctaaatttatctttttatttatactcattaaaaataagatatcatacactttaaacatcattgtaaagactaatgatgccaagtgagaatatgaaacaactggaattttcataaacgttgggagtgtaaattagtacaagcattttggaaaactgtgtggtattatctactgaagttggaaaaacaattttcctatagcacagtagttttgcttctttgtatacatgccttaagtgagtgtacttacgtaccaaagatgtgtgcaataacatttatgtcagtattatacataataaccccaaactggaaaccactcaaatttttaaaatttcagtcagtgtcagaagaaataagataattttgttatattcatgaaagtaaaataacatatggcaataaaaatgaatgaggaaaatgtaataccatgttgaattattccacagtattaagccaaggaagccagacatagtaaataaatacatattgtaggagttcatttgtaaaaaattttaaaaataagccagaatgatctatgacttaatagtcaaaataatggtggtctaagagtggctccagagtgttacacatgaacaacttcttggcctgtgtggtagttacaggcatatattcccttgcaattatttaatgagttgtgcacctatgaattgtctacttcactgtctgtatttttacttcaataaaaagttaaatataataactattatttgtgagaaaggagatgttctggttaactaaatactcttgataatgagagtgttaatacgaatagctgccgcaagatataaaatccatacagttttgtaatggctttgtaatttttttctaaaatgaatgatttcgctttcttgtctctaaatacaaaacacaaaagtaatatagtgttactttaaagatttgaaatttttattttaaaaagatgataaaagtaaaatatgcacaatgtatgaaacattgagccaaacatgtatctttggtatgcatttgatttcctactattgtcttttctaaagtaggaggatatcaaatcactctggtaatttgtatttgattttgttgagattttatatgtgtcacataagaaattaggaataattttgaagtgtcaagtgtttcacaatttgtgccaagacttgacattttttgagacacctcgcccaatcccttagtacaatatctcatctttggcacttggccttagttgctagaacaatacaaattttatgtttctcaaataaatagttgatcactcaagatacatattcactcacatgataaatgccactgactcttcttccctagagcggagggtaccttcagtgaacttgggttgtctgaatgacaatggctttagtcacattggcacttggggccactcagcccccagtgcagtttcttctcatgacaggtcaagtttttgccctgctaagagccctattcttttaacttagttattcacagggagtgcagtataggaacacaagctctagattcaaagcattctaggtttaatttcaactctaccactgcctatatgctgaccttggaaaactaaattttaaagtggggataatatacttattgggttaaggtgcagatttgttgagataaggcatgtaaaattcctagtatagtagccgccatatagcaagctttaaatatcagttttcatttattaatcgctattattaaatacacctttctcttgtgtgaaacaaaggaccacattaacccagtttatccaagtggatccaataaagtccttaagacattactgattattcaaataaataaagctatatactttcttataacagagaactttatttacctagaaaatacagctttttaaaaagctgcctacagtgaatgtgtgacttggtatatgtttctaggtattcatatctaatataagtaaaaccagtttgaaaatcaatgatgtctcattagcactacatgccataaatgtgtgtgtgtttaaagagcttttagctgaaaaggaaaaaaggtcacctacgtatttgaaagactgcagccaaagattgaaggagatattttactattcttcattttatgtctaagctttgctaagatcaatgaattccaaatcatgcatcagttagtaggtgcagagaaaatgctttaatgtctggaaatttcatcaatctcatttctctgtcacaaaaggaattgcttaaatgagtgttcttgagaccaacatggtaaaattacatatcaggcatctaaatatatgtaaatatcaaaaaggtgtgcattttcaacaatatattctggttttcagagaattagttttgaaccagccactggtttcccaaaatatagctcaccattatcgaccagtacatcacagttgatgtactgcagtgtaacaaagaactgtcagctatgggatggtaaatacgatacatgcttcctgctgctttatcgtatatgcacattcttccccaaatagtttagcaaacgtttgcctcctacacacaaatcgcaagaatgccgacactctcaggagaccactaaaatccacagctgcattattttcctttctcttaaggggaaaagtttaaaaataaccaacttttttcagccatgtcttttccctaggaatcactttgttttcatattttctgcctctctgttaaaattgaaaacatgaatgcttcattgcctaagaaactgagtaaacttgctttctgaaatgtaccttttaatgtcttttatgattttgtttttcttcccttatttgcactctcagctgtggatgaatttccatgcaatgcatcatttctttaagagtttacacaccagaagaaataaaaatggaaaatggtatctattaagagaaaacagctttcccaagtccccagcagatgctgtcggtgagcagccctctgtttactcagcacagcagatcagcttaaccctccatagggttgccctaaagaaaggaacatatttctggttgttaaacaaatgaaggcacttttaacttgagtttaccatcctattgtttcagaatacagtgtggacctgggggtttgtaaatttaagccacatatcattccactttggctaataatatttctatttttttatatcccaccagcttctgtatgatcaattgcccatgatcaacttcagattttgtgcttccttccacacatcaaaacatatatgcccacgagagatgtcctttttaaaaatttttatttcaatagtttttggggaacagtggtgttttcttacatggataagttcctcactggtaatttctgagattttggtgcacctgtcacttgagcagtgtacactgtacccaatatatagtcagttatccctcacctccctcccactcttcccccgatcccaaagtccattatatcattcttatacctttgtgtcctcatagcttagttcccacttataagtgagaacatacaatatttggttttctattcctgagttacttcacttagaataatgatctccaactccatccaggttgctgcgaatgccattattttgtccttttttgtggctgaatagcattctatggtgtatatatgccaatttttttttttacccactaggtggttggtgggcattttggctggttccatatttttgcaattgcaaattgtgctgctctaaacataggtttgcaagcatcttttgcatataatggatgtcttttgtttttatacatttattctttttaacaaaaggctgtggttttctcttcatacttctcttcatagcataaggtatcatcagtgaatctttctgcattggaggcaattcaatggtttgtgaacaaaagtctttggcctgtcttcatctgggcaggagcatgacgatatgcagatatccatctgaacagatctgtgatgcaaaagaggggtagtgctaagtcttgtactaaacggtgcatgacttgatatacttaggtttttctctccccacctgaatctcatcttgaattgtaatctacataatcctcatcatctccatgtgtgaagggagagaccaggtgcaggtaattgaatcattggggtggtttctcccatgctgttctcgtgatagtgagtgagttctaacgagatctgaggttttataagtggttctttccctccgctcagcaattctccttcctgccatcttgtgaagaaggtgttttgcttcccttttatctcctgccatgattgtaagtttcctgaggcctccccagccatgctgaaatgtgagtcaattaaaactctttcctttataaattacccagtcttgggtatttccttatagcaatgtgaggacggaccgatagtacaactcatacaagcagtctcagaagggatgagacctgagaagtgtcagtggggcagaatatctgctttgtaatctaaacattatggggagggatgtgatcaagtgaatttgttaagtggcagcctgatgccccatttctctatgtctccgctattcatggcttgtaccatctctgtcaattgtgtatagacactgaaacattacatactactctgtaagctaagttccctacactgggtacttccaagcctatgaactcatttgctaaccaagaacaagagtcgcccacctcaaagtggttttagagatgaaatttatatcatactgaagaggagtcaggtggtttcagaatcactgtttggaccttgaaatagaaatgcttgttcataattaagagatttaaaagaagcagcagcagcagctgaagacgtttaaatcttctttcccagtcattcactatgaaatctaactccattcctggagcgaaaattgatggcatttaggactttagtgttttccaggtatcaataaatccctgctagtgtctctcagtttttctaatagccaggaggaccagtaataaagtacaataaaaggatttagtaaaagaagtaacatttcctcatatcattaagatacattttaggcattcttttaacatctgttatttgagtagcccatattttttacaattaatttttagccattttattatgaaatactacaaattaattaaacaaaatgaatagctccttgtttgttacaaatctgtcaccttttatcaccaacggtatcatgtaatcagacactggtaagatagcagaatacccctcacacctctaatcaatcattagtacatgtcccacctcactaataattgcttccttttgtttataatttcatcacctaatcatgtactgctaaacactagagttcagctttattatttttagggcttaatttaaatggaaccatacagcatgtattcttttaagtctagcttagtttgctacatgttatctttgtgaaattgtccataatgttgcatgtaactgtttattgtcattgatatataatatcccttcatatgattatagcacattaaaaatcatttataatgttgattaatgtttgggttgtggcctgttttgggttcttacaagcaatgcaatgattaaaattcttgtttatgtctcgtagtgcacaattgctcacatttctattcgttgtatatataaccaggagtgtaactgctgagtgaaagagtgtgcatatcttgaactttatttgatagaatcaaacagttatccaaagtgctatttctggaatttcacacccatcaacaatggatttctatgcttttatggatttgtttctggattttctgttccagtctgtttttctatttgtctatctcttcccaattactatggtttttctttttttttttttaaatgcttgcttttaaatttctttctttgttaaacagttccattcactgaaagaaaatagcatataatcaattcttaaagcatgcttagatctatcttttaaatgtgtttatgtaaacctgttataagaactaacgcaaaaagaaaagaaacttttaaatttgcagtagctataaaataaacagcaacatctggtatagtaagtccattagacatcttaaggagtgttgtggctatcttgtgccttggtattcccaaatatatttaggaattcacttgtcagtatataaacattcgcacagttattgagattttgattgagattgaatctataaatgagtagtagaatttatgtcgttacaatattaaatcttctgtcaataaacatgattcattattttgttgattagatcttattcctccataatgttttataattatctagaagaggtatacgtatctttttaatagattaattcctaattatttggtatttttaggatattataaatggcaccttttatattttacttctgaatacttttgctgatacatagaaatgcaattaatttttatatattgatgttgtataagcaactttattaaacccatgatttaggcagtaatttagttgtaaaattttcggttttttctttttttttgaaaacacataacatatttgcatattgagagttttatttttttccagttcttacacttttgatttgtttttgttcatgatggttccaatactttaaaattaaataaaatgcttatatgggttttttttataataacctttaattaaggagaaattttcattcacagtttgcaaaattttttttcattcattaattatttttgattgtggtaaaatacacatagcatgaaatgtattatcttaaggaattttaagtgtacaatttagtggcattaagtatattcattgttgtacaaccattgctaccgtccatctcaagaactcttttcttcttaacaaaactgacattctgtactgatcaaacaataacttttcattcacccctttttacaacccctgtcaaccaccccccttctttctgcctctgtgaatttaactactaatctatatacctcatataagttgaatcacacattatttgcccttttgtgtctattttatttcacttcacatgccctcaatgtccatccatgttgtagcatgtatcagaatttccttcaaggctgaaaaatattccattgtaggtgtgcatggcattttgtttatgcattcatcgttgatagacctttgagttgcttctaacttttggccattcattgtaaataatatttccttgaaaatgagtggaaaaatatctgttttcatgctttcaattatttcaggtctatatccagaagtggatctgcttctggtaatgggaattctctttatattgttttgagaaactgccacactgttttccagagaggtggcaacattttacattctcaacaaaatggtgcacaagggtttaaatttcttcacaaccttgcttctaagcaaggatgctttttaaaagttgagaattgaggttgaattttatcaaatggcttacagcctttattatggtgataatatgttatttcttttctttgttctatttatgtggtgaattacactgattgattttaaaaaagaatccactttgcattcctggaattaacacaaattgttcctgatattttggcctgtttatatattattggctagaatttccaatacttgtttaaaatttttgcatttatgtttatgaaagatttgtttatcaatttttctttctaattatttttggtatcagagtcatgctgtactcataaaataatttgggtaatcttttttattatttagtgggagactgtatgaaagattgatgtgacttcttccttaaatgtttggcagaatgtgctgcggaagccattaggcagatattttttgttgttgttgtataagctgattcttaattttagattaaatatattgttaaaatactgaactgttcatcttgtctgttttgttttgtgtttgttttattacgttgtccttttttcagcctttgtgcatttcatctagtttccaatttttagtatgtaatgtcccgttagggttattttaatattttgggatgtataatggtctccctttttgtattcttggtatttgtgtgtttttttttttacatttttcttcatcagtttccccatggtttatcaagtttattcgttttttttaaacaagcaattaaacaagtgtttgactatcctttctgttgtatttttctatttagttaatttctgtgcatttctttatcattttcttctttttactatctttgggattaattttgttccttttcttaagacgaatgtttagataattaatttttaaccttctctgtaaagatgtgcatttaaattacaaaaattctgtataaaatcagcatatacacatgtcgcaagttttgatatgtagaatgttaaaatgtagtttaataactatttttaaatttttattatgccttcttgaaccagtgtaccctaatgataatttttatcttttggcaattcattttctccctatgatttagatatccactcaatttcattacttctatatctctttctttaaaaaaaaatttagtaataggttttgctgagagaatacatttttaaactcaattatttctaaagcataaaaagaaaggattaaaaatttaaattttcctaacacctaccatattctgtattgtcttttatcatttattatctacctttcaacttctacctttatggatttctttctgtttgtgctttcttgtcacctacttcataagtttttgttcttgtctcaagataactttgatattgctctcttgtttcctaagacaatggccaaattctgtttgtagtctttatttacattttctttcttttttcaatttatatgataactctacaaaaaagatttacaggcagcttacaaaacagttatctatcttaccaagctataaacattggaaattttttgccctcatggcttttattttctcttgacttcctttttacctatataaatcttacttatcacacagattatataccatctgtattctgtatcataatttcctagcccttcatttgtgcctctatgttaactttctgcacactgtacattgttttattttagatgttcattctagaaatttcttgaggtgaagaattatattttatgtatcttttattccccagtgtctcataatagcaaccccattcaaaaacatacaaaatgcctaactaggacccaggaacacaaaggaagaaaaaggaaaaaatattgaaagtggagtttatagaaatccagatgtccatgtcaacttaattatttctaatatttgagccatgtttctctcatgtatatagcatgcttataaaacacctatgtgtgtgtgtagtcacatatgtattattaaaaggtataaatttatttttcctatctaggtacaaagttattcattcctacatatgtgctttgtgcaaatacatcattgtcttcagcatattaacctgcttaaggaaaagaaaataaacatttcagttgttcacataacttatatttcagagccaaatacagtacgttgctacacacaaggcactggtgaaattaactgtttccttcatttaccttctccaatatctacgtatccaatatctgtctatggatgctatggctagttaatccctttcaaacaagtattattcttgtcttcgtaacttttctctgtactgtaaacaaaaagaaccttcttttttgaataggttataaaaatattactgatttactaatttgataggacatccttccctggattatataactgttagttccaatatctgctatattaatgattatattgtgcttatgttttaataaatatgtatttccttcttagaagtctgtggctacaatgtagtgatatatgactacggtgtgattggaataaatagtcatagcaatcatctctttgtcacagtgtaggaaaaaaaaagaaggctattatggcctaacatggtcactcctcactgttacatatgaatcctccaattatctttcatatcagagtacttgaaaaaacagaagcctcaaaattatttttttataaaatttctatctttaagaaatgtattttcaatataacttaacatcgagtacatcttaaataagtgtaatagagaaactattgccaaacaatgaaaatagatggaagcatatgcattgtttgattatactaaccacacataaaaagtaaggtaaacaaaagactgatgctgaagggaaaaaaaaaatcctgctatcatttacattcggatgtttagtaaaatcacaacaaaacgggagcttttcaaacctagtctctgcaaagcacatagcttaaccgttagaaatgccaccaccaatgacaacaacaaacaaacaaaaactatgcagcaaaggaaaataatagtgagcttatgcctgatattatttataaagaaacattagtaatgctaaactcaagcttaccgacagtggcaagtagctgcacattctcagctgcactattacagctgttctctataaacctttggttgcaacattatggccagtagggcacagcatctagcagactgaaaggtcattgctttgtttatatgacttttataatctgaaatttcaacagaatgaatcccacagcaggctcaggtccctccagggccgcagtttttctgtggtattgtttgcctctagaagttctgtgagagagtgattagcatttggcaaatgttaactttgcttgagaggactttgtgtctgcaccaaggtataaactgaggagcctaaaggagaacactcacatgagccagcggctcctagaactaacatcaaaatggattaggtgcaagcttttttttttttttttcctaaaacctgtctcagtttttcacttgatttggtatattctagttgtcctctgtgtgagttcacctcaggtcctttgtctctatctcaagtactaatatcactcctataaatgcctatatttggaagttggagaggggcttaattcttcaaatagattgtagagtagtgacagtgggaacaggaagaatggaataattgtgggtggatatttaatttggccttgaaaaaatgccaagaatcatagctttgatattacccatatatctcttatgcaatagtaatgatggaatctagtaaggatattctccttcctagtgagaaattgcactgctcacagacaaattgaagtaagcagtgagtgggggctagggaggtgatgcgtggcatccttggaatgcaatgggagtccacaggtatcacaagggacagtcagatgaaacttatcaactacacttaaagaaaaatgaacctaacctttcattcatcaaacagaaccctatataaatgtcagtgagcatcagcattcaattaacattgtggcttattcatcagttagggatatatagtgtagggactcctgttgctcctgaatcataattgcagagccgtctcttcagctgtttttagctaggtgcagatgcttcacctgctgcatttcaagtacctttcaccaaatctctactttagacatttgtcatgtggtcccttagtaacacactggtaagatctcacattggttctttgtacattaaggttctaatgaagagttacccttctgggagcctggaataaattcccccacccacaagaaaaaaataaggacaaaaagagttgtttctttcttcttaatgtgtgcattgtttacataaaaacagttgttagaagggtaagaaacagttatattctcctgatatgtctgcattcaacccttccttggggtgtacttttaattctgcagccagggtattagcaatattaaactgaaaatgtcacaaaatgtcaaatctgaaaatgtcactgggaaaggggaaaaaagatggtgaccccatactatctacagatgaaataaatatgcctccctggtactgtacagtgattttttttagtggatataattttatacattttgcatcctattaattttcatggcatagatggagaaatattagaacagcgagagtgctgaagacaaattaactcatcaattacatgtatgggacagtggagactgagtttatttcaccatttcgaatagcaataaaactgtaattactaactcgtggaatcttcatggaaatctgcattcattactgcttaatttgaagtcagagactgctatatacttagcttttctaatatctgccacccagtgaaaacagtagaaaacagtttagaattaaagcagctgtcccactaagtctccacagaaacattttggtaatcatccaaactaaattttacccatgacaccagtgagactagtttgtacttaaatagtgcagaaaatggaaaatgaatatattgtttgttcaggggtacaattcccccttttttttactgttctctgcatgtcagtctaactctctgctaactcttccctcttctatcctctctttacatatgcaaacgcggtgcagagagttattttttaacagaatggctaaggggaaagatgtagtcagaagatttgggtacaaattctgtttataacacttaccaactttctttatggtgttgaacaagtcacttcacttctttgaatctcactctcctcatttataaaatggagattataatgtcaaccttctaaggtttatatgagcattaagtgagctaatgtatgtaaacacctctagtgtagcacccaatattttaatgttggtttcttttgttttaatctttaaaggaaaccaaaagttataggtattatatgttgtgttataatttatggagtgaactgaatttccctgacagcttagtatctagaaaaatcagaactgcatttattatacatatgccatttgttttgcttttgtatctttactatggttgaaaagcaaagtgttacatctatcgaaactgatcttttaactatacatttgtttttacatgccactgtgaattaattaaatctgaaaaggcatcatttaaatgcaattacttgtttttatttctttagtctgttactggcacctgggaaatgatagatcacagttttaaggggtcagataggggcagaaatcaacggcattttattttaggatcagtgatatttttcaaaagtttgtttctgtcaactacaggttttgatgtatgtgcatacagaagcaaaggaaacgtgtctgtggtatatgcactttctgattggagaacagaggcaataaagctcactctgatctgagcaagaaaaaggaacataaagaagggttgtggtagagattagttacaatgaaaaaatgcaaacagaataaatttttagaagtgtttgaaagttgtgatgggtgcttagctaatagttcgaaaactccacctgcatcagtgttaggtatatttattaataaatctcatactctatctctctgagttcctttgccttgtagagatttgtaaaacctaacaacactcaataacacaattaactgtaaagaggttagaacaaaactaaattctatgcgttttcttcattcacttgcctattttgaggtatttttccatttccttaaaagatacaaatgtttctcctgaatcaagcaagactggaaaagtgaatttgatgacttgatgtggctgatctggccacatgtatgctccatgggtttcaactgactaacatagaaacagcacaacatttgtattgctagccagaaactgttgagcaaatgccgtacctctgatctcaaactgcttggctgaatctactgaacagatccaaagtagtatagaaaaaaaatctaagtcagggatttgatgatctttcagactctttcagataataattgttatctgcaaaattaagatttcaataagttattacacgcagatctctgctaagagctcctgctatatataatatgctcttaagtaatgttagctcttatgattcctactcaagttacagtttgtatagtaaaattagggtacaaatgtcaactagagagtgatgtttctacgtacaaaaaacaaaggaaagataaattcagctgtatatgatatctgattgaaaagcccaagcaagaaagctaatgctctaagcttagtaacttagaattgattagccacagtctgctagttgataggcccagtacatgacgttgctcagaaaatgtagtatttagaaagtatctagtgaaaataatttggcagtgtcatttataaattgatgtctgttcactcacctgattaaaatgtacattttcaataaacctcaaaatagaaaatactatacagaaaagaccatcttgagtgtaattttcttaattccaagaatctgtcaaagaacataaacctgctgattctagtgattagaagtggttcacagaggtttattgtgcaacatttacattttatacctaccttgatgtaagctgttcctgttatcgtttgtcataccatctctggccccttctcaattcttctcctctgtatatactctgaactgtgcaaatatgatgcaagaaagtaggataattgatggtaagaatttcttttaagaaatgaccattttagtgcattgtgagtgaatgagagtgatggctttgcatttttccagaaatatacagctatttctggaatagctgtctgacctgtgttttagttgactttggagtatattgttaggacgtaaaccctgtggtggcatataggaaaatattgacagcacctatttttaagtattgtaaatgcatgtaagaaccttaggctctcaaattatcatatacatatatatatatatgtatatatatataaatcaattatctctcacttgaatttggaggagtttcttggcttttcagggactatgcttaagccatacttaactagctcaaattctctttctatgcctgctctttctcactttcaggtttttgcacgtgctaccctctctgcctggaatattcttctctctgcttcacttgtcttgtctgattcactccttaaccttttgctttcagcctagatattttgtacatgagaaaagtcttctctgaccaacaaaagtaggctaatacctttacccatatgcatccaaaacactccgatcacctctaccattgaacatgttacattgtactgagcatttgtcattgtgtgtcagtgtcgttcacaatactagaattaaactatagataacaactgtattgttcaccattttgtcttgagtttttagcaaagcatatgacatatattagatgtttagtaaacattcattaagtggactcgtgatttagagttggaatgagttgggctaacagactattcttgcccaagttttcttctctgggttcagatgtgtctccgaatcctggaccctggtaatactttgctgtgttccatgccgggatctagatctgggattccttaatgcaactattaaagttcttacttaaaagcaatctgtgaggtatgtcctcttttaggacctctgaccaaaatccaaagatggagcgaggacactgtaatttccaagacccttgtaaatatagaaaaacattggaatttccactataggccagtgttcaccgttgtcctctagactgttagtcatccagcatttagaaaaatactattaatgattgataacctacctctgggtaggcaattgaggttataaagaacttctcaagctgggtgtggtggctcacgcctgtaatcccagcactttggaaggcctaggtgggtggatcacttgagatcaggagttcaagaccagcctggccaacatggtgaaaccctctctctactaaaaatacaaaaataagtcgggtgttgtggcaggtgcttatagtcccatttactcaggaggctgaggcaggaaaatggcgtgaacccaggaggcgaagcttgcagtgagccgagatcacaccactgcactccagcctgggcacagagtgagattccgcctcaaaaataaaataaataaataaataaataaataaataaataaataaacaaaccatctctactaagaatacaaaaaattagccaggcatggtggcgagcccctgtcatcccagctacttgggaggctgaggcaggagaattgctggaacccgggaggcagaggttgcagtgagccgatattgccccatttcactccagtttgggcaacaagagtgaaataccgtctcaaaacaacaacaacaacaaacaacaacaacaacaaagtttctacaatgcgatgagaataatggccaccaaatgcccatcaagaatttcaagaatttaatgtctttactagtggtattccataatcatttaaggattatccatagttaaaatttatctgtctccatctattgccattgtaaacagtggaaactcacagctatgcacttgcatctgtcacagacatgctatttatttcttgtcctgtcaacttcacctatttttatttgctaaccatattattctcatatatctaacacattagaatggatgctcgtttgtgtacatcatcactgaacatatagaatgttgtatatagtcaaaagcattttcctaatgtagacttatgaggaaaccaatccatcttacccttctagtgtgtcctactaattctatacaggagattaggcagtcagctattattctcttattgcacagaatttagattccacatatcgttctgttggatacaaccgtttgtctttgcaataaaatccccacaaatattttatggtctgaattcaatagtgttaagagctttcaatttctgaagtcttgccctgttccttcttaaacacaataatcaataagccctgtgtcacaaagtcacatgttttaatggaattacattgataactcttgccaaagtcttcctttaaaacctgaaattctgtgataaattcatgtgtgccagtaatggtcataatctttgagtactgtctttctacagtctctattatattgccacttatgccataccttttaaaaattattttatatagagtttcaaaggtaaaacttttatatcttttccgaattagtacttttttttgcacaaaaaattagagaaagattttcacttataattttgagacaaagtcctagtttcctagcaaaattgatgtaaaattatttgttcttgtgcttctgctattccacctcctcctttttttgtcggtcctttgtttaggaaatattttaataggtttatgcatgagccataagtaactgccccacaatattctttatataaccaatattcttttatatataactcttatataatcaatattcttttatatataacactttgatgtataacttcttgatcctttgagtagattattttatactgtcataagattagcatttttttttctgtgacagtgctcaagtttggactagttggtagaagttttgagaaataacagaaatttaaataaccacgtctataatttactgagtgcttatattctagacactccagtgttaagtacttttcatatattaatatattttaatcttcacagccacgcaaatttgcctcccactttatagatgaagaacttagaattcagagaacttaaatagactgccaaaggatagcaataacaaaagagactattttggaattctgcggaatggaaaaatgaacctgaaaatctaaaccatagaaacaaagcaaaagtcctagagaggactcttagtcaccagtgaattctcttctcctggatttttgcttacaccaagcatttcttcctcttctttgttggctattcctcctctgcacattctttaatggttggcttcttctagggttcagtcccagatcttcatttctgttcagtcttgttcattaggagctttcatccatcacatggttttaaatactatttaaatgatgataaacctgaactgtgtatcagtagcccagagctttcccatgagttccagactcatagtcagcattcaacctgatatctccactaacaagcatataaaattgtatgggtccaaaatgagtgctaaacttttacctccctgaaactatccctctcgctgtttctcatatcggtagtatcactacaattactcattaatcaaatcaaaattatatgaagcatccttgctcattctttttccctaactctcccagtaaaacataaattctatggattctatctctagcatatgtcttgaatctgcctatttgtattgatacttctatgattatcttttcttttgcccttgccctttcctaactgcagaccttaccctggaatgctgtgttctccttgatcttatttttttttgctagattcttctctctgagttctcaacgtgaaagtagacagaattttttcaggacttctttagtcatcttatatagtcccttgctctcttccaatcccatccattcttgtctcaccaacctaaatgcttatatttctacttgtcattatttgtagtattttgataatcctttgtatacttgcttgctagacaggctcacacaaaggcagagatgtgtttctctgttgtatccccagttaacagcagagtatttggaaattgtaagtattcaatatttattgagtttcaaaaaaactcaataaataaagcctaatataacggttgcaaggatgaggtgggtggtgaggtatcattacatgggaatgaggcacttcagtttcgtttgataaactcctcctttttaaaaaaattgactgtaccctgtggaattcctgaagtgagacttagaagattcttgacactggctatttcaacttttttttttttttttttttttagtaaaaacatactaaatctttattgtccagccaaatcctcttttctgcatttaatgttaatctcttcttaaattttgagttcagaaaagcctactttacgttccatgatcatcattgcctttttatgaatagaagtttataggttgcattcatctctctcttcgttacaaattaactgccacaatgatttatatagaataagaagccttattattactactaattgtggtacatggtggatggtgaatgtatttttagctaacctttattagtactttgctaaatattttacattcttcctcttgtaattaatgctatacctcttttacaaagaagaaatattaaattacaaagcttggaatggccaaactgcaactcaagcctaccagaagaaaatgatcttaaatattatgttctaactacccagtacttcctgtctatgccttctcaccaggagtgcctcgtatctcatcatacaaacgggtaggaatgatatcacaatgagagatgaaagaagaatgtaaatttcttttgcataaaggtggaatactcacaattcctcaccaaagcgatgtgattttacattctagtatttgctttattgaccaattgtaccttcatgttagcatgacaaaaacttgaaattaaattcatctttaaaccattttacttgtattttggctaaataataatatttgaggagtctgtaagtttaaaaggggagacatctaaatggattgcccttgctattaagcaggtttttcaaagttagtcctcagaccattttgctggtgtagggcaaattcccccttccctttgcagtcagactagatcaaaatttctggttcacccaatttttacagcaaatgtctacaagcttacccattcacaagtactttaataataacctaaagaataattttgtcttgtacatttataaaggtgatgtgagaatttattaaaaagagatcccacactatggaacaaatatattattaaatatatattatttagataattggttaagcataagtatgtatgcaggaaggaaaaagaatgtgtgtttaatgttagccaccaggtcatggtgacagtaatttagagaaaagtggcagtggtagctctgtaatatatatttttgaattttcattattaatttttctttatcttttttttttttttttttgagacagcgtcttgctctgttaaccaggctggaatgcagtggcaaaactatggctctcttcatcttcagcctccacctcctattcttaatcaatcctcctgcctcagacggaactataggcatgtaccattgcgtccagctagttgttttgtatttcttttgtagagatggagttgtactgtgtttcccaggcttgattcgaactcctaggctcaagccatcttcccacctcagcctcccaaagtggtaggattacaggtgtgaatcactgtgtgcagctttgcataattccttgatgcactttttttttttttttttttaatttgagatggagtcttgctctatcacccaggctggagtgcagtggcatgatctcagctcactgcaatctccaatttcctggttcaagcaattaccctgcctcagcctcctgagtagctgggattacaggcactgccaccatacctagctaatttttttgtatttttagtagacatggggtttcaccatgttggccagactggtctcaaactcctgacctcaggcagtccacctgcctcagcctcccaaagtgctgggattacaggtgtgagccaccatgcctggcctatgcactccttaaacccctattggtcttcacaaattcctactgaattgttgtttaattcatttattcatccaacaaatatttaatctagttcttcactcagctaagtgttggtcaatattttgtatcagacataaagtgctattaaagagagtcattctgcctgtttgcaattgtcaaatatttaatttttgaagcccacaggtttgtcatttgccacacacggtttcatcttctgagtttgtttttccctggctgtttctctttcaatttgctagtgtatatagttgttttcatactggagctgctaaaatcttggctcttttcaaatgcaaagatgccctgtatttgcatttggagaatgtttgcaaagaattttcttcaggatacgtctttacaaaggacctactgtagttgtgttataaggaattttatagcaattcctgatttttaggtataagaagtattatatcccaactggtacgtttccttgtagataactactcattttatagaacggtttacttttgagatgtttttcttactactgtcaaaataaaataatgatgacttcttttgaaatttgaaatttttttgttaatgttttagtctctagtgcctagcatgtagtaggcactcaaaaatattagttgtgtggtaggatgaataaattagcaaaaaaaaatcccccaatctgcagcaaaaactcttttataacacaattctgcatctccaaagctttgttaattatcacatgtgttttgacaaagaaatggaccagatagaatattttatgctttcaactagagtttcaaaaagtgactatgccatgtaatacaaaagagtagatagtatccttaaaatacgcacatggaactcttccaaatgcagacccttggagtattttcaaatctccttcttactgtatgtttacattctaaaaaaaaaaaaaaaaatcctatgacttttctcaaaaatgaatggccacctctctaacctttaacatggttggaattgattgttcctaatctttatggatatctcctttagttttgtttttatagtttttctagaatcccagtgccctgccgcaattatttctgcaggccctttctgctcttgaccctttctatttctattattttttatcattttctttagtcatatcatatacttcctctgcacctggatcttctcttgtccttgaacctgggctaaagagaacactgtaaatgctaatgaattcagagttgtctctctgtctttccttgaatctttccccttgctttctccctgctggcactctgcctctgtctgagtagtttacattcctggaggtcaaacttctttgactttggctgctcctttatttggggtcggacaacagtgatcatttctatagatttccttcctctgtttccatctataaacactactcgagcttctcttacatacagcattctcttacctctgagatttagactttggcatctgaaagtctatagacattatctctcttcatttcacagatgaagaaagagttgaagtttctggttaaatttggtgcattgaaagcatgccattcctccagaaacctgactaaaataatagaaaaaaataaaagagctaaaaatctacaggaacaatcagtagtgaagacaacagcagctgagaaatgacacaaaacttcagatgaaagcagatgggtgagtaatgagtgaattggcagagcagagtggaaccctgggtgcctatagagaaggacaccagagaggagaaggtcactttgtcccccctgggccttggaaagtccctcaggctctaaggaattacaggaatcagattccgtgaaaggcaaaatttggaggataaaaaaattagaattggtttatttttgtaaaagaagcgattagaaatgtcagatgccttttcccacttctcacagcaagacaactacttccttctcaaacctgaaagagaaattaaatccatttttcagataaactgacctggaagagactttgaactgggattccaggcaaagcagaggtgagattagcttttttcgtaaaagccaggagcttccccaaatgtctgcatagctaatggtaagaatacccatcttttaactttgtctcctataatggtaaattattattgtcagaatcagacatctgtgagtctccctataaaaatctagctagggactccattaagttacagggtagcatatgaattcatgaacccagcccatgtacaaaattcaagatcaatttttaaattactcactctgagtgaataaagaccactagaaatctgggtaaaaattacaacgtgggaaatagagacaaaaacaaaaagaagctcagtgaaaatagtccacactatgaaagggagaaagcatcataaagccatgattaatattctcagggagataagggaaaatgtcgcgctcatcaaacagaaacagtatgctattaatcaaagaaattctcggggaataaggaggattcatttgaaattgaaaatataatagttaaaaaatcaaagtgttaaaaagttaatgtaatcttctagactgtagaacaaagagacaaagagatgaagttcagtactcaactaataagagtttcagaaagagaaaaagaaggaaaaaaaatcaagtgatgccaacatcaaagaaatgagaagaatttttcaggaagtgggagttagaagttcctataatgaaagagcccgccaagctctcagaaaaatgggtgataaaaacccacttcaaggcaacataacatggtcaaatgtcaaaactaatgagtttttgatgttttcagagttaaaaatgtggttacacatgatggatcatgctacagagcatgtagatcatgatatggatcatgatgtaagcacagaacttccctacagcaatactggaagctagaagattgttcttcaaaatttggaataaaacattttccgtgaatagttctatatgcagccaaactttcaactaatttgaggacagaataaagacatttgcagacatacgtgatgataaacagttactttccatgcaccccttcttagaaagctactatcacaaaatattagtggcataacatcatcttctaccacctgtatttgaaagaataactgcttattgaaatcagagggttggtttacagattacttattttaaaagtccaggatacctcatatttaataaatactgggtgttaatagtgctgagttacttgtcagttcaaattgttaattcgccagccagcaagaccctgagaattcagcctcttacctctgtcagaattgcacttaaatgttctagacatattaaaatctgctttttacaagaaaattccttcttccctgtatgacccattctaacacttaacaatttcccactgctaagaatttctttgttatgtctcagttaaatctcttaaattgctacttaagtgcatttattattttttccattttggtgctttgttatggataccaactaaccaatgcctgcatgtgtgtgcgctctctctgtctctctgcctgtctgtttctctctccctttctaatcaagcttgcttcaaattcaaagtgaaaatttttcgtttgttttttttctttttttaattttattttattattattatactttaagttttagggtacatgtgcacaatgtgcaggttagttacatatgtatacatgtgccatgctggtgtgctgctgttttgacatggtatctttaaaacaaaatgaaggagactatactctgaaagctaatttagggcaactcatggctttcaccaattgtagtcctctgatgcataattctgtagcataatgtttctctgaataatgtaaatatgaagagaatttggctatttactgacctttggaagtcttactaatttaatttagctttctatcccttggaatgaactaccttcctggaacttcctattctgttgtcattgccatgtctatgggactatattgttaaccactcactcagtcaaactgagtttaatgttaaatgattttaatattcactgttgatttattttctctcctatgtaagtagaaacaaaagcatatatagaaagacttaaaagacctgatttcctgaaaaaaaaatggttaacttttgaacacaggttcttgtagaaaatattattaacataaaatttaaatatatagtaaaatacatacttatattacacaaatattaaataactttctataatacaagcaatttatgaagcatagataatgtgtatttaccctttatattaaataatgaaacatttttgttaatgtgttagccttcaaggataactttcctgctagcagtagctgataatgatgctactgagaagacatcttcaagagagatttatactctaagtagatcacagacaaatcaatgcataaaatgtaaataggctgcgtgttgtatcattggtgatttctgcttttatttagaccatttaggtgactacctttaaagtctttggcagtgtgtgggtggtcaaagaatttctaagctactccctcttgctttcagatcattgaaccaatttagctctagttaataactctattaactggataatggttactgtccttttatcagctcagtaacactacatccccattataaacaactggtcagtaacataaatctctttatatagtaatacacaaaatgctttgtctcttaagggcagtctcacagacagtaactagcactatatttttcattgggaaaagctgcctcaggctcctgtggggctgcaactgggtagcatcttctaatctcttctccagagttgaacagatggcagctccctgattggaaacttgattcaatgctgcatttagtgtgattaaaacaaatggtgagcctggagctgggtgtatacaccccacagaacaggtggcaaaatggaaagtgaaggtaacctgtttatttgtctacacaacactaaagaaatggcttgatgagtattctccttactagtgtgaatctttttttttttccttcatcaaatgaattgaattgaccagctgtattggtgtcctgtagacacagcctgaaaagtctcctgctctaacaggcttcaagctagtaggggtctgtagtgacgcagcaggtgcagagagatctaagcccttgaatgtaatgtatacacagagctctgcagacagccccatggagctaccacataagatggtttttcatgtgtaaatgagaaggtcttttcatttttcaagctattgcattatatccccttctgctgaaagacaaatacaggaaatcaaccaacactgagttaattacagagtgaccagttctataatcaggattgcagatttcagtcttgaggtttaagtgcacaagcatattttgcactttggtactcatagttcaagccatcttgggaagtcatggttttcatgattttgctccctaggacatcagtgctgggagcctattggctttgaatgaaatgactaccagaatgggggttgaaaacaggaaatacttttagggtgaagaattacgaagagctcaatggctgatttacaatgtgagaaattacttggagtggtgttttaatagaaatttatttccttgaaagttgctgctagaaagcgatgttgaagtcttctagaatgaatagaagaaaataagcgaggataagatatatctttaatgattctcagtgatgtttcttaattgtggaatgaaaaactctatttaaaattattgtaaaaaaacaagtctttttctactttcaatattttggctgtgtaatttagctgttgaaagagtaattgtgatttttacttacgtatcagtaattttttaatatatttgatattcctggtcctattatataatggaatcctaaaatatttaaaaaagaagttgtcatgctacttgcttatgtacatgcttatgtatgtatgagtatagatgcatacacatatatctttttgctgtgtatgtatgtatctatatatacatatatgtatagacacacacacatatatatacacatatgcaaaacacgctatgtactattccctccgaaacattcaacaatttatttctaaggtgttaaatgaagacttaataatgaatgctaatacctttcctatatgaaggatttttcatgatagacattgaaatatgaaattttgatggtactattattcccattttataagtgaaaaagctgactcagtaaggtttggtaatttcccaaggtcacacagctcatacattacagggtcaggaattttaacttcggtcttaaatcttttaatctgacatgtaccttttcttgttaacatatatgttaatataaaagcttcaagtacattgcaatatgtagtaaagtgaatattacatatacatgtgctaaaaatttgcatgtttaacatttcttgaatgaatatgttttttctggcatacatctaatgtaggaatagttaattacaatccagtttttgtaaacaaggtagagatcatgtatatctttgtttcctttagtgacatacgtcgcctaaagttgttcttccatatatggatcgcatttatgggttttttttttgtaagcttagcctcaaaagattaatatcagaaacataattttaatgccaggtttttgttttcttattattgttagtagcttctgaaaatagaatttatctcttttccatatagtaccttcatatgatgtagctctctgtaatgacaggtggcattttttttgtatgtttgtttgaacaaaagctcaagaaaaatctgaaacagaaatatttaatatttatatactcaaagaaggcatcaaggacaagccttaaagactctttggcaaaagctcattactaagctccatgtagccagaaacttacatgatttgggaacttaatgtttatagaagtactgacagaactgtgccaaatgttctggataatgtgtcttgggagagatcaggtgggttcagattctactactccatgtattttgcaataagactggattccagcccttgacttcctgagtacaaaggagaaaaaggaaagggtatcagttattccatagcggacaacttcggcacaatcctgttggcttttccacaagtgtctgctattggtcagctctgtcattgacagctgggggatcgatgcctgcagaacagccactaatgctaatggagctacacatgttaaatcccactgccctgacaaaggacagattctggtgttgaatgtgagacttctgtgaaaagcaagatgggactgatctcactaaaataactcttccttcttgcaaatctatagctttttacaagacaaattgagctttttttctctctggtatttgctgggaaaggaaaaatggaggaaaaatataactgttcttcttggtggtgctttaccagtatgactagttttagaaaatgcagtttttaaaatacagaaatattcttcgaatagttctagtcattgtctctgcataatctcatttattcaggtaaaaatgatggagccaataagttctccagatgtttctattaataaatatttcgctattccagatcctataaaaaaggaaacaggatgactagagttttttcaatcttttcttctgaaattataaattcttttcatgatttgaatgtggatactgatagggagttatacattttaactgtgaggtttggattatttaacaacttctcctaagtattatcattgctcttggctttattctacttgatactacaatgattccttagtagaattttctcactttagaggaaacattgagttgataaaggaatttctttcttatagagaaaaagattgggttcgttttctcctatttcatgaaagtgttcattaatgtctagatgtctattgaatgcctacttttactgtccatcagatgtacatctggggactgggactcgccttttattgtgggaagacataaattgaaccaaattattgcataacatgtctagtgataagtgccaggaaggaataccaagcagcacagtggagacagacttgtgggtaagagggctgctattttatatgtggtgatgagagcttagatggtgttagaggtaaggagcttgatgctaaatgtttgctattggcttatttggaaagccagacctagaggaatatcaaaatgggtaacctctattcgttttagagcacgacattttacaaagtggcataatcggacatttttctctctctaatatggcataattttgagcgacggagccttgagcaaagaaatctgtcaccagttccttgtcacatcagttacaggccacaattgggaatattgagattcagaatatttcacagcattaaagaaagcctggaagaattttgccatcactttattgagctcaggaacaatattgacttcagagtccttgagatacttcaatctctacttctttgcctgttccctatgctttcttctcctcctctccaccccccaccccttactctccaaggtggatgcagtcatcagtctgcagaattcatcatggcatgcttctcttcgagttaaaacctgaaatctgtcaagtcacagtgtcgattattgttttgaattctatgcctaattgtggaactaccaaattagcattctgcacattttttccaagggttttctttagtttccctaccaccaaaccctagggttgcttgctgtatctacctataaagaaatacacagtcttccatacaaatagttaaaagttttgtggtaatttaatcttcagttggaacatgctaggtggtcttgcaccagttgcttgtacttggtgaataggcaggcgtggagctaaagccttcaaaaaggtaaggaagaagtctaaggacatgtatatgtgcatcagcaattattttttaagccagattgaaaactcttacgagaggtaatacttcccttagttccctgatgaagcaattgaggctcatttggccagtctgcctctcaatgcagggttctgaaagattatctgagttactaaaattcaaacatcaaacacataattttacctttttgtgtttttagtgtgtatgtgtagggggtagggtagtgtagctgtaggtatgtgtgtcattattatataacagatttcactggcttttgcagtaatatctctcttaatacattataatatccttcaattctattttaagttctcattgaactgataggattttgctattttaatgatgtttactaaaatcgataaaatgctgaatagttttttaaaaaagctttgtgcaacaacaaataaaatttatttcgtactatctattaatcttaatcttgtagtagatttatcatacatttaaattcttcacatgcttgctaagattaccagaaaaaaaataacaaattgtagctgagcagatgaggaacgcatttatcattgcattcttctcatattttactcagaacttacacaatgattattactgtccatacatttaaaatatgatagtaaaatatgtaataattacaccatatcctaggccgtaggctaaaagctttgtgttccttatctcatttcctcctcattgcactcctgtgaggaagattctatgataatgcctattagagagaaaataaacacatggttgatcaggttggaaaacttgcccaaagttacataaccagaggtgggcttaagattaggcaggtgacttgagaacagacaccaaacttatgccatttctagagactagtggagaaaacatgaaattcagaattggcagttcctcattttaacagcattataattttagatattgttatttgactcacaaaacaggaatattaagaaaaaaatagacaaatatgtgcaaaagtgccttgaaaatgttcatactagctaaatagatatagtttcatttattatttccttaaaaaacaatttcttgccaagcttttttgttggacacagtaggctataatttaaaaagtaaatgagaaacagataaagttatttaaaaatttttaaaaatcaatgcattgctttttaaaagtagcattgaaaatttcacagctttaatgcaaggacctttatgttataattttcatctaacacaggtatatgtaggaatgcaagagacttgatcttaaaaaataatgtagaatatcataaatatttatcatatggggcaaatatattttctttcttagagctttcaataggttaatatgatgtgaaaaacagcaaagaaattttagccaaactttggaagaacagcaatgactgaaacacctctattcatattttaataaaaatacctattaaactattagaacgtaaacattttaaatagctgtccctgaaaaccgagagtccactgaaaaaatataagaatttatgtaaaattccagcaaaatggcaaatttaaacattgttggtttatataatcagatggaaactgtcttaagaaacttattgtattcaaattagcaataaaatacataaaaatgctcagaaatatactaaataaaaaagaagtaaaacgttgcatgtgatatgaaacttgactttctggatcagtggagaaacagacaagtcactgatattaagtattataaatacaatgatcataagccagttggagaagactaatgaaatcaccatagtattttggtatttttcactgggttccctactcttgtatgttgttgtagcttaactttttaaaaaacagctttcttagtgtataattgatatgaataaattggcatgtttaatatgtacaattttgttttccaatatataccaataatgctatcactggagtcaggataaacacatttatccctaaaagtttccccatgccttttgtaatactagcaaccattcccttcttgactgcttctactttcttaagcaccttctcatttgttttctgtcactgtagattagttttccttttctagaattttatttaaatggaatcatacactatgaactcttttttgatatggcttttgccaagcacggtggctcacacctataatcccagcagttttggaggccaaggtgagtggataacttgaagtcaggagtttgagaccagcctggccaatatggtgaaaccccgtttgtactaaaaatacaaaaattagctgggcatgaaggtgttctcctgtagtcccagctactcgggaggctaaggcaggagaatcacttgaacctaggaagcagaggttgtagtgagccaagatcatgctgttgcactccaacctgggtgtcacagtgagattctatctcaagaaaaagaagaatatagctcttatcactattcataattgagattaatctatattgtgtatataaacagtcatttttaaaattgttgatttgtattccattgtggaaatatgccacaatttgtttatccagttacctaatggccactggattgtttccagttcttggctattacaaataaacatcaatgaacatttgtgtataagaagttaaggcatgaatcggatatactcctccctaggtggtaagttatatggtttggctgtgttcccacccaaatctcatcttgaattgaggttcccataatccacacatatcatgggagggacctggtgaaaggtaatttaatcatgggggtgattatccccatgctgctcttctcatgatagtgagtgaattctcatgagatctgatggttttataaagggcttttttcccttttgctcaacacttcttcctgccattatgtaaagaacgacaagtttgcttccacttctgccatgagtgtaagtttcctgaggcctcccgagccatgtgaaactgtgagtcaattaaacctctttcctttataaataacccagctttgggcagcataagaatagactaacacagtaaattggtagtgcagagagtagggagctgctgtaaagatttccaaaaatatggaattgactttggaacaagataacaggaagaggttggaacagtttggagggctcaaaagaagataggaaaatgtgggaaagtttggaacttcctagagacttgttgaatgactgtgaccaaaatgctgacagtgatatggatagtgaagtccaggctgaggtggtctcagatggagatgaagaaattgttgggaactgaagtaaaggtcactcttgctatgcaaagagactggtggcattttgtccctgccctagagttctgtggaactttaaacttgagagagacgatttagggtatctggcaggagaaatttctaagcagcacagtattcaaaaggaagcagagcataaaaatttgaaaaatttgaaaaatttgcagccttatgatgcggtagaaaagaaaaaactcattttcaagggagaaatgcaagctggctacagaaatttacataagtaaccaggagtcaaatgctaatcagcaagacaatggggaaaatgtctccagtgcatgtcagagaccttataggcacctcctcccatcacaggctcagagacttattggggaaaattggtttccttggcttggtcagggactttctgctgtgtgcatcctcagacttggtgccctgcatcccagcagcttcagctccagccatggctaagaggggcgaaggtacagctcgggccattgcttgtcagggtgcaggccccaaaccttgtcagcatacatgtagtgttggccctgtgggtgcacagaagtcaagaactgaggtttgggaacttccacctagatttcagagagtgtatggaaatgcctacatgtccaggcagaagtttgctgtgggggtggagccctcatggcgaacctctgctagggcagtgtagaagggaaatgtggggttggagcccccacacagagtcttcactggggcactgcctagtggagctgtgagaagagggccattgtcgtccaggctccaaaatggtagattcactaacagcttgtactttgcgcttggagaagttgtagacactaaacgccaggccatgaaagcagctgggaggaggactgtatgctgcaaagccacaggggtggagctgcgtacagccatgagaactcacttcttgcatcaatgtgccctggatgtgagacatggagtcaaagaaaatcattttggaactttaaagtttaatgactgccctattgtattacagacttgcatggggcctgtagtcccttgttttgtccaatttctccaatttagaatgagtgtgtttacctaacacctgttccctcattttatctaggaagtaactaacttgttttcagttttacaagcttataggcagaagggacttgtcttgtctcagatgaacctttggacttggacttttgagttaatgctggaatgagttaagactttgatggattattggaaaggcatgattgtgctatgaaatgtgaggacatgagattttggaggggccaggtgtgtgacgatacggtttggctttggctaatcatgaattttagtgcccataatccccatatgtcatgaaagggacctagtgggaggtaattgaatcatgagggcagaataccgccatgctactcttctcatgatagtgagtgagttatgagatctgatggtttcataaggggcttttccacttttgcttgacacttcttcctgccattatgtgaagaaggacgtgtttgtttccccttctgcaatgattgtaagtgtcctgaggtctccctagccatgcagaagtgtcaatcaataaatgtcttttgtttgtaaattacccagtcttgggcagtcctttatagcagtgtgagaatggactaatacagtaagcattatattgatgatgatgataataatggtaactgtcattaagtaagcttttgctgtatcagactgtatcacattctatgtgttaaatgtattttatatgtgtaattgtaacaagataaatttaaagttcagctcagtcactgagacaacaaaattgtcagatccttaaaagtgtgtgcatatcttggaatgggatatcatgaaatgggatatatgagaatggctttcatggctcttgcgtagagttttctgtgaatgaagcattgatagcacaccattgtttcatcttgaaacgtagagagcttcaactggacttactagaaggcttgctatgcattctttgcagttgaggaaccctgctgtgattcctgaatgtaccactgaaaactaaagctgaatttggtgaagaaagatgtgaaagtaggaagctgcactcaagaagtaaacacacttacactgaatgcaatacatagtaatttgaacaggagtttaatctagttaatggggaccctatggagggtcagaggactccaatagccagtgtgagttgtagacaactagagaactagggctgaggatggaggagtggccaggaggctgcagtgctagaggctgagcaagagactactgtggagctcccggaagtcgcataaacatcttcctcacccagagaacaagcaagtactttcctgtcctggcatctctttcttgtactctttgaccttggtgagatttaaacagtggcagataatttgaggaaaaggtgaaaaagctgagcagagaaagagagtaggagtttattacatccgctccctgaagaccagcaggttaccaagtacaggatttgctccagaggaagaaaataagagcaaagggattaaagtgatgaattaataactttgatgggatgtagcaaattactgaatcaagacagggctttgtaacataaagttattgtataactatttattatcaaaatgtaaagggaattgcttttctcactagatagtttttgcttcccaatgtccatttaaaatttaagtttcaatttgattgcattccaggtgtcattcttgtgcaagttctgagtacatgtgaattattagctcacataatgcattggtttcgatgttcacagatgttcacgtgaaaagcaaaaaaaaaaaaaaaaaatagctaatagacgaggaattcagtagaaaataattgttgcccttcagattgccatttaaaccaggatcgcaaacagcttagtgttgacctgttctggaagataataactgtttgtacctcaaagagctagattttagaaagctctctgcagaaaaaaatatttaaggtgtgaatcctttcagaattgtttatttcatttctcagcattccattgttctagtctagattcatatcagctaactgcatgtctttctctgaagcacactatttgtttttaagcaggagacatgaaaaatgagagttctatattgagatgtaacttggtcacagcagaatgatctccatctagttatatcacagagctagcagagccttaagaaactagagacagggctttgaaatgacagttgcaagtataatgaaatagtcactctctttactcaaagcttatgggtaaagactttttttcctggcaggtttatctttttttaaaatatcagccaccagtcagacacacacacacacacacacacacacacacacacacacacgcacacccactcccacaacacacacaatcccactcacaattttttattgtgtatggtacatttagcagttggggaagaatgtaactttaaatagaagtcaatcttggcagtttcacttttaactttgtactaggattttgtattgtcttttctaaaaatgaactgtgagtgctgagagagaaattctagaacatctttgatctgaatagcaatgcaaatcaaattctagtaaacttatttacttacacttaaaatgtgttcattttttagtcctgcacatattttaagtagaaaaattttcagcatacattttccattctaactttcaatgttagataatcacaaagcaaattttaagaaatcttttatataaagcatctatgattataatcatttagaaaaaggtttcctattacatttggttagaaaatacttcaacataggtaaattgaataattatctggaaaaaaaatcttatagtgctgtagtttccagttttaattgctcttcgtgtatttttaatgagtattcactaattttataataaaatttttatgtgattactactagaaaaaatattttcagtcgcaaaacatcacaattagtcaaagtgtttgattgaaatactctcccatttaactagacaaaagtaataaatttacattttcattggcaaaatatttaacaccttgagaaaaacagttataattctagttaaaaatctaagaagctaacttggatgttccaaactcatcatttttcaaatggttgaattgagatccagagcagtaaactgacggagcctaaattcttttctgtcaacatatagttcatcagactgatgataatatttattgtttcattcttgaagcagtgctttaaaatcagtgtgaaggggtttgggtgattagaaaagtatttgtctatatgcataatcctttcatatttgtgtgtgaaacagtagggtgactgtacaattctaaaggacagttactcgcagttaagcagaaaatgttttcctaatttttcttcattcttcagcagttagtactatgttgtgtaaaactgattcccattttatatttactgagtaaaattaaatcagatttagaaaatattttttggatggcaaagtatggatgaaaatcacttatattatgatatagattaaagtgatataggttaaaaacaaagagccaaacttaaaactacattttctaatgcatgtgttacttaatgtcgacatatctgttggatgcaataactttttctactcactatttgacttatggttaatgatttttggattatattaattcatttggtatttatggacttataatttttttgtaattttacaggctgtatgtaccttagggaaatagaagttaatatatacatctataaatatatatataatatttataagtatcaatcatgttatagacattgtctcatttgatacaacagctccattagggagggaatattaacatgttaacattagagaaattgaggctcagtgagattaagaaagttggatgtatttcacacaaatattagaatccaaaattttaactgaaatctgcacatttccaaagctccatactctttctcattgactctctgctgaagaaatcgagcagtgaagaggagttctagtacattcattatctattggcaaatgttgacagtttcaaaatataaatgatcttaatctattcgtttgaaaattatgatcagccttagtccgtggtagaacctgagctgtgtacatgaagaactagcttgtctgtagtagcagcttgacaagaaaaaaggtatccttaaaggacaacctgccttaaggaattaccagagtatggtggtgaattttcctaagagttttgacagttgctaactttaatatataaatatgtagctcctgcctggtaactacaaagcacaccaaaactattgtactttgagtgttaattgtggtgagcaaattgaaaaacacatttctttgggatacaattttttccttacatacaaacagtatcctcctctattctctctatgagaacagatggatgaagcctcaatatacttactgcccatagcaaaggatgcttttatgagactttcaaattaggcttagacaagagttatgacttagtggatctgcttagcttggtatttttattctgacaaatagtaagaatttctataagggtgaagctgaaagggcaactgagacccctttgagtgaattagtactcctatagcattacctgtatggataatatattttttacctctgatgtgacccttacgaatttaattaagtgtgatggctggccagcatgtagataattccttctatggacaaaatttaaatgtttttttctcactgcgggcgaaatatttttggaagtccatgccaatttatgtcactcaggtaacttttctaacttttaggtatgagagttgaggaacaaattatgtgtgttgtcttgctgttatgttgcatgtctattaacaatagtcagatgtggtagtacagcatggtcagggttactggagatgtattataaaatgtacttttacagatacttcatttttaagcaggcttgatatataaaaattatatggggttttatttttttaaatgtatttctctgtctgtttttctctttctgtttgtgcacatttatgtgtccaaaattagatatcatattctctaaagaaaatgtgaaaaagaaccacattcagtcaatataacgaggtggatttttgttaagatagtaacactggaatgatttctaaaaatctgtctctagtaaagtttgttttctcctctgagaaaatcctattcttagcatcctgatacatagtacttcatatgccttatatttaattgcacttagtgacattgtggtgtgacatctttataaaccaaggcttctcactttaacagaagactctaattggagctttcattcaaagaacatgctgacaggtaagaggtgtagcaaaggctgcatggtgcaacagtactgggttttcaaaaataactgttgtttcctggtatcatggctctggataaagcatcctgtgcttcagcatctctatttcctcacctgtcaaatgttactgacaacaccttcactgtgatggtggacaagtaatgtatttggaagaatatgataaactttgtaatttatataattagaattggaacactgataaaacctactgatgaatgggtgaaaaggagagtactagaagagttcatataatgaaaaaggcaaactacactgattgtctgaggagcaggatagcaatgtgttaaaaacaagggactgggggctgttaaaaattctgacccccacctccactattatgatctcatcttcataccttaccctatgaagttatgaccactggcctccttgctctctctagaacacactggtcatacttggaatgatctaccggataccagaatgcctcattcccctatttccttcatatctctgagtaaatatgacttcatcacagaggctcgcccccgtaattgtatataaaatgccctgctgttctcagtcacattaatttttatccctttaccctgctttattttgcattactaccatatgatgcattgaattgtttatggtcttcccaccaaaacacaagcttcatgagaacagggattttctctctttgtttattgctacatcctcaagagttatggtctatggattaaatgagtgagcaaattgtgctaggagcagaatacttgggttacactttttcctcactatattaaaatggacatgtcagtcaatcatttttgcatttcatgtttgttgcatgtaagtaaaagatgagatggctattggtcctcccatttttacagattaagaaaccacggtttaaagagtttgccagaatggctctttttataaagacaaaaaacaatagattttggcataggcaaggaaaaaaggaaactcttatacattgttggtgggaatgtaagttagcacaacctctattaaaaacataatggagttacctcaaaaagctaaaaatacaactaccatttgattcagcaatctcactgtttggtatctacccaaaggaaaagaagtcattataccaaaaagacgtgaacacctaaacgtttactgcagcaatatccaccatagcaaagttatggaatcaacctaagtatccatcaacagatgactggataaagagaatgtggtatatatacaaaataaaatactattcagccataaaaaagagtgaaataatgtggattttttgcagtgacatgaatagagctggagattattgtcttaagtgaaacaactcagaaacaaagtcaaatactatatgttctcagttataagtgggagctaaataatgtgtacacatgagtataaagtgtagaatgataaatcatggagactcagaaggaggagaggcaggtggataatgataaattatttgatgagtaaagtgtatgacatttaggtgacgtatagcctaaaagcccagactttaccactgcccaatttatgcatgtaataaaattaacctttgtactccataaatatgtaaaattcaaaattttaaaattgtgactcataaaatccagtgctatgaaattgtaagaaatattagaaatataaaactctttataaactctttaaaatatgttatatttttataataaactagcaataaataaatagctataagccagtctataatttggtaggtggaaataatgtatagttaggtcactttgtttatttttatgataactttagacatggataagagttgagtaaaacaattcatttgggtacattaccaatggtactatctgattgctgaaaagtttatagtgtccactttctatagagatctgttataacttgagagcaacaattccctaaatatttaaagctttttgtaatacaactttttgtagatccacttaatttaatttttttttttttagaaaaagagttattaggaccagttagcactattttgactgtgctttcaaattaatttctactttgttcacttgctaagcatattgactgatggacctattataataactcaaaggtctttcaatgtttgtagcacaaggtttgacaagtgttcgagaaacaagatggagaatgattctcacacccaagactttttggccaatttaagtacataaataagaggtctcaacattgttttttcaaagaagagatcccaaaatctgttatgtagagaattttcatatgaaaataagagacaaaacatgaagtcttcatagaaaaccatttaaatgaatgtctagatagctgaagaagcagtctttgattcacaaaggcttataggtgtgtcaacgtcaaataaaatatatagagatggatatctaaatttaatcttttactgggaaaggcagaattacaatttggagcatacacacagacctggtggtctttggtttatatgaagaacacagaagggttggaggttgtgtatattgctgtttgaaaaaagtttattgacactagtaaagtttgctgagctggcattctttgattggtgagtgaagacagtgggtaaaaacaatcttaaagattcggcaggttatttcagaagccattggatacaactggttttatgttacactaggcacttttaccagctagacttcagagagctacctttgtggagcaatattatatgtcctaagtgctttttgtccctgatttattgactctgctttagttgggtatgacgaggataacccaattcgtattgtcaactttcagagttggaaagggaaaaatagtggtgttagtggactggggaaaaaagaaactattttttatcctaagtgttttatactttgcatctccttattaaaatttgggagaaattaccttaagtgggcctagggccatttagaaaaactgataattaattcctgttgctgtttattttccttcaccaggtgaacatattttattttattcacctaaagactttaggccaagcaggcaatatgccaaatgaaaagtttgttatgtggaaagatcttcaaaaattaagcaattttctcattcttaataattaattttaagatacagagttctcatcttaagcacattgataaaattgaattactttttagcttttctctctttttttaaataaggtttagttggctcatgcaactttaaaaataaatcaaatgcttcattagaaatgcacaaataatttcatctgattaaatagaggaagatattgaaatgctttttagtttctgtgttactgattctgcctagctgtttataggtctgttaccttgcacatgctgtttcaaatccactgggggcagtttaaatgaaattggccaagtaaatatgacaagaagaaatgctttttattctcctatagagttaataaaaaaaaaagaaaaagaaatttagtggggacataaggtgaatgagggaaatgggtatgagacatcagccaaaaggttggtacaaatacattgtttgatttttttctgatggaactgatgagtcatatgaaagatttttgacatcagtctatgtatgttgcttatttgcttgacaaagacagcatgaaataatatttagtaaagatttctgaaaaacttctctattgtgtgaagtgaaaaaaaaagtcaggatttgccaaattgcctcttatttattgaaatcttttttttctgatgctcattagaaatacatggttccagctactgccgagctgtaattaagaggaagcataaagtatagaacagggcaagataggataggtgtgtgtgtgtgtgggcagaggtgggtgtatgtagaaaaatgtgatttgaacagtaggtgtagaagatagaagaaatgaactatatccaggtgcatgtgtaatgcatctgttttgtttctaataataatgtattaaaagcttaaataaaggaaacatatattctcagaagaagaccattttaatgtacatctgaacttcatctgtggactaatcaatatgttattctgatataaaaggaaaatacgcttggtctgcaaggattccttagaaaacaaagccaaacaaaaatgaaagttcagatattttttcttatcatacgttgcttttttccatgagcagcagtaacctagacgtttttatctgaaacattagcctggcccagtaggtgtcagattagatatacattactccattatcttggtagactactctgcatcaaaggatctatggacttggagaatgaaagggaaagagaataaataaaggatatctcttttcagttttagagtagcgcttttaacattaagaaaaatcaataactggattgactgcattcagtagggagcattattgtttcccataatgtatctaatgcatatcattaccagagtaatcacattattatctgcctcggccttgctacttgctcggctagatatgaagccaaagctatttgtaaagtaaggtttttccccctttgcaaaattgctgcaaattgtattcttcccattttctttattagttgtttgaactagcctgcacctctgaattcagattaagtggcatggttttttgtggtggttattatttttccccttcaggattcgtttttactctattcaaattaaactcacctttaggaaatgggacacatcatgggtggtttgttgtatcggttggcatgggaaatagagtagtataaactgtaacttagggtgggttttgtgtttctgagataccttttgaattcagcaactgcagtgattgcggagtgtgtctcaaattgtgttaaattccaaccctcctgtgcagggggctcagtctgaaacaatgaagagcatctagagactagtacattccatttattttctctcctgattacaaaggggggtaaaagatgtacttatactaaattttagtggcatatctgactagggtataatgctcatttatgagcttcatgatatttagctatttaaattggatgagacttagttctcacatgtagaattggagtaataaactcgatggtacagatttttggtggatattcaagacaatacatataagatatctagccaagagcattgtagtggtgcacttccaagtggcagtgtaataaaagaggagtggcagagaagaaattctccccagaagagggctgaaataaatacatatggaacatgtttctctatagaattcattatgcttctacatgcaaaggagttgctgatgatgtcttatgaaaggattaacggtgagaaaggaaaatgaatgtacaggaaataattagattatttgattagagttacttgcattcatttttgttctgggttgaaagatcacttactatcaacttgccagaacatttgttgaaacatgttcccgaggaaaacagcaaactaaattaaatcagtaaaaatacatacacacacgcaaaaatagaaagtatttctcctgtattttccttttcacatacttcttgaacttgcttccttgtgctgagcaatgtagtcaaactcagatcacttagcattaaataggaaataagggggacatgcaactggactaattcatggacctggctgaaagacttctgagaatgaaaggatgacatttctggtaaaataattgttctaaggaaacactggttcttccatccttcatttctcatttcactttcattctaaagatgccattatttaaggagagataggagttttctaatcagaaatgcaaattgcctgtctgcctttccttccttccttccttttcttccttccttccttccttttcttcctgcctccctcccctccctcccctccctccctctttccctttctccctccctccctttctccctccttccttaattccttctctccttttttccttcccttgttccttcattttttgacgaccaattcaagagtatgggtaataattgatataatagcccaatttgacacaaatgtgaactttggcaagcaaaccactttataaactcacttgaaagtacttatttgcttacagtcagttgttaagaagataataccaaagagctgccaatatgtttccatattcagttctatctctacattatggaaaggaaaccaaagtacttgggaacaaaaaacctctctgaatacagatttcaagagcattgttcaattgggaacttgcaagaggcagagcagaaaatggatgttgtagttttccttttagtccagatggaggcatttaaaagaatcatgcttttaggatctctggaacaaaccagcggagcttataatatgaagaccaggcattactatataatatgtagggaatgcttttgctgtgatctttaacttttaacctatgttctgatagttttataatattactcacctggtgttcaacaattcaaattacatacacaaacacacatgactgtagaaaaagaagcacattttgcaatttcccaaggaaacaagtttgagaaatatgtgaaaaggaaagtataggagaattactttctatatgggtgtttttattattgtttaatttagtttgttattttcctcaggaatatgtttcaacagatgttgtgccaggttgatagtaagtgatctttcaacccagagcaaaagtgaatgcaagtaactctaatcaaataaactcttaatagcctctggtcagtgagacaggaattgtctagtcaagtttaaaaaatcaatagtggccactcaaaattcaactacagttagaaactaacaaacttgaccacattccgaaagatcagaagttatttcaatctgacttcttctttcctaattgaataccttttatttctttctcctgcctgattgccctggccagaacttacaacactatgttgaataggagtagggagagagggaatccctgtcttgtgccacttttcaaagggaatgcttccagtttttgcccattgagtatgatattggctgtgggtttgtcataaatagctcttattattttgagatacgtcccatcagtacctaatttgttgagagtttttagcatgaagcgctgttgaattttgtcaaaggccttttctgcatctattgagataatcatgtggtttttgtctttggttctgtttatatgctggattacatttattgatttgtgtatgttgaaccagccttgcatcccagggatgaagcccacttgatcgtggtggataagctttttgatgtgctgctggatttggtttgccagtattttactgaggatttttgcatcaatgttcatcagtgatattggtctaaaattctctttttttgttgtgtctctaccaggctttggtatcaggatgatgctggcctcataaaatgagttagggaggattccctctttttctattgattggaatagtttcagaaggaatggtaccagctcctccttgtacctctggtagaattcggctgtgaatccatctggtcctgggcttttttgggttggtaagctattaattattgcctcaatttcagagcctgttattggtctattcagagattcgacttcttcctggtttagtcttgggagggtgtatgtgtcgaggaatttatccatttcttctagattttctagtttatttgcatagaggtgtttatagtattctctgatggtagtttgtatttctgtgggatcagtggtgatatcccctttatcattttttattgcatctatttgattcttctcttttcttctttattagtcttgctagcagtctatccaggagcttcctggattccttgattttttttgaagggttttttatgtctctgtctccttcagttctgctctgatcttagttattgcttgccttctgctagcttttgaatgtgtttgctcttgcttctctagctcttttaattgtgatgttagggtgtcaattttagatatttcctgctttcttttgtgggcatttagtactataaatttccctctacacattgatttaaatgtgtcccagagattctggtatgttgtgtctttgttctcgctgtttcaaagaacaactttatttctgccttcatttcgttatgtacccagtagtcattcaggagcaggttgttcagtttccacatagttgagtggttttgagtgagtttcttaatcctaagttctagtttgattgcactgtggtctgagagacagtttgtcataatttctgttcttttacatttgctgaggagtgctttacttccaacaatgtggtcaattttggaataagtacgacatgctgagaagaatgcatattctgtttatttggggtggacagttctgtagatgtctgttaggtctgcttggtgcagagctgagttcaattcctgtatatccttgttaactttctgtctcattgatctgtctaatgttgataatgaggtgttaaaatctcccattgttattgtgtgggagtctaagtctctttgtaggtctctaaggacttgctttatgaatctgggtgctcctgtattgggtgcacatatatttaggatagtttgctcttcttgttgaattgatccctttaccattatgtaatggccatctttgtgtattttgatctttgttggtttaaggtctgttttatcagagactaggattgcaacccctgcctttttttgttttccatttgcttggtagatcttcctccatccctttattttgagcctgtgtgtatctctgcacatgagatgtgttttctgaatacagcacactgaagggtcttgactctttatccaatttgccagtctgtgtcttttaattggagcatttagcccatttaaggttaatattgttatgtgtgaatttgatcctgtcattatgatgttaactggttattttgctcattagttgatgaagtttcttcctagcattgatggtctttacagtttggcatgtttttgcagtgcctggtactggttgttcctttccatgtttagtgcttccttcaggagctcttttagggtaggcctggtggtgacaaaatctctcaggatttgcttgtctgtaaaggattttatttctccttcacttatgaagcttagcttggctggatatgaaattctgggttgaaaattcttttctttaagaatgttgaatattggcccccactctctcctggcttgtagggtttctgccgagagatcagctgttagtctgatgggcttccctttgtgggtaacccgacttttctctctggctgcccttaacattttttccttcatttcaactttggtgaatctgaattgtccctgtttgcagatgatattattgtatatctagaaaaccccattgtctcagcccaaaatctccttaagctgataagcaacttcagcaaagtctcaggatacaaaatcaatgtgccaaaatcacaagcattcttatataccagtaacagacaaacagacatttgccattattgttcttacacttatgaatgatatatgttattgttttatttgcttagcatgtctaatgcatatcatttagtggaagcatcccccaaattaggagctccattgtcaaaggcattctcttctaaggtttccagaactggaggcctcaggatacagtgctgtacagtagctcaaaactccagttttgctatcagatagactcatttctgaactctgacttatcactcttttctctgaaacaagtatctttttctgttggaaactcagtttcttcatttacgcagcagggctattcacagtgcttagctaatggcgtttaatactctatacaggagaattaagtgaaacacttcagctaatgtgtaaaatatctagaacagagtaaccactgcatattcctattgtagtataacatacaatagctgacatagctattataactctgtgttttggtttggattacttacagtgattcatatacaaagcccacatattttatgaagcatctactatgtaagttactctgctagtttttataaaatattaaaaataggtataatgtcattctttttattaagtagcttctaatcaagcaagaggtacactgataatacattagtgaatgcaatataagttataattgcgataggtaaaatcaagtaggaaaaaattctctagtggtaagaagaaaagagagatacctttcgacttagtggaagataatcaataaactgtagttattatttttaccattgttgttgctaattccaaatacaaagcaccctagtagagctaaaccaataggtctcttaaaatacagggatatcatgaaatgatttattaaatctgttaacagcattcacatgaaatctcttttgttaaaaacaaataggaaagtaggcaaaaaggtattgtaaaaagtttagattctatgactatattgtgcttaaggcaagtagatctcattgagaagaaatctattgctgattaaaatatgagctatctcattaatcacacagtacattagataataaattgtggttgttaacttgatatgcaccattgaacatggagaaaaaatatcacataggcagacaagtgctctagtgtatgacagtgtaatagcttgtggatatattctttttgtaaatatgtctgctgcatatcttatgtcttactgaactgtgctgtaaaatatggttattctttaagtcacagacattaatgctgaagatttttcaacactggaaaaaatcatgcatttgaatagaagaaagcgtgagatagaaattaacatttttcactcagagtatgtcattctaatatttcattcagttttctaagggagctttgaagatgttagattttaaaaaatgttttggaaaaaaaaagaaactaatgacatagtccactgacaggtaattatgtgaactaattgcacggactgatgtaaactgtgatcaaggatatttaactgtctgttctatatggatctagtgagccggacctgaaaatttgctgataacagaagtagaaaagaatggaaaagtgttatgttctgtagaccagggaacactttttttttttaaagaaagaattaagatttctttaaattttgttttcgtaaatgtacaattttaccatgaagagattgttgaaaattaattttgacctggccttgtgttcagtttgcttgacaaagtaacatattcagaaaactggacgagtttcactataaatattgtttctgcttctgtccaatatggcagccactagtcatgtgtggctactaagtacttgaaatgtggttaatctgaattgatttaggctataagtgtaaaatacaggccatatttctgtattatttttatgctttatcttctttaaaaaaaggtaaaatattgtacttggatatataagttttaatgagatgtgtcaatttcactggtttctttttaactttttaacagagagaggaaaatatttatactcatgtggcttccatttgtgatttgttatgtttctatcaaacagtgctgtttttttgtggtacatgaataaagtgactgatgatggaaacaatattctgaagaaataatcttgacctcctcagaaacacattaaaattactcacattgtggccataagcatgtttgttttagtttatgtataaatcattgtaaagaaaccatataattcaaaatatattatgcattttaaaaacgataagaaaaatgatataaaatcataaatgtgtggatagataacagtgcaaaatctgaaatgcagaatagccatttgttaggtgaaacatgtatgttcatgttcttatataaagcatatgttccaccagtaattgctgcattattcttctattatattattagaggcattgtgattataaaggaaactcttccccctatatggtttaaacgtttgtggaaatttatcttctcactgatgaattttaaatgcagaaatcaatacaaatcatttatgcaagaatctttgcccaagtcccttccatctatccctgcaaattcaaaacaaaacagtactctgtctgttccaacaaagactacatggaacatctccttttctctccttctgttttcttttcttagatgtgtttttcaaagggggaatgagttaaagacagaaaaagcccccagtgcagtcacaagcaagaaaaatacaataagtgactctcaggatttattgctttggagtactacaatagactatctttgggttcataataaatgaatctttaatacctgatagaatgcatacatatctccaagtaggtcatttatgttttcatttacattttctaagattcttcatttatatttttaaaatactgtgttcttccaggaattattccatataaattcaaagtacaattgttgttcccctagaaatggagccattatataccaggaatcactgtcagaagggaatgtattctgaaacgtttttcacatgcatatgtgttggatgtggttattctcacatatatgtccttcgtagaagtcgtctgtaagtctgtaagagccactgctgggcttgtatgtgggggccagatctgaaggttaattcctgttaaaaataagtatcctgcatatgcaggtctgaagcagaaactagcctgtgaattctaaacctctgctgtccaatacagtagccactagccacatgtgggtgtagatcacttggactatagttaatgtgacaaactaaattttaaattttatttaacgttaattaaggtaaatttaaaaaccatcactggattcagtgtttgaaaaacttttaagtatatttggaacaactttggatttactttttcaggaatacattttatgttatctaaatacagattgagtatttgcagccaaaaaatttcaaattgagatgtgctgaaagtataaagcccaaagcagattttgaagacttagtgctaaaataaataaacaaaataactcctaagtcattttacatagattggatgttgaaatggtttggatatttgggttaaaatatattaaaattagttttacctgtttctttttattttcttaatacagctactagaacgtttaaaattatatatgtggtttaagttaaatttctatggaaacagaagaggaaaatacatggaaatatatttgaggtaacaaggttacagatgggatatagtgaccagaatgaggaactagtgccagcagagtgagagtgggtagcaaatggaccaaaagagaagcagctccttgctctgttggcaggtcagtagcttgtaattcctgaactgtcatagggctcaggatcaagaacgtgactttttagcatttagtgtcttatgatcaatgacagacaaatacattattatgttgctttaataataacacaattatttttataatttaaattttttattcattttttaatatatagagatggagtcttgctgtgctgcccaaatttgtctcaaactgctgggcttaagtaatcttcctacctcagcctgcccagagttctgggattataggcctgagccactcagtctggccaataataacaaatttaattattttttaaaagtattactgtatttcagtcttctttcagcctacaatatggtattaaatgccttacatggagacatataaaggattttaccataataacctttaaaacaaaagtgatttcctagaattataggacagaaaaaagaatgttaaaacaaatttcatttcccagggtagaaatctaatggaacattaacttggggcactttgttatatcaaatctagtccatagctaagaactggattagattaatcctttggacagtttggaacaaattgtattacattgtgtttgccatggaagtcttattgccttcatgttgaattaaaatagcctttctctctacataagtgaaatacaagctcactgcagagaaatcagaatactaacaagcaaaaagaggaaaacaataatcacttgtaacccataccacccagagataatgactgtaatttttccttgcattttcttcaaggaaacattgttggtttttagccagggtttggtatgccttaataagcactgcatcacaaactctgtatttaatacttttcacccttttctttgaactctctttgggctgttttcatagcccagactgaggttatctgttgtagaacaacaacttaataaatgatgtcttgttggcttgaaagtactctttatatagatttccaaagcaccaaacataaagccaggaagttctttattcactagaaaatcttgttgaacattttctgacattattagtacaatggagagagtgaagatgaaagaagaatgaagaattctgaatcttgaagagcctgtgcttattagtactttcagcagaaattatgaagggtcacctcatcagcagattcatgaagcctcattaggtaaaggctttaaatgtttcaagagtaatccctcatagaaagccttataaccatcctaagcaaatgctagacaaacatgcctacctgcccatgttgacctttgattggcgagagtttgtgtttcctctttaagaggaagatgcacacccaagtgtgaaactacacagacaatttagcagtgctgtatctgggaatgcaaacctgaggacctaaagtttggcagaccacttgagatgaagtggagtgcaaagtgtccttcgtccattcttcagatagttgcctccattctctctgattttcattctctctattgtcctttcactcagtcttgatattcaactatttttaggacagttgaacaataaaaacatgcatcctgaagttaggaaaaacaatggcttggtgtcctgttccagaatcttctgtgtttattgattttgagataatttgttacataaataccaacgtctctactgtcccttacccaactcccaccctatccctataataagggtaactttggggaatatgctgcagattctttatctccgagttaatctccaggtgtagatcaatgccaaaagttcttagaactcctaggaagttctcagcttctttgagtttctggtccatttggcaggaaggcaggctgaaggggaagagtcaaccaagctaccttgagaagtaagtggaggtgctgaaaacttcatttgcgcgcccctgaactaggttaaacactagaaatctgtgtgcttgatttgcgaatttggtacatatagcctttatttcatggcaatgttggccatcaagctgcaaaggatttttaacatcctttaaataaaggacataaaatgaaataccaccacattgtctactgtgggactgctacagtggacaatgtggcagacaagatatatacgatgctattaagaatatttgggttatactcaatttcaagtgatagaattcatcaatattttatttgtattttcataattttattcatccaatgttcatcttttctgtgccaggtattttaacgagctctggggataggtacatctatgaacaaacagcagatgtgatttctgacctcttgaagtaagacattaatttatagttatataatattccttaattcctacggagcgagaaaagtaagcaatgacacagtgtaattggaagtgctagcataatatgaagattcaggaaaaatcttccttgagtaggtgacatttaagcgatgaaatgttccctgatacattgctagatgctatgactataaagataagcatagcatagtccctatccctgagaatttcatgtctaggaaagagacttgaaaaccaatcacagtcatttattaaaaagcctctacaaaagcatatgaattgtagtggattccaaaggttgtgggtgatcaattctagccatctcagaaaagaccttatgaaaagagattactttaaatgtgagttttgaaagacaataatgttgaaggctgacaaagattaccaggcaatcaagacaaggaagaatatagcaagtattgtctgtaagataaaaaaaaaaatgcctaatatgtttggcaaactctaagtagagattaaggtttgggaaggcaattgaccaaaggtgaaattatatgtaaagcaagttggtaaaatataaaacatgtgaaatgttgtatgaaagagtttacacttctctttttgaagtagaagaggcaatggagtattttaatcaaggatttgacattgatttgtgatttaagattgatatttctgagtgcaaaaggaacgaagaatttggctcctagataggctgggctcagggaaactgagtaggagaccattgtagtagccatgagagaagaatgaaggacctcaaatttaacagtagctggggagattcaagagatttttaggagtgaaaaatcaatgctaattgaagagtgactggctaggacagatgaaggagagagaggactctagaaaatactgagatttctaccttctggattatttatattatccatgagacctctgctagctagtgaaaaggttaagatttggggtttgaatcctgcctctacaacttgtgaattatggggcttggaaggagttacttaaatgtgacaagcctcagttttcttatctgtacaaaagtggcttaaaataattttgagagattcttgggaagataactaaaaatccttcaagaatcctcaattaagataaattatatagaatcaaatggtttaaggtaagttcagtgttaggcatgccaatttttaaattagcattgtctttctggatggatatgtccagtaggtattcagaaataaggactgaggacttgagaagggggtgcaaacagaagcctaagaatttggagatattattattatgtgatcttggaaatcacaccagtgggtgtgattgctccaggtaaaacgcaggaaaaggtttgaaatgagttctcttattgcagtatctaataagtatgcagaagaagaggaagagctcaaaaaatcaactaaaacatggtttaaacatagaaaaatctaaaaaacaagaacaaaagtaagaacatgtgcctagtgtaccacaaggggtattttaagaaggaaccattagcactctggcaaatcttatagctgacaagtagcttgaggaatgaagagaactctgaatataacaacaaagagatcactgtcagccttggagagagaaatctccatatgatggttaggagaagagtgcagattggggtgatttaaggggagaacagaaatatagaaacagtcaagagaaatacagtgctcctgtacgaagttagtcatacagggctgggtacaggataaagaggcttgaattcctagtaacagataataataataaggacctaggatcgagcaaagggggtaatgattggagataaatgatgaaggaatgctctagaagtgactgcagttcaggatgtaaaaaacatgtaaggaggcagggcgcggtggctcacgcttgtaatcccagcactttgggaggaagaggcggatcacgaggttaggagtttgagaccagcctggccaacatggtaaaacccggtctctactaaaaacacaaaaaattagctgggcgtggtggcaggcgcttgtattcccagctattcaggaggatgaagcaggagaatcgcttgaaccccgggggtggaggttgcagtgagctgagacctcgccactgcactccagcctgggcgacagagcgagactccgtctaaaaacaaacaaacaaacaaaacaggaagcattaatctaagatggaagaaggtgaaaccttcttttgagtcaaaatgtaagggagcaagtttagaaagaatattagtaaatggaaattaagaagcttccagtattaattcacctgttgtttgatactattcacttttatttttatattttatctgatactttatgtgttgatattttatctaataacataagtaccttaattgctatcatgttttaatgttatctttagataaaataaattattatgttatcacccaataaaagctaagtgaaacctcatctctgtctgctgcctcctacagacacacacacacacacacacacacacacacacacacacacacacatatacacatatatacatggaaaatactgattgttaataaagtagccccaagaaaaataggatctcagagactataccatcagtgctagggttgaatgttatcagataaatatctttccctaatgatttgtagctcttcaagaaaccttggaactaagcttcatgaaggactgacatcaggacattggagtatgtgttaaatatagctgtttcagaataaaatgatttgtattatttattgatataaatgaggttttgcttgagcatttgcttgttggaaggatgtttttacatagccatgctttgttatgttaactgttagctcaagcttaaattagaattgtaagcaattaattttgtatcatgtttacatttaaaaaacagaagtaccacaagacctttcctagtgaatgaacacatagtttaattagatcatcttgactttattgtatgataagcacataaacataaaaggcttcttctaattctggtgatttttgaaataataaagtccagattctggatttatatgatgaagcaattgcagtagattgtgtagatagaagagcacccatttgaaaaaaagagtccattattttttgagtttttgattatggccattcttgcaggagtaagttggtattgcattgtagttttgatttgcatttcactgatcattagtgatgttggacattttttcatgtttgttgaccatttgtatgtcttcttgtaataattgtctatccatgtccctagcccactttttggtgggattatttggtttttttctttctaatttgtttgagttccttctagattgtggatattagtcctttgttggacgtatagattgtgaataatttctcccactctgtggatcgttggtttattctgctgactgttactttagctctgcagaagctctttagtttaattaagtcccacctatttatctttgcttttgttgtatttgattttggattcttggtcatgaagtcattgcctaagccaatgtctggaagggtttttctgatgttaacctctggaatttttatagtttcaggtcttagatttaagttcttgatccattttgaattgacttttgtataagcagagagaagaggatccagtttctttctcctacctgtggcctgccaattatcccagcaccatttgttgaatagggtgtactttctccactttgtttttgtttgctttgtcaaagatcagttctgggttctctcttctgtcccattggtctatgtgcctacttttatatcagtcccatgctgttttggtgactgtgcccttatagtatagtttgaagtcaggtaatgtgatgcctccagatttgttgtttttgcttagtcttgctttgactatgcaggctcttctttgggggttccatattaattgtaggattgctttgtctagttctttaaagaatgatggtggtatttggatgagaattgccttgaatttgtgattgcttttggcaatatggtcattttcacaatattctacccatccatgagcatgggatatatttccatgtgtttttgttgtctatgatttccttcagcagtgttttgtagttttcctggtagaggtctttcacctccctggtttggtatattccaaaagtattttatttttaaattttggcagctattgtaaaaggggttgagttcttgatttgattctcaggttggtcgctgttggtgtatagcagagatactgacttgtgtacattaattttccatactgaaacttggctgaattcatttatcagttctaaagctttttggaggagtcttttgggttttctaagtatagcatcatatcctgctggcatggatgtggtgtaaagggaacacttctacactgctggtgcgaatgtaaactaatacaaccactatggaaaacagtgcgaagattccttaaataactaaaagtagaactacaatttgatccaggaatcccactactgggtgtctacccagaggaaaagaagtcattatatgaaaaagatactttgtacatgcatatttatagcagcacaattcacaattgcaaaaatatgaaaccagcacaaatctccatcagagtggataaagaaaatgtgatatatatatgaaggaacactgctcagccattaaaaggaataaattaatggcattcataacaacttggatggaacttgagattattattctaagtgaagtaactcaggaatggaaaaaccaaacattgtatgttcccacttataagtgggagctaaactatgaagatgcaaaggcatactaatgatacaatggactttggggacttgaggtaaagagtgggaggggggtgagggataaaagactacaaattgggtttagtttattctgcttgggtgatgggtacaccaaaacctgacaaatcaccactgaagaacttactaatgtaaccaaataccaactgtttcccccaaacttatggaaatgaaaaattttaaaaaaccacatagtccaaagctgattggaattcttcattattctcactcaaagtcagcatcatctcaaagtcattgaaaggaataagtttgcatagaacagcttggattttgggttatcttaatattataagtatcttaatggttattatcttgctcgctttgccttacagttcacttagagttttattttgattttaccatgatgtaatgatctttagtattctgtccttggtctgtatctcttcttcaccagcctctagctaggtggcctcagtcatattttcagctttgctatttattgtgttctagtgcctttgaaatgagtttcactagctatgttcatgtatgtaagtccaaacgctgaaggcatatctttttaaatatcccagcaggattcatacttaatatttcaaaactgaacttgaaccttttctgtgaaacttatttgtcctcctgtatttcctactgaaggacacaaccaaataaaaagagttaaactggaagaaaaccatagttccaccatcaaggtaaaatcagtcaacatattttattttactctgggcttttctctaagcatggcatttgttttcaattgtgttaatacaatttttaaatttttttttttttgagacggagtctcactctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaaatttttatttttattattatttttgtagatatgggttctcactatgttgcctgggcttgtcttgaattcctgagctcaagcaatcctcccatctcagtctcccaaagtgctaggactgcaggtgtaagccactatgcctgactcattttaaaatttatttaaagaatattgacatttttttggtgggggggttcttttatcttacaatgttgatattggtaatttttacttttattttaaatagccctttcacccaagttttaaatatttttgcaatttagcttaaaagagtctgttaagatataaaaacaaatctatcttaagttttgctacttaaaaatttctgttttataaaaattatcttttattttaaaaattttgttcagtgtggatgaaaacttttttattagcattcagtgttagttacctttttatgcttaacatttcattttgatatagtctaatgttcccttttttacatgctttgagtttagtttgttctttttctacctgcttaattattattactttttttttgtcggagttttgctcttgttgcccaggctggagtgcaatggtgcaacctcggctcactgcaacctcctctgcctgggttcaagcgattctcctgcctcagtgtcccaggtagctggggttacaggtgtgcaccaccacccccaactaattttgtatttttagtagagacaggttttcaccatgttggtcaggctggtcttgaactcctgaccacaagtgattcacccacctcggcctcccaaagtgctgggattatagacgtgagccattgcacccagccgttctatctgcttaatttaaacaccctgttcaatacatatacatatatatatataaatacataaatatgtatgtattttaaaatctttttgctatatatgattagaatgttatattgttaaacgcatagttagcacatttcacaagattcgataggcaatatttttattgttatttagctgtaagtgttttataatttgctttatagattcatttttaattcaggaattatttagagatagaatttttcagtttccaatatatataataagggaatatcctttgtggttttaattttgttgctcatggtctgaatgattgttctttatgagttctttggaatttgttaaaatttcctttttggcctacgtattagatcagttaatgctagttctaaaaatatcagaagcttaatcaaataaatatttttcactcatgaaatctaaaacacatgctccaactaagaggcatcttcaggattctaagatattgctgtatattggcatcctaccactaatcagggaagaaagaggctggaggattgtcccttaaatttagatgctcctgaaaatgtttaatacacttttacccacagtccattggccagaattcagcttcatagcccatcgaacagtagggatgactgagaaatgtagtttaaccatgtgtccaaaaggaaagggatgtagttaggagaaaaccagctggtgtctttcaagccatacatgttgttaatttttatatatgttccttcttcactagaaagaagaaaaatctatttactagttgattgtggggtttaatgcatcatgtcatttaaagttgttcattgtgttctatgaattatagtcttattaacattttttctttcgatttatcagattctaaatgagaggactacactttcccatcatgaatgtgaaaatctttttccttttttaaaatcagaagactatattgttaggctcatatgatttcatattatattatcacattattcttgttaatgttctttggcttaaattctcttctggctaatatcaataaacacctgctttattttgggtaagttttgctaggtattctttcatttcacatttagcttctcatgttattttaggttgctatcttacaagtagcctatgattagattttaaaatatccaatctaatagttgatcttctgattaatatatttacttcgtttacgtttgttatgcttattgtgttacattttgctctgttgatttgtttcctctttcttgtttttattgaatcagtaggatttatcccctccttttcttcttgaaattatggatgtcatatattgtattttcatccctaaagagtcacactccaatatttcataacaaagaataaaggtatcatatgtatgcatgtacatgtatgtttgacgaggaccttggcatctactgcttttgtctaaactcccttacttatccttcatccacttttagtttcctttttcttaaggcatgtaattatttccccttaatttttggacacaaaacttgtttgattttatagtcaatatttaatcataatatggtttgttttattttggcaattttgcttctctttctgttcttttacataaaatcgcatgtcacgaaaagagataacgagattattaacagagctaagcaagattgagggagagaacatttttcttccttgtgacagtttcctaggtactttcttattttctaaggtatttctttttctggttcctggaaaatcttttgtatattcggagatgaagaagacaaagaaatgatattactgataaggactgaactaatttattataaaatataaccagttcatgaagggttttaatattcaaccatctcaaggcagtgatattatataaagaaacttgaacattaaaattcttctccataggactagaattttttaacctcaaagtaaccataatgggtgttctaatataattttaggttttatgaaataatcccaatataacaatttacagtttgcttaagagttaatgttttaactttctctgcatttgctgtttatagacttacagttatataatgattgacttctcattctttttaaaataataactatgttattattcaggactgacttcagattcttacaaatacactataattaaaaaagtaaaatgattggtactcatagaaaagaaaatagaaaacatttgttttggatagaaatatgactgaatatctaaaaaatgcaagagactttaaaataaaatttaaaaacaagtttaacaagttggttatagagtgaatgtgtgaaaataaatgggtttttattttatgtaatatgggtaaaaagacctggagtggttacatgtatagatagataaaataacgctttaaatattcaactgtccagtgatagctttggggaaaaatacatctgcaaaagagatgctagagttaatatttatgttatggaagaacctcttttaaattgacaaaaatttttcagattaaaattagcagagtgtatgaataggtaactcactgtgggactaattctaatggcactgaatcctatgtaaagatgctgacacactagagaatataagtaaattcattatcatatttatcagactgcaaaatttaaaagagctgtattacctgttgctggtggggatgtggcaaacgtgaacaattggttgttactgatatacatgcaaattattacatcatttctgtcacagtcataacatttcaaagtacatataactttcattttgatatcccaattctgtaacattatttcttataaataaaattattagtaagtaaagatatatgtacacagatatttactgcagcattattcatagtaataaaaaggaacattaagagatttcctatcagtagaggaatattggaataattacggtgcccccacactatggtgttgtacataactaccaaaacagtgaattagacttacatcacttaaataatttccacaaagtacttaagtatgaaaatcaacatatgaaaaagtgtttataattgttttaattgcaaaaaaaatcatccataaatgttttcatatgtatgtatgtctatttacttttaattatttaggctttaacaaaaaccatgaaagatctatcctaaattgttatccaatatttgctagaaaggagtgaggagtgtggagtagcagtaggggggaaaaggaacgacaagccaatatgttaataccttcagtatataaaataaaatatatgtataacaaagtaataaaattagatataaaataaagtatataaataaaaatccacggaacaaaaatatcttaaaaatctagaacgtatgttactccatttacatatagttataatgaaaaaaacaatataaaggcaataattaagactgtgaatgaagttaatatatctcaacaagatatttgaggagattaaagttaaatcactgggaaatggtagatgcctgacaaacactcttatctgggaattttacatgaattttaaatttagcacttgagagatatttgggttcaggtcctcatcaaatgcattctcatttatctcattattataacggcaactgtaagcaagcactcagagatctatgtgtgaaagatttacaaatacctgtacccccccctgaagcaggactctcgaaactatttcctgctgctaaatgatggtttttatcttctaaaataagttccggaataaaaggaaacaacatagggtgaaaaggtcatgaattttacagttaactgggcatcagctttatttcaggctttgccacataccaactgtgtaatgaagggtatataaagacaataaagccacaattatctctccattaatgtgtcataactatatgctgataactgtcaataccagtcaaatggtttggatgatcagaggtcagccactagaggagaggagtttgtcatagcttagattacttacctgtgtgaccttgagttagagattcttctgtttattcatccccaaagcagatataatagcaatgttatccatagggctgttgtgagaattcagatggataacacacgtaaagcactatttagagtgctacacatactaaaaaagtattcagtggaaacaaccaaaaataataaaaaaaaatcgtatccaacgtggccttggaacataggtctagggggaaataactggggcaaacctcagctacccaggactaatactttgggcctttttttttctgcctctgtgtgtgtgtaataatgaagattaagtgttgtgtattatcaaggaaaattgtccaccttgaacctaatgataaatatgaaaacagtaacaaaacaataaaataaaaaacagccttagaaatgtgaaagttatcctagttacagccattaatcagagttactaacgatgcattatttattactatccagcatattatctttcctgtgcattgcaacataccagcattactttctgtacaactctggccaaattatttgctctcccattacttccgttgtctcaggatatcaataagcattttcattagagaaactctaagttctatttcagttttaaaatactatgactttatgaccaagaaagggtttacctcccagttttgtacttagagtcaacacttaagagaatcatgaaagacttcttgtccatgttgatgtgtttattttctgagtctaaagtctttctcctccttctcatctatcttccccattaattcttcaagtttcttctccacatattcctttagcgaccttcgtattgccttcattttcctccgatgaaagatgcaaaaatggaatctagagtaggaaaagaaaataattccaacttcaatatcagtagccccattctttaagccagttatacattgttttttttttttttttttttttttttttttttttgctggatacttctccatttccttttgttccaactattatcccgtcaaactttgcattttattcctttcagtatcccagaatttaaaatgacttcttttgctttatttccatttggaggaagagggaatttgggcagtctcttggcaaaaggaatatttgacccagtgtttatttggagagaagaaactcacagtaacacagcacttcccagtattacagctgttgccagcaatatgagaaatagagcaatctctcgattctcagcctttcttggatcctcgtctggaaggagaaacaggaaaatatgaaagtgagttttggagaagagaaatagcttgtgacatttattcagaatagaaaactcttttaacctcagtttgccctgtttactacttcatcactgttccatgcttattttgacctttattacttttagtctcctaggttctacaaaactgttgctgatagctgtcagcaaaattcttcccagcctaatttcttcattccaagcctagcctcttcatttctcagcctttcagttgattcagtgccaaattatttatactggtcaaaatttcacccaacaccctagctccattttgtaacactaccatgacctccattaaaggtcatgtagtgacccaacaaatacatgtagaataaatcagtgagcaaccctgctccttaatccctgtcccttcaaaattccataccatgatctttgttacctccacaatattctcctttgaagcacctgttagtcatgcgaagacacgtccaacaatcaagaatgggaccttcaaccacaactgataaagaggagaagaaagataatcagaaagagggcatggcacgagggttccttagtcatacatcaagtgtggaggatttgatctcaagcattcccaggactctcaagtttgcattgctgtgaatttcttcttctcctagaaatcaagtttcttgatggatcaaaatctgtaagtctgatctccaggaaaaagcgggaaaaggatgcctcagcttatactggggcaatgggttgtaaaccatatgttagaaggcctcctagtacctcaaaaatatgtggggtgtctgagatttcatgagctaggtttcgttatcaggtattgttgacgttaccccttgtaaccacagctctaggaattggtttcccagtgtaacaggtgggagagatagggccatatagagcaaaggagatgggaaaatatgggctgaaacctcaaggcgtcacatgtactgtactcactgcaatcttcagaacaagctagaagagaatcagaaagttctaatgagtttaaaaccagctacagtttgccatatttatacccaagtagtctttgtttaccctttaagttccagttacctctccacccattctaaataactctattatgaacttgcatttcttccctcatcccgcattttctattcccttcatataacttcagtgctgttatatagaaagttttacttaccaatttcagagaagttctttagtaattctttcagtttggattccaggttttggcagacatcgagaagcttgccttgatagataaagacacctaagagggagtggaaggggtgtcaaaaaatagaagtagctcttcccttcagaagttaattatgtctgtttttatctttgttttccccagccaaattttctgaggcttgcttgagcaatacaaacttttaacattgaaacagtacctcacctttccatgtttcattgcccagtttataaaattcattcttcaaccatgttctcaacttaacaacctgctgaacagctagagagggagagtaaaggtacatgtaggggaataattacatctatgcaggaagttatgtagacccaggtgttctcttccttgcctcccttctccgtttaagcccctggactctcaggaactcaagcttccctcacccaacacccgaagcctcttgtcactgtgggagaccttgaagcttaaatgaatcatctccttaatctgccgttcaagcagctgagttcggccggggacttctgaaggtatcagatttcccagcaaggagccaacatcctctataaatttggggtcacattctaaacagcctttgactccatggaaggctgagaggggcaggagcaggaataaccacaggtcacccatttctttcttcacccccgctccccgacagcaggttgtcctggcaactagttcacttagttccttttccttcaaaaatccgggaatgagagcctggttctggatagtctgactccacttttcccgctgtttccatcccactatcgggcaatctttagttgtttagtttaatgatctttagttgtttactgactattatccttcattctaggagagggaactgccagctggggagcggatacctgagttctgagtgtagaacaccaagagatagagaagccttgagctcacacaagcagagttctgtgcagggagatgtctcagaaaaagtgtttctttagccctctccctgacttgcatcctcatgagactcttaaaccccctcctgaccttcagagatgtttatcatcagagatgggttatggaagtgatcctatagaacctgagagattgcttaactcaaactctgcttctacattagaggtaagaaaagccaagaatattgagtttcttgcgggtctcggtccctactggggcagtattgttgacaaatactggtggcagtattgttgagaataaaggagtgagcatttatctagaataatatttggcaattttaatagacagtaacatatttcaggctacatttatcactaggatgattttctagacatgacttgtaatcttttccttttcttcttgctttcttctcttttctttcccttccttccttccttccttccttccttccttccttccttccttccttccttccttccttccttccttctttctttctccttttcttttcttttcttttcttttcttttcttttcttttcttttcttttcttttcttttcttttttttcttttcttttcttctttcgagatgggatttcactcttgttgcccgggctggagtgcaatggcatgatctcagctcacttcaacctccgctcccgggttccagtgtttctcctgcatcagcctcctgagtagctgggattacaggcatgtgccatcatgcctggcttattttgtatttttagtagagatgaggtttctccatgttggtcaagctggtcttgaactcccgacctcaggtgattcacccgcctcggcctcccaaagtgctgggattacaggcatgagccactgtgcctggtgatttctaatctttttatagcattcttcttatagagagtgtggagtcagatactagaaacaatagttgaggaatactgagtgatgaatccaataaagttcagatcctttaacaagtgcattctaaaatactggcaaagtatgtaacatataaaaacatagtggttatcatgggcttccctctcagaccacctacaaggaagatgtccaaataaacatgttctcctttcaatggccctttgaataaaaatattctgtgttatttgaataaattgaggttgcttttcagactcttaagagcactggttacctcttttctaatacattgcctgtatggctgtgaccttctggaaaccaggaaacactggcaatctacagggttagtggtagaatttatatttaagatatggggtgatcacagtggaatgttgtgcgggaagttaaaagaattaccattacttatacgtctaccaagtccatgtgacagacattgtgctaaacatttcaggtagtcacaaattctcatggcgcgcaatcctttggagattgtcatttctatgttactggtaagaaattgagactcagagatgtaaaagaatcctcgctggaagaataatttagagtatgagttcagggttcaagctcatgtcttgtgtggttccaaaccctatacattttactgcctctcaacaacaacttgctgggataacacagaaaattatctcttggaatttgataagtcaaaatatgaaggccaatacagattacttgatttatggtttaaattagcatatctctgctcagattttttttttattcccttggctagatgatctcatttttagaggatttcccaaaagattttcacatgctgaggtctgaaggcaagtgagctaatgggattaaattaactctagatagtaaagttgaaaactaaaggggctaaaaaatttggcagagaagtggcaaggtatgagaacaaactgtgcttcaagaaaagatatgcattatagatattttccagtcaatgatccataccttcacttagacagttcaaagagtatcctctgacacattactgaataattcaatggcacattactttaacccagacttagaggtccatctatcatttttatcattgtctcacccttccagcttaaatttcaatcaggtttttagaatgagagaaaaaaaatggcttttggatagtcttagaaaggctggaaaaaggcaagtcacttattaagacagatagaacttgtaattgaaagaatacatatatcccatgtaaaaggaataacaaggaaggaaatctcagtctcatggagtaaacagtagaaagataacacaatgtgctaatggtaaacccagaggtacacatcgaggtttatgagaaaacagagcagtactagctaagtttagagaaatttttatagaaaggctggatccaggagattagagacagtaattaatatatcatgatgagtgagaatccaatagtgttcaggaacctttagggggaacactctaaaagtactgatggtgaaatgtataacataagaaaataaccacaattatcatgggatagcactttgaatttcgtaaatgtaaaatatttgagctttgggaaagaagagctgtctggaaattgattaataatgtaatgatcacattacttaattaaaataataatgcctgtgtctggaaagcaaaaggctaacacccaaaccctagaataattaagttagtatatggtttggcttggcaggaagagctatgatttatagtcagcacaaatctgcagactagctagctaaactctgtttaaaatagtatgagacaaataatggcacatacattcataatatttttaccaactacataatgactcatttgtagttgtaacatagatattcatgggtagttgtttttatactaaaacactagcaattagagagtccctcctttaagggctagaatcagttgtttggtaccatttggcctttgttacaaatcacataaggtactgaggtttgaaatttgaagaacaagtttcataaagagcaagatttttacagaaattctccctcatcccatggtagatctgatttctcagatttattaacaaaaataatgaatccttatcctcaagcttcttacagccatttttctgatggattatttatgccattgagctctgctctattacccatccctacctatcacttcacaggattccttaaaagtttggcaaataatttagataccttttatagtcacatgcagttaactacattcctgactgtaatctgagatcaagaagccattacttgacatttggccatgttataagctatatttctaggtagtgtaataatcgtatttgaaataattactatataccagacattccacatgtagaataagtttaattttctatatacctccccatttatattccattgtcattaagctaatttatttcctcatatttcacttatcctttaggaatagtcataagggtgggtaaattatagggtagactagaagatttacaatgaatctttaacaggaaatgaactaaaaagctaaacacatcaaggcgattgtgggaagaatgaggggaggagggtagcggaagcagaagatatgtgtcacagcttattttctctctatactagaaatgttgagttaaatcctcatattccatgagcttttgccctgttccctttaagggcttttacagaataggttaatagaaagggctcgtgagacgatgtcagttcctatgtggcatggaatgtcttaagatgctttcactgggtgctggggaaggatgtacaactcaactcaggatctgactggcacctttgctggcatatcaccaaggcttcaggtaaagggaccctgtgtaacagccggagagcagacctggtaccagggtcaggaaaggaagtggagtctgcagcaagcgtcagggccttgttgggccaaatcattaggaaagaccaccagttactgatgcaactgagagaaaacaggttgaaagtgccccatgtgcagagtttctcaacaaatactataaatagatttaggaatggtattaggtaaagttacatcttcaccttggaagataccaacacactgtcaaaaactaaaacacacgttagtggagaaatttactgcacaatttactgagaggataaaaaatcaggagtttttaaacccctctctagaaggagagggagtccatggtggttatatttactacattttcacacgctagataggaaggattgagtccatgactggacttgtagttggttaaaacaagcctggattttggtgattatgaatttgttttaacctggctcaagaaggtctagggtcccagagttactcagacttcatagtttcttaacaatttcgggaggttaaagctagctggcatgaaacataacagttttgatatgttgtaggcaaacgctactgtaagtgaaaaactttcttctacatgagacacatccaagacaatgacccctcaaccacacagtgccatgaggtaacatcagctcctacctccccattcttacatcctgtttggaaagaaacaagaggaaaaatgtgaaagaatgattcttccaaaagaaatggagttatctaaaaaaagtgtttaaattatttggtgagattaggcttattatattatgctaatattgctttttattttttacccaaggaggtgaaaagatgttcagagaaagctaagaccaatagactatgaggaagctatgtctctttcgtgtatctgagagcagtgtgaaaaaatgtgtgaccttgcaacataaatgtcatattttattctcaagacaagcttgcatgactatttccattttataaaatacaagcctgatgtttggagccattaaaggacttgtccaaggtcacacacttagtcggataaagatttgggggttgtaacacaaatttgtctgccttcaaatccatgttctttctaaaacaccaaaatttcttttctgaagagagttaatccaaggtcacatcatcattgcctcagagtagcaagaataggtactcttatgaaattatatttgaaaaaaatagaaagatgttgtgttcttttcattcaattatttaaaaattatggagtctgtaattcaaccatcttttagttttctccccatagccaattcttttctccattcctcccaattatttctatagaggaattgcctgttgattaaagtacctaatttctttaatgacacatataaaagatacagatgttaacctagttcgccataaataaataccaggtacatgcagaatttctcctttcctaccttcaaaaggaataaaaacacaataataaaaccaataatgagaacccagtagccaataagaagtaatttcattgaacaaaaagtctatgtcaaatagtgttttataattcttacatgcatgatcttataaaaatctctattctaaaaggctggtcctattttacccatttagagatgagagaactgagactgagtggttaagtattttcaaccagaccatagagctctctggcagtagagcatggatttgtatagttttgaatgattccctatttattttctttaaaccatcaaattctcagtttttggtagccaagaggaaaaaatgtaccctttccctgtacgtaatgaactggcttatttctgataaacttatacttagtaggtgagacattgtggactaatatatggcactagattcaattttaattctgatccttgtaggaaaagatctctttgcagtgtgtagagtcaaggggttgaactcttagtggaatttgaacttaatggttactacccttcaagaactaattttattgttaacttttttttacattatacaacttttctttagtataaaattttgcatttggacctttatttgcagacttgtatttgtcatcttgttttgcagtattaattaggatagttttctcttgattctttctaatatgctaagtaagtattttctgtgtaatacaacctgtcttcaaactacacctgtaggtgttggcttatctataagatcattggaaatttaatcaaatttcattatatcttgcagtgtcttctgaaaaatgacctcaacaaaatttgctatctacctatttactaacataaatgaggaaaccaaaaaggtcaacggtgaggcaggaaggtttcagttcagtggagaaaagaaaatcttgatgaaatgtcattaacttccatatttggaataagctataaaaggtgtggaatctccattctttcaatccgcagtcagtgttgggcagtcctccctcaaggtttgggctttactgaattggaagtcctcctagctgacatagctgttacaatatttagagtatttagagaatgataccatgagaagtttctgatttatattattttttaaatttaatgaaagtataacagcagatattatatatatgtataatttttttgaaaaatgaaaattctggtactacatacactagatgaaaaaggaatttgtctagttctacacattatcaagtcattttttgcctaaacacattcaccaagatggattctaaaaaacactacaaatcagtttttttaagtggtaagaggtatattttctagaaaaatataaaatggtttccaattgtagctatttaagaatttcaccataaatacttcatcaaattcttttgctctgtgatgatttaagaccttgacaaagtatacattgaccactttttatttttgccaagtttagctctatgtctgaagggcagatgcgataaattggtcatacattatctcatttgcagtctgagttttatgagctcccataaaacaattaccatatacacattttacaataaatgagcaaacaaagcggctgcaaacaatatggaaaagtcaataattaatttcagatttccaaatgtaacagagacaagggagctttctcttcttctcaaaagggaaggtttctttgttaggaatatgcaagcatgttaattcattactgtgtggtttctctttttccaaagcttgtcgaaggtctaatttatgtgcaagactgaaagctgtttaaacggataatatgcctccttcatgagaaataccacccctttatgctccattaagttcagacgttgactctataagctacgtaccaattatttctttccagaaacagcaacgtagtttttttctgcaagggacaacagattattgtaggcggctattaatctccacatagttcacaaaatacacaggacactagggagaaaacaatcacgttgctattttaacatttgcaaaatgctatgtggagaggaaataaaaagaagatgcttgtctgattgcaacactcctttattatttcaaatctcccaaagatagaaaaactcttaataatgacctgctgatgttgaagcatctctgtgatagacacagaaatgagtctttatctggttgatctttgttttctccaacatgtatggctgacaactgcacaatccaactgcatgagacggttggatgtgagagtgagcaaaaatgcctattaaaatgctaaaataaattcttatacaacaacagcattgttgagtgcaatgataatggaacaattcgcagagtaaaaaccagaaaaatataccactacttcagtataacctgctgtaggttagaatttaatatgatggcactgaattatttttaggggagtgaattaccctaagtagcagagctgtttacaaaactattgacactgatactagcccatgtatcaaaatccaaggattattttaataatgagaagtcaatatcttattgttaaaaatgtatgactttatccagtcaaaagtatgtaagtgcctacatttaacttacatccaacaagtatttattgagcacttattatttgtcagaaaccatgctaagtagcaacaatagaaagaagatgggagagaaatacctctgctacggcatgcaatcaagtggaaggctgatattttaatctaaactttttttaatgtattgaggtggctttttcccccaagcattcatttttgttacacacacacacacacacacacacacacacgcacgcacacacagattatgtatatgcatatatatgcatatatttattttaaaaaattaacagtctttatgtttctgaatgggaattttgctccattccaaacaaatagggaaagttttggctgagttggtccacacatcaaagggtgacttaagtcagttaatacattctatttctccagaaactgcatcaagaatgggtatgtaaggcaatcacagcccatgagatactggcaaatattaatggaagctttcgggaaaacaaacaaaaatccacactgtctcctttgtaggagttaccagagaaaactctgactgttttcccaaacctccttatgtgaaaatgtgaacactaaagccgccactgccagaggcatgttggggctccccttatctgtggtttatgacggctgatttgacaatcaattctgcacgtggtagcttgaaactgaccatggtagaagaatttacatctcagaaattgcagatgatacaaataaagggtctttaagttttttcttccctttttttaagggaggtgcagatagccagcttactctgagtccatagtgtggagtcatatggaaacttagtgtgagaccagcagagagtcatgagaaattaggtcttgataccgtaagttgaactaccagatcaagctttagtagaaacctgccctaggtctggagttttcatttaatgtgagcatataacttcttcaaaaaataaacagtttcatgaacaatgtacattattttttgaaggtagaatactaaaattggcattacttcaagagaattcttaaaagcaaattgaggttacagaaaaagacagtatgtgtactgggaatcttaagagaacaattgacagttttgaaaatgtaaatctgcctctcaagatacatctggtggacaggcacttagggggttgataatttggaaaaagcagtttagttgttgaaggcatgtgttgcctacagtggtaaaggttaagttgttaaaatgtggtattgacctgtgcactgattccaattataaaatttactccagtcaaatttgcagtgtacattccagtaaaattaagtgttgccccagtaaaatttgtaaatccacatatgccattctacaggaataactagctaactagccactgagcttatgaacagagacaaaatagaagaaaattccaaaataacagtgtggtcaaattagaatttctgttttaattaacggggaagtagtggaggcatataatgctattgaggcagaaataaaagtgtagtgggtcttaacaccaaagaaataaattctacaatattttatctaatgtattcaatgtcaaaaggaaaggaattatacttaaattatgatacaaccataaattattaatggagaaatattggtccacattttaaagctaatttttatacaaatatactgacaatattaagaaagcttgatcttaataatttaataaactcctgacaggttttgagcacctttgtaagtactatgctttctaattttcatgaaatctccatggacaagggtctgatctactccatttattaagtaggaaactgaacttccagaaggaaatgttactttttcaagcttatatgtcctatgagggcaaaagtttgggtccaactctaatgcctatactttgctgaattagatcacatcaattatacattttgatgcatatttcatcttagcccaatcaaatcaaagtgagataaaaattaaagaaaaaacatattttaagttttgtttagataaaagaaaacatgaatcagtgggcaagccatgggacagttgaactaactctcacacatatcgaagtagagttctaaaacagcatttgatgataaaggttagcataaatctggaagctgttcctctgacctgaataggtgcttagagaatattagcaagctagagaaaggcctaaatatgtgtcgagactcatccaatctttcaggtgtgggaaaattgagttttttattaaggtgaaataaccaatgtctatctcacagcatcaaacaaatgacttagagagacaaaggaatttggaaaaacagctttgtctgtcccatcaaaatagctagtcttttaaagtaataactgtgtaaccttggggaagttagttaccctttagaaacctaaggttttgcaactgagacatgggaaaaaatatatacacatacacattataaggttcttgtgagggttaaatgagatgataatatgttaccaaaaagtaccttatatttattaaatgtaagcattcattaaatgttagttgttattgatgttatttttgttacaaataaaagtgttcttcctttctcatttagtaattataaaacattgcacaattcactggatctctttaagccttagtttatttataaagatggctctcgtatagtatcatgttaatcttttaacgttgctttgagggttaaactgtaaaatgcatataaaagtacaataagtcctcacttgatattgtcaacaagttcttagaaaatactttaaaatctttgaataatattatttgtttcaaaattgtttcattctaaacttgagcagaaaaaatactggttttattatgcttcttttgcttaaagtcagtttctaagaacctatcaacaaagttaagtgaggacttactgtattttagaaaatataataaattaaaagaagtgatatattaacatcctcactagaaaaatccactgggtcatctcactccacatctcgttagcctctgtagcattagagaggaagactaccttttgcaaaatagtatcattcacttttttctcaatgccatttctgcacttctctctgttcctgtctgaccagctctttttcattttctttacagaatgcaatatctctttttacctcataattgttaaatgttccacagggctcctcttaatcctcttctcattctactgaatcttaactactcctatgactttaacgtctaaatctctatctatcgcctagccctagaactacaactattctaatcttaaaatgagttttcccaaatggggcttgacaatgacaaaatgattagtgatcttcaaagtatattggataaactttataaagctatatgaaacactattattccactagatattgatatagaagtaattgagctgcaatatcagatgacattaaaatgagtgtttatcaccattcttggctgaaggtttctggtaagaaataagtagcctctaaggacaaactaagcaaatccagcccagttaagttatgatagagatcattctggaatttatagcatctttctcttcctcattcatttgcttcttcaaaaaatatttatttagcactaattatgtccggaatactaagatttttttataaggaaagaggagaaatgataatagggcatgaagaagattattgaaactgttccttgaactagctttaaatttggggtttactatagtgagaattacactagaaaactgagtccctttataagtactccatttgataatcttgcttctaattttaaatcaatctgaaagaaaaaagaaaaaattaactccatcaggtggaaattatatataaacctgaattgaagaacagattttcttttaaattggaaaataattcttctttggaagttaattcctttctacttagaaactggtagttttatgtaagataagaaatgcagaaaaattagattgatatacaaataactggccagtctttgttttctgatacactagataagtattttatgtatttaaggaattaaaaggtggtttacaaataagaaaaacgtgcctcattttaggctgtaaaactccccagccagaaaagacaatagaaatcacttcacagaagccaaacaacctgatttattcaaattatgaattccaaatgaacgagaatgcttattcttgagaaaatacaaacgtggaatttctatattttcgatatgaatatgacattgagactgcttgtaatttctgttagcaatgggtaatatactgcaaagaaagagaaataggttattttttaaaaagaacccactgaaaaaaaatatgaacaaaaaacctagggaaattaaagatagaaaataagctttattgcttaaggaataagcatgggagactgggaaattattagtatggggaaaaattgaggataagagataaagccaaagtcatagctaattattagttgatttggaatcaataaaatttccatgtgtaattttttggttgctgaaaaccttagttataacatttggtcttatatttaatttaatcttcataattctgtgaagatagtatttccaattctcgtatatgaagataaaaagccaggtttatgaatgttacaatgtttgctcatgtcacagtgttggtcagcagcagaagtgagatataaacccagatctgtctgagccccaagcctgtgttctttccactttcctatgctcatcctattccctctctacagagtgaagcaacattattataaggttctatataatgcaatgtgatttaacactaaccggtgattttcaacttatggaagttaattttgtgctaatccatttaaagtgactaactccatcttccccatggcccacaccacgtgttagtgggacagatggtgtgaactgaggtcattgaagaataatactgattgattcacgtggggattatcaagatgttatgacctaaaagaaaaatcagtctatgtttaacaaattttatgagcataataaaatataacttgtatactcagatatttttcttaaatgcatttatgaaaatgtataatttttatctttataattagcatgctgagataatactaggatcattttaaagataggtttttcatatatagaatattagcatactaataggctttatagcataaaaagcatattaacgtagttaattcacacactggacgagcatattcatttagtttctgtaatatggtaagcattgagttaggtggggtatatcagttaatgaaacaaagcccctgttctggcagagctcagagtctaattacacaagaaaatgaattattataactgagagaaaggccataagttacaagaagctggttttagaacagcgcaagaacttcgcttatactggaaacagaaggaagtttctcataatagaaataaatttcagctgagatctgaaaaattaggcataactaaggtaaagaattgtgacagaacattccagataaaggaggaagtatgtgcaaaggcccagagggaatacagttaattcaagaaactgaaagaaacttgaattgagtggaggcagagaacaaaaagtaaccctagactacacacaggagaggttaaagattttgatctttggcctaagaatagagagaattgattgaaagagtttttgcagcagctgatattatcagatgtaggtttgaaaaattttctcaagtttcaggatacaagacatttaagggtaccagagtgtatatagaaaaaccagtaggcttttgagcagtagtcaaggccagagaatggtatatgggacccaaggtatggaagtggtggccatgagactagatgaataaaatttggattttgaactattacatgggcctttgtactttaactagtgaaattaggctcttctgtgtctgaagtgagttgatgaagtacggattacactgaagatttttccaggaaagcaaggaaaaaaatgcctctactgtgtatatttgactggcagtcaaatgggatggagaaagaaggaagctgcttctcattgtactctatgacaggtgaccagtaaagggccacacacagagataaataacactgaaagaggaccaggtttaggaaggcagactcagcagcactgtaatatagtggttcataaatgagtctttggacccagcatgcatgggtttaactactgggtctgagatgtattaactgtatgaacgtggacaatttatttatacctattattccccgtttctctcatctataaaaatggagaagattgtgatggtaactacttacctgaaacattatatggcccatggcaagaaattagtaagttgctattataagccatttctggatatgttgaattttaggtcattttaattatacaaaaaggcatggtgagtaaatttttagatatatacatctgagttcagaggaaaggtctggactgcagataaactgaggagtcaatagtgtttagatggtaattgaaatgggactaaatgagattgactccctgagaaaacatagtgaaaacagaaaaggaaataaaaccgctttgaagaacactattgtttaatagctgggtaggagaaggtgagccttttaagaagattgagaaaaagtggccagatggatagtaagaaaaccaaagaagcttgtatcatgcgcactaagagaaagaagattgtgaataaaagagaaatggttactactgtccaatgtaagatcatgtaagacaaacattgcaatatgactattgattttagttacttgacgatcatcatttaaggtcaataatgaccttagcaatggtggtttatatggagttataggatcagatgccagaacaggggaaactgaaaaataatattgaggtaaataaatgaaaacaaaaagatatcgctcttttaagtttaattgaagggagaggagggaagtagaatggttatttaggtggaattgaggaagaactttactaatgaaaaaaactgatagtttcttttaagacaatgggaaaaacctcaaattgattctatttggttaatgggccacatatagttccaattagacaaattaaggattgacagtcactaaggagtaaaataggtcatcagagtgtccatatcgaaaagacagaatctcaatagtgatcttacattatcaatttggtcagatggtgatccctttggatattacacagtaggacaagatacacacatctgtcacattccaacatcttcataggtcaagatcccagtcaccagaagtacattagactacccttattccttacacaaaagtatacatgacaaccctgattccttgctttcttcataaatttccactttcttctaccccttcctttattggttaatcttgacctcataccccattgttaacaatgactcagtcttcatttcttttggccttcaggacctccggtcctttagtaatttatttctaaattactaaactaaattatttagtaatttagtttcatactttggcatttcctgaaagatgggcaatctattgttatatatttacagagtgtctactgtgtactcaatgtcttctaggcactaggatacagcagtgaacaacaacaacaacagcaaaacaaaatccaagccctcaagaaacttactccttggtgagacagaaagataaatgtatgtctgtatatctaagtgcttgaataaataattaaagatcacacagtaggtcaaatttgtacacttttatgagtgattctatgtcactctatataggaactttagaaaaattttccccagaatttgcccagcaggaattatgctatattttgaatatgaatgtgttaaattcctcaaattacatagcacattatcaaatgtttacagataagtgatacctaattttacaggtgacattggagcatcttgcatggtgtttggaatatacttatgattgatttgtatcatttgttatacttccaggactacgtgtctttccccaggactatatgccgttccctttccaggactatgtgtctttccgcaggactatatgccattccccaagtgccattcgggtagtctgacctcttaccagtcttgggttaatcagctttgagatgggcataatgataaatcctgaaaaaatatttttaatagtttttgtttgtctgctgctgctctctaaatagtaatgggtaagtttctgttttaagtcatgtgttatcctgaagccagtgtatagtggagtccatctcatgctactaggactgataatgtatttttagatcttcagcaaccttaaacgattgtgagtggagaatgggaagagattgggggtgataactgtgtaagcataaatccaatgtgtgagttgcttgagtgtaccagtacgtcagcgtataattacagagtgatgagcacaaaggaaacactaaatattgattttctacatatgagtcttgatgctggatcttgctgccttttacctaagttcttctcatttattctcaccacctccctctagcacttagtaatgggatagttgaagccataggtatctccagaaatagagtatgatttattcatctactttttcatttcacacattttaacggtcgcctattgggcaatgtgtaattttcatgctattcggaattcaaatatcgaaggcacatttcatgtattcaaatttattacaatttagtacatacaggaaaataaaaggttttaatacatagtgataaatgagaatgtagcataatagttggcagtctaagctctggagtccaacacagctaggctgggagtctaaattccatcacttttgactacatagccttgggtagtcatttaacatctgtgggataccaatagtaattgagacccaaagatgctgtaaatagtagataaaatgactcagctgtttatcacagtacctggcatataatatgtcagcctgcatttttgttgacattggtgtttatttttgtataagaatggcatacacgtagtgatactggacaagggaaagagcactggagatgaaacatcccagaagactttctgaaatattaacaggacatgtcttgacacttgaaagatgaatatggattaggaaaggcagaaaaggcagaggaggaaaggacaaaggttagtgcaaaggctggaagtacataatgagcatttgcaggcttcaagaaattccaggtatctggagagaaagtgtgactgtggaaaagtaagactgtgaagggccttgcgtgtcttagggtactaaaaagcaattcacatttcttcttttcatggatcttagttttgtgtgaaaacccagtgtccttccaatgaattaatatgttccgttcctaatgtcaacaatccagtgattatgctgctttgtagtaaaaataaaaacaacccaaaatatttcagtgaaataaatttgaaatcattctatatatatcattgtactaatgaaaagagttagaattcagctcatatataagtctagcttttctaatgcttttgttttaagacctgtgttttaggttcggggctacatgtgcaggtttgttacataggtaaactcatgtcacaggggtttgatgtatgaattattttctcacccaggtacgaagccttgtattcaatggttatttttctgctcctcttcctcctcccactgtccatcctctgttaggctccagtgcttgttgttcctctctttgtgtctatgggttgtcatcatttagctcccacatataagtgagattatgcagtatttagttgctgcgttagtttgctgaggataatggcctctagctcactctgtgttcctgcaaaggacatgatctcatgctttattatggctgattatcccatagtgtatatgtgccacatattcgttatatagtcttccatcaatggacatttaggttgattccatgtctttgctatataatgcttttttttttaatgaagctggaggtaagagatgtctctctctctctctcttagaaatgacacaatgattaccctcttcattgatgctctacttaattctgtgaaggtagagaagtgagcaagatcttgcttgagaagtgggcaataaattcttgttcacttctttagctgagccatctttatctgtctttgtatcttttcatgcctcatcctttctaaatacgtaggtaaggcaactggtgctgctctaaaaatgtgggagtggagggaaatccagttatgacccatgtgtatagagctttccttctggcttgctcttctcctgcacctactctaagcaaaagggcttcctccatggatctagtttagctcacccctgggaatattctggagtgtggagctaaagtgtagatagaaataccatgttcttttattgtccatttaactgtatgctatgtttttccagtggcaacagcaggggaatctgcctggggctctgtttcagggcccctgcttcagggttcctgtgtctgtaccatctgtctccttatcaaatatcaggttggtgcagaagaagtaattgctgcaccaacctaatgtaacagtgggcaccaccgttttgacttgatctctaaatgattacctcagtgcttattgtgaggtgtggatgagttaccatatatgaaatggcctaggaaattgtcttggatatggttggtaatgtgcattcattctgacctagcccattgtgaaagataaagggaaagaataaacagagattgagggtttccctctcttttaaccactgtgaatacagaggaaaaatgaatgcccagatatacttttttacaccatcttcattggatttatatgaaaagtacaagcccatcaataaataataaaacacacattcccaactaaaaattttggtattttaggtctaagttaacaatttattttttcaagatgaaaaggtcccattctaaggtcttttttttttttttttttagatttattcagggagaaataaacatctctttactgaaagcaaacaacaacaaaaacatatcttggggtcaataaggttaatttttttggtagaatattttttttcttgagggatacacaatggaggtgattatgttggaagcgaggaacaggagaggctgagttcagtaagttcaacaagcaatagctattgcttattctacaatgttgggaaatttggggactttacctttttctcagattttgattatctctttgtcaagaagtgaagttatgtctggaatgaatgttaacaatatcagttgaggctaaagaaagcatctattattaccagcctgtttcaaaacaggattttatcaatcacttttggcataactggcattctattgtagtctttttcctccagaattcactgaaaacaagtaattccatgaatctgtgtgcttgcttctcttgtttttaaaagcttccttcagtgaatcatttggtaactactttttaaaattaatgtacactcaaaatattttttctgtattaattaaacaagataaaaaacctaggcttgataggatatggctctccaaagattctctttaaggataaaagaataaataaaataacaaagaacaaaatagttgggcaaattcattttcagtcaacaactatcatcacttatgctacaaatctgtgtgtctgtttctgggtattctccagaaactctaagccacagagttgactgtcttctgtgtgacatctccaccagcacttatcctctctatatctcaaagtcagcaggatcaaaattgaagcccttatcaatgaccagacttcctcctcttctaggatctgacctattggatagcagaacatttaccctaacgtccatctaaaaaatcaattttttctcatttatgcattaattctagtaatatttattgtgcaactacagtgtgctagacatggtctaggtgctgatgctattttagagaatatgtctgacaacattttttcccttattctaatgagggacagcaataaaatgaacaaatatgcaaataatatcatgtcaggtaataatagatgctataaataaaatgactagaataaaataaactcctttggtcttatagtcagtgacattttgtaacttgtttcttcttccagtatagtcttctgaaattaatctttagtgagtcttcagagatattttagtgagctgaaagacagaaactagttaaggtcatcagactggaattcattaattgtttcctttctatcagtgatactgtcctctcagttttgttgagtattttgttcagtctcttattcttaattctctagcagcctctgtttcttttatcttctctcacatactgcagatagaatttttcttctgcttagcctatgtggtagctgccttccagtagcctcagactcattataacatcagtcacctcaagtgagatggatcttggcagtggtgtgttgatgaaaaaaaaaaaaagcctgatttttggcatttctaaatttccatgtgtaaatacttctatcatggccaatcttcaggctaccagaatgacagcacagaacatgcagctgggaaaattttatgccgtacactctcacaagcctgtatcaacactctgagccagcacaccactggctcttgggcaaaagataaattgaccaagttttagtcaaggtttcctatcttaacaaaataaatgtactagggcagtataatcattttatataaaatagcttcctaggaaatctaatgtgctgttctcagatctgggcagtgatggttgaggatgggaagggacttcctgtgaacgtgtaaaaccataggactacctctccaggtcatgtgatttgtccattatggacttattacatggaatttctttcctctttctcctatcaattttcctagtgtctatggggtttttaaaacacggccacaaatgctctgaactgctctcacaaagtggtagattatgtgttggaatcaggacgtgcttgtgactactttgacaatgaccagtagagttcagtggaagtgacaatatgtgacttctgagtccaggtcataaaagacttggactgaagtcctgctctctgctgcattcttgcaaacctgagaatcatatgagaagtctgactaccctgagattgtcatgttgtgaagaagtcctcctcacacggaatggccagatatagaaactctggttggtaatcctagatgagtccctcactctcaacccccaaccacagagaaagtttcaggcacatgagtgaagaagacaccagatggatgtaacacagagctctttatgaatcacttccaggcatgaattttcctagctaaggccacagaccttgtagagcagaaatggaaaatctcccctatgccctattttggattcctgaaccatagaattcatgaacttaataaaatgattgttgttttatttcactacatttgacatggttcgttccaaagcaaaagataactggaagactcaatttttccaggctcaggttgccataatggagatgtgttcatgaataaagttcctggcactccactcataaagctggtgagaaaatacaagattgtactgctgaggttaggacaaaaaactcatagtgatgcctcccagaaagttatgaaaaatcaaatacaacattcctaaagagtttgaaaaattcatttgggacagggtctcttgcaaaagtatttattggggaagataagatcttacaagtgagaatccaggaagtaggtgattttagaataaaaatagataattgtatgatggaaatggaggtcacttcacaaaaactttacagatagcacatcaaaaatgggacccatgtatatccataagagtataccaacaaagctcagtttaaaccaacaaagctcagagttttaggtgctcagtttcctggatcatgtatcatccctctgtatttgaatttagcttatagaataggggaaagatgatgtatatttccattttttcagcagatgggcataagtgctgtatgcattattctgaggaagaatatttcagttaactattgcagtaatatttctgcataacagaccactctaaaactaagtgattttaaatgacaataatttattatcatgggtctgctttaggctgtggaggctggaggatagctcacctggctggtctctgctaggcaactttgctccatgtatttcttactcctcacatggaatttgctgcattgttggggcatatttttagggtgatgagaaaggtgcataaagttaagcagaaatctgcaaggtttcttaaggccatatctcaaaggtgtcatgctttcccttctactctactccattgacaagttacatggccaagcccaataatgtgccatggaaagggtgcatatgatcatgaggctactaatttgatctaccacagaagaattgcagtgtctaacagagatctagtttagcagattaaattccaaaaactgacaagatggctcggtacgggcatttagataaaagctcagccgtgtggacataagctgtgttgtagctgtttacattgcctaaatctcaggaatatttagattaagcttattgctgactctattctagatggtctggttcagggttcagatgcaaaacattttattaaaggagcaggtcaacagttaggtgaagatacggctgtttggtgtgcacccctgatgccacaaccgcctctgtaaaagacagatgttcacctagcaattttcaactcatttttattccactagattttatattgaatcttcttcatataaataatgtatttttcaacaaacaaactgataaagtaatctaccatagttaaagtgagtgttggacatctatttttattgtttgtgcagtaaaaatagatttgtgtccataccgtactctagtgtggctttttaaaacttctaggtcttataagtatgcttgaaaaacatagttcctttcgctcattgaatctttcctaattatattagcacttactattgaattcctatttctcttatagtacatatcacatattttggtatttcagtgtctttttgaaatattgaggtaaaatttacatagaaatgcacagatcttaagtgtgcaattctatgatttttgacaaatgtgtatagatttgtaactatgcctcagtgaagacatagaacatttgcacttacctacttggaaattttctttgcaccccttccaatcttcattcccacaccaaggcagcactggtctgacttccatcaccataggttggttttgcctgttaactgaactttatttaaattcaatcatggattacatgctcttctatgcctagtttcttttgtggatcaaaatatttttgagattcatacatgttattgtgtatgtcagttgtttattttttggcctgtttattttttaaaaattctgagtagtatttaatggcatgaatgtaccacaagttgaatattcatactattgatgggcatttggatgattgatagtttgtagctattaggaatgaagctgatataaatatttttgtatatgtatttttctggacatacatttttacttatgttgggtcaatatctaaataagcagatttctgggtcatgggatacattcatgacaccagctgcaaattttattctagagtttttgtataattgtgcacatctatcaggaaaatatcctatttgtatcagtttcttaacagatctgatgttggcattaatgatcttttaaatattaaccattctagtaaagtagtgtctcattgtggttttaatttttcatttcactggaattaatgatgttgagcaccttttctagtactcattggactttcacatattttcttttatgaagtgtctatacaagccatctgttttcttctattctttatctccatctgttttcttattgagttgtttgtctttttcttagtgaattgtaagagttccttatattatctggataaaactcccttgtcagatgtacatattgaaagtatttttcccaattccatgcaccgcatttttagttttactaatgctcataatttcttaccagaagttttagtgtcaatagaatccaatccagcattctccacatgtgttttgttacccatttaagaaatatttgtctatttcaaggtggcaaggaaaacctagctaggtctttttctagaagctatgcatttagctttatgtttggttttcttcttcttaaataaatttttgggtgtggtgtgaggtagtcaaatgtatttctttccacatatttattttgatgcatcagcatcatttattgaaaagattttctcagcgtattgtcttggcaactgagggacatcatttgacaatatatatgtgagtgcatttctgaattttctattatgctttattgatctatttgtctattttaaaatcaataaaatacttgtttggtaggtgtggttttacatgaagtctttaaatatgatagagtgagttctccaacttcgtgcattttgaagaatcttggattcattttgcatcttcatattagtttgtagaccatgcttgtctatttctgcaaaacatcttttttaagttttatttggaatatattgaatatatgaataaattgagagataattgacattttaacaatgttgagtcttccaatcaatgaatagagcatgcctttccatttatttagtttttaaaaaattatgagttagtttgtaggttttggacagaaatcctgataagttattgataaatggctcatgttttctgatattattggaaataatatttaaaaacttatccaattttttgctaattatatgtaaaaatatattttaaaattgtgaatttatagattacagtcttgttaagtttacttttaagttttcttagttgttctgtagatttcttaggatgttctaagtagctaattatgtaatctgctatggagactattttaattttctttcatatttacttgtcttttatttatttatcttgctttactttcctggttaggatttccaagacagtgtttattagaagtggcaagagcagaaattgttgaattgtttcattcttaatatctcagtattaagtctgatgttagccctgtatttattgctgcgctttttcaggttgagggtttcctttattcctagtttgttaaaaatttaaaaataaaggtgcaaaaatgttgtcaaattccctttttaaatgtatttaattacttttaaaatttttattaaagttgtaaaataaattggctgatttttgaatgttgctccaactttacatatctgagaaagagctcatttcatgtgttagtagaccttatttattacttagtttgttaattttttttttttttttgagatggagtctggctctgttgcccacgatggagtgcagtggcacgatctcagctcactgcaagctccgcctcccgggttcacgccattctcctgcctcagcctcccgagtagctgggactacaggcgcccgctaccacgcccagctaattttttgtatttttagtagagaagtggtttcaccgtgttggccaggatggtctcgatctcttgacctcgtgatccacccgcgtcggcctcccaaagtgctgggattacaggcgtgagccactgcgcccggcaaatatttgttttttatgtattttttttttcaacttagttcaggggtacatgtgcaggatatgcaggtttgttacataagtaaacaagtgccatggtggtttgctgcagataatcccatcactttagtattaagcccagcatcaattagctattcttcctgatgctctctctccccctaccccaacccagacagaccccagtgtgtgttactacagtgtaataccattattcaactatcgtttatgctattgtcatattaccatgtgtgttagaaatttccataacatgttattgtcttagtctgtttggacttctataacaaaataccttaaactaggtagctaataaataacagaaatttatttctcccttttctggaggatgggaagtcaaagatcaaggcactggcagatttcctgtctggtgagggcctgcttctcctatatgacactcttcccattgtgtctcacatggtggaaggggcaaacaagctctctggcctcttttgtaaaacactaatgctgttaatggtggccccaccctcatgacctaatcacctactaaaagccccacctcttaatgctattacactcgggattagatttcaacatataattttttggggggttgggggaacagacatgcagaccacagcagttattttgtgctttaaacaaatcttccaattaagagaatatatgctcacatatttatcatttctttttctctataaattcaaatttttttctgagttttattttaaaaggaactgaggaactattgtattttttaatgcaggccagctggcaatgactttctcaactttcacttatttataaacatataggcctaaaaatgcataaaatgaaccaattctataatgttacacataattagtattctttattaagtccttgaaaatattcacattaactgtttcaaagttcttttctatattctgtttttatttattgttttccttcttgattcggcattgcttttctctgctttttctcacatgcggtaactgttatataatggccattgccaaagctatgttgtaagtagtctgaattatgtcatcttcttttaaaagtttttgaactttgttctgaaaaagaaattaacatcccaggagctttttattttttttcattctggcaaacttggttttactttttataagagcaagtatatttttcttttgtctttgttactaatgtgtcctgtgacctaggaaatgacccttacttctaaattctaaccttttcatgtcccaactaaatgcacaaggtgctcattagggtctctttacccttgcagagctgaaactccagtattttctaacattgtgagacctctggtgtctttttcagtcttcatctctgagtattactctgcaagttttcatagtattgacttacatatttgaaacccagacattggcaaaagacatgtcactaactcctgtgaagtcttccatgctgtttacttctagcagctttcccttctctaataccttgcgtacaaattacagtaagttcaatattttcttcttttgctcaagaagattgtgattatttgggggggctctattcctgttctgttgtagaaaagcaagatgtcagaaaactagaatgactgtttgcttttgtgtctctcaatagtcagacagtactgtctgatgtgaagtacctaaaaaagagttgtcttatacactgtgttcatgtttacagttagtggatgtgtacatccagtgtaagttatttcatcatagctagaattgttctttcgtggtttcttacagttttattgtgatttacttttggcttcatagttataatataaactttttaccaaatgggcacgtattttagatacatgtaaaaaatattttccaaacagtaggtgcttaataaatagaagcccagcatattaaacagaagtcaaacaacttttgctgttctttgtccaagagactgtcccacacccatgagctttagcttctcaatacagatttttaaacgacacttaggagtcttggctactataaaacactacttcgtttttttccgtcttgcctcaatatcttgacaatttctaggataatattcttacttacctctttagtccacatgtctcaccacagggacagacgcactcttcacttggcatatcaagtgattactgaaatgtacattttttcagggtaactacattttagtggggattaccagagagaataagaatactaacatttatcccctgcattttttgttagtcctataacaatatagacagttaggttgtattgttcctcttttgcaaagacaatcacaataaataattttcctgggatatagatattgaactgttagaacctatcttccccaaccccctcaactgatttaatttcatctgaactttagtaatgttatttttaaaatataaataatactaccagcctcacagggtgatttagaacattaaacattataagtgcaaagtttcagtcagatatttgattagtttcttcctctctagaaagttgtcttgagcgcccagtatatgcatagttagagtgagatttgaatcagtatttcatcagtgcctcttactttatagcctgcactctttgcaaggtaccacttaaaaaaatttttttcaggtaattcttttctattattattattatattttaagttctagggtacatgtgcacaatgtgctggtttgtcacacatgtatacatgtgccatgttggtgtgctgaacccattaactcgtcatttacattaggtatatctcctaatgctatccctccccacttcccccaccccacaacaggccccggtgtgtgatgttccccttcctgtgtccaagtgttctcattgttcaattcccacctgtcagtgagaacatgcggtgtttggttttttgtcgttgtgatagtttgctgagaatgatggtttccagcttcatccatatccctacaaaggacatgaactcatccatttttatggctgcataatattccatggtgtatatgtgtcacattttctttttttttttctttttttttttttttattatactttaagttttagggaacatgtgcacattgtgcaggttagttacatatgtatacatgtgccatgctggtgcactgcacccaccagctcgtcatctagcattaggtatatctcccaatgctatcccccccccctccccccaccccaccacagtccccagagtgtgatattccccttcctgtgtccatgtgatctcattgttcagttcccacctatgagtgagaatatgcggtgtttggttttttgttcttgcgatagtttactgagaatgatgatttccaatttcattcatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttctggcagcatgatttatagtcatttgggtatatacccagtaatgggatggctgggtcaaatggtatttctagttccagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagacgtgtctgttcatgtccttcgtccactttttgatggggttgtttgtttttttcttataaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgtttttgacatgaagaccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaaaagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctatgttcttttggcttaggattgacttggcgatgcaggctcttttttggttccatatgaactttaaagtagttttttccaattctgtgaagaaaatcattggtagctttatggggatggcattgaatctgtaaattaccttgggcagtatggccattttcacgatactgattcttcctacccatgagcatggaatgttcttccatttgtttgtatcctcttttatttccttgagcagtggtttgtagttctccttgaagaggtccttcacatcccttgtaagttggattcctaggtattttattcctttgaagcaattgtgaatgggagttcactcatgatttggctctctgtttgtctgttgttggtgtataagaatgcttgtgatttttgtacattgattttgtatcctgatactttgctgaagttgcctattagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtttctctgcctggctttggtatcagaatgatgctggcctcataaaatgagttagggaggattccctctttttctgttgattggaatagtttcagaaagaatggtaccagttcctccttgtacctctggtagaattcagctgtgaatccatctggtcctggactctttttggttggtaaactattgattattgccacaatttcagctcctgttattggtctattcagagattcaacttcttcctggtttagtcttgggagagtgtatgtgttgaggaatttatccatttcttctagattttctagtttatttccatagaggtgtttgtagtattctctgatggtagtttgtatttctgtgggatcggtggtgatatcccctttatcattttttattgcgtctatttgattcttctctctttttttctttattagtcttgctagtggtatatcaattttgttgatcctttcaaaaaaccagctcctggattcattgattttttgaagggttttttgtgtctctatttccttcagttctgctctgatcttagttatatcttgccttctgctagcttttgaatgtgtttgctcttgcttttctagttcttttaattgtgatgttagggtgtcaattttgtatctttcctgctttctcttgtgggcatttagtgctataaatttccctctacacactgctttgaatgtgtcccagagattctggtatgttgtgtctttgttctcattggtttcaaagaacatctttatttctgccttcatttcgtcatgtacccagtagtcattcaggagcaggttgttcagtttccatgtagttgagcggctttgagtgagtttcttaatcctgagttctagtttgattgcactgtggtctgagagatagttagttataatttctgttcttttacatttgctgaggagagctttacttccaagtatgtggtcaattttggaataggtgtggtgtggtgctgaaaagaatgtatattctgttgatttggggtggagagttctgtagatgtctattaggtccacttggtgcagagctgagttcaattcctgggtatccttgttgactttctgtcttgttgatctgtctaatgttgacagtggggtgttaaagtctcccattattaatgtgtgggagtctaagtctctttgtaggtcactcaggacttgctttatgaatctgggtgctcctatattgggtgcatatatatttaggatagttagctcttcttgttgaattgatccctttaccattatgtaatggccttctttgtctcttttgatatttgttggtttaaagtctgttttatcagagactaggattgcaacccctgcctttttttgttttccatttgcttggtagatcttcctccatccttttattttgagcctttgtgtgtctctgcacatgagatgggtttcctgaatacagcacactgatgggtcttgactctttatccagtttgccagtctgtgtcttttaattggagaatttagtccatttacatttaaagttaatattgttatgtgtgaatttgatcctgtcattatgatgttagctggtgattttgctcgttagttgatgcagtttcttcctagtcttgatggtctttacattttggcatgattttgcagcggctggtaccggttgttcctttccatgtttagtgcttccttcagtagctcttgtaaggcaggcctggtggtgacaaaatctctcagcatctgcttgtctgtaaagtattttatttctccttcacttatgaagcttagtttgtctggatatgaaattctgggttgaaaattcttttctttaagaatgttgaatattggcccccactctcttctggctttagggtttctgctgagagatccgctgtaagtctgatgggcttacctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccctgctagattggggaagttctcctggataatatcctgcagagtgttttccaagttggttccattctccccatcactttcaggtacaccaatcagacgtagatttggtcttttcacatagtcccatatttcttggaggctttgctcatttctttttattcttttttctctaaccttcccttctcgcttcatttcattcatttcatcttccattgctgataccctttcttccagttgatcgcatgggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcatctgaagccttcttctctgagctcgtcaaagtcattctccatccagctttgttccgttgctggtgaggaactgcgttcctttggaggaggagaggcgctctgcgttttagagtttccagtttttctgttctgttttttccccatctttgtggttttatctacttttggtctttgatgatgatgatgtacagatgggtttttggtgtggatgtcctttctatttgttagttttccttctaacagacaggaccctcagctgcaggtctgttggaataccctgccatgtgaggtgtcagtgtgcccctgctggggggtgcctcccagttaggctgctcgggggtcacgggtcagggatccacttgaggaggcagtctgcaagttctcagatctccagctgcgtgctgggagaaccactgctctcttcaaagctgtcagacagggacacttaagtctgcagaggttactgctgtctttttgtttgtctgtgccctgcccccagaggtgaagcctacagaggcaggcaggcctccttgagctgttgtgggctccaggcagttcgagcttcctggctgctttgtttacctaagcaagcctgggcaatggctggcgcccctcccccagcctcgctgctgccttgcagtttgatctcagactgctgtgctagcagtcagagagattccgtgggtgtaggaccctccgaggcaggtgtgggatataatctcgtggttcgcggttttttaagccggtctgaaaagcgcaatattcgggtgggagtgacccgattttccaggtgcgtccgtcacccctttctttgactcggaaagggaactccctgaccccttgcgcttcccaagtgcggcaatgcctcgccctgcttcggctcgcgcacggtgcgcgcacccactggcctgcacccactgtctggcactccctagtgagataaacccggtacctcagaaggaaatgcagaaatcacccatcttctgcgttgctcacgctgggaggtgtagaccggagctgttcctatttggccatcttggctcctccctgtcacattttcttaatccagtctatcattgatggacatttgggttggttccaagtctttgcttttgtgaatagtgcctcaataaacatacatgtgcatgtgtctttatagcagcgtgatttataatcctttgggtatatacccagtaatgggatggctggtatttttcaggtaattcttaactgtaagcataggattaattttcttggccatcattctctgagtcattgaaaacatagtttggtagtcactccaattgagttaaaggattttcagtttcattgggtaaaatcactataattcgaaacaccattattaatagacactctaaagacactcatcaactttttaacacatcgagcctcgtaccattataaaagaagagtcagtttcaaagtttaacaaattttgaatctgtgaccactatttgcatcttatatctatgctcctaacaaaaggcaaccaaattaaatggaggatttattataaggtcactgtcattgtatacttgtatttccgtgtaacctgtgataactatttcttgtgttcactacctctgactgttttaagcgaaagcacacaaggaacgtgttaaaggtcagttcaatattgctatggagtgtgataacatttgtaccttaaagaatgtctaacattgcaactgatttttttctacaactttagaacctttttcattattctaatattacagccctgtttgttgaatgaaggaatgagtgaataaattgcatagcttctcattctgcaaatgcatgataaattgtaattgaggagagaccacttgttctaccagttttgagttaatatagatctgactctgctattttcataatcataattatattatcatagttcccaggaattatatctatgtgaaattataaataatagtattttggtgtaaaaatttagatttctagcccagaaaacaatattaacaaatgaagaaacccattaactactgcatttaaaacttcatgtttaaagaaatgatctattaatatattaacatattttgctgaaatgtgagaagggtcccatagttctccaacagtgttattttagacaatcatcatatataagaaaatctatgaaaaaaaggacagcaaaattacaaataaattagaaaactatgcttgtgagcctggaagcacatatcacatacctgactatgccattaactatctgtactttttataaacataattgttatcttttgtagtctcagaaaattgagttaggtaattttttgcattcctgtttattttctaaaatttccatgactcagagaacactttctctatgcattgtgagctactttggattatacaactaaccaaatggagtttgaaagtataatgaattaggttttctcagttagtgatattcattctaaaatttgcttctattaatttctactcagtagccctttcatattcacccatagatcatttcttaaagttctagaaaaagggggcccaggtaaaaattcatgatttagcttaataaaatattcctcaactttatcctatgcataaataacatgcataatttttgagttacacctcttagattttttttaataaaactaagcctagaatttagccttttatgatttatgataagtctaggtcattccactactaattcttacctttaaagcatcagtgccttttgctatctgctccttgggattcatttattaagaggctgagatgtgaacatctgtccatgttccaacagaacaaatcattccaaataacctttctaacccaaagttcaatggatgaggcagacaatgatttatatttgaggaattttgctttgcttttgcaacaaaagccattcttttactgtactctcaacaactgcttgtattgcattaatcagaccttaattaacatggaagaaaggtgataatttacatttatttcagattgacacattgtactttatttagcaaatgagacctgtcaggcactgccagtgatgcttagattgaagacagagtgtcgaaaatatgtcttccacctgcctgtgcctttgtaggagggagctttcagtatgtttacacagggatcattagatgtacctcatgctaagctttcatgaatctttgaataagaaatgctcaaaggtcatcaggtatgaaatattttataatgacacagtgccgtaaggcatgagaaactgtgatttattctccaaagtaaactcaaaagaggataaaggaaagagaactgcataggactcaaaataacttcagatctatcaaaaacagaagagaggagagctgaaactatgagaatagaagctgaggaaaagtttatttactcagtgtcattgtgcaatttaaagtaagagttggaggacggaagtaaatagacgaccgctgtaactgatcaacttctaagaacaataagtgactatcaaatgtcaggaagagaggagaatttaggaattatgaaaaacagtctgctacgggatgaaaactgttaattaaagaagataagtaatttctcccattcttgcttttgattgggcatataggtaaaggttgaatttgaaatataagtttaagataattgagaagaatgaagcatatagttaaagcccatattctgctttcataattttcttgacttttattagcatatatttcagaccacagtttaaggcaggcagtgaggggaagtcttataggctcccttcttgcatgtttgatgagcctggccacttgagcatcacccagagcatactgtccccatgcaggcatccacatctttgctcatgtggtctcctctgttgaaaggaccactccatccactcgatatggaaaatctgttaccagctttaaagtgtgtcttggatctcccctccacttgggagcccagtaccattgtactcccagagtactttaagtcgttcttatcccactgcttatatacctctgcttacctgtaattcctattcatatttatttccccatggcttggtagaatgtctagtgcaaggaaaaaattttggtagttgctagtcaaattagattaaaattttaatgaaaattcatatttttgtagccagtaaatagtattgttttagggtgaaatcttgtgtatttgctcttttaaatgtagcagttaactggtgcagggatatgcaagtctaccacggagtgtgcattgtggcactatttatatagtttatgtgatgtgtgtataagtttaaaatgttaatgcatgtaaacagtatattctcaaaaattcatcgccatttatatagttttgaaatgtatagactcttcctttttaaaattagtttacattttcattgacataaatcattagaagaaattaaactttttattcactgaaaccatagtttaaatgctgatttttctcttttataatataaaaacttacatatattacttttggtaaactttttaaagttttattttctttgtctagagattaaaagttaataatgcctacctcattttttttttaatttcaaaaggtaaaatagatcctcaaaacctctagcaaattttaattatctgattaaatgtttactatcttctcatcacctttaattaacactctggcaagcacactaatttataggtcaaggggctgaaatttccgtcaattaatggcattgaacaagcctcttaaccactgttaaactcagttacctcatttaaaagtgagagtaattttgttgaaatagtaggtgccactctattaaagagaaataaaagctctttggaggagagggaaatttcttgtttgatatatcctgttaaaattatacagccaaatatagatggaaaagatgttataagtcataatagaatccatgatgccaaatctgcgtaatctcacaacacagcacagaattaataatgatgtggcttgaagtggaagatgtttcttattgctgaagatctgtataaaaaggacattaagtttttttatgttagttatgccaaagaaagcatattatgtatgaattagagtttcaaattctgttttgtgtgtctcagtaggaattagaaaattctcattattatgaatatcttgtttcatggttgtttaatggcagagctgaagtggaaactaggttcctgtccatttccatgtcttaaactatttcgtttaaggtaatacttttcagatttaagaatccagtttcaaattctcttgcaaattttagggtctattttccaattgcttgctgatacctttacagagatttttctgctaaacacaatacaggcatatcttggagatgttgcaggttcacttccagacaattgtgctaaaacaattatcacaataaggcaagtcacacaaatttttgggtttctcagtgtttataaaagttatgtttaccctctgctctattaagtgtgccctagtattatgtataaaaaacaatgtacataccttaacttgaacatacttaattactatgaaaatgttatcaatcatttgagccttcaccgagttgtaatctttttgccagtggagggtcttaccacaacattaatagctgctgactgaatagagtggttgttgaaagctggtgtggctgtgacaatttcttaaaataagacagcaatgaagttttctgcatttatgactctttcacaaaatatttctctgtagcacatgatgctttttgagaacactttactcacagaaattctttcaaaattggaatcaatcctctcaaatcctgccactgctttgtcaactaagttcatgtaatattctaaatcctttgttgttatttcaacaatgttcacagcatctttatcaggacttgattctatttcaagaaaccacttattttctcatctgtaagaagcagctcctcctttgttaaagttttgtcatgagataactactcttaatgtttatattttgacttcctcccataaatcactaatgctcttaatggagtctagaatggtgaatcctttccaggaggttttcaaattagtttgcccagatctgtcagaggaatggttacctgtggcagctctagccttgtgaaacttacctcataaataataagacttgaaattcaaaattactcctggatccatgaactacagaatggatattgtgttagcacataaaaacattactctccatgtacattttcatcagagctcttgagtaaccaggtgccttgtcaatgagcagtgatattttgaaaggaatatatattattttctgagcagtaggtctcaaaagtaggcttaaaatatttagtaaaccatgaagtaaatagatgtgctaatacggctttgttgtttcacctatagagcacaggcagagtagatttagtgtaattatttagggctctatgattttcagaatggtaagtgagcactggcttcaactttaagtcagcagatacattagctcctaacaagagagacttttgaagccaagcattgattctctctctctagctatgaaagctttatatggcattatcttccaatagaaggttgttttgtctacattaaaaatctgttatttagtgtagccacctttgtcaatgatctagatcttccggataacttgctgcagcttctgcatcagcacttgctgcttcgccttgaacttttatgttatgaagagagcatctttccttaaacttcatgaactaaactctgctagcttcaaattgtcttatgcagcttcgtcatctctatcagccttcatagaattaaaaagtgaaggccttctcttaattaggccttggcttaaggggatgttgtggctggtttgatcttcaatccagaaaataaaaactttctcaacatgagcaatagggctgtttcatattttttatgatctgtgtattcactggagaatcacttttaattttattcaagaactttattccatccagagcattgctaatttttcatgttggaagcttagatttcagcctatctcagctttgacaggcgttcctcactaagctaatcatttctagattttgatttaaagtgagagatacgtaagtaacagtcttcttttcacttgaaaaattagagaccattgtagggttataaattggcataatttcaacattgttttttatcacagaatagggaggctcaaggagaagaatagatggtggactgttcggttggtggagcagtaagaacacacatatttatcaattaagttttttgtcttacatgggcacggttactggtgccctaaaaacaattaaaatagttaaataaaaaaaatcactgattacagatcaccataacagatttagtagtaataaaacagttaggaatattgtgagtatcaacaaaatatgacataaagacataaagtgggcatatgatgttggaaaaaattcccccaatagacttgttccatgcagtgttgttacaagccctcaatatcagtaaagtgcaatatagtgaagctcaatgaacaaggtaaacctatgtattaaacgttctgtcaatataccctccaccccatctcattgttgttctgtatactcatttcctattctgttggttacaaatttcttctaaaatttgtttgatttcactctatttccaaaatccatagtatctatttctggaatgttgactgcaggcctctgttttatacgcaatgcctacatggttgttgatgattataacatatacttgctacctctggactttcactaaaaacatcctttccatataacttatccatagaaacatctccccaaactataagacttactgtggcttttcattgcttggaggattagctttaatttctgcagtccagtacataagacagttcaaaaattgtctggtaatttatgcttctaaaaatttaggagatccttcccatagagcatatctagggtgcctggaccacatataaggtatatatgtttgagaacctcagggagataacaacgtattaaagaattactgagccttccttgggagaagacaaaaatccagggagatgagcctggaacatgtcttggaaatgcattcatgttgttgcaaaaagttatgctgcttgagagtctgaacagtacttttgacagacccatgagtatataagcacagagctggaattcagggcctactgtagttcttctaacacatctgtgctttgaggaggaattccaaagaatttttccacagaaataagtctcagtgacaagaaggcaagtcctcacacagtccaatgattctgtgattgaaattcaactaaagtgagctagactcttgttgtcctcagaagcctgtcaactgcaaatgtaagtcatgtgtagaggaagaagatatcctcgtggtcctcaaactatttcagcaaataattttttaagcataatttctgagatccaataaaatatgacaagaaatataagtagataaaacaacttgactaatgaggaagcaagagagaaaatagggcttcagacagtggatatgctgacacaagcataaaaattctatatagtcatgtactacataaagacattttggtcaacagtggatcacatatacaatggtggtcccataagattataacagagctaaaatatttctattgcttagtgttgtcgaccttccagtgagacaagatgtggaggtagaattcagtgatattgatggttctagccctgtgtaggcataggctaatgtgtgtgtttgtgtcttagtttttagaaaacatttttaaaagaataaaatttttaaaaaattaaaaatagaaaaaaggtttacagaataagatacatagaaaatattttgtacagctgtacaacatgtttgtgttttgtgttactgtaagagtcaaacgtttaaaaaaattaaaagtttataaagtaaaaaaaatacagttactaaggttaatttatttctgaagaaagaaaagtactttttcagtttagtgtagcctaagtgtatggtgtttatagagtttacagaagtgtacagtcatgccctaggccttcatattcactcacctctcactgacttacccagagcaacttctagtcttgcaagctccattcatgttaagtgcactgtacaagggtactactttttaaatctgttatgacatatttttagcgtaggttttctatgtttagagtcacaaaatcgtaccattgtgttacaattgcttacactattcagtacagtaatttgcaatatagtctataaaatatagtccctacaataaagctaggggtatagtatattccatttaggtttgtgtaagtacactccatgatgtttgctcaaaaacagaattgcatggtgatgtatttctcagaatgcattcctgtcattaagcaattcatgactatacatggagattatattcaaggatattaaaaagaacaagataaataattttgataattaaaagctacaaaaagaacatgaaaatgtaaaatatagtttataatattaaacatagttgaatttaacaagtagatgtttgctaaaaaataaatgagttatccacaatgatgccaagtcaaaaatagattaaaaatataaaaatagataagacatttttagaatataaatgagtaaatatcatcagaatataaatgaatgtaattgagtataaagttctcaattatatatatatatatatatatatgtaattgaaacctcgttcatagagaagaaaaagaatgggggaaaattctatatacagaagtaatgtttggaaatttcctcatacttttgaaatcattcagccatacattcaaatggtcttataaaccccatgctttgcagcccataggttaaaaacgaaatcataatggttaggagaagatattttttactaaagaatgataaaaattccacaaataaaaatttgcatggtaaaggaaaaatcatgcttagaaagtttctcataggcttaagtatacatattaaagaacaaaaaggctgaaaattttagtaactaaacatcttcaagaaattagaaaaataatagtaaagtataatatatctaaagaaagttgaatagaggacatagaacaaaaagtagaatcataaacaatggagaagatcagcagagaaaactatattttaaagtattgatataattggtaaattgctggcaagctaaattaagaaaaaggaaagaaaatacaaaaagcctaagcattaaaagataacactactagacaactgaagactcaaaaaagatagccaaaagatattatggacaactttatgaccatttcttgcaagtgttacagaaatgaaaaaaattcttaatagactaaaactgcggagacttacataaaaacagaaaatccaaataattctataacaatgaaactgaatatataattaacctttccacatacactttagacatatatttttacacatatatttttacatacacatatattttcacatagcaacaacaagaaattggaaaaggaaattaaaaggatatgttttaataggataaataatattaaatgtattggaataaattcagtgaaatatatgcaagacctctacaaagaaaattgtaaaaaaaaatgtttagagaaagtaaaatatgccttagtaaatgtaataaatgtcatgttcatgaattggaagattagatattgagaggtttttgtttttcccttgtagaaattattcataaaatttatgtagaaacgaaaggttcaaaaatagcaaagacacttgaagaaccaggtaggaaggacttgttctaccagctattgatttattatattattactccaattaagacaccgagattgtcatcaatattgaaaaatagatcagaagcaacaaattaaaaatccaggtaagacccatatttttgtggacaatattgcttatagagttggcactgcaaaacaatataaaaacatgagtcttttatagaaattatgtcagtacattggcatttctatacaaaaacaatgaaatccgacacctaagacatgtaactcatttccttataatacttaattttcccctggtttaacctgtcttagcctgtcttggccatatcttgttgatgaggcaaactatttatataaacaatagctacttcataagctataggctggccacaggtttttagagtctgctcttcaatacttggttatttttttctcttagctttttgaaatttaactctaagaatatgtcagttagcaagtggtttgctcctaattatactccattaattaacttctggaaagaaaatttaatctggttcaatttaaaagttgtttttctactcatgttccatatatagatgcctcaaaatttctgaaatgtaaattggcataatgctgtaattcttttggtaggatttatatcaattttctttggagtcaatcttaattacatttgaataccaaaatctatattttgtttctaattgtagcagaaaggtttacctaagttaaaatatgtctgatcattaaaaatatgtatggaattcaaatagaaattttaattgctttcttattttaaaaaatatatatattacaagttcagatgtctaaaaatagttaaactagaaaattcaacacaaagaaatgaaagataaaacaattgaattattgacctcacaataaactgggggtgtttaatacaaatgccttaggtaatataccatacacatttgaaaaatgaaaaatgataacatggtctgaagttgccagttacagaagcattaaaatatgaagccattagtcagaatgaatcatattcctattttgtcttcatattgaaatattcaataaattctagtaattccatatttatcttacatttaataatcttcaggaaattaccaacatgatctttgccatgtaacattttctcttttacctttatttcacttcttaaattctgaaaattaagtaaccaagtcattcttttgtaaatgcattcattatttgttattcaataagcaaatctttgttattcaatcaacaaagtgaaaatattagcacttcagtaagatttaaatattcaatcttaattgattcaaaaggtcttctagccaccccccaccgatttctaaggtgcctttttgccaactatgggtagatcttatcacattttaattcttggccctaaaatttctaattagcaaagtattgcacggtatttgagggctgctgattagcatctaagagactattcccaataacattcccagtgtgtattaagtcaatccaaattttgatagattattcttttcttattttacagaaaccagtcatttttccatactaatttggtctcaatgagaacaacataattctcattcatctccctgtagaagttatatatttccaaagtggttcaaatgtactgaaagccaactcaccactaggaattgaatcaaaattgacccacagacgtacaacattaagtttgctgcgaagatttaaatcagtgggacataaaataaaaattgtatgctacccaaaccaaagcctctccttcaaaaaatactgttgtttttgttgttgtcattgttttcccattatgtcacagttcttaagtggtagaaaagcaagttgataggaatcactttatcttgtagtttcattttcataccacagagcttcagtttccttccaggcaaaagtcatcagtgtagtaacagatgcatctttttctgccctaggatcttagaatcaatgggattatcaagacggagattaccttagcaatgagtgagcattgttttgtgcataaaggcattgagattcatataagaattgacttgaggtccactgtctagttactttaaaagcagaatgatataaaggtttattctagctaatctgtgccatttccagtcagctctttgtttttccttgttttctcttgtatatttgcttttctcacatctaggtcaaataactgcttttttggataatgtagcggatctccttatgtctgcctcatccaaactttctccaacaacataactgagtgggcagtagaaagtgtgaggctgccctaggctccagtttattggactagagttgagcagctgagtcaaaattaatcagtcacaatctctatggtgtgaattagaaaatgtgagatggggacttttaaaacataccaactcatcaggcccttctagagatcagttaaagcaggaatcacagggtgaggactacactgtaactccccacttctttctcatggtcaggattcagagccattaatgcagattatagttattttatacctgtttccataggccatctatattctggttgcatatatgtgaatttgtatgtatattcctattatgtacttatagactgtggccacattcatgtatattactccaaaagcataatctttggcccttacctcaatttcaacaattctacaatatctttcactagcctgaataaacaattttgatttagtgttcatgttcctccagccttcagtaatcttcattccaccatagtactccatataatattgtcatgtgtcaactaaatgctaattttttaaaaattatgtttctggtatataaaatgtaattagaaatccaaatagtaaattagcccttaaaataatgcataaataatttatcatgtataaaacttttctgataaaaatatatctctataaaatgataaacactattttgattaattggttaaattgaccttttcctttaattaactttttctatattaaatttattaaaaatactccagtatttaattaatgtttaacatggaaaattgtgtttggtaattgacttaatttttttactaattggttacatattaaatcctcgttttcatagaacactgctcattactaagaataataattctagtcaagaaaatattcatcactttggtagaggtttttttcctaaattaataatacaaaagttaatttttattgaattacttctggttagggatattaaccttaatcaggcaaacttcttatcttctctagcttacagtttaatgcagtggtttgtaatatatcacacaatgcagtaagcattctgcacatatacatgtttgtgtgtgcatgtgtgtatatatacacatatatatgtacacaggtgttttatttgaacagagataattaccattcataaatgcccattggttaattgcttaataatcgtatttagtggctcaaagtaaaacacttgtgcattatgttttacgatactaagatgtaagttctaaccaaatcctgtgctgacaaggaacacgttccttgatgagctctacaaagacctacaaaaatagtaattcaaacaccaattattcatattttatacaaatgtttgcctatacgtagcctaggtaataatcaacctgaaagtttatattgttagaggcatgtcagtcctaaccaaggagactttttctgattttatgtcactacatatatataaatgatgcattttagtctatttaggaaaatattgttagcttcaattccaagtttttatttatttatgaggtttcttatagtttgattaaaataatttgttacaaacctgtcacattcagttattccatgatccaccacaaatagaaattctcaccatctcaaatgtaatagtgcagataagttgtaaatataattatgatatgcacttataaaatataaggataggagaaaaaaatccagcctcttatttgtgtatcatgtcctttaagattatatctagtattgcagcttgggccccttgactgtcacttcattgccaggaaattttcggcagtgctttgaactattttcatcaaagacagaagggtgtggtgccataggagttaaaagactagatcgtctcaatgagaagggtgtgatccagtgaactaggcaacttcaaaagtacagtaaactatgagttaaaaacttctattagttttggcaacttgaaaggtatttttgaatttatggaaagcaatattttatgaactcagacagtaaaagccaaactgccataaagtgaggagtgatagggtacagggtatagtcgattgtagacagggtatcaatgctgaggaagttagcctgggcttgtgttgaaccactgacctgtgtgaacggaaatgtcctcagaaacactgtattaaaggaaaaatctgcatgacagctctggatcacaaaatggaaagccaagcagagcccggccacgggcggcgttgagaagagtaaggttgttgagacttggggaccagcgtagggttaaaatagagacacaactgaccttgatgcttcttaaagtatttgtatttgttctatgatcttaagtcttcactattaaaataattgatttgtctagttctagttctatgcaacattcagagttaaaatcactagcaaagtctcttaagtgtatcagaatccaaaatagaattcagccaaaatcttctcttgctccaggaataggcttttaaaccaagactcagttacctcatcacccttaggaagttttgagttgaatactttcgaaaatccagaagatagactgacctaaactgagttttctttttttttcttttcttttttttttttttttttgaggagtgataagatagtaaaaaacgtctccggaaatcctgagtttggctagcatagtgtagtgaatatgtttctttgtaatgtcgtgaatttcaaagtcaaaaaaacaaatacatgccctaaattactttcaatttttgaataaggttttatgtttgtttgtttgtttgtttgtttgtttattgagacagtctcgctctcactctgtcacccaggctggagtgcaatggcctgatcttggctcactgcaacctttgcctccctggttgaagcaattcttctgcctcagcctcctgagtagctgggactacaggcgcgtgccaccatgcctggctaaattttgtatttttagtagagaagtggtttcaccgtattggccaggctgctctcgaactcctgacctcatgattcacaagccttggccccccaaagtgctgggattacaggcgtgagccaccgcacgtggccgaataacttcttaaatacttttttttttcttcttctaattcttactgtggaaagttcctatgaccctggaaattgagtgaaatatttagtgtggaatcgcctgcattttcatgaaatttcttcaactatgtttttagaatggtgattttataatagtaagttgtcagtaaatttgtgttgattaatcacctgatttctaaattattttcctaacttttaataccttttaaaacgtaaactttaaaaaataattcatataaaacctgaatatacagaactacaaattgttaacattttggcacttttgatttctctatctccatcttcgtatattttgagttacagatactgagaatctttcctccctaattcagcatgcatatctttctaaatgccctcccccactttttttattccagagtctagtcaaggttcacacgttgcttcaaattctttgtctgtagtttcttctaaccaagagagtcccccctccccctctttgtttttcctgatctttactttttgagggatacggattagttgacataaaatgttccaaattttgttcaggtcttttgatttctaattaaattgttttctctataagaacactacatgaaccatgttgtatagttgtgattgcttcttattagtcattaataatgtcatgtttattagacatgatgttaagtcacttggttagtataataattaccaaatctcttcaactgtctcacgttaagaaatgtgaatatcttgtcctgatcctctccacccccataatatttcataaaatggttttaaagccctaaaacttaaagtataataaataaataaataaataaataaataaataaaaccactgtggaaaaaaaaaaaaagcccttgctgattatgtatttaagccatcagtacattagtggttacaaagtggtgattttaaaattctgccttttcttccacattaattatttggcaatctcctctatacaaatattttcttcccactgtccctttgtccccgacctccaataattacttacacaggaaatagcagctagggctagccaaatagaaaatgtaatgagggtaaaatctttctccagcacttggttttcttttctagatattttcccctcacccggtcttctcaaatatcccttccacttgaggacccaatgactctatgcattctcttattctttcctaaatattacagtgactaagacttattagctactttagaactttaaacagatcattcattctctttgaatagaggtttttcatcagttcaaggtagtaacatgtatccttcattgagttgtaagaatttcaaaagataacagtggagtgtgatacatggttaaagtttaagaaatttccattagcaaatgtaaagcactaggaagagataagtatcaggttccttcctgcacttcattttctactgttcttgtgttttaggagtatttatgattattcagctaatgttatttattcataaaataactagtttttatgcttatatacctttacctcatttttggcagagaataaaatgtattatatatatcctatttcaaaacatatggttattgaatagaagaaattaccacataaaataaactcttgcataaagttgcatgtttatgaggtctttgttaattgtctttgttaacattgtctttgttaattgtgttgcttctaccttatttagaatattttaaaaattatattttaatgtcgaatatcacaatatctattggagtttaaaggtaatcatcacacacaggtttaaaacagagattgatggagttagaaaaaaatgaaaattaaaatgtggatgacgttacgcacactgctaagtcagtttgcaccgtggccagatagtcttccttccccaccctcactgagtatgtacactggaaaaatccagctaagagaaaacataggacttgcagcagaaacatcccttcaggtatcagtgggacttctaactcatatttttaagcttgaagaacagtggcagagaaataaaacatagatttgactctacaaaccagaccctgagtcctgaggaagaaccaggttaatggaaaatgaagaatggcaagaagagcagcccaaagagtaaaccccagagggagggagtaaaactacatatgcccagtgctttttgctatcctcagaggggaataaacagggggattacaagagagagaagagcatgtacatagaggagagaacctgcagagcagagatagagttaggattgttccaaggctattgaaaaaagttctagatgagaattgattgctggctgcagtgaagttattaaaaaatggtcagattttggatatattttaaacttcgagtcagtagaatttgctgatggatacagtaaggaatataagactataagagaaagtctaggatgactctgaagttttggacacatgttaggttggaatttcttttttattatgtgtcaaattttatttctctgcacatatcacagtgttttttattgcttatcagtcttttaaagtaagttgttgttttattaaaggcacatcttatttttaaattaaaatgatattacatgactttgtcagaaaggtcaatcaccagcattttgtctcttcatcccacaagattactcccaagatggtaacagtttttctactatttttaagatattttttctatgatatttttaaaattacatttaaaaatgttaaaacattactttctttaaaataatgaaattatatttcatttactcattttagtaactcttgatttcctgttatggtagttgaagatttagctttccacccatcctcacattcctgctttcccttttctcagccttttgactaagatttctttaaactcattaatagattaatagaagatattttcatggtgatgactatgtaaatacaattcacttctaaaggacgtattgtgctatgattacctttcttttcccattgcctcccttcatcactacacactggacttaataattgcttaatttacgttagtttcctatacgtgtatgaacatttttctccaaatgcattgatctgtcaataggaaggattcctcttccttcctatttcccagtctatatcgttgaagtctaggcttgaaacaaagatgttatttgtgtatttctctcacttctcttattttttgtaatcccactctctggatctcatgtcttccttttaaggttttctgcatacacatcttctaatatagtgtttttgaaactttagcgtgcatcagaatcacatggatatctttttaaaacagtttactaggttttaaccccagtttctgattcagtgtatctggggtgaggagagtgaatttgccttttcaacaaattctcaggtgctgctgctgatttgggcaatacactttaaaaactattccagggcacaagggacataagattttgagagcttccatgtctttctagtttagctagtatgataaattgcgctattgcctaaaaccccccatgcctacttgtatccaagccttttggggtttttgtttgtttgtttgcttgtcgtgtaactgcaattctttctactagaagtggagttcacttccctgttttactggtgaggggtttggtaatgttctttgcttgggccaatgctgttttaatagatggaactcaagcaaatgatttatacttgcttgcaggatgagtttctcttatgttttccccttcaacaacaacaacaacaacagtgacaacgaaagtaagaaagaaaaaagccttaggtagtgttgtcatctcaaaaatgagagacatctgaggcaaacctagctgagcctagcatgtagaagcttaaccacagataatctgcaggagcatgggtgaaaaatatatgcttgtttatataagccactgaattatcatgtagtgtaacagtgtgaaagtagctaaataatagaaagcctgggaaagaataattttctctcagagtgttcatttgtttaagagcttacaatttttccccttatggaacattttagagaattcccttcaaatgatttctctgaattttgcaatgatcaacactgtgaaggaccttttctcatttattgtgctgacttcatgattggccgttttattctagagatacaaattcttatctcccagaattttcatatattgctattatattttcttcatgatcacccaattatgttttatttgctcttcctagaactcctataatctagatgttaaacattctagattgagttatcttttctttcatatttctggaatatttctggaatcactatttctggaatcagtatttctggaatattcccttgactttatcttctaaaattgccaattaattaaaaataatagacagttttatccctaaattctcagcattcctggttcttctttgaacgtttcttataaagtcatattttcattttacaactgcattttcatctcacaacgggcattttctctcttctttctgagaataatgaggatctatctacagtatctatatatttactttttttctactttttgttttgagggtttctttacaccattttttgcttatttattgtgggatcccctttttcataagttggttatttttcttactggagggcttatttggacgatatcatcttggtagcagtgaagctttgctataggagagcaggttgttaacttagggttttgtttgagaacactcaaaattaataggagtctgtttttttctttttcttttttttttttttaaattccctagtgtcacttagtttcttgtcaaggaatcttccaggccaactcctgggtatgtgttggtcagatcaggtattattgacgagaatttatgcctggctgcgaggattctgggaataggttagagaaagatccattaacatgtttcagttcaacatgtagttgttcaatttctttctctattttcagctctattcctcaattatgccgtcaactgagtatgagtctggggtgtccccagctcaattttctcaaagaggaggaggagagtgccttagctgtcctttgccctgcaaggcatttatattattatttccttgattgttaagcctgtaatcatgtcttcccacatgctttctgccttctaacaaccagaaataacttgcttgctattttctgttctcttgttttctatccttgggtttataataatttatcatcactttagtgaattcaagggtgggagttgagaggaattgggaggggtaaatgagcacccgtgttcaagtagaggtataatttgttaactgtgttagctgaactataatcttcatgaagagcggatgtgtagctaccttatttacagttctatacccatgatctagcacagtgccaggcacatagttagcacttatttaatacgtgttgaatgaatgcttcaaaaagaaatatgtaatatttagatatctgtttgacagagtccacggatttccaattcaaaggagaaaatgcagagatgttgtggaaagcaggccagaccattatttttacccagcacagtggcatggacagacagataattactattaaaaaattcagtccgattagccttgctcttagttaacatattttgcaggcactctttacacttaatttttttccagggaaaacatccttctctagttcaaagatatatggatcacattcctgggccattgtgaagtattatgaagtgattcttctctttattttgaaaaaaatggaaggtcaaacaaataatttttctttttcaaatatttgtggtgttttgtcgtggtaaattgagaggttatgctccatatcacctggtatgtaaaatatgatccacttaattcttaaaagatagttagcttctatttgaacaaatatactgtccagtagccttgtaccttgtgttcttgaaaaacacacgtgtgattgtgaaatactttggtaaagaatgcataaagcagagacagatctaaatattcttttagtaagattagaatttctcagcatttttaatctggcacatatgagaatattgctatgatgaacgtgcatgtatcagaaaaggtaagttacattacttaactctctattgtttttaaggaaattctaaatcctaatttggtttaggcctttaaactaatgtccatataacccagcatgacttataaaatctgtgattataggcatgtgtttattagtatgtgtttgtatatcaaaacatttatatgagcaggcaaatattcttcagataaatcatacccttcctaagtattttcctccagagaaggtcactagtttgagagtaaaagtacatatatacgtgtgtgtgtgtgtgtgtgtgtgtgtgtgtgtgtgtgtataacatataggtttaaaatgaaaattccttggctatagaaaatatatttacatgtatataataaattgctacagtattacaaacacccatgctttcttattacctgggaaatccagatattccctttctatttccatctatacaattcagcttgaaatcaaatcgcatctatgaaagaaagagaacagaagtcctatttttatgaaaagcaatgccgaagccatgatgtgtctaattcacttctaaaaattctacttaggtgcaaggacgtagaagacactatagtttgcctattagcttttgctgtatacatagaaccgaaattagtatggctaacaccctgtgactatggccattcttaatgactcttgtaatgcttatggataaaactggttctcaattatcactctggtaattggggctgcatttttagcataagcgaacaccatgggaggcccagaacttcactgtggcacagaacccccaagccttctcactctgtcctttgtcttataacttgatcttcatttcattccaaaaacttgttctgatttcagcaaatttctctgttcctggaaaagttgccattaatgtacattaatttaccatcatcttctgtgtatctgtccttccattctggactgttagcccctttctcctttctagttttccatgatacgacctttattcactctcctcctgcagtagccttttcaagatattattcctaatggatacagatgctcaagtatgtagacctgccattcaatatgatacatatcaggggcacactttgttttccttgtactctgtctgtagactctaagtcctataattgcaggagctttgtgtatcctctaaatgatgtatcctcagaacctaatgtagtgtgtagtacatagtaggcattcattacgtatttgttgtgtgaataaatgcaattgtttgtgattgtattacattttgaacttccacatgccaaggtctattcctttagtccagatactaaggcatttgtctgcgaattgcatcaggatctgagtcatgttccatcatgagaggaaataatttactatgattattgttgcccttaacggcactaaccacaaaagtgcttgtaaatgcctaattgtccatggagatatatgtggtaatgtatgataaaaggaaaagccccaaattttcagagtttgacaggcacctcagttgtagactcatacatgatagaacataagaaaggcagaattcaggccattttatgtaaaattaagaaaaataagatttcctatttttgtgtctcaaatggtttttttaagtaagctaattttatgaaaaaaatcagaagttttatgtgtagttaatttttcattaacaaaagaatagaaaaatccaaataacatacaggtgatcaacacatttcatgcatacaaacatactcttattcatgcatgcatacatacatacagtttttagaaatgcctatacctaagtaataaccattagtaaatttctaactgagatcctcttgataataaaagatagttaatagcttaagaaagtccttgttcatgcttcatgtgtcattaccatgtatttaggaaattcaagcatataaactctaagtgacaataatatccccgttaaaccagtgagagatatctgttatttaaaaaaaaaaagattgtagttgacaatagatgtgctgacatcatcctaaatatttgaatttgctaataattgtcctctacacaattgtagtaagagttcatccttaagatgcatatgttttgctaatgttaagattagctgattaatattgatggcagctaaggccagtggctaatgtctgacatctgtttgggaaatcattgttcccattcaggaagctggcatttctgtagaggttagaatgaggggttagtgtgtaaggaattatgattagggttttgtgtatggttaaggttaggaatagggacatgttctatctcatttctgttcatctcaatgtatttctggtgtctagttgcttgctctattctgtgttaacagagaggtcttcccctctgttcccttgtggcacattcactgtggcacattatttcacgtgctccattctgtgttaatggactgattgatctcattttcttatctgtgttagtccttactttgtccttaaagaatctcttcttttgggatagaaacattctttttgttccaattgtttatttgagtcacaggtggacactttaactgatttaaagtgggaaattaatttttacctcatccttttccagtgccaccttaaccttaatcttaatactgaaaccatatcaaagggaactgtgttttggttttgggagggaaagctattgatatatggatttctctcccaaaattaaaattttaataaatgaaaaattgtaagccaaaaaagtcttagtcctttaatttttttctaacacagctatttgttttattttttctctagtgggctttagtattaatcagtgtatagaggaggtaaaaatagttttcctataacttatgcaaagggaagaaatgaacatttagtataacaaaagactactgaagtgaggtaaccacagagactcagaaaatcaatcaacctaagaaggaaagaacaccaggacctctcaggatattgaatgaatgcacaattaaagtctgttttccttttatttccatttctctttaactgaaacatcaagtggaaaatcatgaaaaccttgaaaattcaagaaaacttttaaagaacattcgaggatcttactatattgatgtacatagtttgatatttttaatgaagttctttaagccattatgtcaatggcttcaagacattttgttcagtaaatgaaaaatgaaacctttacaaactcttgtaagattttcattaaacacttcaaaaaatagttttttatgtaaaagtttctgtcagcatcaaaaatcttttatttagtacacatttcctgtctgttggggggaagcaaaactaaatgagaagaaaattgaaattatctatgtatattccttattaaatgtaagtgggggctagggtggtatattcttgtattactattaatttttagacagagtttttttcatttcacaatgatatcccagtttgccaacttgtagactgagaaaagtgctgcttaaattttttgtgcctaagactccatatctttaaaatgggtttagcaaaatagggataatcaatgaaatattgtatgtaacacgtttagacatacctgatacgtagtaagtacacaatacatattatttaatattagtaagggtactaatattatctagcatgatagccagctagctctggaccttttttgtgctcaaattaatgaatgaataaagaaaaaaatatatattttcttcacaataataagattcagggacattatagaaacttaaactttgaagttatttagttcacacttttaccaaatatgagagtaccataatttatgacaagggattaaatggattcacaccttttttctggatttcttagaagagattaacgtttttgtcttgcaaaatatttttcttaattaaaatgaaattgaatgaatttagcatttactcattggtgctcacttcaaccccaggaatgtcaagagtgggttcacattttcccacagagttgtcaatgctttcctcatataataacactaaacattggattgtaagaattatcaccctcttacatagactactgtctgagtaaaacatttgttctcaatttacttagttttcttgggaagtaatgattcagtcattctgatttgtaaatgttttcttgtatatctcatggccaagacataatagagactccaggaaggtctgacttactcttgaagggaacattaataaccactacaggcactatgtaagttgtagattgtttagttctccttttgtcgagaacccttatagggcagatttcattattgtcatttcttcatcaaagaaactgagatctaccttggttatatcactttatttagatctagtcacaaagacagtcagctctcaaacctttgttttttctgatatttatgaaaaaatgacctttcccatttccatttagttgctattatcttctgccttattctggacaccatagtgtaaacacttgtattctttaaagctctgtatgagaccttagacattcaccaaaagttaaaaaaaacactccttaagaagtaaaattattgtggttaattaggctcctgtatactaaatggaattccaattcagattaggggcattaaatataacattttatttaatcctcaattatgagataggagttattattgccatttaaattaatacatatcatataccttcctagtcacacatgaattgacttgttaattcatagaaattgaatttgcatatgtcaaaagttctactccaactttatgaatgctatttaagattgggttaggatttttggtagtcacggcatagtattacctctaattcagctgttgctgataaaaacacatcggttccagatgcgctattcagtgaacagtctaatgtctggtacctatgtgattaaggacctaaaggctagattcttaagagaataatttattagatcattgctcttgtgtaaatcttcccttaagagagattcatactcagtctatagtaattcacttctgggaccctaaagttagttgcttggctctgctgtgagataaaagtagtatcaaataataatatgatacaagcaagaaagcaaaataaagggaaagaaggaaatttaacagtttgatattttgattgatagttgcagggtctatgccaataaaaaatattatttagatagcattaatgtagttattgactcaagcaatatgttcatgcatgcaatattttattttggtattctttaccattttaaaaataatgataaacaatggacatactctttctctgaaagaaaataacaagataaaggagttttgacatgcagtttgagtaaatatatctaaaatatgtaatgagaatgggagctttcacatctgctgtattcattgtcaaaacattattctagatattttatttaatctagtaatataattatctagcaaagatagtaatttagtaaagttttaaatttaaaaaaagaaattactggaattgtggcagcaaatggatatatttaaaactgagggcaaaatgaagcgcatatcaaaagaaccaacgaatgagagaagataaagataatcaacatactcagacagaaaagtatgcttagtacacagcagtgagcagtttctgaggtttctggtgcaagggaattacctctttcaataaaatgaatcaattataaccaaattatgaagtaatctcttactgtttgattttttgatacatgaaattatttttactgcagattttaatataacaatatgttatagtcatagagcacttttcctaatttagtaattgaaagcttgtgtaaaaaatgtttctctgtttttgttttttttcttatattggccatgaaaacattcttttgaggaagattttattttcccttgctaagtttcagtaaatataatttagttgaatttaatacaaccagatgcataagatgaggtaggtaatttaactgtcagatgaactatagttagttaaggtacgcaatggattttgtttttcttccaagcaagtgtcagttaaatagcaatcatttccttcaaaatactccctcacctcagcccctcaaaagaatttcaatgctatttttgaaaatattttgaattactggtcataaaggagttctaaaacattcctgtgaagtgctttagagcttcacccagtagtgtcaggagtattcattcttacttgaacaagagaacggaaaacaggactggctatagcagttgccagcttcaaggattcaagtgcagaggaaatcagagaaaagaacaggcagaacagatggttaaaagtaatttctgaaattagttcaaattgttttaatagctatttgtattttaacagcataatttaacaatttatattttgagattatgtctatgaaaataagtcccaaagtgagaaaacatttgtatatatatatataggaatataaattttcagaactcagtctttaagactgataacaatcatcataaatgcaaaaatctaaaagaaaaaaacaagtttcccaatatttattctttgttgtctgattttatatatttaaaaaactattgaaacatctgaatcttcgctaaaccctatagagaatggctgtatttctaggcaagtgttctaattatgtatttttcctttatatagtatttcttgttgcttgaaaagctcctttctaatctagcagaatatgttagaaaagacaatcccagtaactgagaattctattgcatcaggatctattatttatatattttttctttttgagcttatggtgggcggtttagagagctgacccattcttctgtctttgcgtgtgtatttttaaattctagtcattgtgtagtgagaatatgcaggtgtttctcagagaactttttcccctctagctggatgtggaaaggacaatgcaattaataacagatggcacgggatgaccacgtccttgagagaacgccttattggcacctcctgctaattgtatcacatataacacaactaaaagcataataaatctgaactgggggacattttatgcaagagctcttctccttttccagacggtaaattgctcagctcttgaaatatctataaccttgtgacactcaacttgcattagcttaattgccttttttccatctccctcccccttctaccctccctttctctttctctccttctctccttctctgtctctccctttttctcaccctctcactgtctctttcttgttgtctcatatttttttccctctaggtgtgaggaaacaatttgacatttgtttttctacctagtttagtgctgcgtctaatacagctgtatttcctagcttgtatagaattttttttttttttttttttgacggaatctcactctgtcgtcaggctggagtgaagtggcgtgatctcggctcactgcaacttccccctcccgggttcaagtgattctcctgcctcagcctcccaagtagctggggtgacaggcacgtgctaatttttgtatatttacaaaatatacccgcccagctaatttttgtatatttagtagagacgggatttcaccatgttggcccggatggtctcgatctcttgacctcctaatccacccgcctcggcctcctaaaatgctgggattacaggcgtgagtcaccgtgcctggcctcttttaaagggctttaaaacacttttcttaacatttgtgttgagaaagaaaatgcctatctgattctgatgtaatttaataaatctgtaaaaaaaaaaaggggggctctcattaagtgtaaactcatgtgagcttctgatggacatacacaataacacacgtacgtatgtaaacaaacatatccattcacacacatgcacaggacttttttctttttttgcacaatggcaataattcaccatattctgtagcattgaaaaggattgcattttcttccatttcataacctggtattattaacaatttctaaagtaaaagtattatgatatgccagaaatgtaaccacccagcaattatctttttctttcctttaagaaaatgctatagtgagtagcatgaatttcacagcaagttcctacacatctattttcatttttggtggtttgcctataaatgagcaaacaaaaagtaatttaaattacatttggagttaataacaaatacatcaaaatcatgaagtatgtgtagaaattgtgccttggctggctagctctgtgtgtgtgtgtgtgtgtacgcatgcacacgtggatgtttgtgggtgtgcatgtgtgcacactgacacattctttccttagctatatagatgtctgtttctttccagtgatttatctccattggtgagagtaaccttagtgtttatgtcagttggatgaaccaatgctaaaataagacaaagaatagctcattcaagaaatgatataatttaaaagaaagcagccatattttcagatcttcatggtattatattcctaaatctcctactgatgaataatttgggcaaaaactcctagggcagttcaggacctgggacatacctgaaattgggtataatggaaagtgaaaaattctcatgattctgaacatgcttatttgggctccggtgacacaagaagcattgttaggagttacgtgttaactatatagaccccaatagtaggtttgtgacagatgaaagaaagttaacattagtagtagtattatgaatttcaaaagtgcttaactcacaatctgcatttagctgatgaatgaccttagtaagtcctactacttttctgagcatcattatcttcctttacaaagtgaggaatcagaactagaatgagtaatattctaatagtactgccttgaagagtaggatttctgcagactcccactgtagattggggagagatcgaaggatgagagtatagtgctacaagccactattctcagatgaattttggtatcatttgttgcgtttatatgtttcatatacgatttacttggagcaatcttgtgaatgtatgtcttcttgggtaaaatcattcaaaaataattagattgcataattgctaaggttcctttcagctagaaattctatgatatatgtaccagcatgcctcctaattaatatgatctaattctaatgttcttaatgaatgaaacctggcatttagaaccaataaatgccgttgatttaaatactgcatgatacatggataaacataagtaaactcctttgcattaaatgtatatttgtgattaaatatttaaaatatacattactttatgtttctagattttaaggaatagcagttatttttacaacaggcagaatctctaaagctcaagtaaatatggatcttacgtttgtttgttttatttcatggctgtcccttcatccccatatatttatagtttactatcttgaggtcagtgcagatagaaggttgctaggtagaaacatgaagataggtttaccacttttagaacaatgaataaaataaaagtattaattagagtgatatttgatgtttatctcatttgtgttcctaccagaatcagatattttctaggagtagattcttctttctggttcagtagtcaaataaagatgtttatcctgtatacagagaaaaaaaggctaatgtgatagaaaatatactcatttttatatattgctgcccagtaatttatccaatttctgactttctcacttttggttgctgtgaggattagaacaagtgaatgcatctgaaaaatataaagtcttgaataaatgcagtagcatcctcatgggtgggagccatctcttattcgtctttgaagcctcatcacttaacatgttttctaatttatagtctatgtttgtcaatatttgatgaatacataagtaaattgatgaataaacaataatatacataattctatatttgggccagttcataagataaggtaaatgctatgtaatgatgagtttatattctctgaattgtttataagaaacataataaaaatcaataaaccagcatatactgcgtatctatatattaccttatgtgattgtaacaactgaaaaaaaaaaaagctgatgcttacaaacatggctgattgctttcctgtgtacgaatattaatcagataccatcatttaaagggatgggcagaaaacaaagtgagagaaaaggattcagaaatcaaatgtgctctactatggttatattaacttttcttctctgcaactccttgtgagttttgccactcattttgaacccaaatttatctcaagtccacacacaccaggtgatatctcacttatattattgtaaattatttacaccacaaattctaggtcatgaagtagaggtgatggaatatttttacaaaaaagttgggatgttgggatcatgttttattttatgcctcctatagtgatcattttattctcagtgtatgtcctacattagcttctgaatttggatattagtgcaatgaatgggatcattacatagcaagcattccatctttcctgtttaatgttatgcttcaaaccctcgggaattgctgatatattagaatatattcaggattgagtattacatttgtatttacatatgatttcaggtaacttatttgaaattccttagatccttgttctcttttaaaataacagtgacaatagcaagtactgacctatcatttagagttggaaatcatcataatgtttggcagcagggaattggtaagtggaaatacactagctttgaaatttatctgaactggattcaattcttggatttttcagttactacatgattttgaaactgtttctcatactctagtttgcttatctgtaaaataccacaatgaactcattggatcatttagaagattagacataataaaaacagagtgcgtagtacagtacctgactgtattcattcaaaacttcgtcttttgttactattattataccacttcttattaacaaagtgaaaatgttggtttagatcagcgttctctagcagaggagagggattttgctggtccctagttcccagagacatttgttgatgtttagagatatttttggttgtcatgaattggggggaggttactacaggaatatggtgtgtagagtccggggatgctgctcaacaacctgtaacacacagcacagtctcccacaacaaggaaacatttggcttaaagtttctatagtgcttagattgagaaacactgatataaattattttgaatcacaccactctcttgaaacaaaaagaaatgtattttaagttgtaattcaaattatctgcttcagattccaagaattgaagctaggaagcatctatactgaatggctgcaatatcctatctgttatgtttaacttggtcttaggctacaggaaatgggttctgcccttcatataacttagaaatatctgaaatttttcagttatttaagacatattttatctgaattttaattacctcctgatcaaattggctaagtagttaagaactgaagctctcattgacctgaattagttattctgtgatctgtgttttgtgctaccttttgactttgctattttcaggaaatgagagggattatggagaatcaacgctgtagtggatgactaaaagcataattactttagcttagcacaactttctttactaacattagttttaagtttatgctatttactatataaactcaaagattttattcataccaatgcaacttggaatgcagtcaagggtaatataaatgattaatttaggttggtatgcagatgattcaaagatcgaatatcatcttaattggcaagatggttttgttctttaacagactgataaaaactgtctttatgttgccattgagtttctataccttgtcaatgccccaaagattgcagactttaaatacaagaaagcagagataacagacatgaaaaaaaaaacagaagaatctgtgaaaatcatttacttattcaactttattcaaaactcaacactcttcaagatattcatgtattatataaacaaaactattttttcccatagagaaaaaacataatgttttataattgaaacttgtgtgttgtagatatgatgggatatataccaacaaggatagacaaggttctggttgcctacagacctacatgtggacccaaacagaatgttcttgatttacaacttttttttttttttccaaaatacgcagcagtatttttagaaacaaaggggatggcacacacatttcaatcagcactttccccctgagccctcagtacaatctgtacaatctcctgtctttccctacttcactttactacctttagggcccttgtctgctacgggtggagtataaataacaagcctcaacaaaagacaaaatagttggatcaaacaggcaaattctctgaaggaggcaagagggattagcaatgtcatattgacaagctgcactagagggcaagagagagaagaattccagcttcagctacagttcaacagaaaatagagaaggtaaacttgaacaatcacccttgggaagttagtagaatctgtttaaaagttgctttcagatatccagaatttatttaggaagaaaatgactccataaagtcggtaaaaaatattttcatatctcttcctgaagataattcattggtttgcatgaagaaaccttttttatttttttaaaaaggaaaaacaaaatttatttttgtgagaacaaatacacaaggaaaatattatgtagcttcaatagggtaataattttgcaaaaaaaaaaaaacacacaagctagacaatttcttgacctttcatttctgcaatcagtcagttggatgtctccctcttcctctgatgagatttagagctggggactcaatgtgttggcagtgcctttgagccaagtactgtcatgttctggtaaccatatctcttattagaacaaatatgaattcaagtagatagcaagacgacatcccagtggaaattgtcgcacttggttatttatctgtcatcagtctactgaactagcaacgaggaggagagatgaactatcacctgctagatacctaattcatctgtttgtttaaaactgcactgtggaaatcaacaaaagacctcttccttaaaataccaagaactgaaaacccatatctgctcttctctgtgtttctatttaataagggatggctgtaaagtgttgtgtttgtgatcagagctaggaaccaagttttgatcaacttctaatgggttaaataaatcgaatgcattataaatctaaaatctaaacatattgcagaccctgaattgacttgtagaagtaaacctattataaatgtattaatttcaatgtaaaatatgtgaaaataaagaatattatattgaaatttaggggatataaagaacttaccaaagaaattttattactcttaaggaatgcttcaggggaaatgaggttttatgataacatgtaaaaggaaaaataattagaaaggggattattaaacaatggaaattccatatttagaagagacatattagagtttcaaaatctattattaacagagatcattatatatgaaggaaaacatttaaacagctatttaatatttttcctattttctgaacattttatctcccacttgaaatatatgggtaaactattcactcatattgtatacaatagacaatataaatttaagagccttcaagttatatgaaccaagttgacatgacaaaaaagtgttaatacagttggaagcatattgaatacttttctaaacatggctaacttagacccaatggttctacaaaacaaagctgacttcctggaatgaatgaacaaaacttgccatgatgcagaacgggagagtgattgcctaaggaagtggaaaatccaagttgtctctcttcatttaaaaggacccactttctcttgtgtaaatgtcatcctacagtttataatgaaaacttgaggaaaccccgagggagacctggtgcttttagtaaatgatgcaagccgcattgacttacaataaaaatcagtttctggggctatttactgctccctttggcatccaatctccctccttccttcatgaaaaaaagagccatattagggccctggcagagggaatgaaaagcattgggattcctagaagatttatgcctccctgagaatgggctaacttgggtaaaccaggatgagaaatggcctccgatgccttccgaggcaagagagacagatggtcaagctaaataaaaaacagaaaaaaagttgatttggaaagttggttgatgaaaacatttcagtagattagatattttgtattaagttccacacaagcaaacattacacatacataattttttacataaatgttccttctcattgtttcaaaacaaatgctatgaagttcaccccgatttttccaatcaaatactttctatctggcatttggcaacaaaacacagaaaacaaaacaaacaagaaaacgagaaacacaattttgaacacttcctaataatatagaaaagcaagattttagccaaaaaaatccataactttatattttaagagaggttgttgcctcaattgaccaaggctctgactttttcagaaagaaatgtaattgtcttttcttttcttttttctggtcccatgtcaggaggttaagacttgtattacttcacccacagaagatttatcacaaattcaagtactcagagtatgcagtgttttcagggaggaaccacttattctgaagttcatatattctcaggatttctggggtaaatatttgcctacaaaagttagttaacacacatacaatacaaatgtaacttgcataccaaaacgcttaccaaccttttaaatttaaaacaaaaaacaatataataaaaattcaaaaatcatttatataaggcagctgccatatactatgttacaaaacaaatattaaatcatatattaaaaggttgtttctctccttgaaagagaaatatgtaagagaagaaagataaaagccaggagaaaaaaggaaaacatttcaccatatgtatacaaaacaaaatgctgtattcagtcatgttaattggtagaggatgcatcagctgtgcttgcaaagggcactaatatgtaactgaactatcagccattgtgctcactggaaagggatactctcctacccttattcaatctgtaaagtgatatagcggtgcctcccacaggcctggagacacagttagagtccacatgcacaaggaatgtcaaaacatgaatcaattatatttctggccagaaaggtcaagtgtggaacttaaacagctgagttaaaacaagccacttgtcaaatctgtcctagggacatgaagccagagtcttgtatctcaatggcagccatatcttggatttgggacactggaagagcagaactgaaatactatatttcaaaactatagtatttaacagtaaggtggacttggaaagtaagtgtaaaacaatttcaatgcatgataaagaatatcactttattttacctaaaatacggagaagtatatttcatatttgatcctcccttattttttgtggaatagtaactaaatggctttgtgattaagtggcaatgtgattggaacttcaggtacatcatcacacttaattctcacaaaaaaaatgaggtaaatctcatctacaatttataatggagaaagctgagcctcacaaaggctgatgaaatttttagctgtcatagctagtatatggtatagccagaaattaaaacagttctctctgctacttaagtccacactttttctaccaaactaatatgagcttcatcattttacatattttaagccactgctctgttttgttttgcacttgtttaatatgtttgaatctttaatttttcactaatgttaataggttgaaagttaattgtgtaaaattagatttttttctttgatcagcaaaacaaccaagagactttaatccaattcacactccgatcaattggttcaagaatgaaaaaaattattttttgcaaaatcagacaaatgtaatgtttctgttggaataaatatgtcatgaggctaataagttcaaatataagatttttcttcaagattagacttgctggaataatattatttataagatataagtataatcacattgcctataaacagcctaataattaaagaagagtttttggttattacatttatttaaaaatgagaatttttttttaaatgtccaataccaagaaagaggctaacttgattcttggtggaatggaatttaggaagggttctgagagatgtgttaagattcctgctatcctgtgctctctgctcttcttcatttatttttctttttctaaaaagtgaaaatataagaacatttacaggggaagtaacattgttgagtacttactatgtgctagtgaatgtgccaggtgtttttcatctattgctttatttaagctcagacaaaatgagcattattttctccctagcactaaggaaactgagcctaaagagatccactgacatacctaaaacatatatttgggaaatggtagaacagatatttaaaccgagaaccctggctttagaagtttcattttctcattactccagggtgtttgtggagatgcaaaattgatcccggacttcatcagttttccttttctggggctcaaaaagcatatgtttcaataatataaaagagaaatttaaaagtttgagaaatagtaattatgtacactttagactttattagttaatatgcaaattcaatagctaacatgctctaaaaagattgcatatttgtaagtttaatttaattctcttttttaccttgagtcaattttgatatcagtagtattgaaacgggagagttccctgaccccggtcgcagtacatgcaacaagagtgtggctcatttggagaactacaaacccctgatggaagagggagcatgtagatggacaggtgccggagccaggactagagcttttgggctctggccccacagtagcgtctaggggtggatgtctgttgactcctgcagccccagtgggcatgttacagtgctcctttagctctcccaactgcagacagcttaagagttaaccagatcagtgccctcttggtacctggattcttgtctggcatctgggaagaatcaggtcacctggacaaagtgaagggtggtaaatgcgagggattttattgccagatggaggtgattctcagcggaatggacggggagctgcaaaggggatggagtgggaagatgaccttcgcctggagttcacccatcctgcagccaatcttctttccatccaatcacagccaaactcctctcgatgttcagatgctcctcttctctcctcctctgccatgctgctcttctgctcctctgctcctctgctcttctgctcatggagcctggggtttgggttttatatgggtacaggatgagggtttggtgggccaaaagggaacatttgggcttgaaaacaggaatgcctgttcccatttagggccatgggtttccaggctttagggcagggcctttgctggggaactgctctcttctgcccagtattttttcctgcctcctgtctgtatcagtgtaaacaattttttttttaagttacaaataattttttataaaaaatattgtaaattcttttttaatgccaatattcttacttgacttctctttccccagccatttatgtgtttctaagatttctgtggacacagttatattcttcaatggaagatacctttctttgaacctataaagaaaaactcttacgtatttacttacttttagcctaaggatagagaagccaatgtaggaataatatgatggtgaagtgatgaaagtaaaaaataaaaacatcatgctagtgctattataatatgtaattagtgtggtctaaggctatatttttcaaaattgtaaaggtatgttttatggaatattctttgagctgttctgaaatcttcaagttacacacacacacacacaaacctttttgcttaaaaattatcttgtaaactcctgctgtatctgaattctaaaatttcacattaacctgttaaatgccgtgtcaagcctaagagtaaataatcttttttattaccaagggtctccccaaatttatttggccaaaaatcccatctttcattttatacctactaataatatctagaaatagaactcacaattcacattgggaaactattctaaatatatattcaaagccaaaagaaagatttactgtacccaatttggaaggacaacgagaataacgatagattagattagaggaacttgaaatagtgtaggcaagcaatgatgagggttggaattaaggccacaaaatggcatagattcaagaaatgcccatgatagggcttagaattgatctgatttagtgattattcagtgaaaaagaaggagtcacatatatcaggtctggcttgagtgattggttaaacggtggtataacttgccaaatggaggtctggaagaaaaattgttagagtaagaatgtgagttcacttttgaactgttgacttcgaaatatttggggttcttctaggtcattttttccaataggagccagaaatagagatttagagcataagaaataaagaataaaagcctcagcaaagatataaatgtcaaagtcactgtgtgataaaaagctcccaggatatggatgagactgcaggtgacttactcttcaactggtagggatccagctactttgttaagtgtactaagcagagcaagatgttgaaaatgtacactatattttgctagtatagatcgtgttttagaaaaagctaaaagataagtaaataaaaataaaattaccaacatattaaatgttttccatattacctgtgacaaggggcccatgatgctgaaactacagtctcccaaagagaaataggcagaatttaagaaagttagctgatgaagatgtttttaatcttctctgtgagttcatgccaacaaatactacattaagcttatgaatacattaatcaagaaaagaggtgttgagtaatgattcactcagaacttaaataatcctgtgatctatttgaagcagcctgacaccattataggaagtggtaaatgtgtttcctgttaaacatttgctcagttcatttacagtaattctgtattccttcttaacaattcacttttgtctcacacttgtgtgtttatatggaatttaatactcagtgatgcccactgattaatggcatgcttgaaaatgtttgtgtgctgtcaagctaactgaaccttgagttggtatcctttctcatttcaagaggataataacagtactggggtaatgtgggctaagcacctactctgtgccatactttagtagaaacttagcatgtagaatctgtcaaatcatccttgtaacgtaatttttttttattgtcctttaaatacctagaaactgaaactgtgggagttaatgtttaaagttacaaaatcagtaagagtcggagctcaattttgattacgtggttgaacgattctacaggctgtaatttttccattgcctcatccttcctacatatggaagattagaaaacaaaacactgaaagaggaattatccctttccacatcaactaattacgtcacatagaggggtttacatgtaaaccttcatactctacttttcctctatttttgtaatagcaattaacagaaactaatacacttgagtaagactgttgtttttgagcttcactttcttccagaaaaaacacttcagtaatggtgggcttatactatggaagttaaggaaggaattgataacaaaaaatgtataaggaatgccagacaattgttccaacttaggaagtgacgttgaactctatagggaaacactggtgctgccttttccagaaaaatccgattatagtattttttttaaataaggaaagttgagaatacatttaatattccataaaactgctctgctttgattttagaaataatcagagaaggaaggcatcagttattagatcatttattcaaaatattttaaacaaattaagtgagcatcaattactttcttatatatgatgagttgttgaactaaagagaggatctggatatcagagagatgcacagctctttgcccatgaaaagttctttattctagttcttttaatttgctttaccccatgaaatttattatgccttccatgtcagtatggtatggggttaactttttaaatttatatttaaagtaattgaatattatcttagagccccgatattcgtaaacatttacctaaaaatttgttgttgtcagtatctcacagtcactaacattgatctacttttcttcaaatacatgtttaaaatgaattctcacagataagtaaggtaagtagaattgaaaacaaatttagccaaaggaaagaagatatgtgaaaatatttacatgaagttgcctgaaatggtactgacacgcattaaaaaatgtgttatataaaagaaactttccttatctctaggtggaatatccacaatcattctaaatgttttttgataagttttgacattttgaaatgaaagttattttaacaaaaaccacattcaagaaagatgcttaaacattttaaatgatgcctaatgtggtgaatatattgtttctcttacagatagagatttttatcaaatgacatttttagtatgttatgaaaaaattaatattaagaattatagtatgaattaaatgtatgcattttagaggtagaggagaataatgaaacacatagtatgcaaatacatccttcaattaaataaaattgtcatctttaatacttttattaacgtcttaccaagtttgtttccattcactgtagatggttataaccaaagagataactgtttacgatcttctttgagtaaaaatcagaaatgtaagcatctatagagtaaattattttcaggaatatattactgatcaatgatggctattttaactcaaagctcattttgaagggaaaaaataacaatgcttagcacttttataatgctttttgtcttcaaatcacttaattaattctaatctttacaacgcccctgagaggtggcaaattggccagatctgtttttcccatactgatattattatgtgcatgtatattaaaatcacagtattttacttcttaaagtaaatttgtttgtagcttcaaataatataaatcatctcacattcatttagttaaaaaaataatgttgtaaaatgaaaacagattccaaatcatgtttggtaatcctttaggagaaattccatacagactttagctttggattttcccttttgtggaggggagcatatttgaagttgtggagcatgatgggtccaggacctcagggaccctagattctagccttagtttttttattaactacgtgtctgaccttgaaacttatttttctcagctacaaggtagcgataatgttacctgcctggcatttatcacggggatgtttgatggttcatgcaacaatgtatgtgaaaacattttattaccttaaagcatttttcaatataattgatatatttttataaattgaaagacaactaacatgaaatatattcctatgggcagaaataaagattgtaggagattgcattttagtttattgattcagcattttacaaatgtatttattgagtgtctagtattacagagagcacacacagttgacatatgaagagcatgtatggagtgaatgagttgtatatggtgaagcttgataagatgtagatattcattatgagtccattgtggctggcatatcccagaatttttcttaattttttcattcaaagaagaaagcatgggactgatactccctctgaatggatgatcttatttattaatggggagaaatatatgggtctcatcattttcatcatgtttaactgtaacaagttaaaattcatcaaaataaagatttcagagtatagtgttgtgcagtgatatatgtagtatcacttcagtacctctgtccactggcatgagccccttccattttcacttgaaaggtaccttttgagaggtattgccttagttaaaaatattttgtcctctttagagtagaatggcttctagcttaggcatttccatcttcatttatcttttgggttttcctctttccttgtgaattactccttctgaggcgcctatattggttattccttatctgttagacatctaaaattgagaagctccagaactcatagtactcaggtcctttttctgtctacattgactaccttggtgctcgtggtcattgctgtgactgcaatgctgtaaacactcaaatacaataatcaattttatatctcttgcatacacttctctcatgatatccagaatcatgtttctaatactattcatcatttcagcttggatacatctcatatgcgtctcagacttaagaggtttaagtaatattcctgactctctcctgtgttcactccattcctcctacaattttcctctttgcagtcagtaaatggcaactctactcttccagttactgaaacaaaggccccagaattcctcttgatttctctcagtcacatatgctccacatctcctattggctctgttttcaaaatatatccacaattcagccacctctcatcacatcaaccaagcacatcctggctaaaactactatgtgttcatcccaacccagcagttccagactgttattcttacttccacccttgctattacagagattattctcaatatatgatacagatctgtggttctcaaatgtcagcatgaatcagaattacccagaagtttgttaaaacagattattgggctctatcctcagagtctgtgattcagtaattgggctacagaattggcacttaaaaaaagttactgagtgatttgaatgtcagtgctctggagaccacccattgagaattagtcatgtagggcttcactactcatggtatggtccactgaccaaacatatcagcatgacttgagcttttcggaaatgtagaattttaggctccacttcagacccactgaatcagaatctgaatactaacatgatttccaggtgatccttctaaacatgacagtctcagaaacacagattaaaaaaagtgtattcttctttatagtgaagagaaatattcttcttttacatttcaagtcacattattttcttcctttactcaaaataggtttccttctcaatctgggtaaaaccctaaatccttaccatggcttagaatgtcttgcatagcctaggcttcctgcaaaaccctctgatttcccctcctaccattcatctgctgattctgttgtcctaccccgttgatcaacttgctcttccttgaactcaaccatgttctgactcagggctttgtcactgccttttttcctcagtctaaaatgctctttccccaaaagccatagggtttatgctctcacttcctttggctctgttcaggagtcatcttagcaatgaagagcttttttccctaaaatatttgataacagtcccccttcccaacctgacactccgtgtacttcttaacctgctttgattttcagtgtgtaatatattaccctctgaaatactacatatttgtttactagcttattttgtttctagaagacaatttcttttggcagagatatttcgacctttttttcccttttgtttgactcttttgttcacttttgtgtgtccaatgcctagaacattgctagcatataatagtagtcaaatatttgttgaatttataaatatgaatgagttttgaaaatcttttctcaaggttggatttttaatgggaagacataagggtatgccagtatgaaagtattgaggagaagaatagatgttatgtataagatatatttcctgcagttttaaattctgtcctaggatgatagaccaaaatgatgaaaatttgctaatgtgttatctccttaaaataaataaccacaaatgatctcagctgtgactgtttttggctaaagaattttaaattaatggtgataaggtccaacagtgtatacagttggaaaggggtagccagtgggaaaatactgggataagtgttgggactgtttttatttaatgcctttgctaatgatctggaagaaacggtgagaatctcattaattaaattcactggtttactaaattaagaagtatcaatggtaccaaagaagaaaaaaaaatacagaaggacatagaggtgtcaaagtggagataaattaattagagttccatctataaaaaaagaattcagattgaaatatttaagacatatttaaacagttctttatgctgttaatgttcatttgatgatgatgttagcattgataatgttgatgaagatattttcctttgatttctgactaatctgtgtcaagagtggctcaactgctgtcattttatgcaagaacccatcatgttggacactatgtgtagtaagggacaaatcttatttccaaactataattaaatctacatttacatatgtccagtggtattagatagcgatggttcacatgaggaagcaagtgaagcaaattcttcctatgggaagggattttgagggcagcatttacacaatgggtcaaagttagaaggagagttggttctgacctcaagacagctttcaggttatattctgccccagcctccatggatttatttctgaatcccagtgtaaatttttcacagtgttcattaaatctgttaggtcaaatcttatataatcggccataaatggtcagatattggtaatttcttgtggctgaactaatgtgctgtttggtataagaactttgaagttgcaaggtaatagctatcctgcttctccaggtactcatttctactcacaagagaccctcccagcttcagttcagacatcaggaactgctggtgagcagcaaatgcagtgctcatttctgctaagcatggaaacttatagtaagagttagcagctggaagaagacagaaggaaaataaatttcaagaagtgcgctaaggttgtgtgtagtggctcattcctgtaatcatagctactggggagactgaggcaggaggatcacttgagcccgggatttcaagactgcggtgagttatgatgttgccactgtactccagcctgggtgacaaagtgagacactatctcttaaaacaaaaagaaaaaaaagtgtcttagaagactaacttatagattaaaagacttaaggattccttaaagtatttaagtattaagtatttaaggattccttaagtatttcaggtaagttttagtattgatgatatttggggtctatttataatactatttataattcttattttcatgtttatattttgccccaggctgttataaggttgaaaatatagttatacataggaacaaaagcaaggcagaaatagggcctgaaggacttcagaaattctgtgatttggttttaatctgtaattgccctgcttctcctgcctggtctcctgtaaaatgtatctatggcagcaggtaatattctcaggcaaaatgctgcttaattctgaactatagaaagttcagaattaaggtggaaacataatattgttagtgttgatgttattgtgtacatatatgggagcatttaggaaaatacactgttggagctcttttggactagcatgcttataaaaccatgtgttctctatcaggtgagccagtaaagctttctgactcctagcattctgcagccttagatggaatgatgcacaggagaaatgcatgcaaatgtgcacaccagcattccatttagagtgtccctgttttgtaccacatgtgagggacatcaggcaacacactatatcactctgattctcagctacctaacctgtaaaatggcagaattgcaccagatgctgtgaattgtgtttttttccaaccataatattctttgcactatatactgatacttttagtggaatattacatgtcctctactggaatattatatgtcctctacatattttgattcagcagagagtagttttgtaagtgaaataataaaaacttcagctacaaattactaataacaataactaatagtgactatttaataatgagtggttactatgtgccagtagtcatgctaaggattatcatgtatcttctgagatttctttgagcagtgtttaaagaaatcagagaagacacaaacaaatggaaaaacatcccatggtcatgaatagaaagaatcagtatcattaaaatggctacagtgtccaaagcaatttacagattcaatggtgttcttatcaaactaccaatgatattcttcacaaaactagaaaaaactactttaaaattcacatggaaccaaaaaaagagcctgaaaagccaaagcagtcctaagcataaagaacaaagctggaggcaccacattacctgacttcaaactatactaccagacgacaataaccaaaccagcatagtaatggtacacaaacaggcacatggcccagaaataaggcttcacatctatgatcatctgatcttcaacaaagctgacaaaaaaaggaaatgaagaaaagactccctattcaataaatggtgctgggacaactagtcatgtgcagaatattgaatctgaaccctttccttataccctacacaaaaagcgattcaagatggattaaagagttaaatgtaaaactccaaactacaaaaaccctggaagacaaccaaggcaataccatcctggacatattaatggaaatgagcaaaaatttcatggcaaagacaccaaaagcaatcacagcaaaaggaaaaattgacaagtgagatcaaattaaacttaagagcttctgcacagcaaaagaaactatcaacagagtacacagacaacataaagaatggtagaaaacttttgcaaactatgcatctgacaaaggttttatgtccagcatctatatgaaacttaaacaaatttacaagagaaaaacaactccactaaaaagtgggcaaaggacatgaacagacacacttctcaaaagaagacatgtatgcggccaacaagcaaataaaaaaagctcgatgtcactcattagagaaatgcaaatcaaaaccacaatgagataccatcacacaccagtcagaatggctatttttaagaagtccaaaaataacatgttggcgaggttgtagaaaaaacagaattcttattcactgttgatgggagcataaattagttcaaccattgtggaaagcagtatggtgattcctcaaagagctaaaaacagaactgctttcaacccagcaatcccattactggatatatatccagaggaatagaaatcattttactataaagacacattcatgtgaatgttcattgcagtattattcacaaaagtgaagacatggaattaacttaaatgcccatcaatgacagattaggtaaagaaaatgtggtacatacacaccatggaaaactaggcagccataaaaaagaatgagatcctgtattttgtgggaacatggatggagctagaggccactatcctttgcaaactaatgcaggaatagaaaaccaaataccacatgttctcacttacaagtgggagctaaatgataagaacttaggaaaacaaaaaaggaaacagacactggggtcgacttgaagggggaggggtggcggagggagtggaacagaaaagataactattgggtactgggcttaatacctgtataataatctgtacaacaaacacctgtgccacatatttacctgtgaaataaaccttcacatttacccccaagcctaaaataaaagttaaaaaaagtttatgaattgtttgatttaaaccttaaatattgttagggttcattcacttctcttaataaattgtagagaacatggtcgtgaagatcatggctgggagggttagaattagaactcagagctcccgagtccttttgaaatttttatcattaccctgcctgatgacaaacactgcctttttctgccatagagagatgcgttcctacctgtcttataatggaaaatgcaatgaagaaaacagaaataaggaagaaatgtaattgcaatacataattacaggctgtgatttttaaatacatattcataaattgaagcagtaaggtaagatggcttttcttcttgcacaaccagaaagatgccatcaacacaatccactttatctttttctatacatcaaataaagaaatagaaggtagattaactttatcaagatcccctattgctagtctatctaaaaacactgtctaaaaggtcagttatagcgctatctccctgactttccatcgtgcttaattttatgatgaacacctaagagaagtatgatatattaaagcactttctccattctttaaaacatcaaaacacagtgtttggaccattgatttttatccaagtgtcctctccttagtatttcagaagctttattcaaaaaaagtaattggtagttgcagcctctttattctcacagctgccaaatttctctaatctggagtagatagtcaaccatccttaacaggtgattcatagcaaggcaaaaagtgctattggacacctggagagtgaagttaagtgcaatgtattgagcagctgagaacatttcttgacagattttgttttaggtaaaaatgtgaggcattttcttttagagatttctgaaaacatatattgtaagggaaagaaaatccatatggtattgatttatttaaatgtttcaaaaattagatattgggaaagcctcttgtatttatatttttcttagagagggaacattttatttcaccaagaataaaaagaaaaaaaaagcctgaaattcatgtttagttccaaatttaaagtcggaattgacatggttttaaaaacatgaccaaacaaaaataagtttgtagtttcaaagaataatgtacgctttagaatgaagcaggcaagctgtttctctggaagactccttattcccttagtcaaaacagagcagcaaacaaataaacagtagtagcaccaaatggtagttgggtataaaactctactgaatttacagcttcagtgatacaagactggatatcaattcatggtttctttttccttatatgcaacaaaacaaaagaactcttaacaggagtaatgaatcgtctgggctgtaattgctatcctgttggtaagtgttacttgcttacaatgcttcagtgttagctggaattaggttgtactctgtagcctactaatccatacttattactaaacagaggagaaagggggctattaccaccttccagaggtgtttttaaaaagcatctttaccctggatgcacatctgaagtgttaacctggttttacccagttttgaataatttttgtaactactaaaaatacaaatgcttaagtctcacaatatgaggtatagggttatcttatataaataatatttagggatttgttatacatctcagatatggcactgagaatttagaaacactgattttttctcattagacttctttatctttattaccttgacctttgctctcaaaacttttctaatcaaaacctgttaatttttttaatccccagctttatcgaggtttaattgacaaaatagatacattcaacatgtgcagtgtgatgatttggtatatgtatacattgtaaattatcacaaattaattggtatattcatcacctcacatagatgccatttttttgtgtgtgtgcatgcaagtgtaataaggaatgatcttcctagcaatatgacagtattattatagtcaccatgctgtatattagatcctcagaagtattcatctcataagtgaaagtttttatgtaccctttaaccaatatctcttcatttcccctactctaggccactggcagccattgttctactttctgcttctatgagttttacttttttagattccacatataagtgagattttacagtattcatctttctgtatctggcttacttcactaaaaataatgtcctctaggttcatccatgttgtcttaaatggactttcttctttttaatggcttaataatattctattgtgtatacacatgtatacacacatcacattttctttattcagctattgatggacttagattatttctatatcttgattattatacataatcctgcagtgaatatgggaatgctgacatctcttcaaaatactgattttacttcttttgtatatgcatatagaagtggaaatgctggatcatatggtagttctatttttaattttttgaggaaccttcacacttcatgcccttcatacttcatacccttcataagcaccaagagtgtgcaaggattccctcttctccacatacccaccaacacatatctcatctttttgataatagccatgccagcaagtgtgagttgatatctcattatgggtttgatatgtttttctctaatgattagtgatgttgagcacattttcataaagttgttgggcatttttatgtcttctctggaaaaatgtctgttcaagtattgctcatttttgaaaaattggtttattagatatgacggataaatatattatcccattacatagcttgtctcttcactctgttgattgttccattagctgtgtagaaggttttcagtttgaggtaatgccacttgtctatttttgcatttgctgcctgtgttttttatgtcatatccaaataaatatggccaagacccatgtcaattagatttttttccctatgttttcttctaggagttttatagtttcagatcttacatttaagcctttaatccattttgagcttatttttaaaatacgtggtgtaaaataaaggtcaaattttattattttgcctgtgaatattcacttgtcccaataccatttatggaagagattgtcctctgctgtttgcttattcttggtgctgtcatcaaagattagttgactgaatatagttgggtttacttcttggctctctactttgtgtcactggtctatttgtcagttattatgccagtaccatactgttatgattacaataactttatactatagtttgaaatcaggaagagtgatgccttcagctttcttcttatgtttttcaaaattgctttggctgttcagtatcttttatggttccatgtacattttaggatcttcctttctatttctgtgaaaattgccattggaaatgtgataggaattttgttggacttacagattactttagagagtgtggtcattttataatatcagttctccctgtccataagcatggagtatctttccatttacttgtatcttctttaatttttttatcaatgtttcctatttttcagtatatagatttttcacctcattggttaaatgtattcctaaatattttttcatgctattgcaaatgggatttttctcttattttttcaaatagttattagtgttagaaatgctactgatttttgtatataaattttgcatcctgcaaatttactgaatatattctaacagttttttgggagagactaggattttctgtatatgagatcatgtcatctgccaacacacacaatttaacaaatattctgatttgcatgccctttattccttttcttacccaatttctgaataggacttctagctccatgttgagtagaagtggcaagggtagttaccgttgtcttgttcctgatcttaggggaacaattcctgccttccagtaaaaaaaaaaaaaatctcacttggtcatggtgtatgatccttttaacatgctgttgaatttagcttgacagtgttttgttaaaaatgtttgtatctatgttcatcaggaatatagcctctaattttcttttctatatcattttttatatggcttagatatcagggtaatgctggccttgtagtttggaagttttccctcctcttaaattttttttggaagagctttgtaaggattggtgttaattcttttttaaatgcttggtagagtttacctgtgaagccatcagatcctgaacttttcggtgttggaaagttgtaaattaccgagtcaatctccttatttgtttttagtctgtttagattttctattttttcatgattcaatcttggtaaattgtaaatttctatgaagtgataccttttttctaagttatcctattagcatataattgttaatggtagtctcttacgattctttgtatttctatagtatcggttgtaatgtttccccttttacttattatgttatttatttcattccattagtctagctaatgtttgccaattttgttcatcttgtctaaaaaccaattcttagttttcttgctcttttctattgtacttctcatctctatttcacttatttctgctctgattgttattttcttccttgtgctgacttcagtcttagttcttctttttctagttccttgaggtgtcaatttggcttgagatctttctttttttaacgtatgcatttattattataagcttccctctttacatggcttttaatgcatcccatacattttgatatgttccttttccattttcttttctcttaagatgcttttttatttctctattgattttttctttaacccattggttgttcaggagcattaatgttttctttccacatatttttgaattctttaattttcttcttgttattcctttttttttttttttttttttttttagctttaagttccgggacacaagcgcagagtggtttgctgcacctatcaacccatcacctaggttttaagccctgcatgcattagctatttgtcctcatgctctccctccccggctccacaccccaacaggccctggtgtgtgttgttaccctccctgtgtctatgtgttctcattgttggactcccacctatgagtgagaatatatggtgtttggttttctgttcctgtgttagtttgctgaggatgatggcttccagcttcatccatgtgcctgcaaagacatgttctcattcctttttgtggctgcataatattccatggtgtatatgaaccatattttctttatccagtctatcactgatgggcatttgggttggttccatgtctttgctattgtgagtagtgctgcataaacgtatgtgtgcatgtatctttgtaatagaattatttatattcctttaggtatatacccagaatgggattgctgggtcaattggtatttctggttctagatccttgaggaattgccacactgtcttccacaatggttgaactaatttacatttccaccaacaatataaaagtgttcctgtttctccacagcctcgccagcatctgttgtttcttgactttttaataaatgccattctgactggtgcgagatggtatctcattgtggttttgattggcatttctctaatgaccagcgatgttgagtttttttttttttcatgtttttggctgcataagtgtcttcttttgagaagttcctgtttatatcctttgcccactttctgatgcaaattctggatattagccctttgtcagatggatagattacaaaaattttctccaattctgtagattgccagttcactctgataatagtttattttgctgtgcagaagctgtttagtttaattagataacgtttgtcaatttcaacttttgttgcagttgcttttggtgatttcatcataaaatctttgtccatacctatgttctgaatggcactgctaggttttcttctagggtttttatgggtttgggttttacttttaagtctttaatccatcaggagataatttttatataaggtgtaaggaaggggtccagtttcagttttctgcatatcactagccagttttcccagcaccatttattaaatagggaattctttccccattgcttgtttttgtcagattcattgaagatcagttggttgtagatgtgtggtcttatttttgaggtctctattatgttccattggtttatatgtctgttttgttaccagtaccatgctgttttggttactgtagccttgtagtatagtttgaagtctggtagtgtgatgcctccagctttgttcttttttcttatgattgtcttggctatgtgggctcttttttggttccacatgaattttaaagtagttttttctgattctgtgaagaatgtaaatggtagtttgatgggaatagcattgaatctgtaaattactttggacagtatggccattttcataatattgattcttcctctccatgagcatggaatgtttttccatttgtttgtgtcctctcttatttcctcaagcagtggtttgtagttctttttgaaggggtccttcacatctcttgttagctgtattcctacgtgttttattctctgtagaaattgtgaatgggagttcattcatgatttagctctctgcttgtctattgtggttgtaaaggaatgcttgagatttttgcacattgattttgtatcttgagactgctgaagttgcttatcagattaaggagttttggggccaagaagatggggttttctacatgtaggatcatgttgtctgcaaacagagaaaatttgacttcctctctacttatttgaatgtcttttatttctctctcttgcctgattgccatggccagaacttccaatacaatgttgaataggaatggtgagagaggacatctttgtcttgtgccagttttcaagtggaatgattccagcttttgatcattcagtataatattggctgtgggtttgtcataaataaatcttacgtttttttagctgtgttccatcaatacctagtttgagactttttaacaggaaaggatgttggattttactgaagactttttctgcatctgttgagataatcatgtggtttttgtcatggttctgattatgtaatagattacatttattgatttgcccatgtggaaccagccttgcatcccagggatggagccgacttgatcgtaatggataagctttttgatatgctgctggatttgatacaccaatattttattaagggtttttgcatcaaagttcatcagggctattggccttaagctttcttttttgttgtgtctgccaggttttggtatcacgatgatgctagcctcataaaatgagtttgagagaagtccctacttttcagttgtttggaatagtttcagcaggaatggtaccagctcctctttgtacctctagtgaaatttcgctatgaatccatccggtcttgaacttttttgtttgtttgttttgattggtaggctatttagtgctgccttactttcagaacttgttattggtctattcagggactccatttctttctggtttagtcttgggacggtgaatgtgtccaggaatttattcatttttctagattttctagtttatttgcatagaggtgttcatagtatcctctgatgctagtttgtatttccgtggggtcagtgttaatatcccctttatcattttttatagtgtctatttgattcttctctcttttttatctttaggtaatttttttgagatggagtctcactctgtcacccaggctggagtgcagtggtatgatctcagctcactgggacctccacccaccgagttcaagcaattctcttgcctcagcctcccgagtagttaggattgcaggcacctagcaccatgcccagctaggttttgtattttcagtagagacggagtttcaccatcttaaactcctgacctcatgatccatccacctctgcctcccaaagtgctggtatgacaggtgtgagccaccgcacccagtcaattcttctctcttttcttctttattagtctagttagtgatctattttatttattttcttttcaaaaagacagctcctggattcattaattttttcaagggattttcacgtctctgtctccttcatttccatgctgatcttagttatttcttgtcttctgccagcttttggatttatttgcttttgcttctgtagttcttttcattgtgatttaaggtctttctagatttctgatgtggacatttaatgtggacatttccctcttaacactgctttagctatgtcccagagattctgggacgttgtctctttgttctcactggtttcaaagaacttctagatttctgccataattttattatttactcaggagttcattcaggagcaggttgttcaatttccatgtggttgggtagttttgagtttcttaatcttgggttctaatttgattgcagtgtggtctgaaagacttctaatttcagtaattttgcatttgctgaggagtgttttagttccaattatgtggtcaattgtagagtaaatgccatgtagcactcagaagaaagtatattctgttgttttggtgtaaagcgttctatagatatctgttaggtccacatgatccagaggtgagtctacatcctgaataacgttgttaattttctgtcttgttgatgtgtccaatgttgacagtagggcgttaaagtctcccgctactattctgtgggagtcttctgctttccgcttgcttagtaaattttcctccatcacgttattttgagcctgtgtttgtctttgcacatgagataggtctcttgaatagagcacaccttgaaacctgactcttcaatcaacttgccagtctgtgtcttttaattgaggcatttagaccatttatatttaaggttagtatttttaatgggtgaatatgatctctcatcatgatgctggctggttattttgcacaatagttgatgctgtttcttctttttttaaattatactttaagttttaggatacatgtgcacaacgtgcgggtttgttacatatgtatacatgtgccatgttggtgtgctgtacccattaactcgtcatttaacattaggtatatctcctaatgctatccctcccccctctgcctaccccacaacaggccccggtgtgtgatgttccccttcctgtgtccatgtgttctcattcttcagttcacacctatgagtgagaacacgtggtgtttggtattttgtccttgtgatagtttgctgagaatgatggtttccagcctcatccatattcctacaaaggacatgaactcatcctcttttatggctgcatagtattccatggtgtatatgtgccacattttcttaatctggtctatcattgatggacatttgtgttggttccaagtctttgctattgtgaatagtgctgcaataaacatacgtatgcatgtgtcattatagcagcatgatttataatcctttgggtatatacccagtaatgggatgactgggtcaaatggtatttctagttctagatccatgaggaatcgccacactgacttccacaatggttgaactagtttatagtcccaccaacagtgtaaaagtgttcctatctctccacatcctctccagcacctgttgtttcctgactttgtaatgatcgccattctaactggtgtgagatggtatctcattgtggttttgatttgcatttctctgatggccagtgatgatgagcattttttcatgtgtcttttggctgcataaatgtcttcttttgagaagtgtctgttcatgtccttcgctcactttttgatagggttgtttgatttttttcttgtaaatttgtttgagttcattgtagattctggatattagccctttgtcagatgagtagattgcaaaaattttctccatttctgtaggttgcctgttcaccatgaaggtagtttcttttgctgtgcagaagctttttagtttaattagatcccatttgtcaattttggcatttgttgccattgcttttggtgttttcgacatgaagaccttgcctgaatggtattgcctaggattttgtctagggtttttatggttttaggtctaatatttaagtctttaatccatcttgaattaattttagtataaggtgtaaggaagggatccagtttcagctttctacatatggctagccagttttcccagcaccatttattaaatagggaatcctttctccatttcttgtttttgtcagatttgtcagagatcagatagttgtagatacgtggcattatttctgagggctctgttctgtttcattggtctatatctctgttttggtaccagtaccatgctgttttggttaatgtggccttgtagtatagtttaaagtcaggtagcgtgatgcctccagctttgttcttttggcttaggattgacttggcaatgtcggctcttttttagttccatatgaactttaaagtagttttttccaattctgtgaagaaagtcattggtagcttgatggggatggcattgaatctataaattaccttgggcagaatggccattttcatgatattgattattcctacccatgagcaggaaatattcttccatttgtttgtatcctcttttatttcgttgagtagtggtttatagttctccttgaataggtccttcacatcccttgtaagttggattcctaggtattttattctccttgaagcaattgcgaatgagagagttcactcatgattcagctctctgtttatctgttattggtgtataagaacgcctgtgatttttgcaaattgattttgtatcctgatactttgctgaggttgcctatcagcttaaggagattttgggctgagacaatggggttttctagatatacaatcatgtcatctgcaaacagggaaaatttgacttcctcttttcctaattgaataccctttatttccttctcctgcctgattgccctggccagaacttccaacactatgttgaataggagtgatgagagagggtatccttgtcttgtgccagttttcaaagggaatgcttccagtttttgcccattcagtatgatattggctgtgggtttgtcatagataggtctgattattttgagatgcgtcccatcaatacctaatttattgagagattttagtatgaagggttgttgaattttgtcaaaggccttttctgcatctgttgagataatcatgtggtttttgtctttggttccgtttatatgctggattatgtttactgatttgcatatgttgaaccaaccttgcatcccagggatgaagcccacttgatcatggtggataagctttttgatgtgctgctggatttggtttgccagtattttattgaggatttttgcatcaatgttcatcagagctgttggtctaaaattctttttttcttgtgtctctgccaggctttggtatcaggatggtgctggcctcataaaatgagttaaggaggattccctgtttttctattgattggaatagtttcagaaggaatggtaccagctcctccttgtacctctggtacaatttggctgtgaatccatctggtcttgggctttttttggttggtaagctattaatttttgtctaaatttcagagcctgttactggtctattcagagattcgacttcttcctggtttagtcttgggaaggtgtatgtgtcggtgtcgaggaatttatccattacttctagattttctagcttatttgcatagaggtgtttatagtattctctgatggtagtttgtatttctgtgggattgaaggtgatatcccctttatcattttttattgcatctatttgattcttctctcttttcttctttattaatcttgctagtggtgtatcagttttgttgatcttttcaaaaaaccagctcctggattcaatgattttttgaagggttttttgtgtctctatctccttcagttctgctctgatcttagttatttcttgccttctgctagcttttgaatgtgtttgctcttgcttctctagttcttttaattgtgatgttagggtgtcaattttagatctttcctgctttctcttgtgggcatttagtgctataaatttccctctacacactgctttgaatgtgtcccagagattctggtatgctgtgtcttttttctcattggtttcaaagaacatctttatttctgccttcatttcattaggtacccagtagtcattcaggagcaggttgttcagtttccatgtagctgagtggttttgagtgagtttcttaatcctgagttctactttgattgcactgtgttctgagagacagtttgttataatttctgttctcttacatttgctgaggagtgctttacttccaactgtatggtcagttctgctgagaagaatgtatattctgttgatttggggtggagagttttgtagatgtctattaggtccacttggtgcagagctgagttcaattcctggatatccttgttaactttctatctcgttgatctgtctaatgttgacagtggggtgttaaagtctcccattattattgtgtgggagtctaagtctctttgtaggtctctaaggacttgctttatgaatgtgggtgctcctgtattgggtgcacatatatttaggatagttagctcttcttgttgaattggtccctttaccattatgtaatggccttctttgtctcttttgatctttgttggtttaaagtctgttttatcagaggctaggattgcatcccttgcctttttttgttttatttatttgctttatttatttgttttatttgttgatttgctttatagattttcctccatccctttattttgagcctgtgcgtgtctctgcatgtgagatgggtttcctgaatacagcacactgatgggtcttaactctttatccaattggccagtctgtgtcttttacttggagcatttagcccatttacatttaaggttaatattgttatgtgtgaatttgatcctgtcattatgatgttagctggttattttgctcgttagttgatgcagtttctttttagccttgatggtctttacagtttggcatgtttttgcagcggctggtaccagttgttcctttccatgtttagtgcttccttcaggagctcttgtagggcaggcctggtggtgacaaaatctctcagcatttgcttgtctgtaaagtattttatttctccttcacttatgaagcttagtttggctggatatgaaattctgggttgaaaattctttcctttaagaatgttgaatattggcccccactctcttctggctggtagagtttctgcggagagatcagttgttagtcttctaggggttccctttgtcggtaacccgacctttctgtctggctgcccttaacattttttccttcatttcaactttggtgcatctgacaattatgtttcttggagttgctcttctcgaggagtatctttgtggcattctctgtatttccttaatttgaatgttggcctgcctttctggattggggaagttctcctggataatatcctgcagagttttttccaacttggttccattctccccatcactttcaggtacaccagtcatacgtagatttggtttttttcacctagccccatatttcttggaggctttgttcatttctttttattctttttctctgaacttctgttctcacttaatttcattcatgtgatcttccatccctgataccctttcttccagttgatctaattggctcctgaagcttgtgcatttgtcacgtatttcttatgccgtggttttgagctccatcaggtcctttaaggacttctctgcattggttattctagttagccattcatctaatcttttttcaagatttttaacgtctttgccatgggttcgaacttcctcctttagctcagagtagtttgatcatctgaagccttcttctctcaactcgtcaaagtcattctctatccagctttgttctgttgttggtggggaactgcgttcctttggaggaggagaggcactctgatttttagagtttccagtttttctgctctgttttgtccccatctttgtggttttatctagctttggtctttgatgatggtgacgtacagatggggttttgttgtaggtgtcgtttctatttgttagttttccttttaacagtcagaaccctcagatgcaggtctgctggagtttgctggaggtccactgcaaaccctgtttgcctgggtatcagcagcggaggctgtagaacagcggatattggtgaacagcaaatgttgctgcgtgatcattcctctggaagttttgtctcagaggagtacccagctgtgtgaggtgtcagtctgcccctactggggtgtgcctcccagttagtctacttgggggtcagggacccacttgaggaggcagtctgtcctttctcagatctcaagctgcatgctgggagaaccactactctcttcaaagctgtcagacagggacatttaagtctacagaggtttctgctgccttttgtttggctatgccctgcccccagaggtggagtctacagaggcaggcaggcctccttgagctgcggtgggctccacccagtttgagcttcctggccgctttgtttacctactcaagcctcattaatggcgggtgcccttcccccagcctctctgccgccttgcagtttgatctcagactcctatgctagcaatgagtgaggatctatgggtgtaggatcctccgagccatgcgcaggatataatctcctggtgtgccgtttgctaagaccattggagacgcgcagtattaaggtgggagtgaccagatttcccaggtgccatctgtcacccctttctttgactaggaaagggaattccctgaccccttgcgcttcctgggtaaggcgatgcctcactctgcttcggctcactctctgtgtactgcacccactgtcctgcacccactatccaatactccccactgagatgatcccggtacttcagttggaaatgcagaaatcacccatcttctgcgttgctcatgctggaagctgtagactggagctgttcctattcggccatcttggctccaccccccgatgctgtttcttcatagtgtcattggtctttatagtgtcatgtgttttgcagtagctggtaccagtttttcctttctatacttagtgcttccttcaggagctcttgcaaggcatgcctggtggtgacaaattcccttagcatttgcatgtctgaaattgatttaatttctccttcaattacgaagattggtttggccagatatgaattgtgggttgaaaatgcttttctttaagattgttaaatactggcccccattcttttctggactgtagggttttgcagatagatccactgttagtctgatgggcttccctttgtaggagacctggcctttctttctgggttcccttaacattttttccttcatgtcaaccttgtagaatttgatgattatgtgtcttggtgttgatcttatcatggagtatcttttctggattctctgtatttcctgaattttcatgttggcctgtcttgctaggttggggacgttctcctggatattaccctgaagtgtgttttccaccttggttccattctccatgtctttttcaggtactccagtcagttttagtttagcctttttacatagtcccacgtttctcagagtttttgtacattccttttcattcttttttctgtcatgttgactgcctgccttatttcaacaagatagtcttccacctctgatactctttttttgcttgattgatttagctattgatacttgtgtatgcttcacaaagttctcatgctgcatttttcagctccatcaggtcatttatgttcctctctaaacgggttgttctagttagcagctcctctaaccttttatcaaggttcttagcttccttgcattgcattagagcatggtccgttacctctgtgaagttcgatattacccaccttctgaagcctacttctgtcaattcatccatctcatcctccgtcctgttctgtgcccttgctggagagatattgcagtcgttcgaaggagaagaggcactctggcctttccggctttcagtgtttttttgttgttgttgattccttctcatcttcatgagtttgtctagtttgtatctttgaggctgctgatcctttgatgaggtttttgtgggagctttatttttgtttgtttgctgctgctgttgttgctttctgtttgtttgacattctttcaatagtcagttccctcttctgtagggctgctgtggtttgctggggttcacttcaggcactattcatctggttcactcctgctcctggagatatcacttgaggaggctggataacaggaaagatgggttcctgctccttcctcttggatctctgaccttgaggggtaccaacctgtttcagtaggaacactcctgtatagggtgtgtgacaacccctgtttggggtgcctcacccagttgggtggcatgggaagcaagacccatttaatgaggcactttggctgttccttggtggaagacgtgggaaacccacttgtctgggctgctgggtttcctcagagctagcaggaggaaagactaaatctgctggtctgtggagactgtgcacacccctcctcctaggggctcaggcccagggagatcagaattcattccctgagcccctggctagagatggagttcctgcagagaggccctgcatccacagtgttggctacggcctcccttcaaggagctcagatggcttagagagcaggcagctgcagcagtggtgatggctgcccctccccacaagtaatttgcaggcttaggctgattctagctgagtggctgttgagaatctttgcagctccatggttacaacccaaggctttggtggcataggatcatgagtgggatcttccaatccatgggttgcacagtcccttggtaaaagcacagtttcccaggctgagtagcacactcactcacctcctcacttgggtgccctttgtggctctcaggtgggctgccacaccacagtgcccttccttcctttctgtaagtcatgccagctgcctagtctgtcctaatgacagaacctggatactttggcttccagtgcaggatttgcatgctgttttagatcttttcaatgggagcctctgattaccactgcttctagttgtccatcttggccccaccccactccttgttattgatttctagtttcataccattgtgctcagaaaagatacttgatatgattttaattttcttaaatttgtaaaaactttcctggaccaacgtatgacttctcctggagaaaggtagtgtgtgcttgagaagaatatgtcctctgctgctattgaatgaagtgttctctatatgcctgttaggttcatagcggtatttaagtctgcttttttttgcatttattttctatctgcatgatctacccatggttgaaagtagactattaaggtcctgtactatattttattgccatgtctcccttcagctcagttaatatttgccttatatatttatgttctctgatattgtgtgcatatatacatatatatatacacacacacataattattataatctcttaacatatttttagtatagattggccttatttttctttttttaacagatttttcctgaaaatctattttggctgatataagtatcaccactctctctcttttggttaccatttacatggcagatatttctcatcccttcactttcagtatatgtatgcccttaaaggtgaatctgagttgctcatagcagcaccattttggatcttgttttttaatctattcagctactctgtgtcttttgattagagaatttaatttatttgcacttaaagtaattattgacaggtagagactttttatcattttgttaatttttttctcattgttttgtatttcctttgattctttatcttttgttgtattcctttgaaatttgttgtttttattctagtattatgctttgaatcctttttctctacagttttttctatccactgaaggttttgtgtgtgtgtgtgtgtagttaccaagaggcttaagtgaaacatgttatagttataatgttctattttaaactgataacaagttatccatttaaactctataattttacttctcccccttacaaattatatactattaatgtcactccttacatctctttatattgtgtgtccattaaaaattcatgttattatagttactttcaaatttctgcttttagtttttgtaccacagttaaaaagtaacatccagtagtttttcctacctgtgggagacatatttcaatatctccagtggatgtctaaagcagtagagagtgccaaactctatatatacagagaaagattgtttggaaggctaagtcttccctcttaataagtaaaggtttttgctttataaaaattttttgagtcattttgcctaaataaatgacttatggtaacctggaattgtatttgataatatcaattgttttaaaccattaacatatttgataggcttcccgaaatcaaacttcagcttcaaaaatgtcttttctgacccctaactttggaatgctacagagagcccctggagcatccaaaagagaggtaaacaggattatttgacatgtttagtatgcggctcatctgtagcagctgctgtgaagacactgactgcagcagtgtaggtgtggctggggttgcatgctcaaaagggccagcaagaaccaggaatggggaaagccccacccactatggagttggaggggcaggagccccatgccctctccaggtgcagctgcagcgacctagccatgactctggatctggttatccctctgctctcaggggcgcaggaagcccctgcccctgaaggcttggaagtgcctgctttcactgtctcacctctccccactcttggcacctactctggtgtggagcaaagttgtggtcgagcctgggcactcttgtgacccaactgggtgtgtgagtgcttgagatggcactgacatgccaactccctgccacctcagcttcctctggactttgggtgcccgggagcaaaggagggaggcctgcaggttcccctcagcacaaatgacctgggcatcattgatagcatgttgatggtgtgaggcagacaggttcctgcatggaaagaggcaggtctccagtaaaaccccaccttcaagccagggatggcctgaagcctggaggccaggctgccaatttcaagtagagttgctgaccaggagtgagaacttatggtcttctcccaggcctgcccatggctgcccattgaccaatcagcacacacctcctctcttttgagcccataaatacccttgactcagccagactcacacagacatcaggactaccagctacaggaaggagctatccattttatatctcctcaactcatcaagatgacctgtgtgtagaaacgtgctacccactattggtctcccctttcccgagaggtggacactaagacagatgaccttcctgaggaaaggagctactcactttgggtctcctgagaactgttctgctgctcagtgaagctcctgtccaccttgctcatccttcagttgtccacatacctcattcttcctggacatgggacaagaacttgggacttgccaaatgttaggactaaaagagctataacacaaacagtgctgaaacgtgctcccctgctcacaacgttgtgggtgacaagaaggagaaaacagctgcggcccttcaaggaattcagacctatgtgatccctgagtcaggactgtgacaccctctttggggctctgtggatcctggtatctccaagcttttgggcaccaccacattccctagtgcccacagcagaagccacttgcagtacacctggtccagccacagcctcacatgaagccagcaccagtgttggtgcctggagctgcctgccctgccacagctgtgtgcctggctgtgtgcagtggctgaaccccatgctcaattgctcacacagcagtcactgctctgtgcctagttcacccttggcaaatgtgggattcaggccagtagcaagaggtgagtgcagcctgccaagcctagtcagtagaaggagcccagtagaagtgagcaaaacccaagcaaagatgccaccggagacagaggtttctggctggccaagtgaagccctaaggacactgtgacaataccttttacaattaagcatacatacctatgataaagtttaatttataaataaggcacaataaaagattaacaaaaataataaaagagaacatttataacagtttaagaaactctatagatatggcttccctctatctctcttaaaatatattattgtactataccatgggtaattgaaactatggatagcagaactgcagataagaagggattactgtacacaccacaattactttattacagaattctgaaatttgctatgtatttaaccttaccagtgagttttatactttcatatgttttcatagtattatataatgccctttatttaaatttgaaaacgctttttagcatggtttttaggacatcctatatttataatagtccttcaacttttacttttctgagaatgtttgcatctctcttttatttctgaaggacagctttgccatgtataatattattagttgacatttttttcttaacaacactttgaacatagcatccaactcacttatgaccttcacagttgctgtagagaaatccactgatagccttaggagtttttgcttgtatgcgattagtctcttttgctactttccagatcctctcttatattttaatttgaatgccatttttcccccaagattaggaaaattttcagtcatcagttatttaaatacatttttctgctcctttctctttactttttagactctcttaatttatatattcattttcttgatcatggcccataagtccttttgcattcttcagcattttacgttccttttgtttggctcttctaatagcctaatttcgactaacctttcttcaagttccttgattcttttttctgcatttttgagtctactgttgaaacactctattagattttccgttctgtcattgtattcttcatctccaatatttgtgtttggttctatttttatggtttctatttctttattaaactttttatattgtttatacacttaaatccctcagatactgttgtttatttgggttctcttgcatcacgctgagcttctttaagataattgtgaattatttgtcatacaattcatagatctccatttctctggggttggttattggaacgttattagtctcttttgatgttatatttgcctacttgttcattatcagtgcagctctgctttggtatttgtgcatttgaagaagcaaacacttcctcctgtttttacagactgatttaggcaagtaaagacctcttcctttgggtctctggcctaatgagattgcccccaagaatcacagttgagtaggattggtgctaggtcacatgggtgctgcagaatctacagtgggggctgtggatgatgaacctattaccagagtctcaaacggacatgaatcttgtctgttttctgggaaaactggactgactgtaagtctttggtcaataggctggcactaggaaatgggtacttttcaggatccgcagttgtgtctgcaataggtgcataggaagatgtccttccttctgggtccctgagtgagctcctactgggtcactgaatgagttcctggacaggaaggactggccctgaaacatagctgagaggggctaaaactagtcataggggtgtttcaggcttcacagtttagactgaggtctgcaagcctctctctaggggcacaggcatatatgcttttataggtcctgggggacagaattgcccctagactgtggctgaatagagtcaggccacaggatgcttcaggatctgcagtgagattcaggctggtgggccttcctctaagagaagcatggaatggtgtgtctcctggcaggtccatgtgagagcagcactaatctatggctagagctaaaaggggctggaacttagttaccaagctgtttcagaatctgctgtgggaccaaagctcagcagccttgtctcagggacatgaatctgtgtgttttcctgtgggttcctgagcatataggactgctatcagtctgtagctgagaggggctggagcctttgcaggctcatatctgggactgaggttggtggacctgtcactgaaggcatgggtgggcatgactcttccctcatcccttggctgatggttctggtggcagaaccaaggacaattggaactggagctaatctacagggagttgaggctgtttccaggtttgtaatcatgaccacaggtggtgaacctgccaactgggtgtggacttgttctttcaaaacagtcctccttagtcttgggccatactaaggtttcacaacctctgacctaaatttcaaagctcccacaaaggcactttttttcccatggatggctgccaaactattgtttctgtgagaggatatgaacagagaatctcctattctatcttcttgctctaaaacctggttactttattttacatttattttactttgcttgaatcagcatagaggtaagagatcagtgggatgagtaaaatgacatggataaaagtcacttggcagactagaaggtaatttttaattaatagtgctcccattcgttgtcttaaaaacaaattggatctttattaattaccttgaacatttgattttctattttttccaaatatttgatgtaaaagcaaccgttctctttttcacctctaccagaaaaacttttagaatggtcctttgtctattttttaatatatgatcttaagagataaatactgtggaaagaatattaagtgtccttatatcaactaataattttagattaattgtcaaggcacaaaaagaacattttcataaagtactttattcataaatattactgtgcattcacttttatgttgtttctaacacatgtaacatagaactcaaccacttaaagtaaggagtcaaaaaagggatatgattgacctttactgagcatcaagcatgtgttagatgctttctatgtcctaatttaatttttataaacaccttaggaattaatattcccatgctacaatcggagaaaacttatacagatgaagaaactggctgggcacagtggttcacgtctataatcccagcactttgggaggccaaggtgggcagatcacctgaggtcaggagttcaagaccagccaggccaacatggtgaaaccctgcctctactaaaaatacaaaagttagctgggcatggtggtgggcacctgaaattccagctacttgggaggctggggcaggagaatctcttgcacctgggagaggttgaagtaagccgagactttgtgagacagtctgtctcaaaaaaacaaacaaacaaacaaaaaaacaaatttacccatgattaaaaacgtttaaatctcagttacaaccctagatatgattgttctaaatatgtcctttctgctacttcctttgctacaaaaaaaatccaagaaatcagaaagaagtaacgcattaagtgtatatatacatacccatacacgcacataattttttcaatgaataacctatactcttcagtatatacccagtaaaatctggaaaaaaattaaaccttatccaaggtaataatcttctctctgttattattccttgtatgttgtttaaaaatctatcaattttccactcgaaatttacttctctcttaaattctttaagaattagaaacctctgattttcatatgccaaataccaggcacaaaaatgttttcttttctttcattgtggtaaatccaagtgtaatacagtaagaatggaaaatatgagtaagtgcatgtacatatataataaaattaagaaatatgtcataatattttactctttggctttaatttccattttattctggcacaaggtttgtagtggagtgggcagggagaaagaacaactagtaacatgttttaaggcaagtgtaaaagataactttaccactcacaagagttttatatccaaatttagctccaaaattaatctgagattcccagactaaaatatctgtggataattttaaagattgagtagtttgttttcttattaattttttgaaatgtgtttttatatcctggtacagagttatatattctggatataagccatttatcaggtacataatttacaaatatctcaccctgtttgtgttttgtctttttattctttgtgtatttgcaagagccaaacttactgcattttctgaggtacagtttgtcatttttatggatcattctttaggtattgttatatttaagaaatctttgactgactcaagatcacaaagattttcttctgttttcttctagaattgtttaaaattgagattttgcattttagacttactcattttgaggtaatttttccatattttatgaataatagatcaaagttattattttatatattgatatacagctttggcaaaaataaattggccatatacatataggtttatttctagagtctattatgttccattgatccatttgtctgtattaatgctgaccacattatctcgacccctagagctttaaaataaatcttgaaatcaggttgcttagctctgtactttaattctgttttaaaagttttattggctattttagatccattgcattttcatataaacttaataataaactagtttatttctaccaaaactgtcagtatatgagttgaaattatattaaagctatataggtcagtgtgggaagaattgacatctacgtaacagtaaatcttccaacccatgaatgcttaatattctatttttatttagatctcttagaatttctctaacaagtattctgtaattttcagatctggtagatttatttctaaatattacatatttgtgtattctcatcatttgcattccttaaaatatcagttttatttgttcgttactattgtacaggaatacaattgactttataaaatttgccgattagttccggggctttttaaatagattctacaggattgtctacatagacaatcttattttttgtgaataaatataattttaattattcctttacaaactaaatgttttaaaatttctctttcttgccttattgcactggttatgatgttcggtatgatgttgcatagtattgatgagagtgggcatttttgtattattcttgatattaaagagaaaacaattgagttttctatgttcagtacaacattaaatcagtatttttcatacttgttttttaaaagttaaattgatgcagttcttttttagttattattttctgagtgcttttaaaatttattgagaaatggatgttgaatgtcattttattttgctccatctactgagaatgtaatacaaatttttaaattttaatatgacaatttgtaagttatatattcttggtttctatttgctaaaattttatttagaatatttgcatctttgttcatgaagaatattagtgtgtaattttcttaacttgtaatggcttttttctgcttttggtattaggataagttttgtttcatagaatgagtttggatcattaaaaagtcaggaaacaacaggtgctggagaggatgtggagaaataggaacacttttacactgttggtgggactgtaaactagttcaaccattgtggaagtcaggtggcgattcctcagggatctagaactaggaataccatttgacccagccatcccattactgggtatatacccaaaggattataaatcatgctgctataaagacacatgcacacgtatgtttattgcgacactattcacaatagcaaagacttcgaaccaacccaaatgtccaacaatgatagactggattaagaaaatgtggcacatatacaccatggaatactatgcagccataaaaaaggatgagttcatgtcctttgtagggacatggatgaagctggaaacggtcattctcagcatactatcgcaaggacaaaaaaccaaacaccacatgttctcactcataggtgggaactgaacaatgagaacacatggacacaggaaggggaacatcacacaccggggtctattgtggggtggggtgaagggggagggatagcattaggagatatacctaatgttgaatgacaagttaatgggtgcagcataccaacatggcacatgtatacatatgtaactaacctgcacattgtgcacatgtaccctaaaacttaaagtataattaaaaaaaaaaaaaaaaaaccattgttctcaacttcgctgagtagagtgtcacatgaataagaactaggcaaatttagttgataataatgtttgagatttctttctacttacaaatattttgtttatttattctcttggttactaagagagggatgctgtcttagtctgtttgggctgctataccaaaaaacccttacctgagtagtttatatatagcagaaatttattttttacaattctggtggctagaaagtccaagatcatggaatatttcatctctggtaagggagcattttctaattcacagatgacattttttgctgtgtcctcacacagtggacgggataaagggtttctctcaggtctcttttatcaaagcaaggacagtaatttgtgagggctctatccctgtgacctaatcagctcccgaattccccacctcctatcattttgttgggcaagatttccatatatgaatttagaggacactacacattcagatcatggcagatgaagaaatttccaaatataagtaagactttatctattttttcttgttgctctataacattcgtttcatgtatctttaaactgctaccatgtgcataaacattatgatggttatgctcttccgaggaattgtctttcatgattgtcctagtttgtttgtgctgctataacttaatacctaaaagtaagtaatttataatgatcagaaatttatttgatctcagaattatagatattagaaagcccaatattaagatgctgacaactggcgaaggccttattgctctgtcatcccatgctaaaagacagaaggaccaagaaacaaaagggagctgaattcacctttttataatgacagtaatcctgcctatgagggtagaccccgcacggccaagtcatctcctgaaggtcccacctcccaacactgttacaatggcaactaaatttcaacatgagttttagaagagacaaacattcaaaccatagcaatgactaaatgaccttcatatgtacaataagtatttttgctttaaaatcttctttgatattaatggagcttctccaaatttttaaaaagaaatcactgttaacatagtttattgttcccattctttttctcttaactgtttatacctttatttttaaagtgagtttgtaatagaaagtatatagttgagtcttgttttatttatccagtccaacaatctacacttgttatttatttgttgatatgattgggttatatctagtacttcttttttattttatgctttttctatttcttcttttttctctttttctgccctattttgatgagtcgggtattttctttttttcccctcgttgcattttattttcctttcggcttaacatttatatttcttttttttgttaatttagttgttggtttggatttatagtatacacatttaacttatcaatctatcttgaaatgatattatgccactttttatatgttaaagtaactttataataatatgctgcacttattccctgtgaggctctgttctgctttttaaaattttacttttatggctgggcgtggtggctcatacctgtattcccagcactttgggaggacgaggcaggcagatcatgaggtcaggagttcgagaccagctgaccaacatggtgaaaccctgtctctactaaaaatacaaaaatgagccaggcgtggtggtgtgcacctgtaatcccagctactcaggaggctgaggcaggagaatcacttgaatccaggaggcggaggttgcagtgagctgagattgtgccaccgcactcccgcctggtgacagagtgtgactctatcccccctccaaaaaaaaataatttatatttgttatgaatctcataatacatttttattaatattcttattttgttttcaatgtcaattgtcttaacaaagatatttaacaataaaagaaatactctgtatttaaccacatagttaccattttcagagctcttcagtatttcgtttagaaatggattttcttctgacagcattaacttctacctgaaataataacgttagtatttcctgtattagttcacctagtgaaaaattctttcagctttgtgtgctcccaaatgtctttatgtcagcttcatatttgaaatactttttttgagatatagaactctagttcagagagtttttatttgagtactttaaaaacttcctccactatcttctagcttacattgtctccaatgagaaatatgttatctttgtttctatatatgtaatgtgtcttcttaatctggctgtttttaggattattttgtttttaacgctcattattactgataatgtgcttttttcattttttaaattcattttatgttggtcttcattgaactttttgtatctgtggattactgtttttatcaaattttgaaaatattcagccattatttcttcaacttttttctgttttctactctctctcttctccttttagattgcacttacatatgtcttagaccacttgaatttgccccacagttactccattttttctctctctttcgatttcattttgaatggtttctattgttaagtcttgaagtccattactttttttttagcaatatctaatccgcttctaattccatttagtataattttcatttcaggcattgtatttttttcatcttggcaaattgaatatttttaacttccataatttatttgtttcctgttgttcctcatctttttctctagtttctttaacatgttaaattgttgtaaaaatgcttttagtattctgtttattaatgttatcatctgtattgattctatattgggttaaattgatttcttttcatcttcattctgcaccttatcctcctcctgtgcatgtctcataatttttgactggttgtcagatattgtgattttagtttatttaggtccttatttttctgttgctgcatatattcctgagcttccttgtggaatgtggttcacttccttggaaatagtgtgatctttttatgtttctttggcttgaacagaacattgtttctctaaggcttttttttagtcccccaccactgaaagaaaaacatataagtactctataaaatgatgagtatattttaaaacttcatactttggcttgtgcattccagacggtattccctctaatgcatttgggtggtttcttttcaccctctgtctttcagtggttttctcaggtacgtattctggacagtattccagtttaggacacaagagtatcctctacatatatttggagctctctcattgtacaactttctcctctctgacagtctgtcctatgaactcttactttggtctttccaagcttccaactctaacaattcaactcagggaggctgtgtgggggcaactggcttctttcctggcaggtctgtcccacagaccctggccaagcaacagatgaaaggagtactcatacgcagacatgcagtgaaaaagtgggcttggggactgatggcactaggggccaaagagtgttagcagtctgataagccagagccacttgtatttattcagtagagatttaatgacaaaggcctggagccaacacaacctgtggataattaacattgtcgcctcccacccccgccccctccaccccttgcaaggagcagtcttgcgcgccgatgatcaagatgatcaaaggtcagtttctggacaacataagtaaataaacttatctagataaacttctgcacgttcttttgcacctacttctcaccctctgcctcagggtaagagaattacctgccttcagtttttattctctcctgaagctttgaaaaacctcccggccttccaagaaggtttgtgtctttccctataacttttcttataacttttcccatcatcctgacccatctcctacactttcccagtgccatagcctggaaactctcaccaggcagtaagccgaggtaatctttggggtccctggtttgtatctcatctcataggaatgactagatcattgtgttgtgtttcctaatgctcagtggcttgaaaagtattgactcatattttgttcagtttttagttgtttcatgtaaaatagtattttgggtctttgttactttatcttggtcagatgcagacgtttcctaagctatttaaatttcttttctaaaaataagcgttagttgaatactaaaaagtccatttggaaaatatttcaatgacattcagttgagattataaaaaaattagtaaattaagaagatagatttgttaataataaattttattgtttcattatttttgtaacaagtatattgagaaatacaattcacataccatgcaatgtatccatttaaagtatagaaatcattggtttgaatacatttacaaagttatgcgacaatcaccgtgaccaattttagaaatttttcatcaaccaaaaaacaaaccctatgcctttttagccgtcactgtgctatttttttcccaatctctttagccctaagtaatgattagcctactttgtgtctctatagatatgcctattctggacctttagtataaataaaatcctaaaatatgtggtttttgtgattggcttattgcactttgccaatcttgtattcaaggttcttctgtgttgcagtatgtatcagcactttattcctcaataatattcaactctttagttatgcccccgttttatttacctttccattatttaatggacatttgggttgtttctacattttggttattatgaataatgctcctatgaacatctgtgtacatgttactgtatgaaaatatgttttcagttttcttgagtatatagctagaattgaaagtgctggataaaatggtaactaaatgtttaaccttttgaggaagtgcacagtgttttttcaatttttcattcacataagctgtttatgaggattgcaattgatccacatctttgtcaacacttgcaatcattactctttttgattaaagcaaccctagtgggtgtaaagtggtatctcattgtggttttaatttgcatttcacttatggaaaatgttgcttttatagtgtcagtaatcccttctcataatatctgtttttacgtgtctgtcagcatttaaatgcatcaaatagcagtaaatcaattactgtttgctgactgctcttattacttctgggaaacctaataaataaattgccatcaataacagctaacttttaaagcccttgatgagatctagtctttttacatactgcattcaatccgcacatactgtcatagatgaagaaaattatggtgaatgagtttcagtaacttataataggagttgtcaaactactacccagagttgaaatccatctcatggtctatgttcacaatgcctgcatgctaagaatattttttacatattacagtgttactaaaaaaaacaatgtgttaaagagacctgtgtagcctggaaagcttaaaatatttaagctttatttaaagggctacatatggccctttatagaaaatctttgctgacctccaacttacgttgcacatgtggttaaaaaccagcttcatccaattcgggaatgtgagttttgcaactgacaatattgtagtagacatatatgtccttcagtttatctgacctagtaaaacagcaggagaaaacaaagtaaaacaagcacatatatatattttaaaaaagacaaaacatgttgagtattctgtgcataatataaaacctgtggtttgccatgggagattggaagaaatttgagcaattatcccttcaacatacatgagtaaagagaaaattgactatagctggacaaaacctaaataaaatgagtgccatggaaagttggggatttgtgcatgcccttactctttcatagtatctaagggggcttaattgttgtggattggatacactaactcagaaggataacaaagtctcttgattgcacatgatgttggaagacaggctaatttagtttaagaatttatattagaaagtaaaatcaccaatctggaggaataaattatatgagtggaatatgagagttggatgaactatacaatggtaacacacactctgacattgtagaccaaatgctaattctcaatattgacacagtaacattcacaaatctaggtactcaattagctttggtttggcctatttcatgtcacttgtataccatccagagatccaaatgaattatcatggagtcctaaacttctgacattggccatgttttatactctccaccttacctgcccttcctgcctatctccaacatccatcgttaaagaaaccaaaaaccacctacacagttcccttatcaatcactcaataataagcatgggcttgtacatatggtatttttacaatttctctctcctgttattaaatgtcagcatttttctaaataactgccaattaaaactcacattcaaaactataaattttgcattctcagagcgacattatttactttatattgtaaaacaatcttattataaataatttgcatgtgaaactacaatcaccactttttttattattatactttaagttttagggtacatgtacacaatgtgcaggtttgttacatatgtatacatgtgccatgttggtgtgctgcacccattaactcatcatttaccattagttatatcttctaatgttatccctcccccctccccccaccccacaacaggcccacagtgatgttccccttcccgtgtctatgtgttctcattgttcaattcccacctgtgaatgagaacacgtggtgcttgattttttctccttgtgatagtttgctgagaatgatggtttccagcttcatccatgtccctacaaaggacatgaactcatccttttttatggctgcatagtattccatggtgtatatgtgccacattttcttaatccggtctatcattgatggacatttgtgttggttccaagtctttgctattgtaaatagtgctgcaataaacatacgtatgcatgtgtccttatagtagcatgatttataatcctttgggtatatagccagtaatgggatggctgggttaaatggtatttctagttctagatccctgaggaatcgccacactgacgtccacaatggttgaactggtttacagtcccaccaacagtgtaaaagtgttcctatctctccacatcctctccagcacctgttgtttcctgactttgtaatgatcgccattctaactggtgtgagatggtatctcattgtgattttgatttgcatttctctgatggccagtgatgatgagcagtttttcatgtgtcttttgggtgcataaatgtcttcttttgagaagtatctgttcatatcctttgcccacttgttgatgggttgtttgatttttttcctgtaaatttgtttgagttcattgtagattctggatattagccctttgtcagataagtaaattgcaaaaattttctcccattctgtaggttgcctgttcactctgatgggagtttcttttgctgtgcagaagctctttagtttaattagatcccatttgtcaattttggcttttgttgccgttgcttttggtgttttagacatgaagtccttagacatgcctatgtcctgaatggtattgcctaggttttcttctagggattttatagttttaggtctaacagttaaatctttaatccatcttgaattaattttagtataaggtgtaaggaagggatccagtttcagctttctacatatggctagtcagttttcccagcaccatttattaaataaggaatcctttccccatttcttgttcttgtcagattcgtcaaagatcagatagttgtagatatgtggagttatttctgagggctctgttctgttccattcgtctctatctctgttttggtaccagtaccatgctgttttggttactgtagccttgtagtatagtttaaagtcaggtagcgtgatgcctccagctttgttcttttggcttaggattgtcttggccatgcgggctcttttttggatccatatgagctttaaagtagttttttccaattctgtgaagaaagtcattggtagcttgatggggatggcattaaatctataaattaccttgggcagtatggccattttcatgatattgattcttcctgcccatgagcatggattgttctttcatttgtttgtatcctcttttatttccttgagcagtggtttgtagttctccttgaagaggtccttcacatcccttgtaagttggattcctaggtattttattctctttgaagcaattgtgaataagagtttactcatgatttggctctctgtttgtctgttattggtgtataagaatgcttgtgttttttgcacattgattttgtatcctgagactttgctgaagttgcttatcagcttaaggagattttgggctgagatgatggggttttctagatatacaatcatgtcatctgcaaacagggacaatttgacttcctcttttcgtaattgaataccctttatttctttctcctgcctgattgccctggccagaacttccaacactaggttgaataggagtggtgagagagggcatccctgtcttgtgccagttttcaaagggaatgcttccagtttttgcccattcagtatgatattggctgtgggtttatcataaagagctcttattattttgagatacgtcccatcaatacctaatttattgagagtttttagcatgaggggttgttgaattttgtcaaaggccttttctgcatctattgagattaattctgtggtttttgtcattggttctttttatatgctggattacatttattgatttgcatatattgaacctgccttgcatcccaggaatgaagcccacttggtcatggtgcataaggtttttgatgtgctgctggatttggtttgccagtattttattgaggatttttgcatcagtgttcatcagggatattggtctaaaattctctttttttgttgtgcctctaccaggctttcatagcaggatgatgttggccttataaattgagttagggaagattccctctttttctattgattggagtagtttcagaaggaatggtaccagctcctccttgtacctctggtagaattcggctgtgaatcagtgtggtcccggactgtttttggttggcaagctattaattattgcctaaagttcagagcctattattggtctattcagagattcaacttcttcctggtttagtcttgggagtgtgtatgtgttgaggaatttatccattttttccagattttctagtttatttgtgtagaggtgtttatagtattctctgatggtagtttgtatttctgtgggatctgtgatgataacccctttatcattttttattgcgtctatttgattcttctctcttttcttctttattagtcttgctagtggtctatgaattttgttgatcttttcataaaaccagctcctggattcattgatttttttgaagggttttttgtctctatctccttcagttctgctctgatcttagttatttcttgccttctgctagcttttgaaagtgtttgctcttgcttctctagttcttttaattgtgatgttagggtatcaattttagatcttcctgctttctcttgtgggcatttagtgctataaacttccctctacacactgctttgaatgtgtcccagagattctggtatgttgtgtctttgttctcgttggtttcaaagaacatctttatttctgccttcatttcgttatgtacccagtagtcattcaggagcaggttgttcagttttcatgtagttgagcggttttgaatgactttcttaatcctgacttctagtttgattgcactgttgtctgagagacaggttgtcataatttctgttctcttacatttgctgaggagtgctttacttccacctgtgtggtcagttttgcaataggtttggtgtggtgctgaaaagaatgtatattctgttgatttggggtggagagttctgtacatgtctatcaggtccacttggtgcagggctgggttcagttcctggatacccttgttaactttctgtctcgttgagctgtctaatgttgatagtgggctgttaaagtctcccattattattgtgtgggaatttaagtctctttgtaggtctctaaggacttgctttatgaatctgggtgctcctgtattgggtgcgcatatatttaggatagttagctgctcttgttgaattgatccctttaccattatgtaatggccttctttgtctcttttgatctttgttggtttaaagtctgttttatcagacactaggattgcaacccctgcctttttttgttttccatttgcttggtagatcttcctccatccctttattttgagcctatatgtgtctctgcccatgagatgggtttcctgaatacaacacattgatgggtcttgattctttttccagtttgccagtctttgtcttttaattggagcgtttagctcatttacatttaagtttaatattgttatgtgtgaatttgatcctgtcattatgatgttagctggttattttgctcattagttgatgcagtttcttcctagcatcaatgatctttacaatttggcatgtttttgcattggctggtaccagttgttcctttccatgtttagtgcttccttcaggagctcttttagggcaggcctggtggtgacaaaatctctcagcatttgcttgtctgtaaaggattttatttctccttcacttacgaagcttagtttggctggatatgaaattctgggttgaaaattcttttctttaggaatgttgaatattggccctcactctcttctggcttgtagagtttctgccgagagatcagctgttagtctgatgggcttccctttgtgggtaacctgacctttctctctggctgcccttaacattttttccttcatttcaactttggtgcatctgacaattatgtttcttggagttgctcttcttgaggagtatctttgtagcgttctctgtattttctgaatttgaatgttggcctgccttgctagattggggaagttctcctggataatttcctgcagagtgttttctaacttggttccattctccccgtcactttcaggtacaccagtgagtcgtagatttggtcttttcacatagtcccacatttcttggagactttgttttctttttattcttttttctctaaacttctgttcttacttcatttcattcatttgatcttccatccctgataccctctcttccagttcattgaatcggctactgaggcttgtgcattcatcacgtagttcctgtgccatggttttcagctccatcaggtcctttaaggacttttctgcattggttattctagttagccattcatataatcttttttcaaggtttttaacttgtatgccatgggttcgaacttcctcctttagcttggagtattttgattgtctgaagccttcttctctcaactcgtcaaggtcattctccttccagctttgttctgttgctggtgaggagctgcattcctttgtaggagaagaagcgctctgatttttagaattttcacattttctgctctgttttttacatgtgtttagaataacacattttctgctctgttttttactcatctttgtggttttatctacctttggtctctgatgatggtgacgtatagatggggttttgttgtggatgtcctttctgtttgttagttttccttctaacagtcaggccctcagctgcaggtctgttggagtttatcagaggtccaccccagaccctgtttgcctgggtatcagcagcggagtctgcagaacagcggatattggtgaacagcaaatgttgctgcctgatcattcctctggaacttttgtgtcagaggagtacccagccatgtgaggtgtcattctgcccctacttgggggtgcctcccagtaaggctactcaggggtcagggtccaacttgaggtggcagtctgtcctttctcagatctcaagctgcatgctgggagaaccactactctcttccaagctgtcagacagggacatttaactttacagaggtttctactgccttttgtttggctatgccctgcccccagaggtggagtctacagaggcaggcaggcgtccttgagctgcggtgggctccacccagtttgagcttcctggccactttgtttacctactcaagccttgccaatggcgggcacccgtcccccagccttgctgccaccttgcagtttgatctcagactcctgtgctagtaatgagcgaggctccgtgggcgtaggaccctctgagccaggcacaggatataatcttctggcgtgccatttgctaagaccatcggaaaagcgcagtattagagtgggagtgacccgattttccaggtgccatttgtcacccctttccttggctaggaaagggaattctctgaccccttgtgcttcccgagtgaggcgatgcctcgccctgcattggctcaggctcggtgcactgcatccactgtcctgcccccagtccaacactccccagtgagatgcacctggtacctctgctggaaatgcagaaatcaatggtcttctgcgccgctcacactgggagctgtagactggagctgttcctattcggccatctttgctccaccctccactttttttttttttttttttggaaagagtcttgctctgtcagccaggcaggagtgcagtggcatgatctcagctcactgcaacctctgcctcctgagttcaaacgattctccagtcttagcctcctgagtagctgggacaaaaggtgcatgccgccacaccctgctaatatttttgtattttagtagagacggggtttcactgtgttgcccaggctggttttgaactcctgagctcaggcaagctgcccacctcagtctcccaaagtgctaggattataggcgtgagccactgcacctggccagtcaccacctatctttaaaaaaggctttagttagtgctaaactatttgtatttcagctagcaattttatcattagtaacttgattttttatgcttaaaggaaattaaatccattcttttttcatcagaatgaagtagcctcaaacataaacaatttaaaaattcagacagtatctttcatcaggctgaaatatgcctaaaaatcacagtgttccatacagtttatcattgctgattatgttaacacaattataatattttgtatttcagaatggcaatgtaactttttccaaaggacacatgaaacctttttatcaacatccttttgtgcattgctaggtcatataagttcctttctagaatatcccctaatttagttttcctttgaataattgtttaatggataaagtgtatttttttctctagaaatccctttgacctttacagaagactggacttataactgaacattatgccaatagaaatgataagatttgttctaatgcttcagaaatttgcttgaagatagtagtgttagtaaatattcaaaagctgttttcttacacagaaatatttttagcaaaatgaataatgcaatattattaagcattgtttctgagatttttaaaaagtatttttttaacccttgatgcaattgcttgtttttactttaattttatctcaccagctagcaaatatataataacttattttcatcttcttttattaccttaggcattcactataattcctgaatttagatttgggataaaatagtgtataataaaaaaggcaaactagtgttgtttattgaaatcgggacaaaattgtgtatatggttacatcaggtatgttttcaaaaccatgttttaaatcgcctgtttcatctttgcataagaaattgtaaacaaccttcgattatgttgaaacttcaataatactaaaacgttctctttggctgttctttattttccagtctgttattcaaggacatttataattttttgcttcaatacttttccaaattactttctttttttctttacttcctttttagtaaatattatgttctttcataataagtctaactactttgtctgaagatgattaccatgtaatattacttcctcactgatattatgcatttatttatttattaatttaatttttatttttttgagaaggagtctcactctgtcacccaggctagagtgcagtggtacaatctcagctcactgcaacctctgcctcccaggttaagcgattcttccgcctcagcctcccaagtagctgggattagaggcatgcaccaccacgcccagctaatttttgtatgtttagtagagacagagtttcaccatgttgaccaggctggtcttgaactcctgacctcaggtgatctgcccgccttggcctcccaaagtgctgggattacaggcgtgagccgccatgcccagcctatgcatttatttttattgaaatgccttgccacatcttcacccatgaaagttccatattacccccaaagctcacatgttacctgctccatgaatttgatactaattatctgacttacctctttcctaagctgctctaacaaacttaccgtgggcactgttgctattgtatgcactcttgtatttgtcctgagattccagctagactgaaagacttcaagggtaaaagaaaagtatttgaatttgttcagtatctattacctgttacatagtagaacctgaatatgtgtgatttcattttaaatctgttacttatatatggttattataattaatatttgtgcataagaattaaaccataagcagctgaacagaaaaaaaagagaaaatgtcttaattaaggatgatggacaaaagagaaaatagacagtatgctggtggaaacaacgcaggtacagaggctagacacgtttgttcccttcaccaccattttgattaaagaggtgtctgagctaactgaccctgcccaagcatgcacattctcagtagtatctctttttatcaagagcctcgcctcaatccgtgcagcctattctcaacaacatagacagagtgacattgtctaaagttaagtcaaattatctcaaacctgtcttaaaaatctccactggtttcccttttggctcagaatgaaaacaaaattacttattatgaaccatgtatgagtcaagatactttataagcagtaacaagcagcccccagagtcttagtggtttcaaatacaacccaagtttacttctgccttctgctatgttttcattgcggcggttgtgagttctttcctttataggcatccagggataaagactgatagagcaggcaatatctcaagtatgtttgacaccatgctgaggcaagtatatactctggactctggcctacaagaattacatgtcatgttttgctcacaaatctttgtccagagcccttttacataactgcactgaaacatgggggcaggaaatagaaatatacctgaaatggtacttgaaaaggtacccatggggccttatgtgatcacatcagcctctgcccatgttacctctgagatctcatctcctattactctcgcccttacttgatttcaattctgccacaatagcttcattgctgctacatgaacaccccatgcatgttcttactgttgcctaaaatgtcttattttaggtatctccatggttaactccctccctgctctctgatctttactcaaaagagactgtttcaaggggaactccccttgttgttttatctaaaatgaatgtctctgtagatgtgtaaacaaattatcatgactgtatcccaataaaactttatggacactgaaaaatagtgagtgcctccccacctgcatgtttttttttctccttgttcacataatatgttgtcagggtctcccggaaaattaaaatttaatgaagagcgggaattttcatttgctttgtgctgctatattttcagcatatagaacagtgcctcaccatgataagtgtttaataaatatttgtttgcatacatcttaagtaaaaattattaacaagcctcttaacttattgcaattatgaccacaatagcatacttgtaattacagtttataattatttggctaccatatgaatgtctattacatgcaagcattttactaggtactttctcatgggctgactcattttgtttcatgatagccctgtaaagtagatacagtcatcccattttacaaatgaataagctctaagaattagtttgcttaagaacccacaggaataaaactaagttacctgaacatggtaaagttttcatttaatgtttggttttagctaaataattctccctatagacctttaagtgtaagaacaatattatttgttctaatgataaaaggaggtaggagaaatttggttacctgcaatgattttcaagtcatgaaagtataccaaataaacatttcacattcacatttctgcaacttttccaaggataataccagtcctgaatcttaactagatattagaattatttggaagctttaaaaaatgctgatgactagttctcacccacagaaatactgatttaatgtaccccaggtaattctaatatgcaactaccattgcgaaccacagaattcgacgattagcttaatcactgagtttccagtggtagtggtggtggagatttgttgatactgtttgtcagaaatgaggagtgtctactaatttgtttaaactgagttggataccatttcccattaatttcattgatagaggaaaataatgaggtaagcattaatttcttaaaatctggcacacattttcacacatacatctttctcatcagtcttctgtgtttttttttttcaaggggaaaaatacgttttctgattttggtaaaaataaattgaaaaagttattggagaatagagaaaaattatgtcaactactatccaatttcctttttgagttgtcaaattgttgtggttggcagaggctcagaacctacaaaaagtcactgttttatctgggattatttacattttccttcaagtatccagtcctggttttgtacactaaggaagtcaactccattctggggaattgctctgaatgtgtttttgttcttgcattgacagaattcttggtttatcagtacagatggcatgcttcaatagtgtagtcatgcagatcttactacatagacttcatttctctttaggatggccaatatcatgaaaggatggtaattctccaatttttccatgaaataaccataatgggtgttaatattagtatttgtttttacctgtaacaatctctatttttttagccataatttcaattatgttataataaaaagaattaaagtgctaatatgagcatctaattctgttttcctcctggtgacatctccacaaagttgagttgctttaactttattcttatctttattcagacactgaaatattctcaatcctggtggtgaaaaatggcccattattttagtccagctcatgaattaattcaatagctaggcatagtaacctggaaggtgttggcttctatttcagataaattattgtgagaaaaaaatacaaaagatttgttacaaatcgtgtgaatgatacagcacctttatggcatacagtttgtacagttaaaaaacagcaagtctctacctcagctaatgcaatgtatatgctactcagtgtttctagggttgcaaaatgcctgtagagctgtccccgaagagatttactattaggattcagttctagaataaatgaggaaggggtaattctcatttcctattatttatgaactatccttgacttatcattcaagctctctaactcagtcagcgtgcctcaaattcctcacactttgtgcttcaaatgcatacctcgaaacattgttcgtcacacgcaacatgctctatcacaacaaatcacaactttttgaagagcttttgaaattttaactctgttgtctttctgggattatcctttcttcctcttaatgctatgctaaaaacatacacaacgtagcctaatttaatggtacctatgattttgattcacatttatctggaaaattttctcttctttcttaggcagtgggacttcttttgaatcaaagagcttttcaaaccatgtaagggcacatggttgtacaagggctaaccagaattctcactgtacataaaaagaggccttctggttttgaaatcttttataggtttcttcaattacctgtcattaacacaacatgtgagttttacttccagtgcagctttgcttatttccttgtcggaggatcttgtattagatttcttgctatattctttatcatgtgctccaacatgctctatactaaattatcccttaaaaggttgacacagaaagtcctagaatctgtttgattctgcaaggcctttgaaagatggacccacaaccagatgagttttatttgaactgcatgtctcatttacacactccagttctacgttaatattttcaagactcagcttggaagaaaagagagtactgaagtagcatcttactataccatttatgtagattttattgtacccagatttcttcaaatagcctaaaaagtactgtgtttggaattagagaacaatttaattcctcactctcttacatgtttgtattagggttctctagagggacacaactaatagaatatatataagatggggagtttattaagtattaacatatacaatcacaaggtcccacagtaggctgactacaagctgaggagcaaggagagctggtccaagtttcaaaactgaagaacttggagtccaatattcgagggctggaagcatccagcacaggagaaagatgtaggctgggagactaggccagtctcgccttttcacatttttctgcctgctttaagttcgctggaagatgattagagggtgcccaccagattaagggtggttctgtcttccccaacccactgactcaaatattaatccctttggcaacaccctcacagatacaccggagattaatactttgtattcttcagtccaatcaagttgacactcagtattaaccatcacaatattaaatgggccatgttgagaaactctaaaaatcttgaacttcaaatttctttattgctacttttctttcaagcctatttgagttaaatggatttgtgtattggctgaggatctaaaagcaccatacaaatgtgctagacattcttttgctgctcaagattcaaaatctctctttctccaacctgctctgtgctccaggaactgagcctatgcttaaagaagacttccctgtcctctagctctcagttggacagggagaagcgctaacggaaagcgggaaggaggaaggatggagaactcaaggcatgttttctactggcttcctctttgctaggtcgcagtttgccattgacggtctctgctattaatatttttctctaccaatatctacaactgtttttgggtgttcactctcccatacctacagttccagatggttcctggtaactgctccttcctagctccttcaggtccaagccttggcctcccaaagctctgagattacaggtgtgatccaccatgcccagcctgcaccaacattattttgatacacagttttaataattatttttgagatatatacatatatgtatttatgtgttctaaagaaaaccatacatttaggaatgggatagtgtgtctgcatgtatgtgtgtatgtagaaaatttagaaaaatataaatctccatatatcaatataaattttctcattaatacattaattatctacatctatatagatatatcaaaaataattcttaaaactgtacatcaaaatactattgatgcaggctgggcatggtggatcatacctgcaatttcagagcttttggaggccaaggcaggaggattgcttgaagccaggagtttgagactggcctggacagcatagcaagactccacctcaacaaacaaataaattagccaggtatggtggctcacacttgtagtcctagctacttggggacttaagtgggaggattgcttgagcccaggaggccaaggttgcagtgagcaatgagctatgatcataccactacactccagcctggttgacaaagatagaccctgtatgcagccatgaaaaaggatgagttaatgtcctttgcagggacatggatgaagctggaaaccatcattctctgcaaactaacacaggagcagaaaaccaaacactgcatgttatcacttataagtgggagttgaacaatgagaacacatgggcacagggaggggagcatcacacactagggcctgtcaggggtggggagctaggggagggatagcattaggagaaatacctaatgtagatgacgggttgatgggtgcagcaaaccactatggaacgtatatacctatgtaacaaacctgcacactctccacatgtatcccagaatttaaagtattaaaaaaaaaactgttgatgcagatacttacgtattaatcgataaggttgaagctactataatagtacttaaaattaatactctaaaccagtagaaaaaaatgtgtgtttacacacacacacacacacacacacacacacactttatctcaaatagaaatcactcataactccatggctagagtagctttattcctaatccaaaaagctttttgacagagtgatactttattgttatcaagttatttttgcactcaaatgtgagaaaatctggggtgtggcaatttctagattattctcctagaaaaccttggctataagagtttgaggatattcatctttgaggttcatatgcattctcctctctcatggatgtaccatgcctacatcccacactcagctcaccagctgaaaatccacctttactctttcagatgcttatgtattattattcaaataactttccatctgctctaaacacttttaataataaggcaatttgcaaacaaacaacgttatttgtaaccagtgactagtggcattcattccagaaacaatgttacccagctgaatactactgctctcaaagctcagcccatagtccttcaagcacagcacaagtgggagtctctgttttaggaacattcttcacagctccctagtgttccaggagtaagttaactctccattcattattcacatgtctacctctttagttccattctgagacaggataaaaactggcttcttgttgaatgcaatttacctcaacccaaagttgccattctgttccttgtggtttgaggtttggtttttttgtttgtttgttttgtttctattttatttttttatttttaagaaaacattaaacaatggcagttgttctaatcattgctctttctgggctttgactcggctataaagggaacttggtattaggatatgtatataatttctgccagatatttttcatctatttatatttcattgtaaaatttatcacagttttctgcgctatttacaacattgtatgtacttatattgagatgaaaccagtcttccctgagaagactcacttttgcttttgaacctatcatctcagttaccgtcaaacactaaagtgatggtttgaatttgtgataatgtgtctcctatctcttggtgtggaatatattcttactaggattacctgaattaaattgctaaccttaagaatgaagggaagatgcttattatttcagctcttgatagattttaactttatgagatttataattagtgtgagtaagatcaatgatatttgaagttcattgaattttcagctaggtgatactcactattttcttttggagcacccactcaatataagcctttgttggtctgacaaaaattgcattcagtgtgatattttggtaagtactctagcataagaaaaagtgcttggattcccctaaacttatgtttgcatatagattctcatacttattagttacattaggttggccaaatttaatactgtattgtattgatttaaaatttgtatcgaacatgagaggctaaaaatacctgccatagctggttgtgaatagctaatcaacaaatatattgtaaattttcccacttatactcttttttttttcttttttcttttcttttcttttctttttcttttttttgagatggagttttgctcttgttgcccaggctggagtgcagtggcacgatctcggctcactgcaacctccgcctccccggttcaagcgattctcctgcctcagcctgtgagtagctggcattacaggcatgggctgccacacccggctaactttttgtatttttagtagagatggggtttcaccttgttagccgggatggtctcgatcgcctgaccttgtgatccgcccgcctcggcctcccaaagtgctgggattacaggcatgatccacggcgctcagcctctagtcttctttttcacttttcttatattgcagattaggaaaactaactactaggaggtatgcagggaaaaggcagacttttactaatgttttttaaattgtgataaaatacacataacatatagcttaccattttaagcatttttcagtgtacagttcagtagagtcaaattcatccacgttgttttccaccaaacaccagaatgcttttcatccagcaaactataattctatacccataaaatagcaactcactaggcaccctttctcccacagacttgttgttttataaatatttttatgatcacagcaaacttagtaaaaattaaagatttattccaaatcattgtgcttcattaacatgagttataatcacatttactatacaactcattttccaaaaaaaattctattttaaaagataaatctactcttttcaagtaaagttcatttgttaaaagaatatggaaattattttactggtttcctcaaacttgcttttagaaaacagttactacatctataaatagatagaatgtgtgggttaggatctttgctacggataagtcatgtttgataacaaacttgtggggcctgaatttttttttttttttttttttttgagactgagtctcactttgtcaccaggctggtgtgcagtggcgtgatcttggctcgcttcaacctcagcctcccggtttcaagtgatgttcctgcctcagcctcccaagtagctgggattacaagcacatgccaccactcccagctaatttttgtatttttagtagagacggggtttcaccatgttggccaggatggtctccatctcctgacgttgtcatctgtcggcctcggcctcccaaagtgctggtattacaggtgtgagccaccacgcccagccctgaaatgtttaactgttggccagctctctcctgactctaatcttggcttaaaatgtgaatatttttatagatattttaaactttgctcaaagtaggttaatactaatttctagagttgtatgtatatatacatataacacacaacttacatatatatatgcatacacagagatagaggtttattttcctatttttgaatttttagtttccatttatatgggttatagtctggggaaataaataaataattgactcaggaacatggaaacaattattcttaagtatcatttaggtatttttttaactcagaaacatttgtgtttgatttcaataagaaagaacatactctgctatataatagcctttagttgtaaagattaagcaaattaataaatgtaaagcacttaaagcaacacatatagaaacatagaaattactcaaagattgttagctattataattattgctgctgttactgtcatcattattacttgagggattaaatggaatgaacagcgagccttatttttaccagagttacagttggcaaacctcagagatacactctacccaagatacctgcccttgaaaatatgcgtccaaagtgtatcttataggtggtaaatactatgaatgaattaggttctttaattctgcaaatgcaaggtaccttccaatctaaaatatatgttagacataatctaaatctttgtgccttctttaaaaaagcagcaactaatatatagctttttaattggaaatatcttttaaaaatgtgtatgcctcctaaattacatttgcagctaaaagattaaacctctgctttgctctctgtggatgttattgtctatattcataactcaaacagaagtaacttgctaatttttgtatttttagcaaagaaaggaggaagcattgtgttccttcttattactgcaaaagtgcatttgagtgtgagaggaaagatgcagagggtatttcaaaatgctctcattattatgagttgagcttttatttctttcagggtactttttagaattcattttacaatagatgcaaacttttcccacataataatactttatttaattccaattgaatcccaccttcacattcaatttcattgaatttcagtctttaaaaatcttccccattcccctacttgcaatattgtgatctctacatttggagagatacttcaggataacagctatcattggccaagcctgtatggctataaagcctagtagctcttctaattttcttccacatttggtaatctttgtacagccttggaagcaaagttaaactattacatttctattctaacagagtccagacttctggaactgaaaaaccaggaatgcaatttgtccgtaggctacttctctttgattcagtacataatgagcccctttctaaattagtggcccataatctttagtgtgtatcagaatcacctgagagctgtataaagcacacattgctgggctcaaccactagagtttctgattctgtaagtgtagggtattcgcagggatggagaatttacatttctaacaagtggtcaggtgtagctaatgcaactggtctgatgtccttactttgagaaactctactttgagaactctttacagggtgtgtggtgaggtaaatgttctatgaaaaggaaaaaaagaaggtgcatatctcaatacattaccttgcccaattttttgcaggtatatagggagtgcatgtacagaatatacagccagacaatgagtgattaaaagcttggcattgacatacacttggaaaacttacagaatctgttttctcatcactttaactaacagaagcttcttgcaagagtggttgtgaatattcaatagtactttcaaaaatgccaattactgtcttacttttacagatctttccaaaatatcagtgtggaaaatggaaacagcacagtctttggagtaagacatgtctgagttgaaactttggtttcctaccacatcccaaatctatgcacaacaggtgaattggcatgtatccatgatcccagtgtgatacatgtataaaaacattaaaaataaaacaaatggagtgacctgcaggttatttacatattctaagttgacagagatttaaataaattacattattaaatcagaaatcagaagatttgtaagttcctattgggataaaaggggactaacatcaggacagggaacccaggggctttgaagatatggatagaattctatttctgaagatgtttggtaggtttatgggtggtatgttttgttattctttaaaatgtgcaaatacattattgtgttcttaatatttttggagtatatcatttgtacagtacaaatgaatgcactggaatatataaatatgccagtgagttttactgcaggaaataaattaattttaaattatgttacaaacatcaaaataatactttaaaaattttttggactagaataagaatgatactgagatgatcacctctgggcttcctccctcacctttgaacatcctattcatccgatgagttatacgcagcacccctcttcttgtggaaactggaataatccatttatttcctttgaatagctcttcatcattttcattgatttcctttctgtgagtaaaatattctttgatttcttatgtcattttacttttctcttcaggctatccatctcttctcatgccttgtaacctctgggagctcccgttctctgattacttctctgacttagggtagatttccttcgaaactgctgaggcatttttttcctccatcaccccaactatgtgtgtgtattctactgtatcgatatctgccataatttgatgtacttgaaattccctttctttcttgttcccgtctgtcatggcaagcaacatacacaaaggatctctgcaataagcaattttcttgctggactgctgtgggcagtgactgggacttttatagtaagtatttatgctgttagtgccaggaagatttgagacagcattatcctgagaacaccaagccctgtattgcacttctatttcaggggcaattattggacagtgcatggaaatgttacagaaaaaaaacccacactattttctaacaggcaagttaaacaatgccaatgattgctgataattcacataaatactacacattacaactttacgatgcagcaaatactgtgctatgctgatttttcattttaacaatgtaaaaactttgatctgacagtaataggcaaaaggcccaattgaagaaaagaaattaggaggagaagagaggattggaccagagaaaaattatgaaagaaataattccctttgggtactgatgtgttacttgtagtttatgaaacttaatcgggagataaaattctggataagaacataataaaaaacttttaatttcttgttctctgtcagcataatccacttttatgtgcctcggctttttcatatgctccatcaaggctaagagatatcacgtaaaaactttggggaatgaacttctaaattggccccttatatcaagaagcctaaaatcaaatgctgtcattcactttttaaaacaaaatttgtcatgtgcttttttaaataaaataactttaatcttaatttttactaaggaaacaggaaatgcataaactgtaaaaaacatgtaaatctcctgaaatcatactacaaatgatatgcataaaatgatttgttttatgtattacattgggtacataatttatccaaacatatataatcagtcacttaagatgtttatgctatttaaatattgtatatgcacacacatcatgtagctgtgcaatacttgctgcataattaactatatagatataacaaacttccttttcctatagagttataatcggttattattatgaacaatgctgaaaaacttatgcatatatctgcactattattcataattttctatacatattcctaaaagaagaatggctggaatcagtggatatatatctattatatatccaatatatttagatatattttttctaaatgcctcacctaaaatattcttaccagttaaaattacactgaacagtttctgaatggctgtgttttctcatccttaacaatactagaacttattcttgtaacctcgcgaatagagtaaatacaaatggtagccactttgtattttagtgaaattattcaaataatacccaaaattaacatctatcttaggttgggttccttgcgaaacagaccctgaaatgcagatttgagagtaggaatttaattgggaagtgcctgcagcaataactgtaggagattgggttggtctgggtagagactgtagaaactcaatgcggttgacaaatgcagttataagatagttctgcagagtacttaggagctagcgtggtctttctgagttttcttgaattaaggcatgcagatactcaaagtgtttgtatattcccctttactcagttcatatttaaccaaggaaatggccacaggttcttttggaaaagaaatggggagtcattatcaacaacacctgctgaattgcagggttgctcctgtgagattattttttccttcagtcaatgagttctggctccattatggaaacttggaaaggactgtatttcttttgggattactactgtattcttctgattgtctgtccttgatttcttttaactgtacagattgagcagcaccctattgcctgcccatcaatcttgcccctaagaacactaccttctcttaacatctccataggtgtttgcgggttaggctttgctgaatatcattcaaaacttgctgctcattacatttgggtccactttgcttatcagagctaagcaacaccactttgcctctgtattttctcaattctatcatttccatccctatcagtgagccagaattttcatattcaagtttttttctcatgtatgaatgttgctaacctaagattaagtcctttaacctttctatgctataggcttctctttggtaaaataaaagtaaaatgttttatttcaatctcataatcttgattccaggacaaaatgaatgaattaaaatgtgtgatgtatttcataatattgcagttttaaacaaatatagcattgtctttttattcctttttataaaaccattcaatcttcacattatactgctaatacctcaaaatatcctgtcttaaaatgttggaaaaatcacattttcctttaccataactccctgtttgcaagaattcaccgttacaaatttgcatccagaacaaaaatgattttccttctagccgttatagaatataatacttaaaacactgtagatcaagatacttaaaatatgacatggaatcaaggaacaagacaggaccccagaatttcagtgta

SEQ ID NO: 191 - DNA, 1597 bp, Homo sapiens
tatcaccagaaccattcaagtgccacgaaataacacatttatgtattattctgcttcaggtgagctcaggaggaaaagacagatatctattcactaaaaatattcttttgattggccggcacggtggcttacacctgtaatcccagcactttgggaggctgaggcaggtggatcacctgaggtcgggagttcaagaccagcctcaccaacatggtgaaaccccgtctctactaaaatacaaaaaattagccaggcattgtggcacgcgcctgtagtcccagctactcaggaagctgaggcaggagaatcgcttgaacctgggaggcggaggttgcagtgagctaacatctcaccactgcactccagcctggtgacagagcaagtctctgtctcaaaaaaaaaaaagttattttgatcaacttcttatggacaaagttcagaaagcaaagaacaatgttttactacatacacatacacatgcatgcacacaaactagaaaaaaaaatttttttgagtgctttgtctggcatctggcgatggtgtttcccgcaccatctggcctgtggtctgtggggacgtacatacgtcttgttagggctctccatccagtccacacatcaatggcttgcctggcttacgtagtctgagcaggtgcccagctttgtcgcagatattgaagccgtgtaaaataaatgccttttgattgttcacactttaagcaatattggtacaatattaaacccattgtcccaggcactccctctccttactgcttatggcacttcatgtattaaaaaatgacagtggcagcattgcccagacatgcgttttgtcatcaagtcttaatgcagtccacctggtccctcaggcaaatgaatggaggcacagaagatgaaatgattttcaaaatgccattaggaaagctcaggccagaactggaaatgggtcccgcacagggcactcggccactcttgcctggccatctcctttttggcactaagccacaagcacacaatgatatagaatgaatggttatcactggggatccagaagggtcattcaatcagttctcagtcttatcaggtctaagttcctttcttatcaggtcctaaaggcctaatcttatcattgtgacaaagataactgtagagtctgttaaacttttttttaataacatgaagattatgatttatagctgaatttctcccttttattccaattcaacaattttcatggctttttgtgtttgttttgttctggacatatttacagaaaattacctgaagagttccaacctgaggcctcctcatggatgggtcaaacgtgacatcatttgttgttgaggaacccacgaacatctcaactggcaggaacgcctcagtcgggaatgcacatcggcaaatccccatcgtgcactgggtcattatgagcatctccccagtggggtttgttgagaatgggattctcctctggttcctgtgcttccggatgagaagaaatcccttcactgtctacatcacccacctgtctatcgcagacatctcactgctcttctgtattttcatcttgtctatcgactatgctttagattatgagc

SEQ ID NO: 192 - DNA, 2718 bp, Homo sapiens
ggtagtttgccctacatatctaaactttctgctcaaaggtatctagtgatttacaaagcctagcttcagagagtcaatcctttatgaatcaaactgttatttttaccttcggctcagatctgacatgggaaaatcatagattttggacatggaatcttagtgtttaaaggattaccaaggccacttgcaggttcagggcacttgtaagcctaatattcaacctgagaagctctttagaaagtcactaaaaaatgtggaaggagactgctggctatcctcgcacttatttaatagaaacatcaagaaacactgtgctagcttctaacaccaagaatatgaagtataaacggttccgtccattcttcagatatgatgtaaaattgcatgagaagcaggaagtgtcatcacagctaatatttacatacgctcactatgggccagctcatcctctctgcactcacaaagatgaacttatttggtccttgcctcaactccatgagatgggtactaatgttatgccatttataaatgagaaaacataacgtcacacagctaggtgtggtggtgccagggttcatgcccaggcagtttggtgccagagtcaaagatcttcattactacactatgagtgccttgcctgtgaagaacccagactcaggggagaatttgacccccaggactcaagcccacgagtgagaacacaagcacactccaggctctcacccctcttgtgccctgcccagaggagccatcatacatggcagtgtggctatggggtgagatctgaaaatagttctagcggccctggagttgtatacaactgtactaccagggctgggttattctgcctgcccctgcttcagcatgagcctctaggcaagagagtcctgttaacttctgctctttcttctctttcctctgctttaaaaatggaagaagagccaggtataagcagaacaccctggcagaactttttacatttggttactgcttgggctacttgctactctgagtagaacgccttcaggggttggcaaactataactggtgggttaaaccctgcccgccacttgcttttataaggttttactggaacatagccacactcgctcatttacatgttgtccatggtctctggaggcttctgtgttccaacagtggcgctcaagagttgtgacagggccataggaatcacaaggcctaaaatatgtattatctggctctttatggaaaaagttttccatgcctgttctaggacgttccaggaacttggagggtgaaaaactgttgtaaagatcaagaagcttgtaatttctcagaaagcaatcaaacacacgacagagaaaaaaagttatttcatatcctatgtttaaatggtacatccatcttcaagagagaaagaatttcatgtcatctggcacttacccttcatctcccgaggcaagctccttctgaccaagcgtccctggcccccacgtccgtcccttcttctttggggccctcttctcctcctcctccccttcctcctttgggacgactgagctcctgccccaggttttgctgctttcacctggtgtcactgtgaatcacaagggttggataggatctagaaaatggacagacagggctcccccaaactagcctctataccaccacacacacacacacatttggagctgcagggaagttagaccttatcaaaaactctgtgcccaagtggacccttccaggaaagtaatggagttctcagccaccaatcatttagctctctcaaagtactaaacatggaaacacttcttcaattttcacaaatccaatgtaaagctagagcttaggccagccagacatcagagttccaaacagatctgactttacctgttttgttgggtgggattgggtagtgagcaaataaggaggcaggtaaggggggaaaaaagacaaggggtaaggaaggcgtggaaatgcaggaatcttggaaagaaagggttgggaagaaaatgaggagttcaaggttatggaaaaggaagtctggagtgggagaaggggaagaaagaggcctagagaaagacagataagagaggaggaatatttttctgacattaataccttggagcaagggttgagacccaaatgccccagggactgtgcttatatcataaacgagcaaactagttaccaaaaaacaaggagttgaaggggctgaggcaaaatatggagtatacggaagctgctattagtgccagccaactgtagccacatgaaaaaagaaacctactgatttgatttcatttttcaaggaaagctagaaatcttggatttttcttttttgagacggagtctcactctgtcgcccatgctggaacgcagtggcgcaatcttggctcactgcaacctccgcctcctgcattcaagcgattctcttgcctcagtctcccaagtagctcggactacagatgggtgccaccatgcccagctaacttttttgtatttttagtagaggcggggtttcagcatgttggccaggatggtctcgatctcctgacctcatgatctgcccgcctcagcctcccagagtgctgggattacaggcataagccaccatgcccagccgaaatcttggatttttaaataaaatctgtctttaaaccagggaaactaattcattcacatataggtgtatgttcacacacacacacacacacacacacttacatgtat

SEQ ID NO: 193 - DNA, 3416 bp, Homo sapiens
ctctgatagttaggtcacctctctatgcctttctgttcttccttaaggaaggtatggcacagaggtctcacatgtatggagctggattctgaatttgcatcctggttcattaagagttttgtggggtttttcttttccttgtttatttttgagacagggtcttgctctgttgcccagtctagagtgtagtggtacgatcatggctcactgaagccttaacctccttctgcctcaacctcccaagtagctgggactataggcttgcaccacccagccggctaatttttctctttttctgtagagatgaggttttgccatgttgcccaggctgcgatcctcctgccttagcctcccaaagtgctgagattacaggtgtgagctccaccatgactggccctggagatggattctgaatttgcatttaagctcattgaggtaagagttctatgttgagttgctgatatttgctataagagcccagtgagcagttggcagtacacaagccactgcttctggacatgctagatccctatttttttttttttttttttgagatggagtcttgctctcttgcccagcctggagtgcaatggcatgatcttggctcagtgaaacctctgcctcccgggttcaggcaattcttccacctcagccaggtagctgggaccacaggtgtgcaccatcgcgccccgctaactttttatatttgtagtagagacggtgtttcaccatattggccaggctggtctcgaactcctgacctcatgtgatccacccaccttgggctcccaaagtgctgagattacaggcatgagccaccgtgctagatcctatttttgaactccactgagcatgtgcaaagttttcattgacctcccacaaccacagtgaatggtatgaagggtctcctccatttctcagatggggacactgagggttagtcacagggacctatgacttgtccagggtgacaggaggaggtggaggggatggtgtcaacatctgactcctgatccgatgaccctagagccgaaagagttactggctgcccccctcccatggtgtccccaacctgagcagagtgaagaggtgactgggtggttcagacccaggttcttgaggcctagcctgctaatctggccaccacccgttctccctcccatttgtgccagagcttagcgggaccagtatctcgtttcctctgtggctgagccggctgagctgataatggggatcagattgatggaagccacacccgccctgccccagcctgcagtaagtgcacagcctgggatggtggctacatgggcatcaaagggacttcggcgactggccccagacagagatgggggggtggcaaagtcagggaggaggagggcagataaaagatggagggttagggaagcttcccattctctccagtgcttcttctaagtctcccccgacttttggtttctctctccctctttcttcctctgtttccctctcttctccactgtcctgccctctctctgaaccgttctgtgtccctggcctcatcactctctcttcctcttttccaccatcgcacatacatctgacgtatgggttttgcagtgaacacacctgaggccacttttttcttaaaacctcctgtgtctgacccccacggcccccagctgcggcccctggccccagtcacagtgacagatgcctggataccggcgacaatagggcattgagtggctatgcatggtgaggctgggctaccacgtggtgctgactgagcctcctacttctgggcccttcttcaatgcagggtcctcctggtcttaatttgtcacctctcttcctcccagcctgtccccatgatacatctctgccccagggctcgctcactggagaacctaggtcctcaaggcccttgtgtgacctctgaccacaccctctttccctttgtgcattagtttcctttttcaaatgagagaaccgatcagaggacgcttaggagatgctggactgttgcgggagttctgaggtcctcaggaggccacactccagttcccagacctgggtgaacagcacgaggcccagagagggaaaggaacggcctgaggtcacacagcaggtgagccaggcctccgggacctcatttctcagagccaggtgggcgggtcccagggtccaggaggggagaggcttaggcatggagggagcgccaatcatgcccccacccccagtgctagccacgactcgaaaaaggggcccggaaagagacacaatgcacagagacacacacgcagagacggagagataggaagagtggaagagggaggcccaggcgccgggaccagacaaaggacgcgcggcggcgcggggagcggagtcgcgcggcaggggcgggggtggagccggggtggggctataactggccagccccgcccccgggatacgcccgggctgccgagtgggaatccgagggctcgggcgaggccgggcccccggggccctgggggcggggcctagatgggcgtgcccgggcgtggccaggcagggcgtggcagggcgggaggggctgcgcgctcgggagctgaccagctccgtggctgctgaaagcaccgagcgcggggctagcggtgcgggcgagcaggcgggcgggccgcgctcaaggtcacctcgcggcccagagccttggcgaggtggggagcctggacctggcctaagggggctgtctcggcctcccaccccatctcccggggggcggagacccgggagcccagaggtgcccccccaacccgcgggccctcctctcccctccccctccccgcagcccgaggcgcccgcgcgaggctgcggcccgcgaagaagcgccgagaaacaaagggacgcggcagcagcggcggcgggcccgcggggcctccgggcgcgccccctcctctcccctccccgcttgccgcaaggtcgacgggctcgaggacgagacgcccgcctcccgggtgcggccgaggcccggggcgcgcgatccgacgccacccgctttcccagggctctcggggacgctttgtcgctttggcttggcccagcaccagtgatcgggccctgcgtttgcctgggcggcctgcggggtctgggcctggatggaggaagcatccttagccgccgcggcccctcccccatcaggcctgctggagagggggcaatcccgcctccagggcggcgtcggacgcctcccgaatcgcagtcagtctccctaaggccctctcagaccaagctctaagcgccctcagcactctgggcgcggccctgcccactctcaggccccgaggcttggtcctacccccccaacccgggcctagctaggcctggtcctaccccccccgccgcacccgcccaatctccgcggagcctgggcccaactcctccccgtcccgattccc

SEQ ID NO: 194 - DNA, 3811 bp, Homo sapiens
ccatgaaaggctactgcctttccagatcttggaggaaattaagactggtgatatatccagcagagaaagcagaggccatcctgcaatggctgtataaaaccaatctccaaagccagtcaaggtacacaagtgtctactatacttctagaaaaaaagcagttgagttacagctctgaaaggggcagacccagcattcaatagaccagttcctacagcccagcctgggaggggtagactaaggaagaagggaggccccccaacccctctggtgagtatcaaaatccgggagcacccacaggacagcccacatgacatgcccacaggtggccgtccacagaaggacagagctggcccatgggcaggcagccctcgtgtccccatccttccccttcggcactgttctcccccagctgaacagaataaaggaaataattggatccagagacccccgcaaggtcccttccacctaggcccatcatctcagtcctctgggttcctctcccagtctgcctccgagaacctgattctcagctgccagccagattgaacccaccccttcccctaggagtgcagtgatgcagtccagggcttcaggtgctctggctccaaggccgcccatctccacacagagagtctaccctcacccagaaggatgctgcctccacgttggtgcctttgctagccagtcgagaggttctggaggtcagagcctgccccggggacctttggggcctgcgagaccatgctatataggaagtctgccctgagcactgggttccctgaccccagctctcctgggacactcacgtattggaagtagagcacaatgctagtgacaatcccagtcaccaggagcacaattcccaggacacagaagaggcctgtgcacgaggtgaagtccacctgccaggaagcaagaaagaggcacctgtcagatggctgtgacaaccagcccagtcagactggccctgccagggagtcccagtgctgcctcctagggggtatgggaatgtccacaacattctaaggacagaaacaggacacagttttgtaggtgcggatgaggagaaggggatcaggtctctagggaacatccctagtgtgccggggtccgggcctgataagaaaggggagtcggggggccagggaagggccctccatgccctcaccttggtctgaaagcagaagatggtgactgaaatggataccaccgcagtgatgatcattgcaatgatgacggctttggtttggtacatactggggagaagcaggagttacagacaagaggcattaagccacgtatgaatgacttcaaaatcaccacttccagaggggacctgcccagaatccacccacgcagctggctgccggcccaggaacaccccactccccacaatacacatttcccaagagtggtgctttatccctgaatgtacctggaaatggtgcccgtcatgaagcccatggcaaaagtctaagggaaggagagagacaagaatgaaacacttaaaaaggaaggaaggcagggtgctgggggagtggccatggtggcctctgccagagctggggaacgccaccaagttggaaagaggcagccacagaggagatcagaacaggcggcccagataaggtggaggagacagccaggacatccttctgaaatgggtccccatcccttccctgggagcagtctccctcacagcatctccacaccctcctgccacccttctagacttacaaaaagggtcagcagaatgatgttccatgggaaacggcgtctgaagggaaagagaagccttgattaaatgacttggggcccctcaggcgtcagaggctcctacagcagaaggaagcgcttggctcctgtgcctggaggattaagccttgactccaaggagggaggttggcatggcctttggcacctgttcaggtgtggtacgcagggacaacatgggccaatgagacagacctgtgttgtggcgccagaaacacctggattggtttgcaactcttaaactgactgcctgtgtgatggggagaaagttactcagcctctttgagcctcgggttcttcctatttgttaactggctaaaatgctacctgtcttgcagggttactataagagtgacagctagttagctcctaaacacacatggtcctttgtatacacctgaacagtagctgtcatcgtcatcctcctcctcatttcttgtaagtttccattcagctgctataaaggaatccttctttccaaaatactcggcccccatcccaatccctgtcacccctctcactgtgttaagtctctgggactcacctgggtccctggcagcaggcaaggatcaggtaggtgacaacgaagacagcactagggacaaagagatggggaagcagttcaggcccaaatctgccccgcttggcagcacacaccaggccagtgatttggggcccaaatagccgtttggaagtctgaggggaagcaactcaacaggaagcaagaacgagattacccccagccagggtcactgagatgctctgaagcaccaggctccggccaggaaggaggtctggggaggctgcagctgacgggctgagaggacatgggggctgcagcgcagcgtgcacgccaccaccagcaggtcccactcttgctctcgagttctaggggtctgctactcatctgggcacgcacacccacaccctctggcacgggaaactggcaccaacttgggggccctctcaaaaagcattttgatcctgccctgagcaaagctggtcacctagaaacagaagctgccacccctgcctccctgcccaaccacagaggagcacacactcactaggacacgtagtagacagccacatttctcctcacaaaggcgctgacaggttccctgtggggcacaggaggacaggagtagtcaccctgaggcttgtctgccccacccaggccagccaggcagccctggcttcaccttctctaattgcccatggtcaccctgagagcagggcccaccgccacccacacccccagcaggtgaccctgaacccccagggcagtaggagtgggtggcaaagcctagagacttacacaaaggtgaagatagcaatgatggccacagtgatgagcagctgcacggagatgatggagtaaacctggacacagacggccgggcatgggtcaccatccggcacccctggcctgccccaggaagctgccagcccccagtactttcctcccactcaagaaccctccctagctgcagcctggcccagaggcgaccccagtgagatgcctggctcagaggcaatgtgcacttcttcctcagccccgctcccatgctccctgccatctcccctcctgtccaacaccagcctcggtgactactgacttgccctgcctggccaccatactctaccagtatggcctctgcactcccagcagctcagtctgcacgctctatgcagctgtgagatggagagggtgggttacaagcgagtaggatcatttctggctccaagctgcctatagtctaaagggagaaagatgtctggggaaggcgggcgctgtggcagaacccacctaggagattctcccagactgaatgtgtcctcccaaaacatggtcaagaagagaggtgcaaaaagagagggaaccctggggttagagaagccaggtgcccctctgagaagcagacaaggctagagaagacaggcagccagtgtatttcatggaattgatgccctggggctactgtggcctacccacttcccattcccacagcctgaggggccccaggtacacccacc

SEQ ID NO: 195 - DNA, 5834 bp, Homo sapiens
ggaattgacttttaccttaatttgtttaatgtctaactcagaactacatatgggagggcacttaaacactgtcttaatatctggtttgtattcagtaggaggaacagcttgatgagacaaccatcaaaatggaaaaggccgggcgcggtggctcacgtctgtaatcccagcactttgggaggccgaggcgggcggatcacgaggtcaggagatcgagcccatcctggctaacacggtgaaaccccgtctttactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaaggaaaaaaaaatcctctggggaagagtggaaagaggattggtcatctcggccatttactacataaatgactttcggcaagttacctctgcacctgtaaaatggaataatggtacccaatagttctattaaacatctgttgaggaaatgtatgtgtatgtgttttgtacaatatttatacttttagatttgcctatgtaaaaatgaaaacactcgtgggaacagtaaatcttaagtagttaacataactttatagaataatttttttttctcttcagacggagtctcactctgttgcccaaggtggggtgcaatggcacgatctcggctcactgcaacctctgcctcaccgattcaagtgattctcctgcctcagcctcccgagtagctgaggctacaggggtgagccaccgcgcccggcctagaataattttcgattgctggttgagcagagcaaggccaatatgagttgaggaaagcagagatggaaaggctctttatagttaatgatttctcatttttgctttgcttccttttgccaaagtcggcttgtcatctgagagtggagaggatttgttagatcttatgaagccagagctcacttctgatgtgaaccaagtattaataattttggtggtggttttctgtactgcatctgagagagtaatcattgttctttgaagatgcaataattctacgctactacgggacttagggaaataatttttgaggataggaagcacagaataattaagatgacaagtcttcctgcctcaaaatcatatcactctgattcgaataaaaaataccaaggtttttccttcttgaggttttatactcatggaagttcttcaacctgaggtctgaaaaataaggcaaccccatcctctccttaaacaggttagagccagtacctttttatttctctatgcacggacaaaataattatgcaaaaaaaaaaaagaggcaggttttgtttttttttttgcactactgaaattcacacttaacatataaacaatctgctatatgcagacagcactggtgtttagagttcaatgatctggattcaagcctatttaaaaccagataagagaaagttcccaaacatctatgtgtcttggattcttcatctgtaaaattgcgttgttgagaagataatatgagactaggcgcgcaaaacaatttgttagagctattatttctaacccggaatgtgttcgctggcagtaacagtgcattagttacgattcatcgagggcagcttctggactttctgtttggaagcccagctgaggcaaaagcagcagtgcgtttaaaaattggagctcgccacattctgaaattctttcggttcgtgaaagcagtaacctaggaaacgagactggcaccacccctttcagtcctaaagcttggtttctcccgcttttctccattatgtttagggcatcgctattttacagtctttttgttttttctttccacatcattagcacaaaagagaaattccccttctacagaagcaagtacaaaacctttctagtcgctcctttttggcagcagctcacctactatttttttctattccgcggtcgcagccccagacgtcctcaaagacaaatattttcgcgagggccagtgtagggcaggaactccctaggccttgaatcaagggaatccagtagataacaacagaaaggactccgacccaggtacctgagacatctgagaccgccaaaattaacacaacaccctacgcgacagagaaaactctgggcggggagagagaaagagagcgagcgagcgagagagagagagagcgagagagagagagagagagagagagagagagagagagagagagagaaagagagcgagcgagagagagcgagagagcgagagagcgagagagcgagagagcgagagagagagagagagagagagagagagagagagagagagagagagagagagagagacgagaggaagcaacgttctcgcgacaagaggggtgtcgacggaaactcggaaatggtcccctagacgacccggccccagctagtgggtggggccagggtacatccgcccctttccggtttttttccccgcctcccaaccgtgaggtgttgggtttgggggacgctggcagctgggttctcccggttcccttgggcaggtgcagggtcgggttcaaagcctccggaacgcgttttggcctgatttgaggaggggggcggggagggacctgcggcttgcggccccgcccccttctccggctcgcagccgaccggtaagcccgcctcctccctcggccggccctggggccgtgtccgccgggcaactccagccgaggcctgggcttctgcctgcaggtgtctgcggcgaggcccctagggtacagcccgatttggccccatggtgggtttcggggccaaccggcgggctggccgcctgccctctctcgtgctggtggtgctgctggtggtgatcgtcgtcctcgccttcaactactggagcatctcctcccgccacgtcctgcttcaggaggaggtggccgagctgcagggccaggtccagcgcaccgaagtggcccgcgggcggctggaaaagcgcaattcggacctcttgctgttggtggacacgcacaagaaacagatcgaccagaaggaggccgactacggccgcctcagcagccggctgcaggccagagagggcctcgggaagagatgcgaggatgacaaggtaaggacgacccttttctcttcaaaccccatggtttcttttctccccggggtctggggcgggatgttaatccgctagctgttgtcttatgccttccagtatttcagtcctgaaggctcctttcacccccaacaaccctgtttctgtcagacttttcccagtttatcagtgccacgttctctggtccctgccagaaaaaaatgactgtaaattctggttctcaagagtggactgtgtgcagatgctgcctattctctaagctcagctggtgagttggcagtagtaatcatctggcctgtgtggcccccttaccttcaaagacacacaaatctggcgactgccaggtttggtgtggttattgtctcatttttattccgtgcacactgatcaatattaatttcgttatttaaagaacgaagccgcctctgactcctctacttatggtagtcatcatatattttttaagctgtgtgacttttaaaatctctatagggtgatgtattgaataactaaataatcagctatgactgcctttttgtgatcaaaatgttatgatagatgggccctcgagctatatgtgagacacacttgtgtcttggacatagttgatccatcattatctactcaatttgaattgttaatgaaatcagccaaaagattagaatctgaaaataaattttaagcagtggaatgtcatgtcagtgtcttcattgaaagaaaatagaatgaaattttgtatagctaagttgctattagggttggtgttttatgcagatggaaaactatacaaagttttaaatataaaaagtttaaaattgaactgtaatcatacttgctactaaataatccttgttttcattagctcattggtaactatattaatagtttatgacttagcaacttctgtaggtatagtagagttatgaaaatttctgggcaggatagtagatgcctttctatacacttctttggtaatcttcacatttttgtgtgtaaatgcccattataattacaagttttactttgcatatcaaaatcacttaagggtaagtcattatgaattaaactgtctgtgagcttctaactttcctgttgacagcctctacctggctttcttatttcatgaagattaaggccctcagctaagtgcttccctataaccccctcctcttcaccataacatagacatgctatgatagggtcaaggaatcagtacatttatatgtgcgctgcatgcttaactctaaagactgaaaaactctcgggcagagtaggtagaaatccatgaaagtttggagtattaaagtaaggtcttcctacttggcatggttgagcattacaattcacattcttctctctggtctcaaaggaaagtctcttgttgtaattaatactcttgattccattctttcatccattggactttttgttgttgtcgttgttgttgttgttgttgttttttgagacggagttttgtttttgttgcccaggcaggagtgcaatggcgtgatctcagctcactgcaacctccgcccccccggggttcaagcaattctcctgcttcagcctcctgagtagctgggattacaggcatgcaccaccacgcctggctaattttgtatttttagtagagaaggggtttctcaatgttggtcaggctggtcttgaactaccaacctcaggtgatccgcccgcctcagcctcccaaagtgctgggattacaggtgtgagccaccatgcccagcctctttttttttttttttttttaaagagacagggtctcattgtgttgcccaggctggagtgcagtagctgttacacaggcatgatgcactatagcattgaaatcctgagctcaagtgatcctcctgcttcagcctctgagtagctgggactgcaggtgtgcaccaccttgcccagctctactgaactgtctctttcagtttgtttcactttttaccttcaacagtatgtgggtgtcccctgttctcagtaaaggaaaaaaaatctgtatattcctttctcccaaccaacccatttgttttttcactttcattgctaaagtcaaattattgatggtctacaaatgttccatctacctattttttcataaccatcctaatcttaaaatgtctgccatctttctttcctccccttttttgaaactattctcttgaaggtcacaaatggcagtcttcctagtcaaaaccaaagaatatttttattcttactgtatttgacctcccagtagtttgatcctgttgattgtctctagctatttggaaactattttctttcttgcttctgttatactggactctccagtcttatcttcttcactatattctttgctggatttattttttctttccagtcacctagtaagggactctgttattgagcctttgctctcccataagagcagtattccccaaagtagtgttaaacagaatacccttcttgtaatatttcttaggtggtgaggagaaaaaaatgaaaaccttttttggagggaaatgttagtgtatcctcctcttggaattcataatgcctgctggaatataaaagctctgagaaatccattaataaagaaggctattcaattttgtttaactcagtcttgtttagtttatttgatcacaggtta

SEQ ID NO: 196 - DNA, 8037 bp, Homo sapiens
tcggagatgctaaactgtcttattagaggaaaataaatctgattatggagtctcagtctctgatcacaccgtctcttgcaggctgggccccaggtgagtggcttccctcctgccggactccccgggctgtcctctcagtggctgggcccagtatggccgcctggccaagacctgtgtggccagaggcccgtgcttggtttgctgccctctgtcaccgtcttgaaatactttgcaattctcagcgaggggcctgccgtcgccttttccactttgcttacagttttgcctgcggcctttaacctgaagggaatcccaggggccaggctcgcaaatctgtgtcttggtccagagcagataaggcggagctctgacctcctgcccggacacgtgcccgccatctggcatggtggaaagggcgtgctggacccacaggcctggggtcagtctcagctccacgacttcgtgggactttggaatcttcgagcctcagtttcctcctctgtccgttggaaggacagcacctccttccacgccgaaacaaggtggttaatgaggagtgacaccagtgctgatgtgcaggcggctgcagggtctgggcagtgtccttctggcagctgctcgtggcagttaagggctcctgggctgtcaccgccaccatggcctgccttccatttctccaggaagttgtttgggtcaggcctggtagcaggaagccctgcatctcccccaaaattatcagatggggagaaccgctcagccctcccccactgtcctgccactcccagggtcccctgcagccaccacagcgccctgctcagtccctccccatccttcaaggcactgcatggggccacatccagaacagatgccatcggtccccacgtgtggcccactgagcagggaggagtggacctaggagcagcaccccagggtcctccctcagggtctcagggcctctcctgagggtcccttgccagcgcagcaccagccccgccctctctgcgggcccacaccacccctgccgtgccctggctggtggcagtagtggggcgctggaatcctgggactggcagcctccaccccacacacgatggggagcctgtggtaccttggctcccgggagctgccccaggacacagccttgctggtccttccgtctgggggatcccaaatcctcacacccctgtggtgggggcctgcgctccatccatctccctgggcgctcaagcccagggtcctgccgcagccttgaggacaccgggacacctatggagaccaggcagtgtgcagttgtcaccgctgaccgcaagtgtgagctgggccgggggtgggatggcgaggacagccagcgcgatgtgccgatgaatggggaatgtcagctggaggcttgagggattgcagaaactggattccttttttttttttggagacggagtttcacttgtcacccaggctggagtgcagtggcgcaatcttggctcaccacaacctctgcctcctgggttcaagcaactctcctgcctcagcctcccaagtagctgggattacaggcatgcgccaccacgcctggccaattttttgtacttttagtagagacggggtttctacctgttggtcaaactcccgaacacaggtgatccgcgtgccttggcctcccttttttttttttttttgagctggggtctctctctgtcacccaggttggagtgcagtggtgtgatctcagctcactgcagcctcaacctctcaggctcaagtgatcctcccacctcagtctcctgagttgctgggaccacaggcgcatgccaccatgccaggctaatttttgtatttttaatagagacggtttcgccatgttgcccggggtggtccggaactcctgagctcaagtgatccccccgcctcggtctcccaaagtgctgggattacaggcgtgagccacccccggcctggattcttgcaccctcctgggagtcctacaggagaggagatgggcggcaaaccccaagacctgctggactggcctgggctgagggtgctggtggggacatctgcagagctggcctcagatcatgcagcaagaaacggcgggggggaggaaggggagcttctgagctgctccccccagggcattgggcagggactccctgcccccagcctgacgtccagacctcaagggggttggagggactgagtccagccctcaggtgcacaccgggccatcacctggctccgtcctgctgtggggcagcccagatcttgcagggaattgggaaccaggggtgtcacagtctaggcctagggaaggaggaggccgtggccctcgcctgcctcccctcagctcagggggctgctctgttctggcccagatgagtgatgccggaaggggagcggtgcagagcagggaggcacacgctcagagccctccgtggccctgactctgcactgcagcagcccccacgcccaagagtcaacccagcatccaaaccagggaagagtctggactgaaagcgcaaccgtacttggtgagaggccggtaatctcgagttctggtaaggaaagcaaggcctggggcggaggctggggctcggctgctgggctggatcaggcggcacacccggctcacactgccctgcagtcctgtgggagacagcggcactcggacccgctcacaagccctgcaggacaccagtggaaccacatgggtggaagcctagaaatcagattctgaattgaagtccagggggttttctgttttctgaaaatgagtagttgcataatctaaccctaaaatcaaccatttcttgttaaaagaccagaagaaccaaagtgctgtgcaggggaggtgtccgcgccgcctatgctttttgtcttagttttttaattttcaaggtcatccttaaagcctctgccttgaccctgcagccacaggtgacttggaggctggaggccaggcctggggtctgtgtccttcaaataaatgcctcagtgccgcttgggggactcggtcctgtgccggagttactcgattagaagttaaaggtggaggggaaagacacctgtggggccatcccaacccacttcctccactcagaccacagctttgaatgggctcagtccccagggacccccaggccccagggtcagcctcgcagggcagagctcagaaccccctgcccagaccccagggagccaaaggggcccagatctgggcacagggcaggaagagggctggcacctgctgggaggggtctaggagccaggggcacagctcacatgagtgcatacccagcacctctgcttcatgtcaaagggagatgatgctggcgtccacccgagaggccacatggaaagcactcgacatggacaggacatcgcccacaggaaaaacccctgcaagggaccttggaccttggggaaggcggctgtgccctcccgggctgggccttgcaccctggcctgcagccattcggctcggaggactcccggcacccacaggcacttggctcccgccacttccctggcccctgtggcacttggggctccacagctctccgactccctgctgagggttgagccgtttgcaagcatgtgtccccatgtgtgcttgagggccgggggcacctgtgcatatggtcaagggccttctgtgcacacatggcacctgcagtgtggtcccagccgttcctcagcacccgtgggcccagctccatctcgggcggcctgcttggcgcagctctcgctggtcacctcgtgccgggtgactgctctccatcagctgtgcccgggctccacatacatagcccgggtcacatccactcacgtcctggtccagccagccttgcggggactctgcccaaggagggacagtaagggtttttgagtaccaagtcagtgaccctgactgccagcagcggctcctcttgacccggaggccggtgaacacctgacaacatttccctccatacagcgcaggggcaggggcagattaaccctccgtgcggaaggaggagtggaggtggaggcgggacagtggctggcccctggtccaagtcttgcagagccctccccatctggggtggggttgaagcaagtcactcaggggcagcttcctagctggtgctcccgagaccctcagctccccaacaccctgatgtcctcctccttcctcccattgtccatggatggagaagggaccaacggttcctccggggctgagctctcgtctcctggtgctcctgcttccctaccccccaacccccaggccagggctgcagcctgaaggggcactgggtccctgcgccctgtgagatgggcgctgccacccttgctctgcaggtgacgaatggaggcgaagtgaattgcagtgtcatatggcatttgagtcctagacagcgcccaggactggtccgaccaccgctagatgccaccaggggggctctgcctgtcccccaccccagcagacagcaggcccagccccatccaagctaggtggagacccctggtccataccctcctgggcttccctctgagttgtatccaacccacccagcaacagctgctctcagcaagcctcctggcctcacctgcactctcttccctcctctcctgcctcttgccttcctttttttgtgagacagatcttgctctctcgcccaggctggagtgctgtggcgcaagctcagctccctgcaacctctgcctcctgggttccaacaaatctcctgcctcagcctcccaagtagctgggattacaggcacccatcaccacgcccagctaatttttatatttttagtagagatggggtttcaccatgttggccacgctgatctcgaactcctgacctcaggtgatctgcctgccttggcctcccaaagtgctgggattacaggtgtgagccactgtgcccagccaccttcctttaaaaacaaaaacaaaaaaccccaaaaacctgaggtcttgctctgaggcccaggctggggtaatcgcagttcactgcagcttcaacctcctgggctcaagcaattcttcctcagcctctgcggcgccgggaccacaggcatgagccactgcaccgggtgttcttggctccctcgaagcatccctcatgttcccgtctcaaggccttggcgggctctttccctgtcttgctgatgtcccaggcccaccccaccttttccctggccctgccatgtgcaggaggcagggctgtcactcttgctgcctccacacctcaggggaggctgtgagccagcgtggccagtcagagcacagcaacctcaggctacaggaactggtgcagagttggagacaggaaccaatcagagacctcactgagaccctcctgccatggcctggtcaaggaggtggtgagtctcactctcccaagacaccttccctgccacgtggagaaggccgtgcacacggaaaccaacacaggagggccgccagccatagcggagacagacacagggaccaagagactgagacagcctctagatgctgaagcctgcgctgaagcagttgggccgtgagaggttcttcttactggaggaaactccggggctttgcatttctccacgtccctgctgaggttctgagccatttgcaagtttgtgccctcatgtgtgcctgagggccgggggcacctgtgcatatgctcaagggctttctgtgcacacatggcacctgcagtgcggtcgcagccattcctcagctcacatctttgcatgtgagtggttctggtaccgcttgtctgcccagcgccctggtgcctatctgctgcctcatgtgagctcgctgggccaccctctgactgctggacccacctccagaggccactcagggcaagagagatggatcccaataccccacccagccagccccagccccctatggtctgccaccttcaattcaacctcctcactgtggctgcagctgtgatctcatccttcctgtctcattttaatgccacctttttcaggaagcctcccctgaccaggaagccaagtggcctcactaccctctccacacagcacaatctaggaatggcctgcccaggtggagcagcagtagtcaaagaggctccattgctgccccaagtcctggccgtccagcactctggactcccctgaggccccaccatcaggagagggagccccagcctctgggccctttcagtcctggctgtggccctgagcaccaggggtgaagtttgctgagcctcacctggccctctgcatttatggtggcggtggggatggggggcagagccagacactcaggggtgaagcccaacgcagccctgtcagtcaaactgcctccttcccactgagaagcaagacaaggggcaaaacagttgtgacccccaagtatcctgtttgttcctggttgaggacatgtgagtccagcaaggggcagccaaactccaggaccgtgaggacccaccctccccgtcctaggctgggccagcaccacagagccactgagcgcagggacctctgctcaaggcgatccctccaaggtaaggggcaatgctggtggcatcagagatgtcgaggcaaggcgcccacccgggacacaaaaagaggcagagctccccccagtggcggctccttcctccccggatgcagcatatcactcatgaaagaagcaaataccaggccaagcaaaggggtgctcatggcagagtctgcagatgaggggtgggggtgcaggaaacagcaggatggcctggagggtggaaggccctggaagtctccaagactgagtagtttccctttcaccttcagtcctctgcctacatacccacctccaccatccttcctgcacccttccctagtcactcatccaccatcctgccattggaacccagtgtaaccatccaccattctcccccttccatcagctacaaccagtgtctccccaatccacaaggcacaccatccatctctccaccagtaatcccctaatgaccaattcaccaccctcccagaaactcatctccccatcatcaaatcatccaaacatcatgcacaatccatttgctgttcatctttctacctctctgcttcccaacacccacaaatccatcctccattcactcaccacccagccattccaacgtgcatgatgcagatccaagcatgcactgcagacccattcccccaacccccatcaatcatccatccatcacctagcgcacattcattcacaatttatccaccatgctctgtccacccacccattgatttatatccagtaactcctgtactcttatccatctacctactgtctctctacttactactatccattcacacatcatctaaaattcattcaccattattcatccaccatcaatccatccctccaccatttggtcttgtccaccatccatctacatccaaaatccacaactttttctcacccaccgtgcattgcaacaactatccatacatacacatctgttcaacagctacgatttctctttcacccatcaaccatccactatgcaaccatgattcattttgccaccgtccgccctttccctcgttctcctttattcaactaccatctaccatccatcaaccatccttccataatcactcttctatccatccatccaccaataacattcaccatctgtgagctgccatccatacacttacccattcaccatccacaatcaactatctactctttttttttttttttttttttttttttttaatagagtctcactctgtcgcccaggctggagtggagtggcacaatctcggctcactgcaacctctgcctcccaggttgaagcaattcggccccagcctcccaagtagttgggattacaaatgtgcaccatcacatttggctcatttttgtatttttagtagagacaaggtttcaccatgttgtccatgctggtcttgaactcctgacctcaagtgatactccatcctcagcctcccaaaatgctggggttacaggcgtgagccaccgcgcccagccaactatctgctttcatctaccatccgtca

SEQ ID NO: 197 - DNA, 8660 bp, Homo sapiens
tcaagagaaaaaaattatgtcctaatagaatctacaccatggatgcaaaatagatccatctaagccatggatgcaaaataggagctatagtaagatcagtcattatatcatcaactcaagaagaaaagtcattactgtcctcatatatggtagctatttatttgatctgagaaaagcaccattactattttaaaaagtcaataaaatagaaatagatgagtatttttttaacatattaatagtttttaaaaccatagaccaatctaatggggaaacactgaggcagtctcattcaagtcacaaacgagacaagcatttttattggaagtataataggaaatgaaagtaaagaaagaaaatggaggccaggcgtcgtggctgatgccagtaatcccagcactttgggaggctgaagtgggaggatcagtagaggccaagagcttgagacgagcctgggcaacatagcaaaattctgattctacaaatttgtttttaattagctaggattggtggcctgaacctgtagtccccactactagtgaggctgaggtgggcagattgcatgagcccagagtttgaggcttccattagccgggattgtgccgctacactctagactgggagacagagttagacctgggctagggggaaaaaatgtaaaagaaaaaaagcctatttacaataaaaacaaaagatgtagaaatagatcaagtaagaaatgtacagaacttacataaaaagaaaaacaaaaagcctgctaaaaaacacaaaaaaatgcatggacaaatgcaaatgcaaaatgttcttggatagaaagattcaacatcaaacatatataatatattcctaagtaattaatatataaatctcttgtgttcctaataaaaacacagttaacaacaaaaacactgaactagcttatttaaagtcaaagagaaaacttaacagaaggagagggaacattttggagggaaaacagcattgaggtaagttagtagcaccagaggatagagcatactatgtaagcttaatcattaaaattgtgtggtaataggttataaaatataaataatagaattgaatagaacatttagatcaaaatcaaaacacataagaaaatatatgatataataaatgcaacatctcaaatttgttcatcattggatgaatatcacaatgtattgtgtggggaccacagagtatttgactggaaagaactatggctgcattaatacctcctactgtgtactaagatacatctcaaatacaataaagatttaaatatacaatatgaatccacataaacactagtagaaaacgtagaataactgtaatctgggcttaacataccaatataaaaaactgatatacttgcacatattcaaactgatgcatgttgagtgttaaatatttctccattgtcaataaaagaggataaatcgaaaagtttatcaataatagacttcttctacagttttatacttattaaggaatatgtttatcaataatagacttcttccatagttttatacttattaaggaatattacataactgtgaaaaaaataatctgaaggatttatctagtatctacatggagaggactccaggatacattcattgtgaatggaaaaaaaccccagcaaagtgaaggaatatattaatatttattcatattttcttggaatgatactgaaaatctggaaataaacaataaattaacaaaagggatttctcaggtgggagactagaaagatgcaattgtaatagcaggaaatcttttagcttgctgtgtgtgtgtgtgtgtgtgtctgtgtgcgagtctgtgtgtgtatacacatatttaaatacatgtattattttacataactattttaattacctatacactcagaagtgactttgaaaccctgagacattacatgccactgacacatctgttaatttctttgaagaaaagagcctttctctgtctgcagccttacttttccataataaatttgaaatatgcctctgatattgtcctcttcccaaaatttaaccaaatcagaatatgcatgcagttcctgagaatctggtctctctgattttctgatctaatttagatgtttataggataaaagaatacttgccgcgcttcttaaatttaattacagggttaaacgggcccgatgaaaagactgcattggttctaatataaattaccttcgctctgcaggaggagcattatccgctgcttggaccgtgagtgcgtaagtccgcccgactatcatttccacccctggagcgatggtgataagccctgttgttttattgatgatgaagtctccctgagccccaacaaggatttcatatgtgatctccccatttgacccttcgtctgcgtcgactgcagtgagctggaattgaaaatcacaacataaatcctcttgggtctcaacttttcaccaccatgtcgttttttcccccaacaaaagaagcttgctttcaaagaaaaaaacacaggaaagtttccttgacatatatactgttttttgttttttgtttttttaactgaggctactgtgtcctgttacaatactaaagcaatcacaaaaataagagtgattttgttttttgtgagagtgattaagaaataaactttggatcttgaaggcttatctttattttaatttaataaagggaaaaagaggaaagccctaacagaaaatctaatatccctataggaaatttatttttcctgtcttgccttgcattcttgacacataaactcatattaaaacagactgaacctggaaaaaatgaaataggcatagtcggcctttgttactcccaaccttccttttactctcatttttccttccataatgttctcctccctgtctcccagacactctcatctttgtgtcctttttgtttacaattgctctaggaaaggttattaacttgcacaccctgatttataaaggactgataagtcgtagagtattaatgtgtcaacaatcaaacaaatgcatctcccattgtagaatatcaagggtaacatagcccaagaaatgtttctttggggaaagaaaatctattcggagcccttgaaattaagcatgtaaacatctgtatagccaatttacatatatctataatcattttgaaggaactggtatctaaaagactttatttgggatattatatgaaaagataacaatgattaacttcatcaagcaacattaaagcaacagtgatttattatattaaaagtggctccttgacttgctgataaatataaattaaaggggaaaaagaatataaagggattctagcagaaatcttatagtaagcattttacatacatcaatagtattttctgtattcatcatacaaaaagtgaagaatgaaagaaagtggtctcaatttacacatgagggaatataattaaaagttttctgtggaataaagaaaacacatgtaattgtagtaaattaacctacctgtagaaatgttttatttacttatatttatattttcaatacattacttctaaaaatagtagtttttatagtttgcagactcctttgaaaatacagtaaagatgctggtataccttccttgatcaaatgtaaacatacacatttaccttgaaacttgaattcaatttcagaaacatcatattaactaatttcccattcaaaagttcatgtttaatatcctcaataaatgtaaacaaagtactttatacactgtactgtgctgaaggggttatattatgcatattctattttttattatatgtcatgcttagagtgataatgtccatagacatagcagcaaaaaataattgagaatgaaaaaggaaatgacattaatgcaactaagtcctgagactggctatttgggggtggacagatgtggttgctggaaggaaaggcattttatgacatgattctgcgacttgtataagcctgacagacatattcctaaaggcaaaggagaaacatttgcagaaacagtcaaaatgaatggcatatatttatagagagctattcaagccagacaaactaattctgttttgtgtatggataaaattagaaaattagaggatggggataacagaggagatatcaattttgattatacttaaatcacttaaaatgtctcaggaaatcttaattaaaatttagcacaaattggattcaatattaacattcttcctgggacttaaattggctaaaggaatgtaatgataaatggcaatgcatcaagttaagaaaaggtgttaaggagtgtgcttcagggatgtcagcattatagctggtcttatttaacattttcataaatgatgttggaagggaggataagctggatgataattacattgaagaaggtacccacctgggagatgctagaaataccaaatagtactgcaaaacacaggagacagaaacacccactaaattgcagagatagtcaaccacagttgagctaaggtattcagggaacacaattagctctgcagaaattattaggaggtagaaagcttaacaagtacacaaaataaggattctatgtttaagttacctagataacactatttttcagtcttttactactaaataataaaataatgggttatgagtcaatataatttgtttgcatgtatgctaacaaagatattttaaggaaattaatcgtagtccaccgtcagaaaaataagctgagacactgattctgaatacccaaatcataatagtgtcttccatgtaagatcccgaaaactcaagacctttttttttttaaacctcaacattagcaggagaattgcttgaacctgagaggcagaggttgcagtgacctgagatcatgccactgcactccagcctggcaacagagtgagactcttaaaaaaaaaaaaaaaaaaaatccaaaacctcaacgacattacacagtagatgtccccttctgaagtctattagatgatgttgaatggagttgtagttgctaattttggagctaacctatggcaagaatttaattcaattatagttcaatgactctgtgaccagtagatagtgtctatgagatggaaatatatgaagctcatttctaatttagcagggaaatctgcttcctaaatgaaaagggcatttatttacatggggaggccaatattttgcttacaagtttcagatgaaagtaaaaacaatactataactttaaagtgtttattgaaacattgtgatatctaaaaggtaagaaattgtgagctatttgttttttttatttcttttcgatgatgttttatagttctattcaggaactttagccctaccctttcataattccttcctctcagtgtttcaacatgtgcatattccaaatgtccccatctgtattagtctgttttcatgctgcttataaagacatacctgagactgggtaatttacaaagggaaggtttattggaatgccacgtggaattccacgtgggtagggaagcctcataatcatggcagaaggtgaaaggtgcatcttatgtggcggcagacaagagaagagagcttgtgcagggaagctcccctttttaaaaccatcagatctcatgagacttgctcactatcacaagaacagcacaggaaagacttgccccaatgattcaattacctcccactgggtcctcccacaacacgtgggaattcaagatgagatctgagtgggaatacatccaaaccatatcattccaaccctggcccctcccaaatctaatgttctcacatttcaaaaccaatcatgctttctcaacagtcttccaaagtcttaactcatttcagcattaactcaaaagtccacagtcaaaagtcccttccacctacgagcctgtcaaatcaaaagcaagttagttacttcctacatacaatggagatacaggcattgggtaaatacagcctttccaaatgggaggaactggccaaaacaaaggggctacaggccccaagcaagtccgaaatccagtggggcagtcaaatattaaagctccaaaatgatctcttttgacttcatgtctcacatccaggtcatgctgatgtaagaggtgggtttccatgctcataggcagctctgtccctttggctttgcaggggacagcctcccccccaactttgtttatgggctggcattgagtgtctgtagcttttgcaggtgcatagtacaagctgtaggtggatctaccattctgggctctggaggacagtggcactcttctcacagctccactggtcagtgccccagtagggactctgtgtgagggctctgactctgcatttcccttctgcactgccctagcagaggttctccaggagggccctgcccctcagcaaacttttgtctgggcaaccaggtgtttccatacatcctctgaaatctaggcagaggttcccaaacctcaattcttgacttctgtgcacctgcaggctcaacaccatgtggaaactgctgaggcttggagcttgaaacctctgaagccacagcctgagctctatgttggaccctttcagccatggctggagtggctgggacacaggacaccaagtccctaggctgcacacagaacagggaccctgggcctgcccatgaaacaattttttcctcataggcctctgggcctgtgatgagagaggctgctgtgaagacctctgacatgccctggagatattttccccattgtcttggggattaacattcagcttcttgttacttatgcaaatttttgcaggtggctttaacttctccttagaaaatgggattttcttttatattgtgttgtcaggctgcaaattttccaaacttttatgttctgtttccattataaaactgaatgcacttaacagcacccaagacacctcatgaatgttttgctgctaagaaatttattccgccaggtatcccaaatcatctctctcaagttcaaagttccacaaatctctagagcaggggcaaaatgccaccagtgtctttgctaaaacataacaagattcacctttgctccagttcccaagaagttcctcatctccctctgagaccacctcaggctggactttattgtccacatcactatcagcattttggacaaagccatttgacaagtctctaggaagttccaaattttcccacatcttcctgtctttttctaacactccagactgctccaacctctgcctgttactcagttctaaaattgcttccacattttcaggtatgttttcagcatcaccccactctactggtatcaatttactgtattagttaattttcacattgctgatatagacatacccgagactgggcaatttacaaaagaaaacaggtattgaaattacagttctatatggcggggaggtctcacaatcatggcagaaggtggtagcagataagagaggagagcttgcgcagggaaacttccatttttaaagctatcagattgtgggagacttattcactatcatgagaacagcaagggaaaatcttgcccccatgattcaattacctcccaccagatccctcccacaatacttgggaattcaaaatgagatttgggtggggacatagccaaaccatatcaccatcaatcacccatgtgaccacaaaataatctaagttgctcctaatgtttccttttaaattttggctgcagtttactactctctttaattgctctttcctggttctgataaaaaaaatacagcttgatataaaaggacaaatataaagatgattgaattgtgcataagctgaacaaaaacattcaaattggagtctcaaaaatgacacagaaagccacagttgatataaaccatatgcaagaatataaattgtaatgcaagagtgtaaacacggtattttatatgaataaatatattttttattagaagtgaattatgggccggaagctgtggctcacgcttgtaattccagcactttgggaggctgaggtgggcagatcacgaggtcaggagtttgaaatcatcctggctaacacggtgaaaccccatctctactaaaaatacaaaaatattagccaggcgtggtggcgagcacatgtagtcccagtgtttttgggaggctgaggcaggagaatggcatgaacccaggatgtgaagcttgcagtgagccgagattgtgccactgcactccagcctgggtgacagagtgagagtctgtctcaaaaaaaaaaaaaaagtgaattatggcttaattgataatgcatgaatgtgttgatcatttgatgtttttgcctcttgggcatccttggctcttgcttccagtaaaagtcccttattttcctttggggagcaattggcaaaaaaacatgtcaagttattcaagttggtatagtcaaggtgactcctagaactactgtaaaagagtgtttttttcttcctctagggctaaactggtaaatttatatctggtgtttctgctggctttccagtcttcattggatgtacctaagactgagacccatacagaagaagacatgtcaagaaataagcagaaaatatcgctcatgacatggtttctgcttatgcctgaaaccaaattcaccactttctgatagattaaaaattacatattttaaatgctaatttattttgaaattatgtctttcaa

SEQ ID NO: 198 - DNA, 10070 bp, Homo sapiens
gacttttattttttgtgccattaaatgacatccagagacttccactcaggacctgaaaagccctcgttccatcacatccaattactccgggaggagatttgctgagtggctgatactgcgggctccagaggctttcgggtagtggggggcactttgactttggcaggagtgagagggaggggatgccagcagagtttcggggtggtgaggggtgacctgcgtctcctctggagagaggacccaggagggctgaagagtggaagctggttctaattatccagccagtgcatcccctaggcctcctcctcccttctgcagctggggttggggcaggaaagggatcaggaggatgggagacttcaagctgccagtttagcttccagtgataaattccaatatttggtagtggcaacaattggctggagtttggggtagaatctgggggcttatctgtgtggtttcttcacgatgtgttcaacattgcttgggatggctgatgttcggctggactgggacttgcttcttgaggaggtccgcctggggctcatggagatttcaggcagttcccagcctgggtgcctgtctgagtgttgcccgggatggccccagctgggtggctgccaggcccccagttctacccgctcggccaggtgggtggggccctttggaggaagagcgcctcctgccacaagcccacacagtgatcaggggctgggccctgggggatgctggggctgggccaggtgaaccaccatgggaggtcacgagggtgggctgagtgtgtttgtgtctgtctgtgtgtgcgctggtggggggcagtctgagggcgggggctggtctccaggcagggccccctttcctctcaggcctcttccctccatgcttcctgacaccatgtgctgctgtgttctgctactaggctggtggatttcctcccagcctcatccctctgcagcaacatctcctactcttgaagctgcgtggggctctgctgcccttggccccatgattccccttctttctcacccaccgaggcctgcatgccttcagatgccacaagcaagacttcaaccccctatgtggcaagtccctgcccgtctctcctctctgacccctgtgggtgggtggttccacctctgagctgccgaatttgggtgcctgtggtgctagggagcggcttatggctgcctggcccaggactcccattttgcagtgagcaagtttcccctctgagggccctgaggctgccctggaggtggtgacccaagcctctcttgcccgttagtttccagcacgttgacaccatcctgggcgctcggccttggagtggcttctggagcaagctgtggcatgtcctctcgtggggcagagaggggatttcccctgctcgcttgcaagaggagtgtgaggctggcttgtgacacctctgggtgaggtgaccgaggtgtggtgtggcacagaccgcagctccccaggattctgaggctcagccacagccagggagggggtgtgtgcgtggaccattctgggcagctgctgctggccaaggaggcctgggacagcaggatgcaactgtgctctgtctgtatccccactggggcccagaagtctgggtcaggagagcggggatgtaggcaaggcggtggcaggtgcaaacagcccttccctggaagtcagaagaaagtcaaatggctgttaactgtggacgcccttggtaagtcatgccactcactgtttcaggctttgctttcctcgtttgccctggggtaggggtgatggccactgtcctgcccccttgacatgggtggcaaggggaaggccagggaggggcagggtggctggtggagaggctggtggagaggcagccctgcctgcctgggattgggacagggaggacgtcgatcaatgcagagactgtcacttgtgggcatggtactcacagaggtggctgccttctcaggtgctgaggcaagctgacgtgtgtttgcaaatgtgggggtgtgagaacgtgcagatccatgtgtgtgaatggcttgtggatgtgcatatgtgggtgtgtctcacacacagacacactcattaactgaaagccaacagtgggctgggcacagggacaggtgggagaagggaaagaaggcagaggtgagcgcttctctcaaggaactgatagtctcatggtggaaggggggccgccacgagtggcaagtgatttagaaatacaaaagagatcaaagcagatgtctggggaggcacaacaaatgctgtgtgagtggagaagacgatagagactagagatgccaacagcaggttgggggaagcctggctcagcggatcagccttgtggggttgttctagaggatgtgatggagggccagcagccgggactggtgcttggaaagtgggcaaggcattgcgggtctgggaaggggagaatgagacgcccagatgggcagtggtgggcaggcagatgtgagcaaagaagtagttcagggacgtctggcagtgtgccgcacacaagggcaatggtacaaggtgcaaatgaaatctgcctggaaggaaagatgtccccctcagaggggtgttcacttagaatcagagggagacagcccagcatgtcacaggcctgagataatggcatctgcaaatctggaaaggcaaagtgtggcctttgggacaagcgtcacatagctgtcctgtgacgctggccggccagcccttgtcagaggcaccagttaaggctgtttagatttcaggggtctctctgttcctcctatcttggggaccagttatgcttgtgctgtttgaatatctcccctgactctctcagtgagcaccccctatccatagagctacaccagggtgactccacacatgcatgagagcagggacaccatcacatggtgacttcttacagcacccaaaacagcgccaagtatacactaggcatctggcatcagctgagcgaatgcagaaggcattactgagttatgccaggcgtggtttgaaagtggccagagaggaaggagctgtgcaaaggtaggaggagtggggtggcacggcagggtttcatcagctagaagtggggtagctctaagcccctccacgacccttgctgtgctcctggcctcgtggggtctgatgcaagacctctactaggaagtatcagggctggctgggaaagtcgagcctcatcagttggtccctgcatttatttggcagaacagggaggccaggacattccgggaagctgggagcaaatcaatttcaggtcattcaattgcagatcaactagtctaaccctgtatcttgatgaggtcaaaattgagacccagggaggggaggtcacctggccaaggtcaaacgatcagagtcgggacatcaagatctcatttgctgaccacatgtacattgtcctgtggtcacagtaaaaagaggaatcctggggagggtttcacctccttgggtctgaacaatgccatccccacatccccctacatagtcatgacaggctctactagaatcatctcaagcctccttcttcaccctaagcctgtcatttacccataagatccagggagggaagaggcctgaacaggatggggttcagtggcccgtctgccatagacgcccctctacctggctcctgtaggctgacctttcccctcgagtctctagaagcttttcctgcctgttcacccaggggacacaagcagctggttataccacactgcccccctcccaacccctgacaccctgcttcctccacggattctctcccctggagagaaatctagatcaaggcaagtcctgggacctgtgttcattggcaggaccccatgctctggcctcccaagcactggtccagccctgggctccgtaagtccccaggcaccgtccaggtgcttcagagagcaccaggccctgagtgtttcaacatcgtgcaaggacctggggtttctgcttttgcaatcgcccctgggttcatccacacctcactgcctcatgtctcgacccctctggtggtgtcctgtcctctcattctggtcagttctgcctgcccctccaggttcgtcgtctccaaagagtgacttttgagtgttgcttctctggtaaataatttctaacggcttcccagagtcaacctgcaaaagccactcctctgccggacttctgagaaccttgtttttccccttcccctccattttctcacttaaaaaaaaaaaatctatggtttctccaacccagagctccctcttccttcactcaaggattcagatctcctccttctctagggcccagccctgctccaacctcctccccatggcctcagggccagagaaatttgtagatcatctggagccaaccccttattttctagattaggaaactgaggcccagcgaggttcattgattggcctcaaagtgaaactactaactagagagaggggagtccagattgcctcactctacaataaaacacctttatatcctctctggctggagagagcacagtgttctggagggaaaggtatgacaggaagggaagagatctatccctgagtccacagacttccaattgtccttacagttagaatcacacaattaagtgtttaattacaacctgctttgcattgttgtttaattgtttccaaagtagactgtaagccacttggggacagggaaaattcctggtgcccttgattgtgtctcctctgaagttcccagcacagcgctgggcacatggaaggcatcacatggcaagactgggaccttggctggggctttcatctgggagggccatttttttttttttgtttttttgagacggagtctctctctgtccccaggctggagtgtagtggcgcgatctcagctcactacaagctccgcctcccaggttcatgctgttctcctgcctcagcctccggagtagctgggactataggcgcccaccgccacgctgggctaatttttttttttttttgtatttttagtagagacagggtttcaccatgttagccaggatggtctcaatctcctgacctcgtgatccgcccacctcagtctcccaaagtgctgggattataggtgtgagccaccgcgcccagcctgggagggccattttaaaccctgtacagatgcaagtccagtttctaagttccccatggacaaaaggtgggtcaaggggtggggtggggaagtacacaagaccaaacaacgcgtttcaggcccagcgcgttttggcttccttgcctggtcaccaacatcttgggaggggtgggtcaggcctctgctggtccctcaggccactgtggtttctggaggacaggctgtggtcgagcctcaggagccccagcacgcagagtagggaagcgtctttggtgtatgcagctcccttcctctcccttgtctgtccctcctcatggcatctcccgatgctctatccttccctccatcctgccttcagaaagcacttcacccccgagagactcccgccctgggcataggcatggtgatcccggagtctcatggtggggctcagaggcactgcttcattttatgagaaccccatgggtgggagaatgtcataggctgaggtcccgacatctttggtgagatcggtagccagggtgctggagacagtttttcttggtctgggcaagatacataattttgtttccttctctctgcatctaaacttaaaagtatgtctttggcaaagccgtttaaacagattcacggattggcaaggtgctgagggcacctggggaaggttcactggtggtaagtttgcaccagctccactcccagggtggcctggagccctctgtgataggtgggccctgctcggcacatctgaagggccctgtcgctcaacctgtgcctttctgggctccatgttcctctcctgtggggcctccggcatcgcggttgtagcaatacctgtgccagcttcctagtgggtggatgtttggtcgaggtcactgggtgagaggaaatggctgacgacacccaccctcccacttgccttcctgccagcctgggggatgtgcttcttgcacttccagatggcattgttcagtctctattgtcttcccttccctaaaattggggagctgagagtgcaggggtggctttatttcccattttctgcaagagaaatctaaggctcagatggcgggtgggggagtcgggggcatggctcacactgggtcaggtgagacacttgtggcatgctgcagtggccaagtggccaccgctcctgctccctggccctggtggcaggaggaccgaggccaagcaggcggggttcgccattaggaggctatagggagttggtctgctccagaagccaaggagggctgctcagagaagctagtggaggggggatggtgggggacatcttcccctcatcactgagatggcacagccgacccagtaattagcaacccatgaggatagactggcagggtggcattccagggccctcttgcccagatcagactcaattacagagcacaatgacttgccaaagttcaggggcagctgcctgcacatgccatgcaaagtttcggggtactcttctccctggctgcagtcacctgctttgagaccctgccttacataccaacccacccaactggagcctctacactggtctgtgggacttacttctcaagggagaccacacctgatgccaacatctttagggcactccttccagttcactcccaagaaacaccagccttcgaccccagtctccaaggctcatgagtgggggtcaaggccccaatttccccgtaaatgcctgaagcgtttgttccaccccagaattcaccccggtggtggctggaaggatggggaggtcttacctcgagttttgttttccttgggaaggagagagatgacttttccttcctgaagatagacaaagaactggtagcgatggaagccactgtgtgccggtggggagggagcctggtaggctataggtagaagcaggagagaggtgagcatcaacatcccatactaccgagggcagagctctctgccttcccatggtcctgctgacctccctggggccccagatcagcactcggccctgcaaaacattaggatttgtatttggcgggatctcagcttcagtattttcatttaagaagtacatattttggtgggggtgagagtgggggaggaggtggtccaagaggaaacaccctgagctggcttgaaggccttgggtgctggcgtggctcccaggcctttatgggccagtgggtgttggcattgtcctgtttttgctttagtctatcctgatggatttcctgcctcaagagaagcccatcttcctctgtgagtgtgtttggcagaggatttttatttattttttcggcatttgcttatgaactcaatccccaaagaagccaatttcttggctgcgtctggagggtctggaagtggttacgagggtgggtgggactgggttcaaaggtttgatcatgggagctgtaggagctgggtgctcggggcatcagggagaagttccctctcccagtccttctctctccctccaggaggctgagctctttttttggggcgggggaagtggggtggggacatccctcattctttccccaagtccatgcagagtcaaggtcctgctggcctggcctaggtctttcaaggtgggcctctttcccagagtgcttcaccccttcccactccccttcccgctctccatcttcctttccaaggaggagagccaggctggagccaagaatctttctgggtgggtgggaaagaagcatttgcaatgaggatgttggtgggagggagtattggtcctttatggccatctccccttctttcctctcctgatcattaaacaaaagcacgacttgctgcttggagcactggaagagtccctcactgtgcacttccggccactggtggcttccagcatgccaacaaccggggaattcctgacgattcatctttccctgcatttttggatcgcagatcagatatatgtgtgtgtgtgtgtgtgtgtgtgtgtgtgtgcacgcgcatgtgcactcagagtgagagcagagctgggtgtgctgagagccatgtgtgtggttggaggtcccactcggggtgggtgtgtgtacatgaacagccagtgtgcaaacgccccgatgctgttttggagggcctgtgtgtgtgtaaatgcaggtaaaggagcatttcttcctaaacaccgccagggctgagaaagacttctgagcacaggtgggtgccagggagtctcctcgtgtgcttaggtatggagggcagatgggacaagtcagtgtgggcaagatgtgtgggcatgtgggctgtggagtacactccaccgtgggcacacttgacgctgcccaaaactggtgacctcagttctgtgcggacaagtctgaagtgagaactcactggatttgtgcaatggagaatttatcctctatctcctcaagggagatagagactaatgcctctcactagggctttcctcaagaatcccctcttcaaaacctccaaaggcagagaattgaggcgtgaggaggaggggaaagggttcacacatgctagaccacttctccgggccaggccctgggctgtaggccttcacttatgacatctcctccatcttcccatttcctggaggcttgagaggtaaagccaggccaacagtgagtggtggtgctgggatttgaatccaggcctgcttggtgcccaagcccacgctgcttcacggaactgcagggctaagtttggtgcccagtgctgtgccagaggccagcccagtacctgagcatccctttcaaggtaggttgggggcatcctcctggggcagggatctgagagaggggagctgggggaaggatgggggtggacaggggttacaagcagcctccagtcagatggccccctgcactgtgaagctggctgcattctttactagccattcacatggcgcaggatggtctgtgcctcagtgttatcctcttaaaatggggacactgatggcagtgaccataaaaggcagttgtggagatgaaatcagggcatccaagaaaactctcaggctggtgctagcacacgacaaagcagcaccatgaggttttgattcctgtgatcgtcactgatgccctggctgggggaaggggtccctagggtcttactcacctgataactcctggccctgaatcttccctttcttcaggtcggcgccctgaaagaagagacaagcagggctgtaggttatgtcttgggcacacttcaggccacgtgggctctgcgggattgcttctctctctgcaggaggaggatgggagaggaaggaggatgggagaagaagtaggatgggagaggaggaaaatgggagagcaggaggatgtatggctgcttttgggagacagggcagtgagtggggttttggaatgggtacctcaggggatccagggaaagaggacagacacacgtattgctgaggggggcaaatggacaccttccctctagagaggccctgtaggacacttcccaaagagctgttccacgatccctattggtgcctgagactgggcgctacacatcacctgcagggtctggtcggatctaagggaggcgcttaggtctgcagttctctggatcttactaaggagcccatcttctctggagggaggactctgctccctttggagcctttagaatattaagcaatgggctcagagcaaccagcgggggaagggaaagcaggaggaggctacactgcctgattctgtggcagcttctccccaccctcagttaactcagcccacaaccctggggcagtttctttggccactgggacagcctcagtttccctcctctctttccctccctcctcccctccactcagtgtctatgggataatgaggtgaccccgggggtgggtgctaattactgtttgtgcaggactgggagatgctcagatgaaagagactggagccgggcccctgggtctgtgccatggctcaggggccccaggccatgccagggagccccaaggcccc

SEQ ID NO: 199 - DNA, 11026 bp, Homo sapiens
cgcactcctcataattaaaatgactgattacttgtcactaacggaaatcaacttcgtagaaccagttgtgacacagatacccagcatgaaaccatagtaaatatagatcttctcagataactttttgttctgtgcacttttgatacaattcatgtacttaaatgtgacatgagccttcaaattattgagccagaaatcaagtatctacatgtctgtatatatctttgtcctagaaaatcctcaggagacctcccttaacaatcactgctcaaaaatgactcacatatccacgtgcaaaccaatcatttgcaaaggtaacaggacaggcatgattggctctgaccagccatttttcaccactttggaataggcttcacttcccctgaagcacatgatccccaaaaataatacctaaataaaactgaaattctgttaaagtgtgaggtaggagaaatagccaactaatggtgtctactatactcagacaatgtgagtatattaaaaccagagacttcacctaaattaactcagtggtacaaacagaataatttaaaactcaccttcacctaaatttcagataattatattattttccactcactatagtataaacatgaactgaaactaaattaggtattttgtccatctagatttaattataacatatgtttttatttatttactttttttcgggggggggtggtctagtttactagaatgtggcttctgtaagggtagagagagcctatttttgttgcttccatattttcagtacagagtaagaacacagtatatattttctttaaaaaaatgaacttagaacctaagtttttaagtatattaggtataccacttcagagcagatatacaattgtctttattatgttattacttatattggataattcacttcaacaatgtttttattgtgtcactttacctgtagcatattttaaaaataatgccccaaattcactactcatcttttaagctaatatagccttattcactgctatttcaaagtcttatcttactttgtcaatcttattctatgtcacatttcttctttcccttcttacacaaagcacatatttacatttaacttttatcattctgcgttatatcatggaccaaaaaaaattaacttgtatgcatggtagatgatctaccattacctaatattgtatagcaattggtagaaacacctctttcacaatcatgggctacttcccatttttaaaatcatctttccttccttcaaacaccacagctgaactggtcctgattcagtgctgtttgcattaatatttttgttgctctaagtataaaatgagaagaactgcttaactcatgctctgattaaattctggaaaggagatttcaggcttcaaggctaaaggcagcaactggaattgttaaacattaagtatttattactcccttccgctcgtaaatcccttgcctcctatcactcagatacgctctgcactttgtttcttctgagttttggcttacttagtttgtttcctctacttagactgtgtcttcctcacatatgtttcactttggaaaaaaaaatctaaccacccttcagtgctagtcttaaattcttcatcctccaggaaacctttatgttcattcaccaactgaaatgttttcttcctttgaatccacaagacaatttgcgctctgctacttgactttattattatagcatacacttgcataaacacattctttctctctctctctaaactttctctctctctctctctctctctccccccctctctctgtctgtctctctctcccctctttctctcactattgtataaagtacctagtatattatattgcatgaagttggtttcctagaaaggacccctttccctagtctgaattacccactgatagtttgaagggggagggttccttagagttctcagtagtctggagacacaatcaatcccaacactgtatacttcatctgaagaagtccatgcattctgtccagggcatatgtcctcaccctgatgcttctttcaatgcaatgtctttacacaccttattaagactcagtttctcacctgacttttacactactaccaaactttcgccagaatcccttggaaatcacagaccatcatcaacaaaatcccctaaatgttcaactttccctctgagtattacctatactttttgattccttctttctccctctaaccatcctcgacaaaagatgctgctttctgtagatctcccagtagtggctaccataatttacatagcacagagcccaggagtacagggcaagcatccttctgtctcctttgacactctgtcccaattcctctgaagtaaatcccatcagataatgccacccactaaatttccttgttatagtcatcacatgccttttgagtaatctcctttattaatggactagtttaacatttggcttatctttttttcctacatcacactataggattagtaacataagtggtgatgtaaaaatccacaagggcattctaatcacagtagcatctgacagtcaacgatcctcttttatcaatcttgttctttccatggttcagggaccttgcattttccctgtattcctgtcacctcatggcagcaacatctcagtatccccaaacccttcttctcctgatctctaagtgctgaaattcccaaagcttagtcttcgtattttttttgtcaaacccattttcagggtgatttcatcttggccccttatttctctctcaagtctagatcagcatttgcaaatgccttgccaagaattaggtttctgtattgaaaaagcctcccaaaccttgattactgccatcacaataggcagtggaggaggtatggggatctgttcaggacaaaaaccaccaagtcattcttgatttttcctaatgtcccatgtatgattcatcggcaaatcctatatgttctatcctttaacccccttctcaaggtctccatagcctatcaacgtcgttcaagctaccgtcaaatttttcctggactcgtcatgcattaaactctacttgtccaaaacactgtgttacccattcccaacatcccccatgcagcatctacaataatctttttatattggatgatgtcataactgtttaaatcattcaaaggctttctttccaacacacctagaacgaatcccatattctagccccaggtacatttctgatctcatttcctaccagactttttcattcacactagcctccagctccctgtctacctttagggctttacagagaaatcccagaatgctgctcacttaagaatccatgtcttgatcttttcctttattcaggtcactgtttcagttttatccaaaaagaactatcttaactttcttatctaaaattgcaccactctcattcttcccttatcaaacttttttgtttccttagaatttatcactacataacttactcatctattcatttcttcaactagtttgtctgcattactcgggtggaaactttgtttgtttgtttgctttgtcaattgctctatatcaaacttctagaacagtgtttagcacattataggtactcaaacatatttgactaaatgatagaactaaatcaattaagagttaatgagactaaaatataaaataagataaaaatcagctacaaaggattcctacttgtggataacaacataaattaaatgtaatgaatgacagatttgtggactacttttagttaaactggtgattcaggtcaggggtctgtacttagcatagtggaagagctattttgcaagcccaacccaattaggttgaattttttttcttactgagagtgtttgataggtgataaaactacacgtaagaagagctctaatcatggtgctcctggtaataggaaaagaaaggcaattactcatgtgcaaaactagaagcaatcaaaagctagatttgccagagatgtttaggttttatgtgcaatttacagctatttacaagttaaccattgaaatgctgtccaaaattaactccgcaattgagaatccaaaatgtttagcatctaaactttttcctcagtaaaattcaatctttaaaattttttcttagtaataaaacattagtaatacacagttgattagaaatagtcataaacatttgattataaactattataagagtaattagtaataaacatttgatgataaataaagaaaaaaattgaaaacttacaactttggtcttagatactgcatttttgaaattccaagtaagccaacattctctgagacatcaaggtttttgtaacttttagtaaagtactaaaactggtagtgttatttttttactttcattcaatcagcatttaaaattcacaatttcagaaaaaaatggttaatttattccactatttcttctattagaagtggtaattttatatttgtcattagagatttcattttgagaatcttttgagttatcctactggaggaatacaaaccattaagaaaagatatacatttcaacatcttattcaatgtaaaacatcgtaagtattttgttaccattttcatagtaaaatgaaactcaagaagttgcttagtgtttacctgatataatctgtattgagtttagataactaaactaatatagctccaagtttcaggcttttgtttatacagcataagtatgcagttaatgcaaactacaggcttacagcttatctgcaaaacctgagcttttactttagttctgtatattaacataattccgcataccttcactctgagtacagaagtaaacattcttgcatcttcagatacacctccgatgtagaattttttctgaaacactgggggatgattattttcatcctgaatctcaatgtatactttagctgtattgcctggaggacaagaaacgatgcattttttattggtggttattcatgggggaaaaaatgcactgaagtaaatatttgctgcacttttttttggaaacattgaaaataaatcaaaagccatttctagatgccatgcctagcacccccaaattcaggggacactgataatgatgcttctggtataaaaatgttaagttgctgttatttcttttaattacaatgtcctggtagttcactttacttgatttaatttggcactaaaatactgcaccctgttaattttaatgaaacaactctactgttcacgttcacaaacacttcacacacaataccagttataccaaagggacacaaatatataaaccccttatgaaatagtagaaactgccataaactattatatgaatatatatttattcttaagtataaaatcagcaatggcatttctttagcttaaaattgtacaataacttttatgttttaagactaaaagtaacagtgttcgggtgaggtgtttatttccacaaatggaaaacaagttttatcatgccttggaaactgtcaatgttagaggctaacattcattgaaaacaatggagctgaagatatgattatgactcataaatgctgcattttaccatttaaataacagtaaatgtaccataaatgatatgtcatcatcaaatgttagaacctccctcaaatcatcacacctttaatgagaaatgtggtacttgtcactagtccaataatgaccttttaaaaaacaatttaatatgtataaaaataacttataaaccaaataaaatgggaaataagtggctattcattttgtaaaaaaatagtcaaataagtattgctaatgtattacataagtcgacttttctgattcatttcagttatgaacaaacggcaattaacgtacatactatttatcaaggatgcccttattttggtgttttacctgtgtttaatgcctcctgtacaattttaagtaattaacaccagcctacttgcaggatacatcatgggtatacatttgtatttgttgaataaattaatgaatgaatagcttgtattagtaagaacttagaaatagtcttttttttttttttgcttgcccttggaaaggtcagacagaacagtgagttaacctcaagattttgctcctatcctgctgctactcattcagcttttctctgtttgtcatctgtgacctggaagaggtagaatcaagaggaaaatcatgctagcgcaacagattagagaaccaacagcgaaatagggctaatagcagattatgcttctctatcctgcagtgccagggctctgacttgtaccttagtcagccaccacaaatcagaattcacccaaaatgaaatcatttttagttcagtagcagaccacttttatctctagaataaaaaatgcgaacagctctaaatttaaaaataaaaaggaattttagaatatgtcacctttccaataacttctttgcactttcattcagaaacatatacaattcaaatgtgctatttcttttcagaactcttagagtgacagaggtctcggaaaaatactgatgacgtatattttcttctttaaatgggatgagtcatttaaaatgttatacaatttgcaaagaacaagaactttgtcatgacctgttcccttacctcccaaccctaacttcatatctggatggtaaccaaatcctacatgtcagcctcataagcaggtaaatcatcacctaataaatatatcttgtgtcatttttctctcaactccacagctgcccatatacttaagtctgttgttgtctcacctgagtgactaaacgtcatctgctcccctgtcgtgtctttctaatgtgtcctgcattctgatataacaaagacatcacaaaatacaaataggatacattaaatcaaatgttaaaccaaccaccattcatatgtacatttttttctttttcttgttttttgagatggagtctccctctgtcgcccaggctggagtgcagtggcacgatctcggctcactgtaagctccacctcccgagttcatgccattctcctgcctcagcgtccctaatggctgtgactacaggcatgcgccaccatggctggctaattttttgtgtttttttagtagagacgggatttctccatattggtgaggcttgtctcgaactcctgacctcaggtgattcacccacctcggcctcccaaagttctgggattacaggcatgagccaccatgcctggccgacaattcttaaaaataccatgtgtatattcatatccatacttatatgtatactttgtgcatataagtttaagattcaaataccaaattgttcctatgaaagctcctttgattcagtggcctgtatcagatattaagtggtttgtgggaaaaggcctatggataacccaaaatatgattatataacctgaacataatggggagagatgattatacttaattataatattttaattaaatgatatttatttatatgaaaactaatgactatacaatacaaaattccagaatacttcacaaccagcacacaaacaaaatctcaagaacattgtttagacttaaaagaacttatacatttatttattttaaaaagccacgatcatttagttcttttcacaaaagagaaacagttataatgcgatttataacaatactgtatcatgaattttgaaatttatgatgttagctatatagctaattatgtaggatagtttgtaatagtcaactaaaaataaatataaagttgtgaaaaaggtgttttcattaagtttgtgacttagatgttagaataaaaaaaattgttaacttttattttccataatgtaaaatagactagtcttcctttttttttgcttctccctgataactttaggcagttgttatgtatccctcctttgaaatgctatagtgcactaaaaatgtttctttctataaataacctttccagagcttggtttacattgcatttagttataagcatgattttattcttattagatttcaatattcttaaagatggaaattgtatctcctacatctatcagtactataatgcctcagtttgtaggtaatttttccgctcagatattattgtaacaaaatttcttaatttttgttgaacaaaaaagttgatattcaattaatttgttagctttctttgattataatcatgagattatgattaactgaaacaaaaagttaactcttagaaggatatgagggagctcactaaatcaaagtgaagtaagtccaaagaaggcttttggtaccacaaaataatcaggaagttgtagagcctttaaagcagcagatgtttgattttcttgcagatgaaataacagcaaactctcttcttttatgttattttaccccaccccttattcctctttttttttttttaaagaaacaaaccaaaaaacaacccactaggcttaagaatcataccctggggacacattacctgactgtcctagtttgggtcatgtgcttgctccttgtctcgggaaggagaagtcaccagattatccacttgagaagtcactgggacaattataagaaattgtagtgtgtctacttaaagaatgtaaaataaatgttggccagtaagaaaaggaaaagcaaataagtatacacctatagttaaatcactagaacagcgttctttttgacttttttattcatgtgtatacaatgtacatgacatcatcaatttccttggctcacgtgcttccccactaaggattgtaccatgttcttccaccaaatttggatattgattatttcaaggcagaagcttggaagcaactctgatttaaattcttttaagatagcctgctttttatctccttgagtacttacaaaaactttttttccatgttgtatcctttatttaatgtagacatcaaacacataacaaaagaaagatactagaaagagaaaggaaagcacagatagaaaaataatgttaagggaacaacgtgcgtgcctaatatcctagtattcccctccagtctcccttctggctcatctaaacaatgcaagtattggaaagagaaccacaaacagtgaaagaaattacaaagtaggcaaaaaagttatttggaaagtgttttggttaagagacattataatttttctgtgtgctttggggcaccctgccttatttttcttccattattaacttttttctccaattttctatgggacaatcttttctttggctagaacttttggctttagtaagccagaagttttaaaaatgactcctgaggtaagaaaatgtgagataccttcttgcaatgttttaaagaaagagaaaataatacttttatgtagtcaagctcaggggaaaatgtaagtcttagtatagttacctccttgaatagcacttctgttctattttagacatttaaacatggtagaaggagttcagaagagtgattttaaatacccattaacctcaacttgactctatgatttttaagaccaaatttagtttgatttttcccttcccttacttttaataatcaagactgtgatgctagttttttctttttaggaaggccctattatcctcaagatgaatccatttcatttatccacatgactaatctagtgcctacactgcactggattttcaaagaaagccttactgaataagaagccaatgagttaaaagtgttctcaactgggatcaatttggctgctctagagccatttttggtagtcacaacagtgtggataggggaacgtagtgctactggaattaaatgagtagaggtcaggaatgctgagaaatattctgtgatgaacagaacaggctcttaccccaaacgaacaaacaaacaaacaaaatatttgggccaaaatgccattagtgatgaggctgagaaaccccaagttaaataacaagagaaagaggaattagatgagttaagataaaatggaaagtttccaaatgctatagtaataccctctcctcaatccatctgcatgcacatgcctttaatgtggaacttatcaaaatatgctgtaattatttgatcacacattggttatactcttttttgactgtgtcctataaagtcaagggctcaagcctgtttacctccactcttgtcactgccttctggcctctgttcctgacattctctccatctaaaatattcttaattccaagccatttctctagtcattgccagtaaatatacatcacagaaatatttattcctgtacttgggaatgtagaagtttagtctgattaaaaaacatacactagactatattttcctcaaaccttaaaggaaaggactgtgcttttcttattgttacgtatcgttgcctaacacattaaatgatttttaaaattgttatcatgataaatgatttatagattcttcaaacagtcctattgcagagaattttttaaatgcttggaataccagatttatatttgttaatttgttggtatcaggagattgaagtcagttcctcactttaaaaacacacaaacaattttttatgctgtttttcttttaagacaatttttgtttaagctttacgggtatattaattatggaagcattgtgacttccacatagtaggtgatatggtttggctctgtgtccccacccaaatctcatcttgaactataatcctcacgtatcgacggaagaacctggtgggaggtgatcagatcatgggggcagttttccccaatgtgttctcatgtagtgagtttgcacgaaatccaatggttttataaggggtgcttccccctacactccctctttcctgctgccttgtgaagaaggtacttgcttctctttccccttccaccatgattacaagtttcctgaggcctccccagccatgtggaactgtgagtcaattaaatctcttctctttataaattacccagtctcggttatttctttataccagtgtgaaaacagactaatactgtaggtgttcaataaatgttaaattaaattgtaattgctaccacttcactactcccaagggtcctcttaaataaaataaattactctattttattcctg

SEQ ID NO: 200 - DNA, 13160 bp, Homo sapiens
gctcttgcatttagcgtctttattgtttttcatgacaaacctagagttgaaccaacatctggctaaaaagcaaatgcaccatgacaaatgttcatggatcagcaaagtgctaacccagttatggaagtctaatatagtgttacagagtcacaggcttagctaatatgtaaatcagcaaacatgagcaataatgatttatatttgcatggcattctatagattatgaaacatttcatatcaatctcatttgatttttccaataaccgtagaaagtagacaagtaggctgggcattgtgcctcatacctataatcccagcattttgggaggatcacttgaagccaggagttcaagaccagcctggtcagtatgacaacaccctgtttctacaaaaaaaattttttttttttaattagccaggtttgttggcgtatgcctgtggtcttatttacttgggagggttgaggtgggaggatcacttgaacctaggagtttgaggtaacagtgagttatgattgcactactgcactcaagtcagggttacagagcaagactctgtccccctgtctccctgtccccgacccccaccccccccaaaaaaagggccggcgtagtggctcatgcctgtaatcccagcaatttggaaagccgacgcaggtggattacctgaggttgggagtttgacaccagcctgaccaacatagagaaaccctgtttctattaaaaatacaaaaattagccaggcgtggtgttgggtgcctgtaatcccagctactcgggagactgaggcagaagaattacttgaactcaggaagcggaggttgcagtgagccgagatcgtgccattgcactccagtctgggcaacaagagtgaaactcaaaaaaaaaaaaaaaagaaagaaagaaagtagacaaattatgaaacagattcagcgacattgcgtgataactcagagtgaaaaggaactcagatttaatgtcttcagtcttttagcagctaaatgattattttatctctggaaaatggttaccttgctaaaaataaaaaaggtgagcggttattaacgtttatcattctatgatgcactgacttggaagatcacttacaattaactgtactttgtaataacatgttctgtcttctaaatattgtatttttatgtcagtatgatggtaaaaataatataagcattttatataatggttttaaaaatcaaaataaatatgggcctaattaagttataagttaaaaatataatcttaaatttttgaaatcttagaaactgcaagatgaatcagttatctggttttcttggattaacaaaatttttaaaaaacaactcttggagtagcagggaaaataagtcttagtaaaaatgtgagtatatatgagcttgagaaaaataatgaaaagtatacatagtgctctgtaaatggatcaaatcgtgttgaactaaatatttcaatggaagctacgaacatgtagatgactattacaatcgttgtatcatctaagacttgatctcctgtgtgatcaaaccacttctgaggaattgccagtttaccaacacattgctgtatcagtcttggacccacgtaaaacattaatacaacatactgcatgattcagctagatgacattctggaaaaggcaaatctatggagacagtaaaaagatcagtggttgctaggggtcagggtaaggaggggatgaatagtggagggcagaggatttttagggcagtgaaacttaactgtatgatactgtaatggtggatgcatgttattatacattagtccaaacccatagaatgtataacaccaagagtgaactctaacataaaactctgctagggaatgttgatggcaaagtaggttatacgtgcatggggacaagcgtatatgggtaatctctgtaccttctgctcaatgttgctgtgaacttaaagctgctctaaaatataaagcctactttaaaaaaataacataatgagctaacaaagaccacaattctaggtcttcctcagaagctttataaatatgcattaaaaaattattttttgggtatactctggcagaaatacaagaaaaacaaaggcccagaatttttccaggagaatagatccagagcgaacatgaacttacttcacacccagattgagtttcccatgaacatgactcgttctcctgagggagaacccctctttggaaagcatgttcacccaggcatgtttgacacaaggaagactcgaagtctggctcccctggagggatgtgcaccatggaggagccggtgtacttcaggctgggactctgatgcttgtccacactgaccattgggctcttgatccaccttcgtacctgcaatgtgcaaaaggaaagaaaaaacaaatgtgtttgactccctttgatgtttattggggatttggtgggaaatctggtgggatgggagctcatgaaaggagaactcggtctcacaacctgtctatctttcaaactcaacacaattcgaattggtcaatgctgttcagtctctttcctagagtatgcattacatggctggtcatttcatcttgctgagtctgtctccgcatttttttttcacattatttttttcttttctttttcctcctgcttccagtggggttagaatttttttctttttagagataggggggtttcactctgttgcccaggctggtcttggtgttaaaagatcctcctggaccagcctgccaacatgatgaaaccccatctctactaaaaataccaaaattagccaggcctggtggtacacgcctataatctcagctgcttgggagaatcgcttgaacctgggaagcggaggttgcagtgagctgagatagccccgctgcactccagcctgggtgacagagcaagactgtctccaaccacaacaacaacacaacaacaacaaaccctcaaaacccaaaaacaaacaaaaacaattaccctggccaggcgagatggtttatatctaaatagcactttgggaggccaaggcaggaggactgctttagcccaggagtttgagaccagcctgggcaaaatagcgaaactttgtctctacgaaaaaaataacttttttttttttttaaagaaaaagatccttttgcctcttaaagtgttgggatcacaggtataagtcactgtgcccagcctgtctcctcatttgtaagattcaggtaataatatttcctcccaagctgtgaaaatgctaccatgttttacaatgttcaagtactttgcctggcacatgtttggtgcccaatagatagtgactattttactttgacccttattattatgattatgatgacagaaatttagttcacacatttctaaggtgaattactagttattcttacaagggaaaatactaatctcatagtttacaatctaatccattgctaagcaaatacatattcactattattattgttattgagacaggatcttcctctgtcacccaggatggaatgcagtggcctaatcatggctcactgcagtcttgaactgctgggctcaagcaatcctctcacctcagcctctggagtagctgagaccacaggctcgcaccatcacactactaatttttttttttttttgtagagatgaggtctcactaagttgcgcaggctggtatcaaactcctgggctcaagtgatcctcccgcctcccaaagtgttgggattacaggcatgagccactgaatccggcccatatatactactgcacaactttgattataaaagaaattgcttctggctaagaaattagctcaagtttgtttttaaagttctaaaactcaccacttgtcttgcttgcttgtaaaatccctataagatacagaaagaagtataaagctattctaatattaacaggcatggtatttatacagcatttcaaaaatcaaggcactttttaaagtgtttgatgtgtatagtttttaatcctcagaacaggcagggtgaggtggctcacacctgtaatcccagcactttaaactttgggaggctaaggcaggcaggtcacttgaggccaggattttgggaccagcctagccaacatagcaaaaccccatctctacaaaagaaaataaataagtaaatgaagaataaaaaattaattaattagtcctcagaaaagttttataagaaaggtactattttcaatcccattatacagatggaaaaacaaacgcatagagatgtgaagcaaatttccccagggcacagtgttgttatggagtaaaggcgggatccaggcaccttgaatccagagtttataaacatgcaattttcttttctttctttttttttttttttgagacagagtctcgctctgttgcccctggctggagtacagtggcgcgatctcagctcactgcaagctctgcctcctgggttcacgccattctcctgcctcagcctcccgagtagctgggactacaggcacctgccaccatgcctggctaattttttgtatttttagtagagaccgggtttcatcgtgttagccaggatggtctcgatctcctgacctcatgatccgcccaccttggcctcccatagtgctggtattacaggcttgagccactgcgcctggccatgagcatgcaattttctaagaagcactgaagtgttgttaagacttatggtcactggtgcttgaaatttattttgatttactatttcactttcatgctcttcaaaactcctgaggattcttttatattcaaccaattagtgaaattagcctatagcaaaaggacaaagaagtaaaatcacagtactgaattttagttagtgatgctacaattattattattattatttttgttgttgttgttgttaaagggtcttgttttgttccccagattggagtgcattggcacgatgacagctcactgcagccttaacctcctaggctcaagcgatcctcccacctcagccctcccaagtagctgggactacaggcgtgcaccaccatgactggctaattatttttaaattgttttgtagagacagggtcttgctatattgcccagactggtcttaaactcctggccttaggcgatcctcccactttggcttcccaaagtgttgggattacaagtgtgagccaccatgcccagcctgcaattaactttttaaaaaacactgaggataaactaaaattgcaatagcaataatgtttaagcaatttattatattacttgatagaatattttgctatcactaaaattaagtattatgaagactgtgaaaatatgaaaaatatttagaacataattatatgagaaaagccaaatacaaaactgtttaattgctataatcacaaatgtaaaaacatatgtactaactataggccgggtgcagtggctcacgcctgtaatcccagcactttgggaggtcgaggcaggcagatcacctgagcccaggagttcaagaccagcctggtcaacatgacaaaaccccatctctacaaaaaacacaaaaattagctgggtgtagtgttgggcacctgtaatcccagctactcaggaggctgaggcaggagaatcgcttgacccctggaggtggaggttgtggtgaaccaagatcatgccattgcactccagcctgggcaacaagagtgaaaactctgtctcaaaaaacaaacaaacaaacaaacaaaaaaaatatatatatacacatatatattttatatatacatatatattttatatacacatatatattttatatatatacatatatatttatacatatacatatatacatatacatatatattttatatatatacatatatatatatacatatatatatacacagaaacactatagacataaagtaggagagttaagaggcaaaatagaaactgctgtgtttattgttagtatcatgggtgttttatctgtttttacaactcttcgtactttaacttttaaaagaataatattttatcagaatcataaatgtatatatatatatacatttctttaaaaaatagagtctcaccatgttggtcaagccaagctggttagaactcctgggctcaagtgttcccctcccagctcagcctcccaaaatgctgggattacaggcgtgagctaccacatccagccacaagtgtcttttaattgctttatttatttatttctttattcatttatttatatttattaagatggagtctctgattgtcacccaggctggagtgcagtggcgcgatctcagctcactgcagcctcctcctccctggttcaagtgattctcctccctcagcctcctgagtggctggaattacaggcaccgtgcccccacgcccagctaatttttgtatttttagtagagacggggttttgctatgttggccaggccggtcttgaactcctgatctcgggtgatccacccacctcagcctcccaaagggctggtaatacaggcgtgagcaactgcacctggcctatatgtactcttttcaatagccatttaaaatatctttgtgaggccggttgtggtggctcacacctgtaatcccagcactttgggtttgggaggctgaggcgtgtggatcacctgatctcaggagttcaagaccagcctgaccaacatggtgaaaccctgactctcctaaaaatacaaaaattagctgggcgtggtggtgcacacccgtaaccccagctgctccagaggctgaagcagaagaacggcttgaacctcggaggcagaggttgcagtgagcctgagatcatggcactgcattccagcctgggtgaaagaaggagactctgtctcaaaaaaaataaaatatctttttgagtttactatcctaaagttaaaattttgggtttccttaaatatttctgtcactatagggccccttaagcatgttagtaggtatattaagaatgtttcgctgattcattaatggaagtctaaatgaaactttaaaagtttgagactccaatagaatgtatcttcttaatgttagtactaaatgtgtttttgatcagtctaaaaagtgttcaatttcattagagatggataatgttttttattattcttattcagatagttttgggcttgaagtctggtaactgttcttgctttgtctccaacgttgtagtttaaaatcaatctttttactctggcttactttcaatgtctcttttgccaagtagatttaactttagggttactgtgaacaggatttaaacagatgataaatctattcaaatatatttgtaagttgtatgcctggactaagaatctttgtatcttgaaatgtatatctcccctgactccctgaacacccgcactctagagcttgagttatggccaacaaaataaaattttttttaaatattcttttttcatgttatttttatttctttttgttttttatttttatattttctttttcttttttttaatatgttacagtctgaatatgttcatagtgacttttctgtttgtttggttggttttttttacagagatacagtctcactctattccctttgttggagggctgtggcacgatcatagctcacttcaaccaagagctcctaggctcaagctatcctctcgcctcagcctcccagttacctgggactacagatgcgcgccaccacgttcggctatttattttttggagagacggtgtctcattatgttgcccaggctggtcttgaactcctggtctcaagtgatcctcctgccttggcatcccaaagctctgggattacagacatgagccattacacctggccagaataaaattattaaagggacatactatttatttaataaaataagtaaactataagtaagaaggaaaataaagcatatgaatgatcaggatcattgcgggtggagggctcaattttaaacagtatgagccaggatactatcggatactccctctctgtccacacagaatgtagcaagggatatggagaaatactccctttctccagaagcatcagagaaaaagtgttacttacaaaaatgaatccagcaacacatttctaaccggactgttgctgaattttactgcatgctttgtcttaaaaaggttttgtctccattggcttagtccttatactggcttcaacgtgtcccttctttatgactccttgacacttttcaccagctttgaagcctcacaagtgatttttacaggcccaattaaggacagagtttacgatgtttgcttgctcttgagagagtggctggaccgacccagtgaatgcacaggagttaggcaaggtgcccttcaaaactgctgagtagagaaatcctcccacggcccctcggggaattcaagctacaactggcccattgtgtttcctcaggctgcggattgctttactggagggagtagctgactgtgagtggctttgggagcccttcataacaatggctggaggagagctgcagcagctgtgtgtgcgagaaacacgaatgcccggatgccagcggcagcctgggctcctgggcctcctgggccacctgggccctagttttattcagagctacacaactgtttgtgaagcgcattgtaaacaaacatagacggggtgagacatcctctttatcctgaataaatcaagaattcccaggccgggcgctgtggctcatgcctgtaatcccagtactttgggaggaggcgggcggatcacgaggtcagtagatcgagaccatcctggctaacacggtgaaaccccgtctctactaaaaatacaaaaaaaattgccgggcgtagtggagggtgcctgtagtcccagctactcgggaggctgaggcaggagaatggcgtgaacccgggaggcggagcttgcagtgagctgagatcgcgccactgcactccagcctgggcgacagagcgagactctgtctcaaaaaaaaaaaaaaaaaaaattccctcacttggggtttataggagactgttctccaaaccacaccagacttttagaagcaactacctctacagataccggggtgaaccagtaaggcccttcatttaactagacagaaactgagtgaacagtgggtaaacaaaatattcaaccaaattctttgctaaatccagtccaccttggttttattaatgtctttacttggaaaaaaaaaaaaaaaaagccatccaaaagcaatccctcagtctagaaaattgccagatgtgattaaagagattggctggcttctagggattttccacttgtggttttttcctattatctaagagcaaacagatattactattaatttaaaatagtttagctgataatgatatcaaccgatacaggaaaattatagagagtttaggtacttaggtgtgaactcaggtggcaacacctactctcattggcccccgtccttttagggggaagagctgactctcttaaaaagccaagagagcttgaagttgccttctgtaatttccaaacaggcattttttttttttaattatagagaactgactttgcttacttgacgcctcaataactttcaatttcgagagagtcagcccagttttctagtgaaattacttggataggtcaatagattataaaaagggaggccaggtgaggtggaggccgaggcaggtggatcatttgaggccaggtgttaaagaccaggctggccaacatggtgaaaccccgtttctactgaaaacacaaaaattagccaccatggtggcgtccacctgtaatcccagctactagggaggctgaggcaggagaatcccttgaacccaggagccggaggtggcagtgagccaagatcgtgccactgcactccagcctggatgaaagagtgagactctgtctcaaaaaaaaaaaaaaagagagagagaaagtaagagacctgcatgcctatgcctctcccagagggtgcatgctagcaggttagttacggcatgagtgtaatttaggagaaggctcctggaagcaaattcatctcacactgatactggagcctgaagctgcttcatagcatgtctcctaaaatataacagtgctgtaatattcagtaatattaatcagatatcttcaccccagctatatgtcatcatcatgtatctgtcttttctctctctcttttttttttttgagacggagttgtacttttgttgaccaggctggagcgcaatggcgcgatctcagctcactgcaacctccgcctcccgggttcaagcaattctcctgcttcagcctcccgagtagctgggattacagacgtgtgtcaccacatccagctagttttgtatttttagtagagacagggtttctccatgttcgtcaggctgatctcgaactcctgacctcaggtgatccatccaccttggcctcccaatcccaagcctgttgggattacaggcgtgagccaccgcaccaggcctattactgtcttttctctagtgtttgtagtgtttattgcttgtataaaacaacaggacttttatgctaactggtcttgatattaagcctatgtcacctttccaactggatcataagcatgagaatagcttcttaggccttaggaaaaaaaaaaattccagaggctagtgtatgggcttacaaacaaactaggtaataaaaataggaatctcttgattgcttttaatatttacttatagatctcaacaagttttgctaacatcctccatcaaggtaatacagattttctatttaaatatttctctttaacacgcaagacctatcctggagcaggcaccctgagaagatggagtgacttttagaattccctgaccttctatgctgttgtccttgggatctcccagtcctttcctctcaccttgacctagttgcatcctcttctagattctcaggggccaacctgtgtctccaggcctagtccggaggatggagtggtggggaggactctggggaagtgggaaaacggagacgcaatgcgtccatgtaccctatttaatgttgctgctcacagcaggcagcaccccagctccgtctcttcagaggacagtgcttgcctgttcttctagctcagtaagtataaagtctccctcctcatcctccccattgaggaatccaccccaccctgtcccaccccaccccaccctacactgccaagtgttaaatagataaagtgcaggaattcatcaacgtacgtttttctttggaaatacaggtgaagtttttctcatttctttaaattgtgggactctgccaggtgcggtggctcatgcctgtcgtcccagtgctttgggaggccgaggcaggcagatcacctaaggtcaggagtttgagaccagtctggccaacatatagtgaaactccatctctactaaaaatacaaaaattagtcgggcgcgggggcacatgcctgtaattccagctacttgggagactgaggcaggagaatcacttgaacctaggtggcggaggttgcagtgagccgagattgcaccactagactccagtctgcagagtgaaactgtctcaaaaaaaaaaaaaaattgtgggactcattcttttcgtttgaatttgtctttcctcgatatgtactttttttagatataaaaaattgttttaaaaagagaaagtaggaaaattattttaggtactatctctacgggacagtgtatgttatttgcttttggaaattaaggctcagggaaaatagaaatgctggtgtaatcagtggagaagaacctggctatcctgtccgtcaaaatccactgagctttggaaacaacttcctcccctctttcctccaagaaatccccttttccagtgttttttttgtttgtttattttaggttcaagggtacatgtgaaggtttgttacacaggtaagctcatgacaccgggatttgttgtacagattatttcatcacccaggaattaagcctagtacccaatagttatcttttgtgctcttctccctcctcccactcttcaccctccagtagaccccagtatctgttgtttccttctttgtattcatgtaagttctcattccagtgtttttctgtttgtttgtttttttgagatggagtcttgctctgttgcctaggctggagtgcagtgatgcgatcttggctcactgcaacctccacctcccaggttcaagcaattctcctgcctcagcctcccgagtaactaggactacaggcacacaccaccacacccagctgagttttgtatttttagtagagacagggtttcaccatgttgaccaggctggtctcgaactcctgacctcaggcaatctgcctgcctcgacctcccaaagtgctgggattacaggcatgagccaccgtgcccagccttttttttttttttcttgagacggactcttgctctgttgcccaggctggagtgcagtagtatgatctcagctcaccgcaacctcccgttcctgggttcaaggaattctcctgcctcagtctcctgagtaactgggatcacaagtgtgcaccaccatgaccagctaattttttttttttttttttgtatttttagtagagatggggtttcaccatgttgaccaggctggtctcaaacttctgacctcaggttatctgcccaccttggcctcccagagtgctgggattacaggcgtgagccactgcgcctggcctcattccagtgttgttgttgtttttttaactgtctctctctctctaggctactgtctctcagcatattaaacaccttgttcttgcaatatctctaaaagctagcgaacagactgcaagcaaaacatcctctttacacccacaaactcttcctttttcccgcagccacctttcaccaccacccaactcttctctcttagccgagcttcatgaaaaaataatctccatttcctcatctcacattttctcctcaacccatttgctcattaaatggcaatttgttcattaaatggtatttatggattgcttaatatttgcaaggactaaagcgaagaacataataacaaaagtctcatttcataaaatgaagcttgcacaaagatgccaataaacctcattgtcaaatccaatagacatttctctgtgcttacttcatttgcatatactctgcagcatttaaaagctttcacaaaggttcaacaactatttgcctggca

SEQ ID NO: 201 - DNA, 16034 bp, Homo sapiens
tttttatcctccccatcttatatagttctgtcattgcaaactcaagtcttcctgatttgcctgtgtgcctgtgtgtagcctaagggcacaggcattggccccgggccaggttgccaacttccaccctgccctgctggctcctgtccctcccatgcactctgtgttccagctcaggagagtggagctgcccgggtgccttggtctcctctgggtggccccgtgccaggtctggtaggatggggacacattgtggtcattctgatgccccagcctgtgcagaggtgaagccagagacagctggtgctctggctggggttagtggctgtggcaaggtgggcccgactgccgactcttgcctactgtgcccagccccctatctggctctgctctcttgcagctgcgcaccaagctgtcatcacaggagatccagcagtttgcagcactgctgcacgagtaccgcaatggggcctctatccacgagttctgcatcaacctgcggcagctctacggggacagccgcaagttcctgctgcttggtgagtgggccctggaaagagggtggcttgtccaaacctggcttggagaggctgatccctcctgggaatgtgcacacggacccctcagtgggtgcagcaggggctccatcagggatgggagatttgaaccagagatggcatgagagcagagtccagagatcggggaatctgctgtgattagtcagaagggcttttcccaggtactgttgggggcccaccgacaggccttcattctcctgggaactcaagctgagctgggtgggccctgccaggaagtagcagagatcccccaggagcagggctgggagtgaacacaaccctgagatttaggaaaacagtgctggaggagccagagaggcatgggttttggtgaatgtgtaggacttcaaggcggaaggaccagcgtttgccaagacccctaaaatgctcggcacattaggtcagtgcggctagagggctgtgtggtctgagcagcagagttggatgttggccccacacctctcaggggcggtgacttagctgtggtttccctctgccgacacttagaacacagcaagtttgcggtaatgtgttgctagtagccagttgaaggcttctgggtcctggcctgttttccctgcaaaccaaggaaggtgggtttgttaaccatcgtaccgacctggcagtggcaaacgtggattgcctgcccagggctccccgctcttaggagcgtgaagggctggaggctggggcagcctgtctgtacaataggttctgtctaagcagtgcctgccccttctgtgctgggccctgcgttgcctcctggcatgggactctgtctgcccctccacatcggggagtagagattctgagagacacactaggcttcccaaataagagggcagccctctgagttgggacagtcacctaggtcatggcagggaaactggactttggcatgaggcctgcctctgaggactgcacccttgttgccgggtgccagcaggtggctttgagcactgctctgggcctcagctttccccactgtaaaatgggtcctttgtgaggactaatagagaatgagaggaggccacaggttcttggcctgtgctggtgccttgaggccagggagtgtgcatgtggcagaggcagtaagctgtcagggccagcagcagtgtctgtcaagagttgaggttttagccaaactgtctggccccaggaagcatgatttcaaccaggatgctagatgcagtgagcatggcatcagggtccccaaggccatgcaccaggggcagctgtggccctgtcagggggctttgagccctgagagaagagctgagtgggctgagccgaactggaggtgccatgctgggtgttgtgtgtctgcaggtctgaggcccttcatccctgagaaggacagccagcacttcgagaacttcctggagaccattggcgtgaaggatggccgcggcatcatcactgacagctttggcaggcaccggcgggccctgagcaccacatccagttccaccaccaatgggaacagggccacgggcagctctgatgaccggtcggcaccctcagagggggatgagtgggaccgcatgatctcggacatcagcagcgacattgaggcgctgggctgcagcatggaccaggactcagcatgatggacagtggatgggggggcacccacaccttccgcgcagtcgtcataggccttcccagaaggagctgcccagacctgcgtgtcagcccttggtggtggccagggagaggcgcccggtgcagatggccccgggcggcccaggtcctctactgtgaaggagcagggagctgccgagggacacgagcctcagtgcggggtggaaggctctttgccttgtccaccagggctcagccaagccctgcagtgtgtccccgctcggggagggcccggccgagcgggcagggagagccagtcctgtcggctgggcccttggacggctgtcagttttgcacatgatgttcctattgtaactctcagagaccttaaaaagaagtttactgcaatgtgaataatttaatctctggttgccaagcatgtttctgatccagttgggtgaaagccatcggtgccaggaggggtgtccgctctagcctctgtccctgggtccccatctgccctgcagcacctgggactcggcagtggtccctgggggctggggtggaggaggcaacaggctcttgtgccacaggaaggacttgatttggacttgagcagtgtggatgtggggcaggagcgggtgttctgaggcctttcgtgggcagcgtgtgtgagggtagcgtgtgtggcatgtgttgggggcaccttgatctttacatcctgtgcactgaatccttcaaggtcactggctgtgccccgcaccccccctccccccaaccccatgctgcaggttttttcctcaagcagcctgcactaccccgtggaacagaaatgctctctgagatctcgtcaccttggagcctgggggctgggtcttcagaggccagtgtgcaactctgccgaccctccctgtgccgtcattgtgggcctgtctccatccttgtcccgtgagctcttctccccaaaccctgttggccttggtcttgcctataccctttgggcccttacaaagcttccttggatatgggaaggggagaagaggtgacctgggtcaggttgtccggagcctctccctccaccggagagcagccacaaccctgcggagacccccaaggggacagacatctaggaaggagactggctgtcacatctccctcctgcccaggctgggggcctagccttgctggatggaggggctgcatgtcaggccccagggattctctggcccaggcttggggaagcagggagagcctctggggctccatggacaccctgattgtgtccaggccaagccagaggatctggagtatctcaggcaccttcctgaataaggtagacgggtttgtatggtatcacagcttctgaacaggaaggggcctggtcggtgtttttttgtttgttttgttttgtttttctcaagacagagtctcactctgttgcccaggttggagtgcagtggtgcggttttggctcactgcaacctacacctcctgggttcaagcgattctcctgtctcagcctcccgagtagctgggactacaggcgcctgccaccacgcccagctaatttttgtatttttagcagagacggggtttcaccatattggccaggctggtctcaaactcctgactttgtgatccgcctgcctcccaaagtgttgggattacaggcgtgagccaccgcggccggcccggtcagtgttttatgggcgagtttttccactgtactgggctgttgtagagctgcttactcatgggaccccaggccagggcaggcagcaggctctttactgttgacactgtctcttaagtttacatgaaaatggacatgccctggaagcatcaggagaggctgaggacaaaccacacagtctcctgggctcttgccccctaccagagcccaccctgtgccagaaggttcagtgtcccccttccatccctctggttgaacatggccttgcatgggccttctgtgtggagtgtcaaaggaaccacatgcttgcccctccagggtccatcccaggtgtggcccccgtgctgcagtcgctggtctttgctagcagaaagagtagaggacatggagcagatgaagggacaccagagggtaatgaggggacaccagagagtaatgaagggacatcagagggtggtgacaggacaccagagggcagtgaggggacaccagggagtaatgggacatcagggagtgatgggacatcagaaggtgatgaggggacaccagagggtggtgaggggacaccagagagtagtgaggggacaccagagagtaatgaggggacactagaaggtgaggggacaccagagggcggtgaagggacaccagagagtaatgaggggcacgagagggtggtgaggggacatcagagggtgatgggacaccagagggcgatgaggggacaccggagagtattgaggggacaccagagggcagtgaagggacgccagagagtactgaggggacaccagagggtggtgaggggacaccagagagtaatggggacaccagaaggtgaggggacgccagagggcagtgaagggacaccggagagtattgggacaccagagggcagtgaggggacaccagagggcgatgaggggacaccagagagtaatgaggggacatcagagagtaatgaggggacatcaaggcggtgaggggacaccagagagtaatgggacatcagaaggcggtgaggggacatcagtaatgaggggacgtcagaaggcggtgaggggacaccagagagtaatgggacatcagaaagcggtgaggggacaccagagagtaatgggacatcagaaggtggtgaggggacatcagaaggcggtgaggggacatcagaaggcggtgaggggacaccagagagtaatgggatatcagaaggcggtgaggggacatcagaaggcggtgaggggacatcagagagtaatgaggggacatcagaaggcggtgaggggacaccagagagtaatgaggggacatcagaaggcagtgaggggacatcagagagtaatgagggcacatcagaaggtggtgagatatcagaaggcggtgaggggacaccagagagtaatgaggggacatcagaaggcggtgaggggacaccagagagtgaggggacatcagaaggcagtgaggggacatcagaaggcggtgaggggacatcagagagtaatgggacatcagaaggcggtgaggggacatcagagagtaatgggacatcagaaggtggtgaggggacatcagaaggtggtgaggggacatcagaaggcggtgaggggacaccagagagtaatgaggggacatcagaaggtggtgaggggacatcagaaggcggtgaggggacatcagaaggcggtgaggggacaccagagagtaatgaggggacatcagagagtaatgaggggacatcagaaggcggtgaggagacatcagaaggcagtgaggggacaccagagagtaatgaggggacatcagaaggtggtgaggggacaccagagagtaatggggacatcagaaggcggtgaggggacaccagagagtaatgaggagacatcagaaggcggtgaggggacatcggagagtaatgaggggacatcagaaggcggtgaggggacaccagagagtaatgaggggacatcagaaggcggtgaggggacatcagaaggtggtgaggggacaccagagagtaatgaggggacatcagaaggcggtgaggggacatcagtaatgaggtgacatcagaaggtgaggggacatcagaaggcggtgaggggacaccagagagtattgagacaccagagggtggtgaggggacaccagagagtattgcggggacaccagagggcagtgaggggacaccagagagtaatgaggggacaccagagagtattgggacatcagagagtattgggacaccagagagcaggggacaccagagggtggtgaaggtacaccggggagtattgaggggacaccagagggcggtgaggggacaccagagagtaatgaggggacaccaaagggcagtgaggggacactggtgagtattgaggtgacaccagagagtaatgaggggacatcagagggtggtgaggggacaccagagggaagtgaggggacacagggtgatgaagggacacaagagggtgatgaggggacaccagagggaagtgaggggacacaagagggtgatgaagggacaccagagggtgatgagggggcaccagagggcagtgaggggacaccacagagtaatgagtggacaccacagggcagtaaggggacaccagatggtggtgaagggacaccagagggaagtgaagggatgccagatggtgatgatgggactccagagggcgaggaggagacaccagagggcaatgaagggacaccgatttattgagtagcagagctgagggaaggcgtaggatggctccagcttccggtcagtggctacatggtcagttcctgcagaaagagatggtcatgttgggggaagcaccccgcagtggagccaacatcaggacctctcgaggcccttggggacagctcaggggtagggaaaggggccagtgctcactcaccatgatggcgttgacgatgtcactgtggttgtctctcagagcccgcacggccttggccctggacacattggcctgcgccatcaccagctcaatgtcacgcagttccagccccgcctcgtccacctggagttgggggagcagggaagtggctggagctgcttgaggtccctggggcagagcccccatgtagcgcctcccaccaccccctgcgaggccctggagcccctgcacttcacctcttcctcctcctcctcttcctcttccttgcactccagcctcacccggggcctgggtgctgactcagggaccaaggctgagggctctgagggcaccttaaacttctcagctgcggctttgtgcacttgctgggacaggtcctcaatctgcaaaatggaagacagctgtgtcagtagagcctgtcccccccttgtcccctatccctcggatcccccattccaccacagccgccacccagaccttggcctcgccaaagaccacataagtgtctgaggctgggctcttgaagacatcaggcttggcgatgacaaagaggatgttcttggacttctggatggtgatcctggtgactccctgaatctgccgcaagcccagctttgacattgcctgggagtagagggcagaggggggctcagacctggtgttgacccacgtcgggggaggagagcagcacagtgcccaggaaggcaaagtctccaccgccaacttccccaagaccttgggctggtggttggtccttccccatgagcctcagtctataagggccttctcatgacattccagcctcagctgtttaggggaaggtgtgtgggttactggcatggacccaaaggtcccctgatggatgggatttcattagccatggagtgtgagggtcttggtaaggacgttccccacacagatggtcccaggcctgaggtcccagagggagccaccagcccacctttcgggccttcttctcactgcgactctgcttggctttggcgatggtctcctcactgccgcctgctggggcctgagaaaaggtgagggctgagcatccatgggtggggtgtggggccctcccagaggcccaccctcttccctggactgggcacctgggctggacactgcacggtctgaggagccaagatgtcctgctcgtccagctcggctgatgactccccgtggctatccgaatgctggcccgagcccagggcccgaggcgagtctggggaaggggagaggtgtgaggatggccttttgcttctaggtggcggggaagggggttcaggaccctggccctgctgccacatcagggccagaggaagcagtgccagctctccatggtggctgtggggtctgggccccccacctcgccacctcagaggccctccagctcaggacagctctaaggaggagtccagttgacccaagccccagggcacttcactcccaccctctgccttaccttcctccaggctgtcctcatcctcttgctgctcgggggctgagagcccttgagggccagctgggctctggggcccagagggaggaggcacttggcaaggcggcaagatctgcaaggccaggtctttggcatccatggaggccaccttggggctgaggagtggggagtgaggcgagaggctgactcgcggcccagtccccagaggctgtgtggttcctgagacagcagcagcggcaggctggactcctgcctggggcggtgggaggcccagagagcctgggggctcctcgtcttccacagagtcttcctgggggtcctggcacaggcagggggctgggggctccagtgggggtagggctgccccagcaagggtaccaggagcagaagggtcagggcccaggggcctgtccacgggcgtgctgggctgacccttggcaaggttttctgggggctgcagcaagggggtgccaaggacactgggtacttcgtggggttgctcaacactgcccagacccagtacaggctccggctgctgggaggttggtgcagacgtgggggcaggcgcgtcagggcagcctctgtccagactggacacagcccctactgaagactctgggcaggagtccagactggcctctgtggccacagctgagggaagcgtgggctccggggtggacttgccactcaggcctctttcctccctggctgggctcaggagccgggcctggctgacctcagggcaggcagcaggaggcgcatcggggacctcccttgcacctccaagtgctgacctgggtccatgttcctgtgccagtggcttcaggcctccttcctgctggttctcaacctccagggtctccttttggggtgagtcaggcttagccccatcacctgtgtgcgctcgcgcttccagacatgcttcccgtccaggcctagaaagggcttctgctatttcctccccagcaccagaggccggctcagggagactgagggcctccatgcccaaagtggaatccgcatcttcctgtgcggcccaaggtgtcccagcttctgcagctggctgtgggtcatcctgttggacctggtccaaggctgcaggctccgggactgtagggagggctgcattcttctcctcaggtgctggcctggggcctaaggcctcacctacttcctgctgagccatggtggccacaggctctgtccctggggcacagcctgcttctgcctgcaaggtttgaggggtggccacagccagaggctctggacctgaggtggggcctgtgtcttgcagaggcagaggtgctgtcatagcggagtcctggggtaaggtgaggccctcttcagcctgctgggacacaggcgtggctgcagccacaggctttggggctgacgagagatctgtgtcttgtaggggcagaggcggtgtcatagcggagtcctggggtaaggtgaggccctcttcagcctgctgggacacaggcgtggctgcagccacaggctttggggctgacgagagatctgtgtcttgtaggggcagaggcggtgtcatagcggagtcctggggtaaggtgaggccctcttcagcctgctgggacacaatcgtggctgcagccacaggctttggggctgacgagagatctgtgtcttgtaggggcagaggcggtgtcatagcggagtcctggggtaaggtgaggccctcttcagcctgctgggacacaatcgtggctgcagccacaggctttggggctgacgagagatctgtgtcttgtaggggcagaggcggtgtcatagcggagtcctggggtaaggtgaggccctcttcagcctgctgggacacaagcgtggctgcagccacaggctttggggctgacgagagatctgtgtcttgtaggggcagaggcggtgtcatagcggagtcctggggtaaggtgaggccctcttcagcctgctgggacacaagcgtggctgcagccacaggctttggggctgacgagagatctgtgtcttgtaggggcagaggcggtgtcatagcggagtcctggggtaaggtgaggccctcttcagcctgctgggacacaagcgtggctgcagccacaggctttggggctgacgagagttctgtgtcttgtaggggcagaggcggtgtcataacggagtcctggggtaaggtgaggccctcttcagcctgctgggacacaatcgtggctgcagccacaggctttggggctgatgagagatctgtgtcttgtaggggcagaggcggtgtcatagcggagtcctggggtaaggtgaggtcctctttagcctgcctggggacaatcgtggctgcagctacaggctttctgccagaggggaggtccagccctccttcttccttcaagttctgaggagagtctggacacaatgtgaggcttgtttcttcctgtggagttggaagtttttctgcagtgacagactcttggcctaagatctcgctgatgccctcctgggagggctgaggcattgccatggcagcagattcttgtccagcggtggagtctgtttcttcctccccagcctgtggggtcactctggtagccacctccacctggaggcctggggctacctgcagagtgtgaggggtcacagtggcagtggactcctggcctaaagcaaggccctcttctgttacttctgagatcaattcctgtctctgggacagataggcccctctgtctgaggtctgaggagcagcctccacggcccaggacacagtcccatcctgagcctgcagccccttggccccacctccgctctcctcctctgtcttctggacactgtcctggagcaaagtggcctgggcatggggctccccgctgtacagcctctcatcatctgcctctgcgtaggaggctgagtctgaatcagaggaggctgcagaggtgtcgtcccggaaggcaaaagcctcgtccatgccctccgtgatggacaggtcagacagtgactgcaggaaggaggcagacgtgctgtcctcctcaccctccccagccaggtccccacctgggtcgggatccgccacagcctcctcttcttcttcctctggggatagcggtgtcacctccactgcctccacctgaaagatgaggctgccctggaagggtaggagggctgcggggatcattgggtcattggccaggaagtccaggtcgaagaagtggccctcctggccccaggaggagctgctgtctgcagagaggctggactcagaggacgggggctctggggtccctgctgggtgcagctctcgttcatccaccatggacccctgcggggacaggccccagcctgaggggaagtccagcccttcagccggagccagcaggctgagggaacaggagggtgaagaggcccagctgtccccatcggccgtaatgtaggagcccgagggtgaggcggggggcgagtccagcagctcatcccgcagctcagcctctgagtccctggcgtccccgtggggcccacaggcaggaagcagggcataggtggtcttggtgggggtggagggaggcgtgaagaaggaatcagggtctgggggaggggaaggcacagaaagatcaccctgagaacacagctcggggggtgggtctgggcttgcgtgcccaccctcctggtccctgagcgctgtccgggcagctctgggtgacaggagggcctggcacgtctcctctcccatcacaatccggggctccagggtggccgggagaggagcctccgtggacagagcctgggaagacaggccctcagggaggagcatggggcttgggccgccctcccctgggtccgcccaggccgagggtgccccaccaggccctgcatcccagctggctccctcgggctggggccgggcacccggcttgctgggcaggaacgtgagggccaggtggctgggccctggggtcagagcacagggctcccgccggtcccctcccaggatggtggtggcagcggccgcatcgcaggacagatctgtggagatagagaagatcatgaggtgcccctggatgcatctcccaggcaagggccaggcccggggagatgaattccggctgcatagggcccagaggaaggtggatccaggaaggcaggagagaaaagagaagaccctctgcacgctgcgtttgagggagaacttccaggagttttgacagcagagagcagatgctagtggtttcctagagaggggttttgagggaagtgttgctgggagtcatgaacagacctgtctggcggcttttctcaaggacacctcagcaaagaactagcatttcagcctctctggggagactggattgcagtttccattccacagaatcagtgtggttcagctgggctcggtgggaggggctggtggtgggaatctgccaggcagtgccagtcccatcccatgacctcccaatagatgcgccacatgaggcaggtggcaccagcacgacgcgcgcagctcgaacactctgggcttcatgcctcgctctgcctcctctctctgctgtccttgctacctacacttgaggccaacatgtcagggtttcaccaggcccctctgaccctgctcccctcctgcacccagggagatggggaagccaggggccaccacacgcagccaagtttctggagaacagagatgaagtgtcccgtggaggctttgctggagcatctggccacaagggcagtggtgggcaggaacggagaccatggagcccagcaagagcacaggacagcttcagagggccaacagcagcctctggctgagtcctctccttggtggcagccaccccatgggtgaccaccagttccttcccgggtgctgggagttcccaccctgccctgtgggccttctctgggtcccatgatgcactcccccaacccgctgggcaggcttcagtatgaggaggctctggtactcagtaaacgtctgtgagctaacacacctccagctgagaaaggagtccataggaagtagccctcatgggtcagaaaggacttaggggactcaggaagatggaagaaaacccctccgaggttgcggcacaccagaccgctatggttttctgcctcctggactcttactggcctgtattttatcacaggcgagatcacattgcacattcagttttgaatctagctattttcacccaacctaatctcataagcattttcctgtgtgctctaaatgctcataagcttcattttaaatgtctccattatgtccactccctcacttggacctaggccaaaggcacctctgtttgaagcatccaatgaaggcccttcagagcccaggccaggtcttgcccaaggtgggggagcggcggcacacaggggccagctctccaggctgcagatgcctgcctggtggctcctgctctcccgcactcactggtgaccaggacaacatctcttgcacctcagctttctcatctacaaagcagagccaggattagagttgaagctgaaagaagggggaccctgttgccaggctgctccagctcccctcagcagcatcagagccctgagccctgaaccaccagccaaaacttgtcacccaagggctttgctgctggggtgatgggacatccagggggtcctgagacaagggggtcctttgggttcttgcatgcctgacacccaacatcaggagtgggcgtggctggtggggcatcactgggtgccctgaagctgggctcttggttctggcccctggtgtggcccccagggcaggggaacggctgagctgttgggatggagcagaaaccaaaggccaaaggtttttataactcattcaaggtcaccaagcaagccagaacagagccagcacaagaccctggggctgggaagtctgggcctgcactccctgcctcccacctagagcagaggcagcagcctgtgtcaccccaaaccaggccccaggccccagcagtggtcccatctctgggtgacttcttgcccacagcaaggtgcccttggccctacccacacatggctgacctccacgccaggactgtccaggctcggctctttctaggccccgtagaccccatcagcctccaccagcatttgttgacccagcctaaggacaggtggtctgcacacccagggccattgctaatcaggccacctcccccaaggccttccaccttccagacccaacttaggctttattccaccacctggccctccatccgggcttcctaggctctggccagtcctgctcctccctccagagccatgaccagtcgccggcccaggacagaccgggtgcaactgaggaccctcccggtggtcacctgatcgtactgggggtatcagccggacaccccgcctccagaacccgctgcctctgtccagagcggcccagccccagcaggctggcagctcggtgcaaacaacgggatgcagcgggcgggatgcgagccccacgatccctgggtcggaagccaagggcttaagcccccacgttctttctggctcgcggcgggcacttcgtgcgccccaccttccccgcagttctgagagaggcggtagcagggttcagatggagggaaggacagggcgcggaaaggggaggggactcgaggggggccagggggatgggggagaggggtgaaaggtgagcgatggaaagagaacccgggctggagaggggagaggctgaaggcagggaaagagtggccacggcctcacctgtgcggggcccgggtcggtccgcctcgggcagcagcagctcggcgcgggcagcctccccaggcatggcctggccgtgcgcccgcccgtccctcagtccttccgaccctccgtcagtccgtgccgccgccccgccgagcctgcgcggccaccgcccctcggccgggcggtgggggcagtgggtgacgtcaggccgccccgcccgcctgtcccagcgagtgagcgtgcgcgggctcgccaggcactgcggagggcgtagggggggctccctccccgcccccaccccacccggctgtggcctccctctcgctgtgggcggtttcgtgggggagcgggggtgggcgcctgcgcccggtcccaccctttccacagcatttacgagggagggtttcagggccaattggaagctgggttgcctcagggtggcattcgcccgtggccaggaagaggcggggacgcccctagaaccctggttgtgggaggctggggaggtggttgggattctgggatgctcggagcgctttgggtggagttggcggcgcagcctccttccccgctgaccaagcagagggtgcagggcctggggagggagggggccccgcccagcccgatgcctccatgcaaaaggtgagctggagctgcagctctggagtgattggctggtcctggcagtcgtcggtctccgtggcaaccgcctcctgtctccatggcaaccagggatggagccgacgagagcgcaccagggaaggcgacccggatgggtcggtctccaggtctctaggcaactcggtgatctgtcctatcatctcccctccacccccacactaggcagtagaaggaaaaggaagaaagtgtttccctctattcctggcagcaccctctgccacacctcccaggaggaagcccgccccgtgaatttcctgaaatgcctcttgctttcacacaggctactgcgccacccagattcactgagcacccctcctcccccgtgccaggcaccagggagacagatgaatgagacattgtcatcacccctgactggggtggggggaatcagagtagccattgtcacaggcagg

SEQ ID NO: 202 - DNA, 54152 bp, Homo sapiens
aaagatgaggtggaaaaaactcaagtttgatgcatcaggaagtttcttgtgagatgaaggcaggggggagcccagggagtcagggccccgcaaccaccaaactgtccctgttccaccctgacccctccagcttttgaccagatcggtggttacgggcagctggaggcagcctacgcccaggccattccctccaggaccattgccaacaccacctgccacctgccacgtacagacgccatgcacatgtttcgagacccccacacaggggacctgccgtggaccgggatgacctttggcctgaccatcatggccacctggtactggtgcaccgaccaggtgagtgccaacgtctcccgcccatcccaccttcctgccgtcccagtgggctctggtaggcccaggcggcctgtctgccctccgcgtcatgagtctgggctggggcctcagaaggtgtggctccaggctgggacatgctgctaggggtctttgcggtcccggggggcttgagccctccgtttagaatccgatgaggcccactggctaccgcccgtcctggcctttaggtgcttcgactgagacagtttggagtatgggattccgaagggactcggatgctcctcggtggccctgccatcggtcatggggcgggcattttgggccagtcttgggctgccgggatccggaagcaggcggggtacctgacctcccttggcctgccagtggtgggggccagccatggctgggccagcgtttctggtagagctctggacgctgtcagcagcagagcggtacctagggggtcctgggaagccgtctttatccctagtccctgaggcagggaccctgtgatgatgaaactgctggccctgggagagagagagcagagagtgaggctgagcaagaagggccaaccccgccccagcacaggaccctgctcaggcacacaggagccggcaggcccgggttcgcctcctggctctgccattcaccagggagtgggcctagaccagttggtttagtcactcgatgcctcagttcccctgtctgtaatatgggaataatcctgccctttgtgggtgtagcaaggcagcttcctcccagctcacccccgcagcctcctctattccgacacaggcctgggacgtggttggaaatgggctgaatggggttgttggaggcaatgcaggagtttctgttgagtgcagggggtgactctggccctgccctcaagaccctgtcaccagccctccaggtgacctcagatgagctgcttcctgtctctgggcagaagcagatggtgcccttgctttgcttgtcccaaaggccgtgggcagctccagggagcatgggggtgggaaaaggcctgtgaagcagtgggcacaggccccacaattgtccatgcctctggacccagccccaggggtccaccataggacaaggcagccacagccagcctctgtggaatgaacgatcacagcgctcacacaagcctttcccacgtggcctaccctgggagtaggcccgaccagctccattcataggccagagcactgaggccagagacagagctggatccgaacccagagtggagtgacttttccgtggttcccgactctgctcttcctctcccaagcagcacgggctccatcagtatctgcccagagaccctccctgggttccaacagtaagaacggacctggccgggggcggtggctcaagcctgtaatcccagcactttgggaggctgacatgggcggatcacgaggtcaggagatcgagaccatcctggctaacacagtgaaaccccgtctctactaaaaatacaaaaaattagctgggcacggtggcaggcgcctgtagtcccagctactcgggaggctgaggcaggagaatggcgtgagcccaggaggtggagttgacagtgagcagtgagccgagattgtgccactgcactccagcctgggggacagagcgagactccgtctaaaaaaaaaaaaaaaaagaacagaccccaactaggagctatcagaagctctggaaggctgggcctcagtttccccatctgtaacacgtggtcctcaagcagggcccctcatgctccggcatgctgtgctcacaagctgcccacatccgccatgcctcatgggagggctttccagggaacatgtgggctcacagcaggcgtctgcccagttctcctgggagggctgagggccagccccagtgggcaaggggctggtgaaaggttggccgtggagggcacagtaggcaagtggtaccctgccaggctgagcccctttacacccgccacctcccacctcctcccaatgcagcatgggcttggcatggcacggtcttctctgggtggaacatcagtcaggagattttcccatcaaggccaaacgaatctgcacatgtcctggccttggggtcagggttgggcaggccccactgcacagataaggagcccgaggcccagagaggatcacacagggaggtggaggaggaacactgctgaccccaggtggttcaggacaccaaccagcattggagctgtagcctggcctctgccctacctccccatcctctaccccttgggctgggtctgcctggtggatgcggggcctcggtccagaaacccaggcactagtcctacttgaggttcctggtctctgtgtggctctcactgacactggggacttttaggggcacctagaggtctgactccactttgctctgtggccagggtagccctcaaagatagccacagtctagtcagaagggaggtagcagttctgtgtgttgagaccataggggtgttttgcttttttttaagatggagtcttgctctgttgctcaggctggagtgcagtggcaccatctcggctcactgcaacctccgcctcctgggttcaagtgattctcctgtctcagccacccaggtagctgggactacaggcatgtgccaccacactcggctaatttttgtatttttttttaagttttttttttttttttttttttcccagagacatagtcttgttctgtcacccaggctggagtgcagtggtgtgatctcagctcactgcaacctccgcctcctgggtttgagcaattctcctgcctcagcctcctaagtagttgggattacaagcgtgtaccatcatgcccggctaatttttgtatttttaatagagacggggtttcaccatgttggcaaggctggtctcgaactcctgacctcgtgatccgcccacctaggcctcccaaagtgctgggattacaggcatgagccaccatgcccagccaatttttgtatttttagtagaaatggggtttcaccatgttggccaggctggtcttgaactcctgacctcaagtaatccacccatcttggcctcccaaagtgctgggatacaggcatggaccgttcactatcttctggctcatccatgacaagtaggtggcatttttctaaccagaaacaaaaccagtaacaaagaggcaaagggtccagtggacagagccctggtctgggctcccgtctgggctatgcccctgcccctccctgggccttggtgtccctgtctgtgaaacagggcagtgcacagaccagaaggcctcccagggtcctgccagctctgtcacctgctgatgccgcagctccaggccgggtgccctcccttagtcagtagcagccacctcagtcataacagcaaccacagctttcgtgggcagcgtgctgactccaatggccacaccccaaaactcactcatcatcttccctgagaaagagaactcacattcaccggaggcccttgaggagccagggacaggcttggccggctacactagcagcctcacttaagtcgttgcaacaactctcctcattttgcagatgaggagcccaaggtgaaatggccactcagggagtgagtgccggcttcctcagggaagagcgcctggctgggactagacaccagtgctgggaggtgggggtgagcagtggcctgctgacatctgagttgggggcccagccttgctatctgacagtcaggggtggggaaagcccctgccctattcagggggactggcaggcctcacagctcatggaaactctgagcctcagcttctctacttggggtgacagcacctgtcccagggccagctgacatgagcacagattggaatatagaggcaaatatcccaccaatggcaaaaagacattcagggtcttagggaaatgcttctctcccaagcacctagacagaaccaccgtctaactctctcattgtccagatggggcaactgaggcccaaactgaggcaagggcttctcccaagtcacagcaagctggcagagaagcaggaaggacagcagcttgccctgcgttcggaggctgcagcccgcaggcattcctagcctctgtaattaatgtttccgtgacatccacagcttaggggtaaatgctgggagccgtccgttaaactagcaagcttggaaagtaagttaaaatcacggaggcagccggatgcggtggctcacacctgtaatcccagcactttgggaggccgaggcgggcagatcacctgaagtcgggagttcaagaccagcctgaccaacatggtaaaaccccatctctactaaaaatacaaaaaaaaattagccgggcgtggtggctcatgcctgtaatcccagctacttgggaggctgaggcaggagaatcccttgaaccctggaaggcagaggttgcggtgacccgagattgcgccattgcactccagcctgggcaacaagagtgaaactccatctcaaagaaaaaaaaaatcatagaggcttcctgctcctgagttgcagctggtgacttaaactgtggaaccgcaaaggaaaactagttacgtttcagagtcataggtcgtacaactttgtgaacgtactaaaaaccatgggaacagtgtacactttgggtgaattatatggtctgtgaatatctcaataaagctgtttaaaaagtaactcttttgggctgggcacggtggctcacgcttgtaatcccagcactttgggaggtcgaggcgggcgatcacgaggtcaggagatcaagaccatcctggctaacaaggtgaaacctcgtctctattttaaaaatacaaaaaattagccgggcgtggtggcaggcgcctgttgtcccagctacttgggaggctgaggcaggagaatggcgtgaacccggaggcggagcttgcagtgagccgagatcgcaccactgcactccagcctgggcgacagagcaagactccgactcaaaaaaaaagtaactcttttgaagtagaatcgtaatatcagtgctgggagagatctcagacattatgggtccaaattaccgctccctcctcccattctgcaaatctggaaaggcctggttaggatttgctgaaggctcccagaagggccggtgtcctcagatagcttctagcctccctctgctactgaactgcaagctttcaaaaccccaggtcttaaagcacctgaactctgccagccatgcaaacacagttggcgccagtgtctgctcctggcactataaatgtgccagctgctgtcatgagggtccaggagatgagggtaggggtgtatgtccccataccaccccacccagggtctcctccagccctgacaattgccaggggtggtgggctgggcaggatccacacctcccctattgacaggtcaggggactgagtccctgggaatgagtgtacctcggctctcgctgcttggcctgctgaagtgagctctcctggtgggaccctgacagtattggggctttgagtgtggctgttttgggcaggtcagaggctaatgggacatcatcgtgcctcatgcccattccctgaggcccaccaaggaccaatcctgacacaagtgtccctcaggcttggactcaccccgtctcgcactccacccccaggtcatcgtgcagcgatcactgtcagcccgggacctgaaccatgccaaggcgggctccatcctggccagctacctcaagatgctccccatgggcctgatcatcatgccgggcatgatcagccgcgcattgttcccaggtaggacgggctccgggcactgaacccaggctgcagggcacccagggttctgggaccttgtcctgcaaacgtcaccagaagaagaggcaaaggatagatgtgaactgttccccaacctggggagtggggagagtggtcctcagggccacaatcaaagggattaacatggatgtggcttggcacaaggtctggacaggtatcacttactgctgtgtgacctcaaggctgtaaatgaacgtccctgtgccccgccttttcctcatctgcaaactagggactgtgccacccatctggcaggtgccatcaagatcctctaaccacaggctttggagacctctaggtggggaaacgtgcattttcttaggttgccttttcaggatgctgggaccaagagtccccagcattaatgatggccttccatatggccctggccggttcccacccctgcctgttcatcaagtttccccatctgtaacaagggaattgaagtcatcagagtcagggacatggtagcccagaagacaacagctcgagctcttgggtggctggcagggagggactcgtgacccctggtgtgcagggaccctgacccacctgtgcctccttgtctgtggagcgctgggcctgcatcctcttcaacgcatctgcttcttctcttccccgactctgggcccatggggagccaccctggggtccaacaaaggtccctcgggttatatggggggcactcagctgccggcgcggtggtggggttggcccgttggccacttgctctgagtggcgcctccggagagggactgagtgctctctcacctcgaagtactcctctgacacagaggaagccactgagggccgtcgggggccagggccacggccggagctgcctgagtggctgtcctggtcactgagggttacgtagtcgtcatcatcttcttcttccaccccatccagcccattggggagccccaccccgaggctctcggggtcatcctgggtcacagatagctgccgctggagtggggcgtggcctgggcctgccatcctgggtagcctatggtctgtcccattctggggagcttcctctttggggagctccaggacccagccaatatcactgctgtcccgggctagtacatctgccacagggactgtccggggcttgggcacggggggcaatggctcagggtccccctgggggaggccgttctcagctgggacaccgtcctggggggcactgggctctgggggagggcaaggctctggacggggcctgctgtcctggctctgcttccacagctggtgctgggcgctggcctgggaggtgtcacggatcttgatgcggttcatctggctgggctgggggttccagatgttggggtcgatgatattgatgtagcccaggatgtcgctgccaggctccgggtctggctccacccacgtgggcaggtactcaaacatgttggccctctccaggtgaagcagtcctgggtggatgggtggcagcagctcggggagttcccctggatgctcagccagcgctgggcctttcagccccaggggcttcttggcctcctgcttctcagaggagatcttggcaatctcgtcgacgctcttggccttgacaagtgcgtacttggggttgacgagcttcttggccacagtgcccgcgggcaccagggggaccacagagggcagcacaataggctccggctccggttccttctccatagggatgcccttgaggctcacactgtgtgacatgaggtacagctcctggaactgccggtcaaacatctccaccacctggccagacagcacagagatcacattccggtccgtccgcgcggccgaccacgtgaagctgcaacagagggagggggcgctggtcaggcacatgaccctgcttcctccgcccagcccccgtgcacccatagccgctgggcctcagactgtggccacagggccctgggatcaagaagtgaatgggggcagagagcaggtgcatactgtggggtcagactgagtcggatgtcaagcaagttggttgcaccaagcccattcccacctctgcaaatgacagggcactgtgctcctctcaggctggtacaggattcactaagcagctcaggaaggccctggacactgtggggggttctgcatgtggtggccgctgctgccatgcgtctatgctgccaccaacccccatgtaaccatgggcagcgcccaccccatgccccatgtggtggtgcccacagagctggccccatccctaaggacggctctcagagtgacccccataggcttgcgaaggcacggcctggccacaccccacctccaggccggtgacatctccaagctggaacaacagcgtcctcagacaaagcccttctctgcctgcctccagagacagacaggcgggcagatgtgctccagccctgcgcacacctcagcagccttgggaccaatgaaccggaataaccagggttaggattaagggcagaagccagttgggagccagaggtacctctcgcacaacttccctgaaagctggagagtcacctgtaggagccgcacacagcccggtctccatccacaaacatgaacttctgggccagggcacccttgaacttggttgccgaccgcgtgaagaactcagttcccccgctgctccgcactctgagattctgttttgggaaccaagagacagaattacacgactgcaaccctgaccacacagggcgaggggaggacggcagctgcccagggctcagaggggactctggagtagtcaggaggggaagaaagaggctgtaaggcctggagaaaggggctggtgtgtctgggactgcagggctcagggtaaggagggagctgctgagccgtgaagctacagagcgggcaggcactggtacaaaggggttggcataagatggtctgggctttggccctaaaggtgtctgaagagcagcatcaggcaggaaaaggcttacacagccagccagcttgggaaatgctgccgtgggtggtggatgctatggtggggtcctgagcgggagggtgatgtgcacacgttttagaagtgtctcgtggatggctagggggtgatgcagccagaggagggcaggaagggggcctgccctgcagaatctgtgccttatactccgataagtctgtggccctccagggtgcgtggccctacccggcctctcccctgtgcttctcaacacccctgtctctgctgggctctgctccgaggacaggactcacagcaaacctttctccttccccatggccaggacaccacccagcacccaggccaggtcctgtaaatggtcagagattcaattctgtgccggcttacactgtttggcccaggagcaggccaggaaggccctcagagactgtggccaagggagctgagacccaaggagaagagggctccttgggcatgaggagcacagcgggcccctcaactgcctcagctccaaggccaggtcgtcaccggccttttcctggaccctgaacacataagggccctctgtcccagtgtggagtctctggagctgccaagggcctgtgtgttatgagctccaggtgctgacttccctcccccaggtagcaggacctgctgtgagggaggagcagatggtaaaggctggtgctgggcacggcagaccccaggaaggacagggcgagcctggctggaacccaagtgtcgaggatggccaagggcatcccgaagtagaatcacaggtgtaaaggggacctggggctcatctggcccctgtctagggcagtgtgtaagaaatgctcctgggtgccctgagggtctgactcaggaggcctgaggtcaggcagggaatctcagttttaacacccactccagggattcctgactggtctgcctgcatgcctcctgtgatgggagtctcactccctcccgaggggctctgtgccggcttctggctctcggctatgacgtgttcttagtcaggctgagctgtgacgtactggtctgtcccctcacccactcactggccccagcttattcaccccactcattcacatagtcatcaacccctgccgaggcctccagctgcagagatgcctgtgatgaggatcccacctgggaggtgaaggggaggctgagggggtaaacgaaaacaagctgaatgcccaggatcgcagaggagtagcctgaagtgtgaagggctggccgggaggctcccgggagaggatgacataggtcacagggggaggtggggaagcattccagggaagggactcaaagaccaggcatgagaggcctttgtacaagagcacctcaggggaggaggggtgggtgatggagcctgcagagcgagcaggggcgggctcctggtaaaagaccctgcaccggcttaagagcctgagcttggccctggggccagtagggagccatgggaggatttacagcaagagcgatggggttgggtgtgtatctcaggagcagtgctggcatcaggcagtgggtgtgtgaggtgaatgctatgggagaggaggggagcctgagagagcagagctgcccgccatgccatccagcctcctgccctgccagtcctttccgtgtcccagacccctgtggctggggtggccccaggcaagcaaccacagaggcaggcaggtgtgggccgtgggtgagtccccatctgatgcccacctgtgggataaaccatagccttttcatagggcccagtgcagaaggcagataagcctctgctcccagggccgccctcgccggccccccaccccgcaggctgcaggtttgcacacagccagctcagcaggaagctggccacggcccaggacaattagcgctcgtgactttgtacccaacatggagcacgctcggggttgagaagtcggacaaagatcctggaggtggtacgaggccttccctgtcactgagcccaaccgagcccagctccaccgcctcctgcaggctcctggcccggccacagacccctccttagcctggaaaatcggccgccagcatcaggacccttctggacagtgtctgtccccacccatcccaaaccttgtcctgatgagggctcggaaagtcaccacttccatctcagagtgactcagcctccgtgtgagccgcaggcctcggctgggccgctgactcgctgtgactcgaagcaagtcccgggcccttgctgggccttagtctcccttagcacacagcagggcgggcctccaactcttaggcctgttctacctggggctcagcagcaggtgggggcctgcagcagggccccccacctcttgcctcatggcctgctccccagcttgtgcctggatgggccccaccccacggggcctggcctggatgaggtaacgtctcaagactctgggctcgtgtgcgcagaggtggaggatcccacaaagctgcattgtctctgagctcctgggacacccccggcacaggacagcagatgggtggagggatgccggggctggcccaagaggggtgccctggaaaagtctttggaccctctgggacctcagtttcctcataagtaagagaggacgtcaagggcgagtcagggcaggggaggacggccgggtggtgcttcatctgctctcagcgggtggcaaggcaaggtgggggctccagggctggggcaaactacagcaacctgcccccaatccccccaggcctccaggccacatgtgcttaaaggacatgtgatccaactgtgccaagcccgctggtgcgaggcagagggggctgagcccaggagcccctggagtgggtctagggtctaggcattcctgagctccagtcaaacaggctccaatcctagcaccaaatggacgccaaccaaggcctttctttccacgcctcagttttctcatctatgaaagggtctactcatccttgtgctgcaaggctgctgtgaggactgaatagagccacagtacaggtggggccctcccagggaaggtgtccagctcccagtgggtgccccatgaactggaagtggcgcagtgggctgtgggggaccaacacagaggaccacaaaacatccaggagggatggactgcccagggaggccaggactgtcagccgtactgggtgggtggttggtgggctcaggtagggaaagtgacctgcccactgtctcccagtagccctgggctgggccgggactgaggacagggctctttcatcacccacctcctcagggccctgctggccaaacaccgtctcctttaatttcaccctcacacaaccccgtgaggcatcactatggccatggggcgctcgaggcccagagaggtggaaccacacgcccaggtcccacagcaggtcaacagccagtgagccatgtaggcagcaccaggacagcctgtgctggcaggttagctttggttttggttttataatggaagccagtgattacttcccctgcccatagtgggatggccattcctaggtttattgatagttgagtagttagtgtgaatgagtagaggcccggtagagcagtggggaggtccagagatgcatccttgaccaggtctgagctgggaacagtgaggccaggcctagtgtgaggaatgcaaggaacagagcccaacatagcagcaggagcctggctgcctgaggtgcaggcctccagcagcctctactctcctctacagggcctgtctcgctctctgtggagggtggagaggggtggtcaacactcaccctggacttctccaggctgttgtgaagttggggtggtgggccctttgtgaaccacatttggcccaaagtatgtgacggcatgtaggggcagggccagcctagctccaaggccctggtctgaggggctcctctctcccctaggccaaggctgctcagcctctgcacaactgatacatgtccccttttgtgtgggacctgtccccggcagtgtaggatgtttaacaacatccttggccactcaatgctggtagtacccccaaggtggacagttaacaatgccaaatgtccctcagcagagtgaatcccccccgtttgagaacccctgccttggccgggcgcggtggctcacgcctgtaatccccgcactttgggaggccgaggcgggcggatcacgaggtcagcagatcgagaccatcctggctaacacggtgaaaccccatctctactaaaaatacaaaaaattagccgggcgtggtggcgggcccctgtagtcccagctactggggaggctgaagcaggataatggcacgaacccgggaggcagagcttgcagttcacgccactgcagtccagcctgggcgacagagcaagactccctctcaaaaaaaaaaaaaaaaaaaaaagagaaccctgccttataccctgaatccaccacagacccaggcccaggtagagacagcaagcaacacccaggcatccccggggaacgggggaacctgggcagcggaagggctgggtcgtgcctgtccagcgtgaggcctgagcggcagcgatcctcacttcctcaccgtgtgccttcccatggccatcccagctgatgcttctttgttcatcagaaacgggaaacgggtctggcctttgcccaggggctgctggtatttccagtttggctgcacgaagtcaactggcttttcagatggcccaggcatctcatggctcttgtctgtcctaagctggaagcctcaggcccagcctgtctctggttggcctgggagcatccctccacacccagtatcacccccaaaagcagccaagtcatgcggcctggccctgtgaccctagagggtgtcagtgaaagttctggccctcttcccaaggcctgctccctatttgtcatttggggtggtcattcccatactcccacatggagggccactggggccggccagggcaaccggctgaggtgcttaggaatggctgggagccccacatttggggagacactggtgcacgctgctcccacctcacctggggaccaggagtgggcttggcccaagcaacagggcagcgtttcgagagtgtgttggtgtgggctccaagctcaggaggaaggagccgagtgagggtgaaccacagccagaccctggcgcagagggaaagaaagccgctcagcactcagaccagagctgcgtctcatggcggggctgtgcctgtccctagccaaagccaggatgggaagggagctcgtgaccgaaggcccaccgcacaaacggcctccttcactcttcacagcacccctgacagataaatgaccatgtccccattttgtagacaagacaatggaggcctagaaggattcagtgactctgcccaaggttaccatgcaggtggcacagctggggctcaggactggctcctggtatcacccccaaactggcacctgacaccccaaggtcaaaaggatgaccctaccagaaaacctgtaccctgcctgggcccaaaggagctggggcaggttggtgcagagctgggcaggggtggcagtggctgagggcaggcccagggattatcggcaaaggaagtgctcccgggacaggtctgggcccagctagctcaaggtgagggaggtaggcagggaaggcaggccctcgacagggggtgacacttggctggggctgggctctcagggcctctggccacccgcccagggctgtagaagggcaagctcagaggcgagaatgaggaagccaggtcacactttcccatggaggcgtctagctcctggatatgtcaccctacagactctgccaccttccctggggaagcgaggcggctgagcagggcaggcggggccagggacctgcagtgccagctgccttccagctggtcacagccagtggaagggctgggggtggaacagggcaggcctcatacccaagcccctaccccagcccagggcctgggatttagaatgtgtggttcttgccagtagctgtataactttcctcagcacacacagcactttacaaccaccgtctcctttaatttcaccttcacacaaccccgtgaggcatcactatggccatggggcactcgaggcccagagaggtggaaccacacacccaggacccacagcaggtcagcggccagtgagccgtgtgggcagcaccagggcagcctgtgctggcaggttggctttggttttggttttataatggaagccagtgactacttcccctgcccatagtgggatggccattcctaggtttattgatagttgagtagttggtgtgaatgagtagggtgggagtgctagaagattggttgagccaataaaaaggataagagaaattaatataagggatcaagttcatcctttgatgctctgtgttattatttgtagttgtttattatttgctgcttgagtaccagggatctgcagcctccttgtcagagctgatttgtcactattggcttttaggcgccacccctaaattggtcggaattgctttgggcaaggcatggcctccctcggatctcagtttctccatctgtcttgtgggagcctcatctgaatgacctcaaggccccttcaggcccaggcactccaggccccccacctgccccattgcctccggcttcctggaaactcagaactctgcaagcagcggagcagccagggcttctctgctgagaaggggcctgggtggaaggcgaggcctctggagtggctggccccaggttagggtccctgctccaaaccgacaggcttgctccctgcttgcgtctgcacgctgggggaagtgcaaagcactcgctgggcctggggcaggggtacggtgctggtggggccccactggggtctcttcctgggcatcgggcagggccaggccttctgcagtcaggtttccaaagtggcctttccacactggctctctcaggcatgagctatctgccactggaatcgattcccagcactaattacgcggcggggagtgaggtgggtgtggggcttggggccaacccaccagggagaccacattaaaaatgtcccaagagctagagactcaccacggagtgctcacaaccacttgaaaggactcaaccggaggcgttggggttggagggggtgggcgcgcctgacaaatgctgacaaattacaggcgtggagcccggccccttgttaaccagactggcggtgccccttctcctaggaccacaagcctgaaacctgcagaattttgacctgtcagacactggtgctgagcccaagggtctggagcaggcctctaccccactatctttaacttgctagcagtgacatggggtatgtggctccattccctcatctgcaaaatgggaacaactccctatcccactaggctgttgtgaggattaaattaaccaatgcaaagtgcctgtgacagggcctggcgcacggccaatgcaagagaagtattcgccgtcatcacgcacgctcatctgctctcagggaaatgctctgcacgcagcaggtgccaagcgatggctggcagaaggagggctccagacaccaaatgccagggtgtctgggcagaagagcgttggaccaatgagatcctgtagcccagagaagggaggtgacatgcccaaggacacacagcaaaacagtgctgagaaccacagcccaccctgaccccatcggcagccttctctgatccacttctgttccatggtttcccccaccccaaaggttctttctcctctgctcttgtgccttaaattcacttcaactgtgcagccatcgcagaagccttccctggccccagcctgagggagcttcctctgtctgagccagaatctaaaaccagtaaatggaattctaaggagacagatttgggcttaacccaagaaaggacttcctgggagttgaagctctccagaaaggccacgagctacctgaggaggcagtgagcacactatcaccagaggtatgcaagcaaacagataaccgatgtggcatgggctgctctgaaataacatgatgcagcacttggcatgagctccagcacctggtcagcaagcacctaatcagtgtttattttatctctgccacgttggaggtagtgagtatcctgcccctcagggaattcaagcagtggctatgtgactgcttggcaggaggctctaggattactggactctgagtgcctggcacaggactccgtccagagcaggcaggtactcgaagtgtttgttgacagactgaatgacccctgccctccagccacccaggcaagtgaggagcctgctcaccttgaggtgccccaggtgcatgcaggcccgctcacacatgtgcaggaagtacttgacgttactctcatccacgatgatgtacacggccactttcctcttgaagccggcgtccagcaggtccttgaagatgtccacgtcggtgaacatgtccatgaccacagctatcacctgggagcaagaagagagactagggcctgtcagacagtgcagcagtggggacagggtgccctggcagagcgcacagccctcccatgccaccagcctctcacaggtgcccactctggccctactcctggagcctcaggcccgggaccaggaagtgaggggccaggggcctctcttgccctgaagttctagttgcagtcccagctctgggctcagcccaggggccctgtgttggtgcattcccaggccagggccggctacgctctgccctccttgtaacacctgggaatgctgagatgaacctgatgtgtcaatgaccggaagggcagcagctggcgtggcggctcgctggggcatcccctacattcctgggctggtgtggactttggccagtgtctaaacccagatctcttcctgtcagctgacaacatctgtccccatagcaggtgacctcctgctggacctggctcagggtggggccccagtggtcagggccttcccccagcccagccaagcaccaccaacagggcagggggcctggctgagtgaaggtgcaaggtggaacatgcagaaggacaggatgaggtggtatgggcccggccccagtggggctcagtgactgtcaggcttctctcacacctagtcccctccctgtcccttggcagcaaggggagggagtcaggacagggcctgtgcctgggcacagccgcctacactgctgatgcagacacatgtcccacttttgggcagccccacccctcccaccctccgagcctggcaccaccatccctgtcccaggtctgaggaccacctggagaagaggccagggacctgccctaggccacacagcaagctggggacagagtcaggctacagactaccctgacttgtcagagagcaccccagccttgctgggatgcggagattcagggtggtggaggcggcctggagcctgctggggatgtgtctgcacgccccaaagtgagctcaccaggctggcccctgcaggcccatctgggctcctcctgggcctcaggcccccatcgttcacctggcaccaaagcccaaactccagcagaggggagggctccatacctgccctgcctcaaactcactgtgtgaccctgagcaaaacacctggcttctctggacccagttttctcatcagtatagcatgctccatctctcaggagaatggagcacacctgaataccgcagcacctgcaaagagcccgacggggggctggggcgggggctcggtgatgcccgtttgctgcctttctcccacagtcaccccgcacgttcccatttacagggggtcttgtcagcctgactcctgcagcctctcacaggcaccatggtggtgacagcccagcatgcagccaggtaaactgaggctcaatgaggttgtaaggcttgttggatgtcgcaaagcaagttgggccagggcctggacctacctccgagtcaggtcagggttggtctccagtaccttctcttggacgtttagtctcggagagcctgggagagagtggtccccccagagcggacagcggaggtgtgggaccagctgggactcccagaactccaaggcctagggttctctctgttctctggggagatgactgctccctatctctctgtttctgaagggctgttttggggcagagggagtagctggttgatgcagggtctacgactcgcaggggaggcagatgttggcaccagatggggaagcacttgctgcccccagggctgcccaaggttaaacagggatcttaagagggagctcactccctgacctaggagatgttcaaggaaggccagagactgcttggagcgggggtagatgatagggcagagaagacacgatgcaggcaggtcaccatgaccctggaggcagtggtgttgagacactgggcaggggtgtgtggtggtagcagggtcctccctgcctgggatctcccagacccaaagcctctccagccccagaatctccttagttaagccacttctgagcaggcaaacagcctcacgtgccaccctggaaaggagcctaatgagggcgcagtaggcatgcttctccctggagggcaccaggccctgcctaccgtggcagatggggacttgccctgggcttgggctgggggacgtgccccagcaggacccgcaccatgtgcgccactccccacattgccctcagccaggcagggtgcctgatccagggaccatctgctgtcaggttggatatgttggagcctgcactccaaaatggatccccccacagtcctggctctccccaggcattgggttcagtgcctagggtggtcagagatgggtttgtaacaggcacgagcttatgctggggatggggagggggagcctggtgctcccccaggcaacccccaacagcctggcctgtccatggagccacaaaggtttcttgggggcccttgagtcctgtcatgccctttcccattttatagacaggaaagctgggatcacagtccatgactgaggctagaacccagggccctgtcccacccagagcaccttctgcacaagagactgggcatcagtcctgggcccttgagctgcttgatggtttataaggagcctttacagctgttaccttgttcaggcctcacaagcacaccgggaggcagtggttctttttcccattttgcagataaagaaactgaagcacagaggcattcgccaccttgcctaattctgttgggaggcccagctcacttgtgacaccatgagctcagcaagagcagagcccttgtctgagcccaggacggggcctggtttaaggaaggtcctggggagcttttatcaactgagaacaagaccaactggcttggtctgggaatgactgcaggaatcagggcatctgggaccacagcccctcctgggcccttggcttccccatctgtcaaatgggggtgtgggcctggcttgcccctgtggttctatccagttcacacattgtcagagctggcccaagtcaagaaaagtaccagatgcttcacgtagccccaagcccacacgtcctctcagaggtcctgggcagggcaagggctgtggaaatgagaggggaggctgactccaaagaccagctctacctgctgttatgtcaggggccacactgggcaggaggcgggtggcctgggtcccatcactgagcttgttccgctcctgaggcaggaaccagccatgtccatgtgagcagctggcacaggggcaggcatggcaggcgggcacgtgtgtgtcctgcaccccaggtaccgttgtcaaagccgacgggcagctcccagcccagcagcctggaatctgcgcaggccacacagcccagctcccaagtgaaggagggagcccagtggtccctgtgcatcttactgatggacaggcctctgctgggcggccttgaggcctcgaagatgcagctgcagaacccaggaggcccaatgcccaagacaaccatctgactcctgccagggtgtgggaggatggcccaagatggcagggtgtgggaggatggccatgcctggggggcagaggcaggcaggctgcactggagggaaacaccagcagggatgtgggcactcctccagtgagccaacagcgagcctgcgcctgccccagcccaggcctctccctgggggctcctggtgcccaaacacctccggcatgtctgtccaggggtgtccatatgcacaagccctccagcgccccgcccgatgagcacctcctcccatgctgtaccctccctgcccagtggatccgccggccttctccaccctgccttctgcctgtgtctcgaatcccccacctccctctgtgtccttgggacagggggacatccgcctccatgtgagagatgcagaaactgcagctgggagaggggagggcactggtccaaggtggtgctgcatggggatccccagtgccctgccaggagcacctccaacacctgggcagtgaccggagcagcttgagctgggatgcaggggtgacagcatctcacacaaaggagaaccccacctgtggccactgccccccagcagacacggcctgaagccacgtaacactggctgctggcgttgggggtgggacagggctttaggtcacagaggcagggagcacaggcgtgggcctcctcaatctccctcagccccagccagagccccctgagcaagggtggagcgggcggagtcggtccagcaccggcgcccaagctctaggctgggctttgggtgagccacacctgcgttccaggtctcagtttcttcacctgtcaaaggagaaggtggacaagatgtccaaggcccttcgtctctgatgtccctgccgagggaccccaactcctgttccctgcctggtgccgggcagggcctgtctgggcggctaacacatctcattgcgcccacaggtctgggagaggaagtgctggtggccgccctctccctgcctccccacacagctcctgcctcacaggtgccaacaacagcctgtggctcctgacacccacaacagctgtttcctagccttcctgtgaccacagaaccactcttgaagcagaagtgccctcgcaggacgagtaggtagaacaggtctccacagaggtgcctggggaggaggggtggggcgagacgggctggcctggttccgagcatggtgggaaaccacgggtgcacaggcccagcctctgcagcagcacctcttcaggggggccctaaaccaacgcatcctgacccctctccccgacgcttcctgatccctctccccgacgcgtcctgcctcaagccactgtgtctcctacatgttgttctccttgccacctgcccattttgcatctgctcggacaactaccttttttcaaatcccaactccagtgcagccccagcctcccctgtcgtcactctggcctgtctgggttgagcgtgtatcacttgcgtatttcttctcaggcacagcaatggagtctcccaaggactgagtcgcaagactcgggtaagaggggacagtttccaacctgcacgtgacaagccttacactcacctcaccctcctaggcctcagagatccctagaggcggctcagagagaggagagaggcggccatattctctctcctcactatgctccaggcaggtggaggacagataccctcaagcctgccccagaacctggagccctgaagcagccacagacactgcacacactgcagacaagtccctaggcctctctgggcctcactttcccacctgagaagtgccgggggtggacagagtctctcatcttggggttcgttattctccaggtctgatggcagatgcccagacagtggcagtgtgggctctgcacccgctggctccgatctcagctcctcctgggaagctgcatgaccttgggcaagtaccttcatttcctcatggggataataacaatccccacccacaaggttgttggaaattaaaatgaattcatgcaggtgaagccctagcaggggatccacaaacggcagctgcacggaccctcctcgtcctcccaccaacccaagtcccatcccaccagacccacagctccctctggggtgaacaggccagcagcgtctcactaccctccgggccagctggaaggctgtaagtgacgcatcagggctgctcacaggaatgctgcagactgtcttaaaggttgaggcagtggccatcatgaccttggattcaacttccacttacagccatgatggaataacagagacggaattcaccccctgccttagcaataaaaaacccggataaaatctatgaagccatggacaacaggcttcaatcagcacagcgattcctgagagaagaggaacaaaccagctgagccctaggatcaccccactatttccaggctgcagcacagggaggggcgcccccgtggagtcttgtggtctccctgagttgaggagacagggttcactctgagtgtagcagctaggatttgcaggacggagtgccgcaggggagagagctgcacagagtgaactccagagacctgcagagggtcccctggagtcttcagctgatagccgagcagcacacgaacgtgaggaaactactgaggctgagcagggaaccactggaaaggggaggctgagcagagaaccaccggaaaggggtggctggaacaattgctggtgctcacgcaggaccgggaatagtgtatgtgcccccagccagaacagaaacccctcctaacacacaggtcctgcagggggtgtcctcagaaggatactgcctcagcagttgacaaataagtcctagaccaggcataagcaaacttcctgaagaaccagagtgtagacatgtgaggctttaagggccatatgttctctgtcacaactactcaaatctgctggtgtaacacaaaagcagccaaacaaagtatataaataaatatctatgttctattgtttataaaagctggcaagaggcttcctttggcctggggtccataatttgcaactcctaccctggagtgaagtctgctctggtcctgcctaataaagcttgacaggaagccacaaaagcattaaatcgtttccaagtaacctaactgcatcccagaacaaggctccaaaatatttaaaggagaaaacaaaacaaacaaaaactacaaactaaaatccaacatgcccggtatccaattaaaaattaccagacacacaaagaaacaagaaaacatgatgcacatgagaaaaaaaaatccatcaaaatcaaccaaaaaccgacacagatgttagaactggcagataaagacataaaaacagttataactgtgttccatgtgttcaaaaagttaggtagagatgtggaagcttttttttagccaacaaatcgaaattcaagaggtgaaaatgcaacatttaagacgaaaaatatactaggtggaattaacagattaaacactatagaagagaaaattagtgaacttgaagacatgtaagtagaaactgtccaaaatgacacacagaaagactgaaagaacatgaacacagcatcagcaaactgtgggtcaacttcaagccatccaatatatgtgtaattgcagtctcagaaggtggaagggttgggagtgagcgagagactaaaaaaataaataaataagaaaaaaatggccaaaacacttctaccatttgattaaagactaaatccaaggcaaggtgcagtggctcatgcctataatcccagcactttgggaggcagaggcgggtggatcacttgaggtcagaagttggagaccagcctggccaacatggcaaaaccctgtctctactaaaaatacaaaaattagcagggcatagtggcatgtgcctataatcccagctacttgggaggctgaggcaggagaattgcttgaacccaggaggtggagtttgcagtgagccaagattgcgccactgcactccagcctgggcaacagagtaagactctgtctcaattaaaaaaaaaaaaaaaagactaaatccacaggtctcagaagagacatgaaaaaactataccaacgcacatcataaacaaatcacttaaagtcagtaacaaagagagcgttaaaaacaaccagaagagaaaagacaactgcatgtcaaggaacaaagtaagtggacttctcatcagaatcactgcaagccacaagacaacaggcaatatctttaaagtactaaatggaaaaaaaaaaaaatcaacttagaattttatacccagtaaaaatacatttcaaaacaaaaggcaaactaaagactttttcaaatataaaaaagctgagagaattcattaccagcagacccgcactccctcctccagctgcaaccccctcctccagcagcacggttgggacagacgtggctgcagcacctcagtttttctatcatgacatggtcccactccccctcccctcctcctcccctccagggggctggcagaattagtgacatgccatctgaagaggcccaagaaggttctctgggttaggaagttctcctaggatccctgggtggtgctccctgccacctcctggcaatctccaaaccagtttgcccatataatgtctctgaaagtctgtcaccgagaggactagtttagctaacagtctcatcttgcctcccagggtaaagggagtctgtgtacttggtaacaaatgctgaccccagccagagcaaggataattaggccaaccagctggcacgcatacaggtgtcccttttctggagacagggaggggtggtgatggccactcccattttccagagggggtgtcactgtcccagggccaccctgtcaactagtggcagaggtctcctgttcctaggcttttctcctaatgggggaccctgtgtccattccaacctctgaacccacccacagcctcccagaggccacctcagctcttgaaagaaatacctgaccatcagcactgtctggaaggttaatgcctgggcctccctggctctgccatgccttccctgggtggcccatggcgggtcacttcccactctaagcctcagcttctcttcttggtaacatggggagtgaaactggatgaactctgaggtcccgttccccttgacattcatcagctctgtgaacaccttccccaccctctgactattaaggctgaagcctcattaaggccaattaaaggaagatcaggccttctgagcaccaaatggctgcagtgggttggggtcaagaagcccaggctaatcatgcccagagcgctctgaccaggaggctcagcctagcccagtggcatgaaggcactaccctgagtctcctacctcccccagacggacatcagcttcctggtcatggctcaggaatactgcaaagacaaggggctggcagagcttggggaaaggccatgaggtgaccaaggctgttccctgtggatgaggcaagagggcaagatcctttcccgctggccgcaaggagcttcagaatcctcagagcttccaggcttgcaggcgcaggatccagccaaccagaccatcccatgtgggcagcaaacggcaccagctgagaattttcaaacaggaaaatctcaaaactatagattcaaaagcctttaaaacctcagcttctccagggtccaagagcgacagacattggggccatcaagcatcctaatgccccagaaagcctggcttggaaaggacttgcccaaggtcacaaagcacaccagggcagggctgaggcttctaggccacctggtgcccacatgctctctgctgcgttccagtgagcccctgcttgaacttctcccaggacagggagctcaccacttccaccccagactactcacagagagaagctctcaggacaggagtgaggagtgaaggtggaggaggcgaggggagagatctggcatctaccgatgccagctccatgccagacacagagtgttttacacaccacactttttcccatttaaatctcactgactttatgaggcaggtgttagctgttagcactaccatgacactgaggaggaaggaacagaaggtcagagaggccaagcaactatctccaagcagccactaaagataacaccagagctggggctcatgcctgggtcccagtgatacggaagcctgtcttcccaccaccccacatggcatttaacctggcaaggtactcgagcccaggggtcattcagacccttaaaggggactaggacagcccaaccaggccagggcctgccaggctggggccaacgtgggccagggcacagggtgggaccccatcttcctccccagctgctctcaaggcagagggtagctcagtgcttttggatgctcctgtctatcactgcgtcaagacaaggcctgatccccattttacaagtgaagaaactgaggccgagggtcctgcagcatgcaagtggctaagtgggaccagcactctctgctggcccaggggccaggaccctcagctgcagggagaccctctccagccagggagacccaatccaggtccagccacacctaagacccttggtgtaaccttatgaaggccccagccgactctgagcctcagtttccccagctgtgatatgaacatgacggcaggccctggctcttggggttgtgggaaggaggccagcccagtggctgagcagctgcctgtcccactggagtgcccagacgggcaggcactctctccttagagctccttcctcgaagggctgctcccggctctcctcgaaactcttaattaagggaagggagcctttggagcgcacaggagttaacacctgggattactttatcagatggttccccacccactctctgacctgtggtgggagcctgggccagctgtgcgccccacaaggtgtcaactgggccacctgtggcctctggcagtgtggggagctgtcctggcactgcccagctaaaggatgcaatgagtggccttcctcctggtccccaggccacagagctcaccctgttcttgtgagtccccgtcccagccctcctccagagagcccagtatttagctgccaaggagcctcatgaaaacgcttttactgccaggcacggtggctcatgcctgtaatcccagcactttgggaggcagaggcgggtggatcacaaggtcaggagttcgagacccacctgaccaatacggtgaaaccccgtttctattaaaaatacaaaaattagctgggcgtggtggcgcacacctgtaattccagctactcaggaggctgaggcaggagaatcgcttgaaccctggaggcggaggttgcggtgagcagagatcgtgccactgcactccagcctgggcgacagagcaagactttgtctcaagaagaaaaaaaaaaaaagaaaatgcttttactgtcctgagtcaacaggatccagcagtgaggctctggtgctcccatgcaggggtagggctcagaaggaacagtgccactgcttctccagggaatgggagggtgctcagggcctgcagactgggggtctcggcccagtccctccagatatcagttctgtgacctcaggccagttatttgccatctccgagccccaccaagcctcagtttcctcatctgcacaatggagacaacacctactttccagagttgtggggaggattacacagcatggtaaagtgcccgctcagcacctggcgcggggctggcatttagtaagcacctcattaagctgcttctattctctcagagccaagctgtgggccaggacttcagtgtgtgaaggcgggggcctgacagaaaaaatgtggggtgaatcaggcttcgtgaaacctgggttcgactttatttctctgggtctgttcccaagccctggcctggcatgcagagatcagtgttctggccctggccaccggcgcctcacctgccctcagtttcctcaactgtgaaataaggaaggtgtgatctgtccctgccctggggcctcaccctggggctggtgagggatcctgctaaggcccccctgctgtgtcctgttgaggggggctcagcatctgctggaggagcaaccagctagaacatctacatccagctctggctgaggaagccccaacccagcccagcctcacgccttctcaggctgcagccaagtgaggccggggctcgcccctcccaggcgtgatcttacaagcccgtcctctggtatgtagttggaaccccacagcaggttttttcccagataaatcatggctcctggggctaggggaggggcaggcagttgaccttccatcttggagtaggagcccactagggctggagggaggctggagggcacaagctgctgagagtgagacctgggacccacccgcctcttgtcccaggggagtctaggatcacagggcagcaaggtgtcagggctgaaggggcccctaacagtcttcaatacctgttcccattttacagatgggatgaccggggcttggagaggagctggggcttgttccaggtcccacagtcaggcagaggcagagcacggactcttggctcctggtcctgctgtccactagttccattctagtcatttgggaacaggggggactgacagcagtcctgacaggaacacagccgctcccctaagtgctgcgtcacttccctgccccagggtctgcctgttgtgctgacgacaggtaaggtgagtgaggaggcggaaggctgggctgtcctgactcagccccagcagccccagcctaaagcccccggtgggaaggggccagtgtgcggcaaggcggcccaggcagagggatccccatcctaggcagggggcaggcagagttctccctacacaataccagagtgagaaggggaggtggaagcatgggcacgagaggtgattcatggggagagataaggcagggagcgctcccaggaagcaggcagacaaagcgccccgtcagcatccgtcagtgtccgggccctgcccctgtgagcctgggaagcagctggggcaggacagctggaggactgcagtggcctggatgagctgcccctcccagcccctgcctgtcactctgtcctgccagggccagggcacaagggatagcctagagtttgagggaaacacaggcctggtccccacccctctacccgagaactagctaggtgaccttgggcagcgactaaccagtttctacatctgaaaaatgagacagataacactagctgagattataaagcgcctcgcactcagtcaacacttgctattgttattatccctgcccacacatgccacacaagcctgggccacaggtcccaggacagatgtggcagggaaggaagtgcccagggcagaaagcaggggcttggctcaccacaatgctgtggagtcatgaacaaatccctgtccttctctgtgcctcagtatccttgtctgtcagatgaggagcttagtctctactgcctctgaggcccccactgtgggacccttgaggactccctgaggtctgagagtagggagcagtttcagcagtgagtgccccatcctgagggctggaaaagcagaaagcagggcccacctgtccgaggctggaggacatcactcactatggggccatgtagacagactggcacccaaactggagaccagcttcttcctggctatgtcaccttagacaggtgacagcaatcaccttgtgggaagcaaaggaaggcaatgtcaccttaggtgacactaataaccttgtgggacttttgtgggaagcaaaggaagctccaggtggctcatgggactgtacggagtggctgggtcacagctgtagccagagactcagggaggaacctggggtcagcaggtgaagtcctggccctgggagcccctatctggcccatcgctgggcgggggatctgtctgtctgcagaccctctggctgttcccatctgcctccttcctgtcgctgacaaggaggggaggcacagaggagtgggaaccttggcacagcaggtccccctacccatggcctcagtttccctattttcaagatggaagtggaggctgggtaatgggatcccagcaggctctctgtggggactgggttctctagcctccagccagtcatccccatcaggcacagacatcagcagcacttcctccacaccacagcaggtgtggggcgggtctctcagtctgcaaactatgaaggtcccttcctcctccccctcctcctcctcttcctctaactccttccttacttttgtcacccgatattccatcttcacaatagccaaagatgcagcttttatccacaccacctccatcttatagatcagaaacccgaagcctcaaagctgcccagggtcagtcagtgaattgagagcagccaggccaggggccaggcgcccccacccagctagctgacccaactggtccccttgttgggcagggactccaccttcctggaaactggggccagggccaggggccacctcaccagttcttgacccacgtctggtttctctgcccacgaacttccccaaggccctgtcagttagccaggatggtccccgaagccagcattctggtcttctgcaattggctgccctgctctgggactggaagtataaagggattagacccagctaggaacacctcatcccacaacctgaggcccagacctggcttcagaatccttctcaacacagctcactaggtaagctttatctatcaaattaagatgtgcttggaaacgatgagaaggtacttacgtgcagcaggcattagcacctgctcatggtcacaactgtccagcagtggcctagctgtctctgcaaatggcaagcaccccttctcagaatgtgtgacggtgtgtcagccaagaatggccccccacagctagggcactgcatagcccaacaggggtggagaaggggagggccagagaaggcttgaggtcccttccggtggcaaaattcaggtggacaatgctcaggtggactcactccacttccacagatgaggaccacacctccctcacccaagcatcctggcctggaaagtttccaccattgcaaagctcacaaagaggctcagagagggtgtgcaatctgctcccagttgctcagcacagctaggaaacaggcagtgttgaacaaggacctccaggccagtctcagatggacttggaccatgcctattccctcaccccacaacaaaagctctccccaccagagagctcatggtgtgtgcgcgcctttacagtgaatcagagccactctaagggagagtgagaggaagccctggggttcctcccctccccactccaccctatctcggtgccttcttctggggaaccagaaacaccctccaacaataaagaggccctttgagacggggcagcccactgtcacctgctaggacctgggaaccctaccctgcaaagaaactgcggatccccacgaaggtggggaggaaacctccacccaagaggcagccagggaaaacagcagagatccctagaagcccatgttgggctcccgttttgggctctgagtgagcctgtattgagaggggtccggtggctggttgggccatggctccaggagtccccgcgctgcctcaccttctgtgcctggctgatcatcttccgcaccacctctttgatgtgggcctgcccgtctatggggggctgcatgtagacgctagcccgggtcacgccgcggtaggcgatggtgtcgggccagcccaggtccagctgcgggatggagcggtccgacttctggggccagtactccagggagggcagcggctcggcctcgatggggaccccatccgccccgctggcttcctcgccgtcgccgaccccattgtcctcgggcccctgagaggggcccgtgccccgagggtcctcagagcccgggtcgtacacctcgatggtctccaggatgcgcttgagctccagctccgagaggaagtctcggatgttctcccgcttgagcacctcgtagaaggcgtcccggccgcgggccaccagggcctccagcgccagccgctgctcctcgctgtagaagaactcaggcttggactcgctggagcgccagttcacatggttgtcgtccagacactgcacctgagagaaggccatggcgccgcctgcccgggcactgctgccgggggtgggtgggcaaggtccagctcctagctccggcccagctggggcaccgcgcgctcgggggcctctccgcggcctctgcttctctgcccatgagcaatctgcgggaaagacctgatgagcccggctcggcggggagggcgggccgcgcggggaggggcggcgggggcggggccgggaactcaggtgggcgtgggaaggacggggctggggctggggctgggaagatgaggtgggggcactggactgggatgggaagaaagtaagggatcggaacagcggtgagggagcggtgggccacgtcccagggctcagcgtgcctctacgtgcagggaacccatatcccagatttccggagctgcctgaagtcctcgcaacttctgagggaaactagggcagccggggaacttcccagtagcttcttagagtgggaggcggccccggcacagaggcgccccgcaaaccgagggcttccgggtaagggaggggtcttaaaatttccgggtgccggcaacccaggaggcctgcccggaggaggctggggctctgggaggggtccaggagacccagaaacgcggttgcggggcggcgacgccccgcgagacccgggatccggggggcgcggccgggacttgcttaccgagcgggcgctggcggagcggggcgcacacgcggcggctgcggcggcggcgcgaggctgggcgggggcgcgccggtgactcagggccgccccgcttaccccgccgccgccacctgcggtcacgtgccgcccggggcggggccggaagctgattcacccctcgacagacagacagacctggggcggacgcactgcccacggtcccctggtgcccgaattccgaaaatatcagaggcctaagcccaagagctcctggaacacccatcccagagagggacagtgttctccctgaggtcacacagcgggtcaacagccttggcacccccctgtgcccccagggtctgttggtgatcctggatcaaccctggctgtgcccagtttcgccggcgtggcgggaagtccgtgcggctgtatagatacccagctgtccagttgtggaaacaggtctagggtactgggctgggagcccccaggcagggatagggcactgactgacccaaactcagggctttcctgagcagatacccagttctcagtcctaagccctgatcccctctgggaggggtccccggactgcttctgcgtggcgggcagcacccgacctgaaccctagggcagggaggggccaagagggccgctgtgggctggggtcaggcccagctctctgctgagcgtcccctggggttgggaccctggttatggggagcgtggagaccacatctgaaggcaggctttgagggtgggacagcaaagcccattaaatctggcccaacaaacagcccccaccccatcgcgtgccgcagccagtctgcccggcaccaggcccagcccttcctcccatcccccatacttgctctggatctggatggggctggtttgggtcccgtaaggatgctgcttccgtaggctggtgacatctctaggccttgtgccctcaaaccccccccctccaaggccttctccaccattcatggcccatcaggactccttgcctctgagtccactgccctgggcaatgactagcctcctaggcccagcatccttgtggtccccatcactgacccctcaagcatgaagtcctacactctgccatatagccccccaagggctttatgctactgaacatagtggcccctggggaacaggcacacatatttgcatcctcctcctgccccagggccagagaggggaggtgatcccagcgggggagccctgccttgagggtcctgaagacccatttatagcccctctgctactgtggatcccctgtaagaccttctctgagccgcctcagcttctccctgtgttcttaccaatgcacagaggctggagagttcaggaagggagtccaaggcctcactcccacctccaccaccccaacacttctgcagttgatgagcaggaaggttgtatgcacccagttttccccagtagcgacgttttgcataactataatacaataatatcacagccagaaaattgacactggtgcaatccacaaagcttatttagatttcaccagttttttgtttgttttgggacagggtcttgctctgtcacctaggctggagtgcagtggtatgtacaatcattgctcaatgcagccttgaactcctgggctcaagcctcagcctcctgagtagctgggaccagagacaccatgcccagctaattttttttcttttttcttttttcttttttttttttttttgtagagacaaggcctcactatgttgctcagactggtctcaaactcctggcctcaagtgattctcccaccttggcctcccgaagttctgggattataggcgtgagccactgcactggccagatttcaccagttttacatgcactcatttatgtgtgttatacaaccttattatgtgtatagatttgtgtaaccaccattacagtcaagatacagaactgttctgtcactacaaagatctccttctctgtagccatccccacacctcccccgaccaccattcctaacttctggcaaccactaatctattctacaattcaacaattttgctgtttcaagaatgctatataaatggaagatatagtatataaacttttgggattggccttttttcccacttagcataattctccagcaagtcatccaggttgtttcatggatcaatggtttgtgcttttcattgctgactagtattccatggtatggatataccacagtttgcttaaccatttcagtgattgaaggatatgtggggtttccagcttttgattattacaaataaccttgttatgagcattcatacacatatgtatataaacatcaggtttcatttctctggcataagtgcccaagagtgttattcctgggtcctggtagttgcatgttcaaacactgccaaactttttccagagtggctgtaccatttcacattctcaccaacaatgtatgagtgatccagtttctccacatccttgccaacatgtggtgttaccgctatttttttttttttttttggccattctgataggtagatcatatcttattgtggcttaaatttgtgctttcctgatggctaatgtcattgaatctcttttcatgggcttatatgccatctgtttgtcttttcctttgaaacatttgttcatgtcttttgcccattttctaaatggattgtctattttttaactcttgagttttaacttttttacttttttgttttattagagataggctcttgctctgttatccaggctgaagtgcagtggcttaatgatagctcactgcaacctcaaattcctggactcaagccgtcctcccacttcagcctcctgagtagctgggactacagatgtgcaccaccatgcctggctaattgttttttatttttagtagaatcatggtcttgctatgttgcccaggcttatactgttgaatttcaaaagttctttatatattctagctacaggacctttgttgggtgtgtgctctgcaaatattttctcccagtcagtagcttgctttttcatcctcttcgaggtgtcttacacagagctaaagttttaaatgttgatgaggtccagtttatcaatttttccttttatgcatcatgcttttggcatcaagtctaagaactattcactttgttgaagtcaaaatgaaaatgtagagatgaatctctatatttaacgttttatttgggaagaaaaattgcaattcagggcatgcacaaagactgggtggtctttgatgtgtctggagaacacaaagaaggttagaggttttcttgaaagcagaaatgttacttagtgctctttgagaaagttccttggcactggtaagggtttggggagctgaagagttctgactggtaagtgatggtggtaagcaaaattagtcctagatctgtagcaagttatctcagcagctatagataaaactggttgcaggttgtaaaagggagtttctttcaccagccaggctcatagggaattgcatttttggaataatgttatgtaccctgggtgctttcccccactgtcctcttaactctattttagttttgtagacaagaatgatccaatgtgtatgatcaacttttacagcctagccttaggtcctaaagattttctcctattattttccccaaaagtttgatagttttttttaacattttacatttaaatctgtgatctattttgagttaatttttgtataaggtgtgaagtttagattgagggtaggtttttggcctatagatgttctcagaattctgagtttttacagaggaggagacagcctcacagattttttttttttttttgatacggggtcttgcactgttgcccaggctggcgtgcagtgtcacgatctcagctcactgcaagctccgcctcctgggttcacaccattctcctgcctcagcctccggagtagctgggactacaggcgcctgccaccacgccctgctaattttttgtagttttaatagagacggggtttcaccgtgttagccaggatggtatcgatctcctgacctcgtgatctgcccgcctcagcctcccaaagtgctgggattacaggcgtgagccaccgtgcctggcattattattattattatttttttttttttttttgagatagcgtcttgctgtgtctcccaggctggagtgcaatggcctgatctcggctcactgcaacctccatctcccaggttcagcgattctcgtgccgtagcctcccaagtagctgggactacaggtgcgtgccactgcaccttgctaatatttgtattttttggtagagacagggcttcaccatcttgcccaggctggtctcaaactcctggcctcaagtgattcatccacctcagcctcccaaagtgctaggattacaggcatgagccaccgttcctggccagtctcagagatcttaataatcactcaagatcttacagcaagggattgggagagctgagtttgttttgttgttgttgttgtttgtttgtttgtttgagacagggtcttgctctgtcacctcaaggctggagtgcagcggtgcaatcacggttcactgcagcctgcacctcccatactcaaacaatcctcccacctcagcctcccgaatagctgagactacaggcacgaaccaccacgctaattttaatgtttttggtagagacatgctttcgccaggctttgttgtttaattgagatggggtctccctatattggtcaggttggtcttgaactcctggcctcaaacaatcctcctgcctcggcctcccaaagtgttgggattacagatgtaagccactctgcctgactgagaactggatttgtactcaggtctgggagcctttctcctgctccctcctgcaatggcagtgtctggactggctcccgagaatgtgccgggcctggttagggagtagagagcaccttgattactcctcaagggactgtgtccagtgacctccttgggagggaatcattcactcagtcaacagacactggcagaagctaccatatggttgcttgtgctaagcactgttgagacccagacttttccctgaggccccatagtcatagtctgggtgggagacaggacagtcagaggtcatagagttattggtgctgtggaggatatagccccaaagcctgaagggctcagatgtccataatgaattgagaggaatgagtataagttccctgggataaatccagggaagggcagaaggtgggaagggtgttccagggagaaggaacagcaaacacagagacctagaggtgtccaggagagcctggggtgccagaagtctgggtgaaattagtcaaggagagggtggccgagcgaggtggccatagcaaggggtgtgggagggccttaattggagcctgtgataccccggcagcggctggagaggcacggagcgggtttgagcagggaagagcgtgggcggattggtgggtttcgaagttccctttgcttgcttgcagggggagtggattaggaggcacagcaaggaggtagtgcagttcgcctaataatcaaacaggactgggcattggccatggggagggaagacaaggggacgaggaggggcaacccctggcttctggtgtgggccttggctggacggggagctgatgcaaaagtggggcccagtggggagctcctaggcctgcagaagccagtaccctggcaaacccatagacccctgccagctccccagttctcactgcccccagctctgcctccccggggctgcttactctggagtcctgggggactgtgtttcaatggtgacaccactgccacggttctcataaagaagttctttcttgctgctcagcacaaacacttggtcaaaccagtgggactcggggcggtttcccatgccgagagcctggaatgggctgaagaaactcacaaagaatctcctgactcgggctttctgaaacatatatggctgcaacgcctcacctgtccctcccaggagggctgggtcctccgagtgccagtcagcctgcctaggttcagagcccatcagcagtggctcatcacctgtcctctgaatcctggaccccagtgtcctcagagttctgccatggggcccccggctctgtcttggatccgactgtgtcccccaggcaagttatgtcctttctggtcctgaaaaactaatgggggtagaggtggtagggtagggcagctggatcaaacagtgcctgaactcctcatggctctttctgggatcccttctcccactcctcctctcctcctgtgcctttcctccctcctccccaccatgcagtcacttattcattcattcaatcagtgttcccagaaagtctcttctgggcccggccctggaccaggcgatacctgggacttggagatgattcaaacccagtgtctgcccttggggagcctccgtcctggtggggaaggtagactatgtaaacaaacaactgtgattcaatctttggccttaggagcccttgggaggaagctgctactgccttgggggttgggagagtcagggaaggcctcagagcacaagccctttgcaatgggccttgaagcaggaggtaaacaagggtgtgggtgggtgttagacggacagtggtgccctgggaggagggactacgtctgcaaaggcatggaggcgtccaagtgctgggtgtgtgtgagaaaatacaagcaggtcagggtggctcgtgcacggtgctgggatgggaggttctgggaccaactgtcaagggcctcgaatgccatagaaaggatacttttttcccccaggatgccatgggctgagaggtgggggtagggaggagggtcctgagaaataagtaataggctgagagctgtgactccaaagtgtggagaggatggacaggaggctggggaggagcatgggattgggcagggtgggccccagacgggagggggaagaagctatgagcctggggggctaatgggaggagccagggaggtgcctgggggatgacaggaacctggcgtccgggaagcctggagctcaaacaggctgggctggagactgggacatgttcaagggtgccagggtaggggacactgccagggtaggggggactgccagggtaggggacactgccccaggccagctggcctgggggaaggggtgtgagacccgcccttccccatgggctgggcatctaagaagggacgtatcagaagggggctttggagggggcagtctacagagggagcaccaagtcacagaagtgtcaatgccagccgcccctgctgctgctgtgttgcaactctgcctgcccctaaccagccactgcagtgctgtcagtcagcttgtttctgaactcccccgtaatcatcatcttctggttagctctgcactctgggccctcctgaaaaccccagaagcaggggccaaagctttctagaaagtcttttatgggaggaaaaagagaatgtgggtcaactctcttcatccctacgtatcactaggccaaagtcagccccacgactgctaacaccagcaaatctcactgagcagagcagtgaggagagccccacacctcagggctatggaggtaggccggggttctgcccccacacagggcaggaggccgagggatgcctggatttagggttcagtcgggatctggcctgagcctgggaaattcgtgagtcctttcattcaacagatgagccgtgtgtaccaccccagccatgggggagatagcacgaggcaaaccccgtcctctcaggactcacctgccacagggaagtggcaagaaccaaataaacatgtccaagtcctcccagggatgacaagggatgagggaaagcgatgtggggcaaggggacagacggagaatggggtgggaaggacagaccggaattcgggaaggaggcagtcctcaggcgaggcctggggcaggcctcaggtgggagcgaggagggacttgtggggaggggccaagggtctggatcacccagggtcttgtagactgttgagaggctgagtggctggagagtcctgggcatcagctcagctctctgcagcaggaaatagcctggcgtaaagcttggaccccagggttggagacaggggtgtggatgggctctgaccccacgtcctaagccaggaagttggagcaggcaggcctcgccagcccctgagctttcaccacagccctgctgcatgagctgcagctgtgtgacagcacactcaagccggctgcccatggacagacgcgacttgttgacttgtcgctgagtgaacacaaagcccagggaacaggttgagggcctggggcagggcccatcctgcaggcctctctcttctctagcctccatttccccctttggggagaatggctggggacgaggggggcaagggaggctcaggccccaggtagactctaatggcggacctcacacagcagagccaacggcaggtgagccccctggccaagaagtaggatcaggaagaagagttatgatggagaacagcagggaaaaggattttcagaggccatgccctccctgtggctcagattgtgaaactgaggcccaaggccaaatggtaacaggtcagaggcattgatggagcaggtctgggccaggctcctgcccccagccctatcttgcccaccccaggtgctcatgtctatgaggagagacaccaagtgtccgtctctcgaacagatgatgtgggctgcgtggtgccgtccgagtgcctgcgggcctgcggggccgaggtcggctgctccaacatcgcctaccccaagctggtcatggaactgatgcccatcggtgaggctgtgtgggtgggggtctgggtggagggcgtggggttggacttggggcccaatgagtatggggactgtggaggctgccactcactggccaagaaatttggggcatgtcacttccctgcttggagcctgggtgtcctcatttgtaaattggagataatggcatctacccacccctcagcgttgttgctgggattaaacataatgacacagggaaaatgctgggtgcaggcttggccatgctgtagttcccaccttgggccttcgcttttctcttctgttctgggcaaggggactcgctaagccctccagggctgacaccgagccattgttgggccacagtccctctctaggtcttgagttccctctctaagaaatggatggaataagctccaagttcatccatctccatgagcaagacaagggagtgggtggagaaatgttttggggaaaactgtgatttgactcactttcctttgggctccatcccaaccagcttctgacaagtgaacagagagcccagagacacctggaagtcacacagccaatcagacacagaaccgaggccagacaacccagccaggcaataaatggctgtgccttccgggcaggggggcctatgtcaggcttatcctaggacagacgggcaagagtttgtagaggtaaaggaggtgcttaaaattgcaggagttcttgtagacagacttgaactcatccccagagaggggaggcgaccagcctgaagccacacagcacagagtgggcagttgagcatccttccaccttccttagggctcctcaccctcaggccctcttgagcccacaactcccagaaggcctttcacagcaatgctacccgcacctcctaggggagccctcactcccactctggaaaaccacagagccaaggagagaggggatccactatgcctgctgggtcctgccatgcacaggaagtggcggaaaattccagagactggggcactgcatgctggggtgaggtgtgcatcttgcccagggtgtggccttcaagcagaggccccgcccaagccttcctcaccaaccccaccgcaccccaaagtcctgccgctggcctgctgtgaatccctgggcaatctcttcacttctctgagcttccatttcctcatctgtcaagcgggttaatcatgctttcctcggacgaaggcatgggtgtgaaagtgctttgtcaacgccaggctctgcagaaaggacaggcctgatcgcagcctcagcattatgagtaattatggtcgggcctagggttgccagcaagcctagggctcaagcagccagctccgaagtccccacggtttgtccttggcctccccagtctcctcattctgggtcttgctcacctcaaacctcctcagcttctctccctccccgccctctgccttggaggagcatgcaaatggcgggcgggcctcaggcattagagcccaggcgggaggggttcccggggctgtctcaaggccggacagggtcacacatcccccgtcccaccccaggtctgcgggggctgatgatcgcagtgatgctggcggcgctcatgtcgtcgctgacctccatcttcaacagcagcagcaccctcttcactatggacatctggaggcggctgcgtccccgctccggcgagcgggagctcctgctggtgggacggtacgggggtgggggccagtacgggggtgggggaacactacaagggtgggcgcccgcactgactttgagggatgagccggagtttgccacttagagaaaggtggatgccaggaaggagggaagagaagggccagtgtaccccatccataccacctctcacattgctctcctgtccacctctgtgtgatcacagccctcatctgggatgcatctccacccttgagctggattccttctgcaggggccagccctccctccccaaccatgccacagatctctctatctccccgaaaacctgggcccccattcctcctgatggttcccagctgcgccacagagggcccccgggccagcactcaggactggccacacttgggctgccacgtccctcagcctccatggccctggccctactgagctccagcttgtttcctcccagcccagcttgtcccctcctttttcacctcgatgactcatgctgatctttctggactctgcctgtgtcccctcctccgtgcagtcctccctgagaccctcaaccaaggaatgagcctctctccccttcataccccagggacgcttgccagattcttcccacagcacatgtggccattacaggccaagagacctccccgacacccttctccaaatatctgggcgcttcatgaggaccggggctgtgtctggagaacaggtggtgtttggttacatgaataagttctttagtggcgatttctcagattttggtgtatccatcacccgagtggtatacactgtacccaatgtgtagtcttttatccctcacaccctcccagcgtttcccctgagtcctcaaagtccattgtatcattcttttttttttttttgagacagtctcgttttgtcacccaggctggagtgcagtggtatgatcttggctccctgcgacctccacctcccgggttcaagagattctcgtgtctcagcctcttgagtagctgggattgcaggagcgcaccaccacgcctggctactttttgtatttttagtagagacagggtctcaccatgttggccaggctggtctcgaactcctgacctcaggttattcatccacctcagcgggctgggattacaggtatgagccagtgtgcccagcccatcctatcactcttatgcctttacatcctcagaggttagctcccatgtgcacgtgtctatttgcgccctccctggccctccagtcccaccctcttgttgtcctctgagcagtgtggctcacactctgctgctcgggggtccagccttctggcacaacagagcaccccctggccaggagcccagggcacccatcctgggggtggggtctcctccagagctccaggcagctgtcccagggatgcaaaatagtcaggcttctgttggaagggccctgttgggacacgccagaggcgggtgcgagtgagctcatccacgggctcacaggattctccaaaacaaggagcctcccacctctcactgggcaggacacttccatgtccctgtgtcctgggcacttggccccttgaccacttctccccctctggctcccctgcctctcctcagaagctgtgtggcctggggaagaccctgcccctctctgaccatgtgtctcctctgaggccagaccttgctctaagcccctccatgctccagcatcctgggccctgggaactggatgccctcctgccacccagtgtgtgacactggtagcccctgtacctgcccagtggccctcatgtcccctgcccactacttcctggcctcctcacccagactcccacctgcaaccaaaagtcttgacctggcctcctgctgcgccagctcacccagctgcccgtgcccttgaccctccttcccacctcttctgccaagtcaacccccgcccctagccctgcaagcctggcagtcggcctccctgaggagcaaggcacaaggctgcgtggtgcagggcaggttgctcaccctctctgggccccagttctctcagctgccagctggatagagcagaaagggccccgtgccaggtgtcaggctggccagctcaacttcccgtccctcttacagcactgggataccctcaacacccccagcccctcaaagccgtctcagcttcctcctgcccgaaacaccaccattggagcggtatctcctaggcctcgtggtcatggatctctggtagggtgaatggcctgacaacagtctctgtcagggagaggcgaggcttacagagagaagaccaacagcccagaggcctggagaggaggccatcgcagggccgggtgcagtaccatgccggtgaccctgatggctctgtccagctgagcagaggctggaggagccgtcacaggctgggggagagcgatgacccgcccccactcccgtatgcctgccccaagcccccacacctcagtccactgttccgccactgcccccctgccccactctcccctgtctgtgttcccggctgttcagtccgtaaatggggcccacagcctcctggaaaccctgtgcaggactcggagagatctcagacacccctccttgagatgttccacagtaactgtggctgcagcccagggagatgctggagggcactatccaccctgatggtggcatgggagggagtggcattccaggcagaaggagcagcctctgggtttgggggtcctctggcagccaggtaagaaggctgggtaagaaagcgagggcctggctggagtggccccagccctggcacagagatgcagagtctggtgttgggcgggagagctgtgtgcagagggcggggtgggcaggcgttaatggaggcccgcctgggcctttgatgagggcagcgcccgcctgcctgcctggctaggggttaattagccttaatcaaggtggcacctccttcctccaccctctccctcaggcctagaagggaagaaagggagggaggaaggcggacaggcgctgagaggacccaccctagctgaacacatagcctctgtcacccctgccaccacagccagggttccagcgggtcacccaccacccaccttgggggtgaggaatgccaactgacccaggacacaggggtgaggtgctcagccagggaggagcggatggatgccatgccccagcttcatccccttagctgggtcccatgcccctcaaggctcggggagggggtgcctcctcctgaaagccctcctagattgatgtttcctctgagctgctccagcccagtccgagtgtaggtaagaggctcatctgttttctttgctggactctgagtgctgggcaggcaccaggtcccactcatcgccgagttggggatcctagggtagtgtcctacgcaggtgagcacctcaccagtggtttgttggatgaacaagtgtagcatgtgcctgttgtagaggggctcttggcctaagggagaggcaggcaggagctgacacgcaggggacaggaggggacgggctcatgctggcccagcagggctccggcttcacagctggggagtatgggctctaaccccaacccacacctctggctccaaactttgcatccttagtaagcaggttgccctgtgaaggatgtgcagcacagggctgtcggggtggggatgtgccagccagaggtcccagctcccacaaatgccggccagtgtgaaaaatcctagtgtcttcaaataaccaccaggaagtcagtctggcccagatcggggggcagtggtcattcatgcactcaccaaatgcttagtaagcacctactatatgctgggagacacagcaatgaactaaagagatgaggctcctgctctcctggtgcttccattgggaggggaagacaggcagtaaacaagtagacacccaggtaaatgtgcatgtagtgactgggacaggtgctttgaaggagagacaagagggagctccatggcggagctccaagggctggctccgcagagaccccagggcagggaaggagcagacagcacttagagtcaggagctgcacctgcaggatccagggagccaccaaagggtttggagcagggcaggactggccaggtcactggtggtgtggaccagagtccagggaggaggctggagctggggtagcaggggaaagattagagagcaagtcttagtgaccaggggaggtgggagagagctgaagagcctcccacgacgaccgctgcctgccttccactcgcctgcaggctggtcatagtggcactcatcggcgtgagtgtggcctggatccccgtcctgcaggactccaacagcgggcaactcttcatctacatgcagtcagtgaccagctccctggccccaccagtgactgcagtctttgtcctgggcgtcttctggcgacgtgccaacgagcaggtgggcgtcggcggtctgctctccctggggacgtgccacaatttgctcttccctgctgcctgtggggggagccttggtcctcctcccgtagccccacatgccctgcctccctcctccccagggggccttctggggcctgatagcagggctggtggtgggggccacgaggctggtcctggaattcctgaacccagccccaccgtgcggagagccagacacgcggccagccgtcctggggagcatccactacctgcacttcgctgtcgccctctttgcactcagtggtgctgttgtggtggctggaagcctgctgaccccacccccacagagtgtccaggtgagccagccctgacccctgaccctgacccctaacaatttcttactctggtcccattctcatccccgacccactctgactcagaattttctagccctggactacctagccccgtccctttttgaactcagctgccatcttgccatccccaacctttgatcctgtctgggtcacccccaccctgccatcccccacccccaaccctatcctcactcatttcttacagattgagaaccttacctggtggaccctggctcaggatgtgcccttgggaactaaagcaggtaagtggatgaccctaggcactcctccaccttgaccctggcctggaggcaagggcaccaggtgtaaccttgtgtccttcatctgtccctctccttctgcaaccccctccaggtgatggccaaacaccccagaaacacgccttctgggcccgtgtctgtggcttcaatgccatcctcctcatgtgtgtcaacatattcttttatgcctacttcgcctgacactgccatcctggacagaaaggcaggagctctgagtcctcaggtccacccatttccctcatggggatcccgaggccccaagaggggcagattcccctcacagctgcacagcagctcggtgcccaagaactggccaagccagcaaagcgggagccctgaaaaattaggggggaaatgggagaaaataatgtgacatttcaaaaacagcaccaaagcagtcagcattggaaggaaaattagatttctgacggacatcctgatgttggttttactgttttcgttttgaatacacaggctgggtcaggagcagtgagatttgccagcactcagggttctaagggtcttgggccagctctggatggaggaagagccccacatgcccagagcaaggccccccattaagggactgcagccacctccaagggctcctccctccacccaccggctcccaaatgccagagggagcctcttcgccctccctccctgcccaccatccctcaaccatcagcctggcgttcaaagcctttccaagtcccacctcacttttccctctcccaaaggtgcccaggctctgggcaggccctgctcatatccctgatcatggcacattctctggaggaccctcctgttctcgggtaggggccgtgccccacctaggtagccgtcccatgtgggatcctgtaggatctctaaaacctagctctggccccaactttctgtctgccctggaggtttctcagcctcctgagagctctgctgggccccggtctgggcagaacctgggcctaaacaaacaagagccagggcagccagggtctctgcgtggctgggcccagggcttgccctcagagctcacctgtccaacagaagaggagtgtgcctccaccttccctactgcccgcccctttttcagggtcttagggcctctagccctgtggtggggtgctgggtgccccaggtggagctgaagtcatggggctgttgaggagttggtgtccacctggagtctgtccagtgagtttaggtcaacaggtgtgcagtctgtccttcgaggctgagccacctcccaacagcctgaacaactccaggggccttttgagggaggggcaggcaggcccagtgggtggtcagcccaaggtgaacccacccaccatggccagggttccttaggttgagcctccagtgggtgaaacctgggagtcctcaaccttcctggcagatggggccattgacaagaggaggtgggcggggcctccacagactccgccctgtggtgtcacacagctggcagccaatggaaagcaaccagccaggaagccccggagctacccttgctgggtacccttgctgggggacctgggccatcccagtttgtgcagagcggccggaggcagttaggagcccacgttcagtccaaggccgtccactgagccccgtgtgactctgacagagctgggggtgtccatgtcctctctggacctcagttcctgtaaaaaggcccgttggccagatcggccgccgggctgctcacaggtgcacgggctgcacgtaactccgtgggaagaagccaacgcgcccgcaggaccggccccgccaccagtgggggtctgggcgctccaggacctcaatgatgtcgccacggcggaagctgagctgcgaggggtcctgggctgagaagtcaaactgggcctgggcaaagcaggccccaggtgactgcaagaagaggaggtggttagtagggtgccttcagaagccctgcaacccaccctccctcagaggcacccaagagaagtgatttgccacaggtgaggaggggtctcgggcagcaccggagttgaactttaagtccagatcaatggtagtgccaccactgggcctcctgctgcccacacccctgcctgtctgctgtgcagatgctgcatctacatagaacacggctttcccagccgcccagctgggacaatagggctggtgggtcaggggacctgagtcctggtccttagggtgggattttggttaggtccctgcttctcttgggatcttatttacccgactctgcagcagccatggtagcttttgactccaggccacaaagccatgagaatgggccttataaactgtaaagtgacgtgcagctaagagtcgtgtttattgctcttgcccttggtcagccgttgagggagagaattgtcactttgagctctcaggcctgggctccactcctatctatgccccatgtgtgatgttgggtaggtccctgccctttgtggaactcagtttccccacctgtgaatggcagcaggacaggagctctctgcagcacatctgcctggcaccgtgactattgcacccagcaccctggccctgcctgcccaccaagatctcagctctgaatctgcagaatctcatccaggatgggtgataggatcagcagagaagctgtaattagcagctctctgcccaggaaggaggaggcgtcataggtcccaggggactgaggcagctctggagtcgagccacagggtgggtgaccccacggcccgggccagagcgaggtgttgggtgtaggggagctctcagttgcccctgccctagctccatcctggcttcctcacactcttccaaggcagagctggcccaggtggtgaacagggaggaggatggagatctggcagacaggagcccagctggagagaaaagtgccctgaggctgggagctcacagtgacctgggcactcagggtcaggcagggaaggccaacagaggagaaactagtgggggtctctcaaggcactgtttgactcccctggcatatcagaccccagggctcatcctactgaacagagggaacactgaggggatgaactggcctctgatcacatggaaaggtggtggggaggtgctaggaacaagatttggctggagcttctcttcagcggttatcagcctctccccaggccttggccacactccccatctcctctgcagagcccaagctcaagtgtcccagggtcttgacctccagccccaggccttgccagcatccccgctcctgaagaaaacagcctgttggggctaataaccccagtggctattgttggcatcccaatcagcttcagagctggcccttggggctccttgatgaaagggctggctggcaaattgctgttattgcaaggtcaaggggtggatgaccccgaccccccaccccccaccccccaccccgcggcttgccaggatctcgcccaccagcactcatgctgccccacacccaaggtcaactcttccgcgagcagaaaccaggactgagcctaccaggtaagtgtccttggatgagtcactgcactctctgagcctcggtttcctcatctgtataatgggcatgatgaggctcccagagtacagagaccagttcagtgcatggtacccagtatgctcagtgggggtctgtaccttccttcactcaatgaacatttattgagcacctactgtgtgccacatgctattctaggagctgagaacaagctagacagtttgtccccatgggattttccttctgtcctttgcttttctttccctcttctcctttcccacccttgcaagtctcaccatagccgccaccaggatataacttcgaagcctgggctggacgcctcttgcaataccaggctgctggggaagtgagaccaggcccgtgcttggcctcagtgtcagcatctcccctgctgcagatggcaggaggtgcagagaggctcccacaggccagcccccacccgcccctaccttgagcaagggctcctcgtcgcgcaggaagatctgccgcttcttggcgatggtggtggtgcggtagaagtcgaccagctcgttgagggagttgaacttctcctcccacaggaagtacttccccgaggcctcacgcagcaccttgaagtgctgcacctggtctccatagctaggggaaaggacccggggccacctcaggtggtggccgtcccagcctggcatggtcccaggggctcccgtctcactaccacctggaaccagcctgtctcacggtgggacctggagtcagataaggtgcaagtgggagaggccccactgacccagctccacatggggtctggggagtcccatctggcagtggaatatggggttaatttaagggtgtgggctctgaaccaggccactttctcactgtgtgacctcatgcaagtctctcaacttctctgaacctcagttttctcataatgataacatctccgttatggataagtgcacagtgactggcatattggcaacgtgaaatgggtacctctgagtgtgtcgtgatcagagagcatctccttcacatctctttgttgttcccctcagcttggacctactccctgctcccctgctcctcccatgccccagagtcccttggggagcaagtcctagactcatcctgactcagaccaaagcctactgctatgagaggagctcagacctgttgaatgtctcacgtcctccccctcccatgaaccttccgtggcttctcccttggcctcagggtaaactcttaacacttcagactcaagatctggctccacttacatgtccagct

SEQ ID NO: 203 - DNA, 64045 bp, Homo sapiens
tttttcaatcatgtggatgatatataacctgctataaacccaataatggttctcctgccatttaaaaagacatttgtaaactgctttcctgtgtgttagtttaattttttcatcattcattttggtattaaaagttgacaaagcattaaataaaatgtgaacaaatatgtaagggcaaataatctcaaaatataggagctatagtttggtagtcacataaaaaaggctgccagatttagataagatcatgtaattattttctacttgaatggtttctgtagttaggtgtcccattttcctgtcttacttaaaataaggggaaagaaaggcaacagcagtagttgatcatgaagattcatgatcttttcaaagacatcgactccctacaaaacagaaaaaggagtctacagagactgtctttgcaaataattatctttgcgcagatgtttctgtacttagacgtactccttttcatcattagtttccaatttactatagggaagttgtctttccagaatattttacatttctttatttcttcatttccttttttcctttcttctcttctttttttttttttttctttttggtatagggtattaaatctagaaggtatctcagagaatatctagtttaaccccttagaaagtcgatgtgacttgtcaaagtcactgacattcagtaacagaagtagcatttgagcactggtgtccaggtttcccgcacatcagtcctgtgctcttcccatcacagttccttgtcttccctgtctttcatgttttgtttctttcatactcagaataaataacacagtattttcccatttaattgtctggatcgcctcaacacaattctaggggctcctaatctgaatggcttcattccatagattgtgaaactaaaccaaacgcacacagacacacagtgaggtgcttagagtcagaggttgcatgggcacttactacactggagtgacaccgcaggcatttcctttctgatcactcagtccatagggtgataaccaataaatacgagcaaaaccagtataactgagattggcaagaagcctcctggactccaaaagtgtgactttaaagacagaaaatacattattttccctatggctagtaagattcagatatttttatgagccatcagaggtacctttgtaggagtcctttagaaaatctttcaggctaacattattttgtataaaccaacactgataggtaatcaaagtgaaaaagggaggaacacacgttcctatctatggtttcattgatctcatcttacctctggccttcaccagtctaagtgatcatttcctcagactgacatgtccatcaccaaggcagtttctgtagtttgacatatgacctactgaagcaaaaatgccccagggtatactccaagtgaaaacagatagtgaataaataacgtggattccaaagcaagtagcatgaagtgttgaaaagttctctgtgccaattctttgacttttctctaaattctgaagaagttctaagttaacaattcatgattatccatgaaatgaattaatctgaaccctgttgacttttgtctgatgcaactgtgctttaattcttattttaattaacctgtagatgaagaacacataccagctcaaagctcatttcccaaatgaaacattgtttgagctggtgtgtgttaatttcccaaataaaacattgttgtttcactctttgagatgtcaaattaaattggttacaagaaaaaattctgactttgatcagtcctctatgccagccaggaacatttttattatagaaaatctgtatatgcagtgaagatgttgctttctcactgatacaagggcggagtagtcatcatcctttctgatgaaacacagatggtctctgcagagcccccattcatctttctgcaacagtgttgcaattattcagctaccttctcctgtcaccttctttgagaaagatcatccactccaaatactcttgctcccttttattggcacatattcagagccacatatgtgacatcttggacaaatacacccatcttaggaaaaaattttaacaggagtatgcagtagttagatctcctagaaaaactttttttgagttccatttatttctatcttgaaaataaaaacgatgtacttccaaaacagttgagaatatagaaaagcatagtggcagatagtaagtcacgtacaatcccatcagaaggggtaaatattattaatatttttacatattttatttcagtcttcattcatacatataatatgtctatttattaaacttcagcattcttttttgaacaatttatggataatttgccatatccttgtgtatatttctgaaacatgatgtttaattgctaataatactctactatacacttagccaatccttactggtttgtttttcatttttaacttttaaaagtaatattctgattaacaatgttgtgtataagtatttctctatgtttatgattaagttcttgaaataaattcctggaattacaattaagtcaagtaattaaatgttctcaagacagcataatataagaacctgtattttccaaatactcaccagtaaaagctattttaataagttaaatttgtttgacattccattcaatattaaaggattgaccttcaaatatttattgtccacttatattcttcctgtggacatctttttgttttgttttgtttttgagacggagtctcccactgtcacccaggctggagtgcagtggcgggatctcggctcactgcaagctctgcctcccgggttcacgccattctcctgcctcagcctcccgagtagctggaactgctggcgcccgccactatgactggctaattttttgtatttttagtagagacggggtttcaccgtgttagccaagatggtctcgagatcctgaccttgtgatccgcctgcctcggcctcccaaagtgcagcgtgagccaccgcgcccgtccgttttttccctttttttaaaaacacactttacttttacttccaggtgagtatttttaatactgttatatttttgtaaaatattataaaaatactgtaatagttttgtaaaatattttgtaaaaatttttaaatgaagctatttaacacatatgacatgctaatgttacttaatggattcctatgtatttcataggaatctcggcccagtccaggcgccgcgcgtggctggagctctggctggctgccttagtgtcatgcggaggcgtagcgaggattcagggacagtaagctctgttctcgccgagcagggggcgggctcgcgagatcagctgcttctggccgggcgggggcgtggactcagcgttctgggtggccaggccgtcgacctgcggcctttgttccgggccgctgccaggcctgaggccctcctgggtttcggttcagcgttagttaacagttaacccgccagggcaggcttctgcccaggcacaggagagccagtgagcttgttcaccttgaaacttgggccacacctgagacctgccacctcagggtggtaagcaggccgtttctaacaagctttcatggcatttgtgcgctttaaagtatagaagctgctccagggcttccgcagccccggccgtcctggagatactcgttccctggagtccgtagttgagaatttacagctcctggacagccacgtgcagtctcagaactgcaggcgtctttaccgaaatgttaaacacagcttgaagttaggcaggataactgccagagctggatggaccttagaggtgccagctaatgcgctgtgagcgttttctgaggttaggcctgctctaaacatttgatatgtgttaaggcatttatgtgctttgcccacacccctatgtggcgggcccttcttacagtaaaagaaactgcagcacagcgaaattaagcaacttgccccaaatcacgcagaactgggatgcaaacccaggtctagctcactcgtgatcacagttcaacatcagacgatgatgccaatttccagaacagctacgtgactttatataaaattattgggcaagcgttcaattgtaaacattcgtgaacatagctgttgcacattagctttcctatttttttttaaattcaggaccatgtttggtgacatatagatatcaatattatatatatcaccaatatacatctttgctttgctaaaaggtttttgtgtcttcaggatagtttacttgtaagccacatgtttttataaatccgtgggtgcaacctgaataaaactaatgcctaccccgtggcggttttgtgaagagtaatgaactattatattcaaagggtccaagcagtaggcacttactgaaggacagctagttttatctattattattctgccattcagagagatatcaaaactactctaaggcatttctcttccctgcacctaaaagcaagggtgtcatacttgagataagcattctgataatgtgtaggcaaagtttccagacttagtaaaagcagcttaatcatggctcaagaggagtgacaagttaccacctatctgcaattcaaggagaatataagatagagaagaaagcagtgaatgaatttcatttgattagcagtagattggacactctactggtcttgcctctctacaacctctcttccacctgacctctaaatgttgaagtgcttcaggaaatgtcttagaccttcttccttatctacacttcctctccaacatgaatcttgatggctctgcacaagatactgaaaagagggaatattcttctgtctgggtgggcagagaagatgacattaaaaaatctgaaagaataatagctgttgtccatgatagagaagtggtcattttctatcacaagggagaatatcatgctatggatattcgctgttaccactcaggaggacctttacatttgggagatatagaggattttgatggatgaccgtgtatagtttgccgctggcataaatacaaaattactttggcaacaggagaaggtctgtaccagactataaactctaaagatccatcagcaaaacccaagtagtgctccaaaggaataaagcaaaggattcacacagtgacagtagacaatgggaatatttatgtgactctttctaatgaactaatgactctgatttttatgccactggatacttcaaagtaattaagagttcttcctgataaaaaatacatagcaatgaaaaatattgtgtatgcttgaaaacatttttagaataactctgcttcagttttaaaagggatgaaatttttcaacataggcacaactatttaaaaatcatataaatttgagaggtttaagagcacacatacttagtatgatataaggattatcatcaggatcaatagaatacattttatcaaatcctctggattaattagaacctgaaggttataggtttggtatgttctgtttaagaaggatgaaaataaatttggagtaaacaaaataaataataggtaaaaattaaggtttagtaagaatttttttaattttaaaaatttaatttttaaaataggaaaaaatccctgtttgatgtagcagacttaattctggaaaagttttaatatatacaaagtaaatagactatataatgaacttccatcactcagctttaacagttatcagcattcttccattcttgttttatttatacctctatggattccctacctctcctatttgattgttatttttacatttttaggtaaagcttaaatacattgaaatgttcacatctgaactgtacaactttcccaaataacatagcagattttgtatacttaaaaaatgcctccaaaaatgagataattttacctgctgaacttgaaaataagaaacttaaccactgtgctagacatcaaaaccaaataagccttggcttagtttctctatgatcaaggcagatcgagcagtaaggaagccacacacacctgctgcccagccatgagagatgtaaagtctcctgttcaatgagtcaatgtactttgaatgcctatatgaaattttcaaataaaggttttttaaattttttttaaataaaaaaataggccaggcgcggtggcttacgcctgtaatcccagcactttgcaagcccgagacgggcagatcacgaggacagcagatggagaccatcctggctaacatgatgagaccccttctctactaaaaatacaaaaaaattagccgggcgtggtggcgggcacctgtagccccagctactcgggaggctgaggcaggagaatggcgtgaacccgggaggcggagcttgcagtgagccgagatcgcgccactgcactccagcctgggttaccgagcgagactccgtcgcaaaagaaataaataaataaaaataaaaataaataaatctcccacctgtgttaagacagttaaatatttcttgatgttagcttgaggaccaagtgagccatcttgccagttaagcaagtcttatttcagaggaccaaatggttaaaagaggagaatttgtacatttgttgagcttccccatctgaagcttgggttccgtactatcctattactatccatcttcatactgaatgaaacaaactgaaagggaattcataatcttttttcttaactgaacaggaaaacttatgaaaatcaacaataaatctgaattttaattttcattcaacagctgaaaaaccatgtctgttgaccacattggactattgcctagttaaaatccataaaattctctataaaccaatgaaaagaaagtagtctggcaataatttccaactttttaaatcctaatttttaggtcaggtgcaatgcctcacgcctgtaatcccagcactttgggaggcccaggcaggtggatcacgaggtcagaagatagagaccatcctggctaacatggtgaaaacccgtctctactaaaaatacaaaaaaaaaaaaaaaattacccgggtgtggtggcgggcacctgtagtctcagcaactctggaggctgaggcaggagaatggcgtgaacctgggagggggagcttgcagtgagccgagatcgtgccactgcagtccagtctgggcgacagagccagactccgtctcaaaaaaaaaaaaaaaaaaaaattctaatttttagttacaaagaaaaaggatagaacgaggcttttcaaggaattcttgctcatcccttcaataatttggtaggcaacacagtcctagaattcagcttcctttttggttttattactattaaatagatactttcatataaatggaaacatttttcctcaaaacatcaattcaaaacatactccttatattaatggctatggcaccacatttttggtaaattccctatgtgtaactttttcctgttggtatgtgatttttttcatttaatatgactatctgctggtgttgggggcaataggtttgtgaatattctgtggatatgtccatgcataggtgtatatatatacctatatttttccagctaatacctcaaatgtgtgattgtttaatatataccacactatgtttgcacagagcagggcttctattagcagtggatatttttatttcttttttttttttttttttttttgttttgagacggagtctctctctgttgcccaggctggagtgcagtggcgcgatctccgctcactgcaagctctgcctcccgggttcacgccattctcctacctcagcctcccgagtagctgggactacaggcgcccgccactacgcctggctaattttttgtattttttgtagagacagggtttcaccgtgttagccaggatggtctcgatctcctgacctcgtgatccacccgcctcggcctcccaaagtgctggaattacaggcatgagccaccacgcccagtggatatttttatttctaactttgaaaatcagtccacacaatttcattggtgtgaattctttctgttgctctttttcatattttaatgcagagattcctcttacaaggcccatgcttcaaacacaattatatctttctatatccagccagctggaaatatataggggtaagaagtatttcttgaaaagtccttgtttagtaagttagtaacaactgggatgactagttgccaagatgtcttgtaactgcctagcagatgacacctgccgtggcaagtctcattcacttcagtacaagactctgtacatttcaatctgatattctattttgccatttaagtacgccattaaaatcatagagattttcagtgacattggagtactgtaaatattagtttcaaaaagaattattttgaataggatgattaaaccaataagaagaaagaaacacacagaaatgatattttgcagtttatctgtattaagaaatgcttcttgccaatttctggttttggtttttggattgctacataagactttctttccatttactttatgtgtttttaaaagctgcaggtgatttttaaggtttgatggaattataatgggagccttgtataagttaaatgaaactggtaaaggagagcttactttgtctataatgctttcaggattataacttagatttaaaaatgaaatgtctgacttgtaaaatatttaatgttatatcagacttcaataaaattttctgcgagaactcaaagtaaatgcattagatttttaatgaatgttctgaatgaaatatgaatttttgtctttcagtctctgtagtttatctcaatatattaataaaaaggtctgttctcactgtaaaaaaaaattcatattataatgacatgaatatacagacttccaaattagttctttttatatctgtattttttaaacctcttgagttgggttatttttatttccatttcctggctcttctgccgcatgaaaatcatgcttccacttttcttgcaccctttgataagcctcaaagttactatatggggtacccgaaagacaagatattgtcactagcctcaaaaattttactattatggacacacagacaccaatggtttccctgtttctgaaagctcccagtttacacagatagaacttcatgctttatattctttatcagacttcacatagttgaaaattatttccttccaatctggaaaagatgatttttgagttgtaactgatcacaaattgctagtcagtctgtgtgttcatcctacggtttcaacatcttctaaactgtgtttatggtactagtcttaattcatttttatattaaaaacagtcattttcatcacacatacctgcatttcaaaattttttattagaagatgacacagtacaaggcagttgaacactaacttttgatattttgataaaaacaaaaatgggaatctttccaagtgacttttgagcaaggatctggtcatctatgtatttgataccagtcgctcaatattttaaggtaaatttaattgaagtatattacacatacataaatgtgcataaatcataagtgtaaatctcaatgaattttaaaaagaaaacacaacagaaaaacaccttagcattctctctaatgcctgcccctagtcataatccacaatccccctcctaaacagtaacaattattccttaattaccataaattatttttgtctgttttgaaatatttaggtaaatgcagttagataaatgtactctctttgtttaaggcctctttttataaacattgtatttgtggcatttattcatattttgtatgtggaaacagttcatttatttttactggtgaatagtatttttctcctgtgaaaacaccatagttgtattcctctgttctacttttggtgagcattttgtttgtttccaattttgatattttgattaagtctgtgatgaacattttcttttcttttttttttttttttttgagacggagtctcactctgtcgcccagactgaagcgcagtggcgggatctcagctcactgcaagctccgccttctgggttcatgccattctcctgcctcagcctcccaagtagctgggactacaggcgcccgccaccacactcggctaattttttttgtatttttagtagagacggggtttcaccatgttagccaggatggtctccatctcctgacctcatgatccgcccgcctcggcctcccaaagtgccgagattacaggtgtgagccaccgcgcccagccgaacatttccatacatctattttggtgcacagatgtgtggggttttgttgcagggtcataggatatgcattcatttacctttactagatactgtaaaatggttattcacagtgattgtacagcaaaaatttcccctccttacaatgtaaatgagaattccagagttctatatccttgctcagatctggtaatttctcctatttttgattagctctaatagtgagtgcatgaagttgtattaacttgctatactattgatccttaatgaagcatgcctcctggtattttgccatgtgtatccctacccacattgactctggtcttggccatgtgattagatttggccagtgggtgcttagcaagtatgatgcaagagaaggatttacaaccacttatgaacactgggaactcctaatctttgaatgctccttgttggaaatcagcttccacactgagaggagcccagtaatccacgtggagaggtctttgggggagaaccaaaacttctggtcatagtccaagctaagcttccagccaaccatgagcactacttgctagacacatgagtgaggtcattttggaaattccagctgtcttagcaatagtcaatgtcaccggaagcagaagaaccatggcccagtcaagtcacagagtcatgaataataaataattgttgttatattaatatgttaactttgggatgacttgctaccaagtaaaaataacttagacaaaaacatctaactggttttaatgtttatatatctggtgattttaaatgttgattatcttattgatatttggccatgttctagttactattgatgcataacaggccaccctggggcattaagcaacagtcagtttcttataccagttttgtggcccaagaaattagggctcagccatgagagtgtgtttctgctacccagcactgggggctgaaggctggaatcatctggagactccttactcactcgtatgtctggctcctgggctgggatcagtgcaagtctgggctcacctggcacttgattggagcacctacacttgggctggccatgtagtttggcctctcacagcatgaagacttgattctagtatggagcataccaacagggggcctcttgaaaacgagatggcgctccatggcctcttatgatctggcctcagaaatctcatatcatcatttcaccacactcgatgggtcaaaacagtcactgccacaatatattcaaggccacagaacctacttcctgatcagaagattgtgaacgaacaaactggggaccatacgtttaacctctcattttgcatcctctaaagtatggtgcttgttcaagtccttgggacagaaaaaatttgtttcacttaggctatttttttcttgttgctgtgtagctgttacatatatatgatatgtatgtgtttgtatatattctcttttccccattttgtgaattgttttatctcaatagtacatattaataaacaaaagttataattataatgtaattccatttgtattagtctttttcttttttttggagacagaatctcactctgttccccaggctggagtgcagtggtgccatcttggctcactgcaacctccgcttcctgtgctcaagtgattctcccacctcagcctcccaagtagctaggattataggcacccaccaccacacctggcaatgtattagtctttttatgtctggtttaagaacaattggtttaacccaaggtcaaaaaattattctcatatgtaatattatagaaactatatttctttacctttcacacttaagtctccattggaattgactttagtatatgcattaggaaaaagacaaatttttttccttatgtggttatctgattgatctagtctcatttgctaaaaaggaagaatctttttttctaatttgggtaactatgtatatctggatctgtttctagacactctattctattccattagtctatttttcctatctatctatcccaacaccagaatgtcttaatcactgtagctttgtagctttataatacattttgatatctggtagtacaaatcagcttgccactacacacacacacacatgcacacacacacacacaaaaccctactgagattttcactgggattacagaaaatttatacaaaaattggaaaaaatttacagattataaataatgagtctttcaatccatgaatatggtatatatcccatttatgtaatttctctcaattatgttttatggctttcagtgtagaagttttgcacatcttgattacatttatcctgaagtctgtaatgtttgtgttgctattgcaaatgatattctaaattctaacttttttataaatcttttttctattttttgctagtatataggaacataattatttcacttaatcagcaagcttgctaactataattatttttgacagcttttccaaagatatttttggatttcctacatagccacttacgtctgcaagtaatgaaagtttatttcttcttttctaatctatttagattcctgcttttaatcatttatacatatttcttgccttattgcactgacaagacataatgttaaatatcgcagtagcagccgataacttggtataattcctgatctcaagggaaaagcttttatcatctttcagtttcatacttgtgatttttttagtaatgattattaaaatagagaaaatttattttttttgcgatgtttcatttttaatgtataacagttttctgaaatattaccgttgttttcattgtataggtacatgtacatgtgcacacacagacacatgcatgtgtgtaaatactaatttttatttatttatttatttttattgatcattcttgggtgttcctcgcagagggggatttggcagggtcataggacaatagtggagggagggtcagcagataaacaagtgaacaaaggtctctggttttcctaggcagaggaccctgcggccttccgcagtgtttgtgtccctgggtacttaagattagggagtggtgatgactcttaatgagcatgctgccttcaagcatctgtttaacaaagcacatcttgcacagcccttaatccatttaaccctgagtggacacagcacatgtttcagagagcacagggttgggggtaaggtcacagatcaacaggatcccacggcagaagaatttttcttagtacagaacaaaatgaaaagtctcccatgtctactactttccacacagacatggcaaccatccgatttctcaatcttttccccacctttcccccctttccattccacaaaaccgccattgtcatcatggcccattctcaatgagctgttgggtacacctcccagacggggtggtggccgggcagaggggctcctcacttcccagtaggggcggccgggcagaggcgcccctcacctcccggacggggcggctggcctggcgggggctgacccccacctccctcccggacggggcggctggcctggcgggggctgacccctacctccctcccagacggggtggctgccgggcggagacgctcctcacttcccagacggggtggctgccggacggaggggctccttacttctcagagggggcggctgccgggcagagggtctcctcccttctcagacggggcggccgggcagagacgctcctcacctcccagacagggtcacagccgggcagaggcacccctcacatcccagacggggcggcagggcagaggcgctccccacatctcagacgatgggcggccgggcagagacgctcctcacttcctagatgggatggcggccgggaagagatgctcctcactttccagactgggcagccaggcagaggggctcctcacatcccagacgatgggtggccaggcagagacgctcctcacttcccagacagggtggcggcctggcagaggctgcaatctcggctctttgggaggccaaggcaggcagctgggaggtggttgtagcgagcccagatcacgccactgcactccagcctgggcaccattgagcactgagtgaacgagactcggtctgcaatcccggcacctcgggaggccgaggctggcggatcacttgcggttaggagctggagaccagcccggccaacacagccaaaccccgtctccaccaaaaaaatacgaaaaccagtcaggcgtggcggcgcacgcctgcaattttcgcaggcacttggcaggctgaggcaggagaatcaggcagggaggttgcagtgagcggagatggcagcagtacagtccagcttcggctcggcatcagagggagaccgtggaaagagagggagagggagactgtggggagagggagagggagacggagagggagagggagagggagacggagagggagagggagagggagagggagaatactaattcgaaaatttattttttaattgtacatttttatgggagcttcctgattgaggtatactccacccagtcttaaatctgagctccatagaaactgaggcaaagacagaatcatgactaattacatagccatcattgtttactagaaggaatcatacccaaatgaatgaaagctccatgagaaaaagaacttcacatggagtcttcaatgtcatgtaacaagtgcctagaatagggccaggcaaacagtaaacattcaattaacatttgctggctgggtgcggcggctcacacctgtaatcccagcactttgggaggccgaggagggtggatcacaaggtcaggagatcgagaccatcctggctaacatggtgaaaccccgtctctactaaagatacaaaaaaattagccgggcatggtggcaggcacctgtagtcccagctagttgggaggctgaggcaggaaaatggcgtgaacccagggggcaaagcttgcagtgagccaagattgcgccactgcactccagcctgggtgacacagcaagaatccatgtcaaaaacaaacaaacaaaaacatttgctgaatgaatatcgattatgtgggtcctaagaggactttgttttgcctaaagttctttgttagaagttctaatcaactaataatgacacccttgcagaaattttatttttaaatgaagacatgttttatatttggctgtttcttaaatgagcctccgtgaaagtcatgggcagtagagtaaattgtacttgtgggaaatgcaattgtacttgtacttaatgcaaggccaaagtgatgtagtttgggtttgcagcttattggttcagtacaggtttagtgccaactttccaataactttaaataataaatgctgctcagaatggaataatctattattctaaagcacagttccatttgcttaagaatatgtaaatatcgcaccttcttgtataacttctataaaaagattttgaagttttaattatttaaaggttatatacaaaaagctactttagagggaacttttttataacacggtgttcttttattttccaggaagagagaaaagccaaaaagtaattaaaataatgaaggtgaaagtgattattatctccatagtatctccaaaaacgaaatagaatgaaacacaacgaaaaacgaatttaaacaatacagaaaataattaaaaccttgctaaaattgtttaggttctctggcttccagtgaaaaatcagactaaaggatgaccaattaaatcagtgttttcactgtaggaaatgctaacgtctaaagaggcagaagaagaaaaaaatattttacaggtcagggataagtcatgaaaaggataatagggaaaaaggataaaatagtcaaaaacaggtaaggaagggattaaatgacagtaatactgctcttttagaaactctatttaattgactttgccaccatgaaagctttcatattctccaaatatcactagggagtcctcagaattatttatatatgacttaatgactcataatagaaaatatattcgatataacatgggactctgtgtaaactgggggctttttcagagtaacagcttgtcaataattcatcttgtccatggtcaaatctcgtcaaagttcacctcatggctatacattcgaagttcaaatctctcaccaaaatacaacataaatttcagagaaacagacctgctcttgtatatgtatatatacatatcaattaagtggtgcattttcttttttttttaataatgaacatcgtttattttcataaaggaaaaataccttttttttattattattatactttaagttttagggtacatgtgcacaatgtgcaggttagttacatatgtatacatgtgccatgctggtttgtaatagaagtaacagctgcaagaactatctgacaaggtattataaaactctaacctactgcatcaacacttagtatcataaagctattgtcctgccagtctctcagaggtaactatgaataaaatcaggttaagaattctaccatatcatcctcctattgatgatttgcataggaactatggcaagcagcttaggcactggaatatttcaaataaattaataatgctgaaataagtcaaacaccattttgcttactactgcagaaaatataatgctatgactgctgataatctctgaaagttattcattgtgtataactgaaactgtatatacattgaacagcaactgcctaattccccttccctgcagccctgggcagctaccattctactttctgtttctctgaatttgactatgttagatatcctatatgagtgaaattatgtaatatttgtcattatgctgctggctaatatcaattagcatcatatcctccaggttcatctatgttgtagcatgtgacaggattttcttgtttttttaaggctgaaaaatattccatggtatgcatttaccacattttcttcattcaaccattaatggacatttagtttatttgtatatcttagctactgtgaatagtgctacagtgaacatgaaatcctttctcaaaaaaagtaaaaatagaactaccatgtgcatttccactctgcaatctcactcagattacataacccaaaaaaattggaaacaagatcttaaaccacttttttttaacaaatggtgatttgagtcaagagagtagtaacttgagagatcacatagctaagaaatggtggagttagaaatcagatccagatgtgtctaactctagtatgtattcttaaacaaaacattaataattgtttcagaaataagtaatatatatctttttatcattttttaaaaaactgtgaatgcataatagcagattacctgatgaccatatgagcctgtcagaaaatgaatttgtagtgtctgttttagcataaggaataaaggaatataaatgtacagaaacacttatgtaaatcccattgtgctggcagaattggctaactggaagaaaatgctgaccacttactgcatatcattaaaaaaattaaattttaaatggtttcaagttcaaaatatgaagagtgataattaagaaagtaaggctgatgccatgtctcaagcctgtactcccaacactttgggaggccgaggtgggccgatcacttgagatcaggagttcaagactagcctggccaatatggtgaaacccccatctctactaaaaatacaaaaattagccgggcgcggtgttgggtgcctgtagtcccagctactcgggaggctgaggcaggagaattgaattgctggagcgcaagaggcggaggttgcagtgagccaagatcgcaccagtgcactccagcctgggcaacagagcaagactctgtctcaaaaataaataaataagaaagtgaaaaactaaagagttcaggggaacatcttaaaataatggaatggagcctactgaagcaggatgtgattacaaatgaatttgaattcatttatatgacaatatgaattgggtacttaccatgtatcagacactcttctaggtactagggttatggtatgaacaaagcagacaataatacctgtatgtggaatttatattttactggggaaaagacatgataaatacaataattaagaaaaataatatgaaatggtgattagtgctaaagagaacaaaaagaaaatgggacagagaatgctggagcaggactgatggattttcactgagatggacacgagaagcagtcctgcaatgggacgtttaaacagagatctgaacaaggcaagggagtgtaccatcgcggtaagtggcgaatgagctctcccaggagagaggcgcacatgaagtcctggaggtaacagtataagtaccaagctggagcaaagttagcaatggggaggggctagtatgcacagagctgctcctatattttaatggttgcagagctgccgagaagtccgtgtgcacatatttttcttaataattaataatcagtgttctgaggtctttgtaaaacacacaacttttagcagaatgactgcccagctgaaaagttgagcgttgactacagggatccactcagaggaggaggccaatcccagggcagttcacctcatacccgggcaggctggtctgtaaggtccctcagccctgctgttgactatgaacaactctggaaggtgagcattcgtaagaaatgagcaatgtcggccaggcgcggtggctcacgcctgtaatcccagcactttgggaggccaagacgggcggatcacgaggtcaggagatcgagaccatcctggctaacatggtgaaaccccgtctctactaaaaatacaaaaaaattagccaggcatggtgttgggcacctgtagtcccagctactcgggaggctgaggcaggagaatggcgtgaacccgggaggtggagcttgcagtgagccgagatggcgccactgcactccagcctgggcgacagagcgagactccatctcaaaaaaagaaaaaagaaatgagcaatgtcttctgcaagctatacgtccactctaccagagggtgcctcccctgggaaacagccttcccaggaagccctttatcccaaattcctttttgttcttggacaaagaagagaaggttcaagttcctacttcacacctctccctggcttcagataatggaccccagattgggaatgagattgagaaaaggggaacaagagaaaaaggaatccagaaccggccacttcacaagcagtaacaaccaaatttgaaaggactacagtgttgttgccagtactgccctccgtgggcctccattggcccttccactggtgggccccagggtacttggttcatactcaggctctgagtatgaatggaagggccaatctcttaagcctgacactcttcaaaccagagaaaggaaatcacctgcaccattctttgactggaaaataatcaaagttgaggtattttataaactttaagtttattcttaatattattacaaatactttaagtgtatcaatatatgttctatcaaaaccaatcaacctcattttaaaaagcacattttcttcacaaacatttctgtcatctttaaaaagtctcccttttgagacaggccttgctctgtcactcaggccacagtgcagtagcatgatcatggttcactgtaaccttgaactcctggcctcaagcaatcctctcacctcggcctcccaaagcactgggataataggcgtgagccactgcactcagccaaaatctctttttttttttttttttttgagacagtctcgctctgtcacccaggctggagtacactggcgtgatctctgctcacggcaagctccgcctcctgggttcatgccattctcctgcctcggcctcccgagtagctgggactacaggtgcctgccacctcacccaactaatttttttttttttgtatttttagtagagacggggtttcaccatgttagccaggatggtctcgatctcctgacctcgtgatccacccgcctcggcctcccaaagtgttgggattacaggcgtgagccaccgctcccagccaaaaaatctcttttaaatgtactcgtctgagcagctcatcttagccctctgagaaagccaatacactgttacagaaatcaaaactctctctcctttgttcatgacctaggacaccaagaatcaatcctgcttatacatacagtcgatcagttatagaactttgttttagcctatttccccctacacaccacacaggcttctgactcagttttgctctgtgtggaagaatttcaatccaaatctgttggggtatggtagcaaggccatgttttccaattctttggaagttggtggtaactaaaatggaaaagagattcttagcacaaggaaaattagagatttgattagctatatgaaatttagtcaatcaaatattccatggtatgcatttaccacattttcttcattcatccatcaatggacacttagtttatgtgtatatcttggctactgtgaataatgctacaatcaacatgaaaccctttcttaaaaaaattaaaaatagaacgaccatgggtaattctactctgcaatcacactcagattacataacccaagaaaactagaatcaagatcttacaccactttttttttaacaaatggtgatctcaagagaggaaaagttcagattcaaacgactcaaagaggtaaatttgtaggtaaaaaaaaactgagggcctcaatatgatagtttctcttccttgtgctggtaccgtgtacagcagtgtggcatgccatatgacaaaggtgactgaaaaacaaattccaatgctacagtgtccaggacctagctcattctttatagtctgtgatccacatcaccaccacaaagttcatccctgcactttgaaggtcccaacttatgtaaattccacacatcacaggacaataaaaacaagttattctaaatacttagaagggaggaaagaatacaaagtatgaaagaaaatatgttggccgggcgcggtggctcacgcccgtaatcgcagcactttgggaggctgaggcgggcagatcatgaggtcaggagatcgagactatcctgactaacatggtgaaactccttctctactaaaaatacaaaaaattagccaggcgtggtggcgggcacctgtagccccagctactcaggaggctgaggcaggagtatggcgtgaacccaggaggcagagcttgcagtgagcagagatcgcaccactgcactcgagcctgggcgacagagcgagactccgtctcaaaaaaaaaaaaaaagaaaatatgttatgcacatttctttccagttatagccagtgacagctcttctactggatcagctatcgattgccacaacaaagctgcataacaaacaaccactcaagctcagtgctctcttggcagccacagaggagctagagaggaagtggaaatatgcaagggccttgttgaggctctgtttttgtcatgtctgttagtatccctttaccaaagcaatgcacatgggcaaggccagtgtgagaatgggaaggcactgcaaagtcacgtgactgagggcaacaggcagaaaggaatgatcagatgcttaacgtgttactatatttcagttattgaatactcatttgattattgtttttagattcaatctcttaatgatgttttccaccttggcatctatcttcctgaatatactaatcactattatgtcagtctgcctctgttaacttcaatttctggatcaactctgcatctgtttctattatctgttttttcttggtcttataccttagaatgcctaatagttttctggttctttctttaatttaataactgatgttgtggatgaaaaaatatcaattcattagagagcattatcttcttttagaatgaatttttgaggcatctggcagggcagttatgttaagggaaatttccatcatcttaacacaatgaggcatggggctggtttgagattggatttcagtctttctaagtcctaatataattcttatttcccctgactcctatggtgttgtccttctggcagcacaactaaagttgagggtaattaccagtgaacttcagaatccaaaattccaatgttcaccttttcagcactcatgagacagctaatagttcagctgaaattttctgacttttttcacttggcatcattccctagaatgatgttccatagaaattgttgtgtacatcattgttcatttctttgtattactgagtagtattccatgttatgggtgcatcatagtttgtgtaaccattcacctattgaaggacattttgactgtttccaatatttggctatttcacataaagttactatgaatgcttgtgtacaatttttagtgtggacataagttgttatttctcttggatgaatacccaggaatgcaactgctgagttgtgtagtaagtgcatatttagttttatcagaaactgctgaatgattttccagagtggctgtgtcatttttaacttccaccagcaacatctgagtaatccagtttttctgcatcctcaccagtacctggtgtcatcaacattttttattttagtcatgctgataggtatatagtgacatctcattgtgattttacttttgtatttctctaatggctgttagataactttttgtgtgctattaatcatctatatatcttcatcagcgaaatatctgtgcatttcttttgcccatttcccaattggattctttatgttttactgcttattttgaggcttctttatatattctaaatactagtcttttgccagatacgtgagttgaaaatattatattactgtctgtagcttatcttttcattctctttacagggttttaatttgataatgatcaaggattttgactcctaggtaattcctcaagaagctacatatctaatagaacctaattctacatttgctaggggacacatgaaagagtgttccaagcagaaccgttcacagtacaaaaaccctagagataatatgtccactgacacaagtaaatgagtaagtgctaagatattcacagaaaggaatcgtataaaggaatcaaagggaataaccaaccatgtggttgaattttagaaataaactattatatttctaaatataatataatatatattatatttctaaatataatataatatatattatatttctaaatataatataatatatattatatttctaaatataatataatatatattatatttctaaatataatataatatatattatatttctaaatataatataatatatattatatttctaaatagtatatttagaaatatactattgagtggggaaagaagattgcttagtatatgttttctataaagttagaaataaaatatattggcaaaattatagaagcaacaaaaatacataaataaaaatgggttaattaacaaagtggtgggatgactgttacttttggtgggaagaagagaaggttttgaaatgtagggggactataaagctaaatgtaaattatggccaggttaaagcaatgagtagtagactcacaggtgcttcttaccttaacaagtaagcagtctgttgaaaaaaacaaaaaaattaagtaaaccagcacactaaattcagtgtgttgtgaacatgagtcacattcaaaaatttttaaggggaagaaatagcaaatacatgatttcagttttatgtggcattagtttattatgagatggatgaatggatggatggatggatggatggatggacggaggacaaaatggaaagattttagtgtatcagttactatttattgcctacctgacattcaaagctgcttctttctttctgacatgatattgattttttttttaggtatccaccctcctttatttaactcatgcttgcttcacagattctaaaaggcaggtttggattccttttatgtgttcataagggccccactccctttgcagctaattgatgtagacaagcaattaagtggttcttgctaaacagatttgaatgttactctactaagaatcttctgaaaatgtatcttcattctttttttttttttttttttttttttttttgagacagagtcttgctctatcgcccaggctggagtgcagtggcacaatctccactcactgcaagctccgcctcccgggttcacaccattctcctgcctcagcctcccaagtagctgggactacaggtgactgccaccacacccggctaatttttttgtgtgtgtttttagtagagatggggtttaccatgttagccaggatggtcttgatctcctgacctcatgatccgcctgccttggcctcccaaagtgctgggattacagacgtgagccactgtacctggcccccagtatcttcattcttaagaaggtacattattttattttttgcctatcaatgcttcctagcctggaggatatgaaaatatatctaaatcaactgcaaggaccatgccacctttagagagtgatctagaagatcaagcccacacattgagtttggcagagaagaaagagggccttagccttactgaactgctggacttaaaaaaccttggacctaacctgcctttgcacttattttgacatttactttcctattaatccagttgattttttttaacttacaatgtagatatatagatgatacataaatcactttaaatgacaggttagaaaacatttacttcaagtagccatattatatggtgaatactgtcaaaagattcaaaatcattatgtgatgggcctggccaagacaatggtatgcatcagggatctggaagaaccagcacattcaaattgggcaggctgagaccagcttacaaaggtctgggtaggatgcagggaattcccaagtgatatggttcggctgtgtcctcacccaaatcttatcttgcattgtagctctcataatccctgtgtgtcatgggagggacccagtgggaggtatctgaatcatgggggcaggtttttcccatgtcgttctcatgatagtgaatgtctcactagattggatggttttataaagggcagttcccctacacatggtctcttgcctgccgccgtgtaagacatacctttgttcctccttcaccttcctccatgattatgaggcttcccccgccatgtggaactgtgattccattaaacctctttttctttataaattacccagtctcgaggtatgtcttaatgcagtgtgagaatgaactaatatagtaaactggtaccagtagagtgtggtgccgctgtaaagatacccaaaatgtggaagtgaatttggaactaggtaacaggcagagggtggaatagtttggagggctcagaagaagaaaggaaaatgtgggaaagtttggaacttcctagagactgttgaatggctttgaccaaaatgttgatagtgatatgcacaataaagtccaggctgaggtggtctcagatggagatgaggaacttgttgggaactggagtaaaggtcactcttgctatgcaaagagactggtgacattttgcccctgccctagagatctgtggaactttgaacttgagagagatgatttaaagtatctggtagaagaaatttcaaagtggcaaagtgttcaagatgaagcagagcttaaaagtttgaaaaatttgcagcctgacaatgcagcacaaaagcaaaacccattttctgaggataaattcaagccagctgcagaaatttgcataagtaacaaggagccaaatgctaatcaccaagacaatggggaaaatatttccagggcaagtcagagacctttgcaacagcccctaccatcacaggcccagaggcctgggagggaaaatggtttcctgggctgggtccagggcccgcctgctgtgtgcagcctttagacttggtgccctgcatcccagctgctccagccatggctaaaagggccaaggtacagcccaggccgtggattcagagggtgcaagccctaagctttggcagcttccacatggtgtgttgagcctgtaggtgcatagcagtcaagaattgaagtttggaaacctctgcctagatttcagaggatgtatggaaatgcctggatgtccagacagaggtgtgctgcaggggcagagccttcatggagaacctctgctagggcagtgtggaagggaaatgtggggtggaagcccctatacagagtctccattgggcactgcctagtggagctgtgagaagagggccactgtcctccagaccccagaatggtcgatccactgacagtttgcaccatgaacctggaaaagccacagccactcaatgccagcccgcgaaagcagctgggaggggagctgtgccctgcaaagtcacaaggatggagctacccaagaccatgggaacccacctcttgcatcaatgtgacctggatgtgagacatggagtcaaaagagatcattttggagctttaagatttgactgccctgctggattttagacttgcatggggcctggagcccctttgttttggccaatttctcttatttggaatgggaatatttattcaatgcctgtacccccattgtatatagaaaataactaacttgcttttgattttacagactcataggcgaaagggacttgccttgtctcagatgagactttggacttggacttttgggttaatgttgaaatgagttaagacattggaggactgttgggaaggcatgattgtattttgaaatgtgaggacatgacatttgggaggggcccagggaagaatgatatggtttggctatgcccttcccccaaaatctcatcttgaattgcagctcccataatccccatgtgtcatgggagggattcagtgggaagtaattgaatcatgcgggcgggtttttcccatgctgttctcatgatagtgaataagtctcatgagatctgatggttttataaagggcaattcccctgcacatgctctctgtcttgccaccatgtaagatgtgcctttgatcctccttcaccttcctccatgattgtgaggtctccccagccatatgtaacagtgagtccattaaacctctttttctttatacattacccagtctcagatatatctttattagcagcctaagaatggactaatacaccaagagagagtataatgccccagggccagggccactgtgacctgtggtaacaatggatgggcacagttactgggacctggagcacagaacatgtgtcaagatgccagttgtcaggagctgtgtggcagttatctattccacaataaaactggggatatcaatatccacaagatatcaataaaattgattatctcacagtttctgtggttcaggaatctgagaagggcttacctggaggcctctggctcagtctctcaaaagctgccatcaagtcacaggccagggtcatctcaaggctcacctggggaaggatcctcttctaagctcacacatgtggttgctggtatttggaaatggagtccttggaggttataggtttaggcgaggtcatgagggtgggaccctcatgaatggggttagtgtccttataaaaaggaataccagcaaattctctctctttttcccatgtgaggacacagcaagaaagcagacatctgcaaatcagggagacagccctcagcagacacaagacctgttgacgccttaatcttggacttcccagccttcagaactgtggaaaataaatgtttgtggtttaagccacccagtctatgatgttttgttatagcagcctgaattgactaagacagataccttgaaaaccaccatcccctgctgagcaatattgttctgctccttaggctgatttcagttttctttcacttagcatttcataactttaatttgcttgttaaaaaatttatctggatcttttattccctttatcctaaacttcaaaccacccactttcttttgcaagttttctgtttgacaccattcacttccttttctttctccttcattcatttctccctttctccctctttccctccctccctccattccttttgtcctttcttccttcctttcttctttcttcctttatttttttcatctgactctttccctggcaattgtccttggctccttcgtttacagtagtcactcttgatggtgagcattttgaatctccaaatgactatgaaatctttttatttctcattagcgcatgcaggtagtacatgtgtttcagtaaaattgaggaagcctggcagacactctgtggtctctgctgcattttctctggaatagctacagctctgtgtagcaatatggttaaggcaccatattgtgtgaaggcccacctagcctgggcatcactgtatctctgtcttcctaacaaaatgaagtggaaatttcaaaaaaatcaggagatggaacaaaagttttctcatgttttttactgcttattaaatgaacaacgaacaataatccaatgttaaatgtaaagttttcagccctctgcctgaataggctcacctagttatttgaacatgcctcactccaaatcttgtcctcagcaactgtggataaatcatgacagagaagttcccctaacctacagcagaggctcctcaagctatgccaccctactgatatagaagtggagaaagagtgctgggcgtggtggctcacgcctgtaatcccaacactttgggagtctgaggcagcggctcacgaggtcaggaaatcgagaccatcctggctaacactgtgaaacccggtctctaataaaaatacaaaaaattagccgggcgtggtggtgggcgcttgtagtcccagctacttgggaggctgaggcaggagaatggagcgaacccgggaggcggagcttgcagtgagccgagattgtgccgctgcactccagcctgggcgacagagcgagagtccgtctcaaaaaaaaaaaaaaaaaaaaaaaaagaaagagaaaaagaaaaaaaaataatggagaaagaggtgttctggcccatttagttacattttccagggcaaaaatcacggatacatggtgaaattcaactatattctctgcccaagataaaatccaattacagcctctgctcaatgaggaaatcccatcacaggttccttttgcttcactaggagacaaagagacaagtttgtttataatctatttatagaggcatacacaccttaaaaaaaagtggtcctcaagtaggagatttgcatttgttggtcattttatttctgggcagatgttcagtctttctaacttgaaaagtgtctagcaactttggctgaccttattaagattaatggtcataatgtatttaaatcccctgttgttctaagaaggattaaacaaaagttatgggaggcccttgttttagactgagctattacaaattgggccacaagagaccagactaaaccaaaatggagtcactcatgctaaataccatataattaaactggaactctaaggaaacaggtagatcccacatcagacttgtttttcctgaaatcaggggatacaagtctgagtcagtatactaaaaaagtcccctctgctttaacgcttatgaacaaagtaacctgcaggaacctgaagttaaccagtcagcttttgttctattgttctacttccttgttctcagtatgacctctcattctattttgtagtatggaggcatctctgattaacaaatcatgagaagaaagccaattagataaccaaataattattatctcttactgaaataactcccaaggacctttggcaagatctagcactaaccaaattttcccagaaaaaaattttgggaaaggactatttgtggattgtaaaccactactagggcagatcccaactgattagagatggattttgaggatgcactcaagaaaaagaagcacaagttaaagtagtacctgtcacctgtgctttttccaaagaaggttttgtgaacttcaatatttaaacaggaaagagtaagaaggagtggaagaaacaaaaggagggagggtaggcattgatgcaagtggtgaggcattgattagcactcagtgaatctatattttacacatgcaaagaagggcgtagaggaaaaagtcaattatgcattcatttcatgctcagtaaatctatattttccgtaagataaagcaagcatgtgaaatcatggttctttctgtttgggaacaaaaagaaggcagttttatgcgtgactcagttcccactcttaacttttcgctttggcatagtgagacgggagtcctaagacgttatttatttatttatttatttatttatttattgacggagtttcactctgtcgcccaggatggagtgcagtggtgccatccctgctcactgcaacctctgcctcccaggttcaagcgattctgttgcctcagcctcctaagtagctgggactacaggcacctgccaccacacaggctaatttttgttttttcagtagagacaaggttttaccatgttggccaggctggtcttgaactcctgacctcaagtgatctgcccacctcggcctcccaaagtgctgggattacaggcttgagccaccgcccctggcccagccaaggatttatttgtgcctgcagatagctgtatgaacagacacctgtaagaattgggggaattcctctcttctcaatgttccaaagtaacttgaggttccgggccattcaaaggtgaaattttttactcaccacaggtcaggagctttgtaaaggaattgcatgcagagggtaccatgccagtttttccaaggggtttttctcagcccttaaagtcaattttaattcctcaaagcagtctggttatttctgaaaaaatgtcattccagtcaaagacttgataaaatatccaacgtctccaattgggttctgttacaagagaaaacagattcttattgaacttatgcaaataattatattgccataaattaaggattgtcaaaaatagtttccaaattcggctgggcgcagtggctcatgcctgtaatcccagcactttggggaggccgaggagggcggatcatgaggtcaggagatcgagaccatcctggctaacacagagaaaccccgtctctactaaaaatacaaaaaaattagccgggcgtggtggcgggggcctgtagtcccagctacttgggaggctgaggcaggaaaatggcgtaaacccgggaggcagagcttgcagtgagcggagatcgtgccactgcacttcagcctgggtgacagagtcagagtccatctcaaaaaaaaaaaaaaaaaaaaaaagtttccaaattctggagaaatcaggtaaaagaaaaagaaacgtggctgggcgctgtggctcacacctgtaatcccagcactttgggaggttgaggcaggtggatcacaaggtcaggagatcgagaccatcctggctaacatggtgaaaccctgtttctactaaaaatacaaaaaaattagctgggtgtggtggcgggtgcttgtagtcccagctactcagcaggctgaggcaggaaaatggtgaacccgggaggtggagcttgcagtgagctgagatcgcaccactgcactccagcctgggtaacagagcaagactccgtctcaaaaaagaaaataaaagaagaaaaagaaaaagaaacgtgtttcagattctggtcataagagtatactttactcaattgttaaaaattataaatagatcaaaagaaaaaagctatctttttaaagtaatttctatttttattttagattcagggggtatatgcacaggtttgctacctgggtatattgcatggtgctgaggttttgggtacaaatgttcccatcacccaggtagtgaatataatactcagtagttttcaacctatgcgtcctccttccctcctacctctagtagtccccagtgcatatcattgccatctttatgtccatgagctcccaaatgtttagctcccacttgtaaatgagaacatgtggtattcagtttcctattcctgcattaattcacttaggatagtggctgcatccatgttgccgcaaagaacatgatttcattttttatggctgcatagtactccatggtgtatatgtaccacgttttctttatccaatccactattgatggacgcctaggttgatttcatgtctaaaagttttcttgactgaaaaaaaaaatcaacaatgcttcaaacaaaaagggttataaaatatatttcagtcctctgttagttcagttctatgaaattaattcatttcatttgatattgggattagtaatcctcatgaacacagtagctctacaatgagagttctggaagtttgtttctctactctactgatgaaatctccaaggttgtcagaaacttacatttgaagcacccatcagaatcctttctgtgaactaccctaaagaagcaagttttggactatagctgattattaactgctttttgagaagaatcaaataaaataataattgtctgtggatgacaaaagttttaggacagccatggttaaagataaggaaatttggttatttctgtgtcatactaaaatttaacttaataatacttattttgattattatgattatcagacaaatcagaactataggatctcattgtgccacggcattccgcctgggtgacagaatgagactctttctcaaaaaaaaaaaaattataagatctcatacaattttggaacacatgttaataacacacttatgtaagtagaacccaaagaaacttaaaaaccatttcatatttgaatgtttcctatatgattttaacatatcgaataagccaaatgtgtttcttttagacttcaggggacctattatctaaaaaagctaatgaagtaaaaaaaatactgaattacaattgaaattttaatgtttgaaagtttctcaaatgtcaaatgtttaaaacactctacaccgcaagatagaattacaggtcactataaaataaattattcacttagccacaatcataattcaaagactttaaaaatcattcactttttgatagagcagagactcagtttcccaaacaatatgacctaataaagatcgaatgaggcgaactgaatatctccctctctccctctttattttatagtttactcaagaggtaaacaaaaatctttctttatcaaaatagaaaaccagccgggcgcgatggctcacgcctataatcccagcactttgggaggctgaagcaggtggatcacttgagttcgggagttcgagaccagcctggccaacatggcaaaatcctgtctctactaaaaatataaaaattaggcagacatggtggcaggcgcctgtaatcccagctactctggaggctgaggcaggagaatcgcttgaacctggcggaggtttcagtgagcccagatcaggccactgcactccagcctgggtgacaagagcgaaactctgtgtcaaaaaaaaaaagagagagagaaaaccaaattttacttttacattagtgtagcattaacactaaagataatttttttttttaaatttagagacagggtctcgctatgttgcctaggctggagggcagtggctattcacaggcccatcccattactgatcagcacgaattttgccctgccccatttccgacctaggccagttcacccctctgttggcaacctggtagtcccctgctcccaggaggtcaccatgctaaaactaatttttaatgaaaccttataaacaaattcatccaatcttaataagtttgatcataaggtaagatttccataaacctctcatagcctgttatagttttctattaaagaacagattaatgctccaaggaaaccattgttgtcacacaggagcccagactgtggcatcagtgtgcttttgatattaatcctgaatttatagaaaaactaaataatatcttttaaattttagccaacttgatcacacacagaattccttttacaagatctgtcttccacaaaccttcttcaatttcctaacacctttagccttatcctatcattctgccttagcacaaaaatttactttcttttcaactttctatatccgtttagtttttagttttattcatcttttttcctcttttaatttaagaaaacctctagactaggcaaaattacttcccctttaagagaaaacatatttccatgccttctcataagctttttaccaaaacgtatctacttttctaagtttgcatattaaattgtttcttttatatctagtagttttcactacatacattgattatgttaactgttagtaactcttatttttagtgaaaaacttaggaagtaatttttactgtgtactagatgcagagtccagaacaaaggacaatgcctggaaatagggcttgttatattttagaggctcaaatctaaaaccataagtttatttaagagttatgtatcaaaaattacataaaagcaagttttgaccttaaaacatctagcagatatagtatcaaaccagtagaccaatagtctcagacaaaatgtctaaattctgaagatgtttccattttattttaccaataattttaaaactgtctttatttactaaagattattaaagtcacatgaactaaaaggcatttaagtttctatttttatgataaaatatttgatttaacacattttcattaagccaattagagtgctttcatattgaaggaagaccctctcatattattttatattgttttatactcagtacctgttttaagaaaaaacaacaaggaagtaaaaccaaagacaggcagcccagcgccaggcccgaaaccaggcctgggcctgactggcctaaacccagtagttaaaaatcaactcataacttagaaaccgatgttattcatagattccagacattgtatagaagaacactgtgcaactccctgccctgttctgtttctttctgaccaccggtgcatgcagcccctgtcatgtaccccctgcttgctcaaatcaatcacgaccctttcatgtgaaatctttagtgttttgagcccttaaaagggatagaaattgtgcactcggggagctcggattttaaggcagtagcttgccgatgctcccagctgaataaagcccttccttctacaactcggtgtctgagagggtttgtctgtggctcgtcctgctacaatatattttggtagtgaaacatcacatacacatacaacatataaataaatagataaacagaaacatagaagcagttcttacagatgtataagatttttcatccatcagttttaaatagttcggtttttttaattcatcctacaatgacctgttttactgccctaggcaattgttagctaggcaaccctaaatttgcatttctaaaggagaaaatttgcatctcaaagtatagaaagagactgggaatttaagctttttttaaaaaaaagaaatttggctgtgctagaggacaatttgaaaattaatgccagggtaatacaaaattatataaatgtattaaaagattttataaggagatcaatttcctttacataggtctctaccttttaactggaccgctgaacttaggacagagcccacactgaattttaggtctgcaaaaagagacatgccatggggacgggaccatacaatgttttcacagtgcatttcatcacaaagacattccccttgggcaacccaacaccaatcagcccattctgtgatctgcccattccctagccattatacacaccagagtcaagtttttcaaaatacaaaataatttctgttaccaccccgcccctcaaccaaaaagatcaggtaatgcaatacaaaagagagtagagttttagatacgagaatactctgttgcagaaggtagtcaggcagacatgagcagggcaggagaagggccccccaccaggattgtcaggcaaccatcaagtgatggtcaggcagttgttaaacagtcgctctaaaataataattggttgcagctggcgccagggaacgacaatctcccaataaatagaaacacctgtaactagtgatcagcagcttccaaataagatctcagaagttaggtgtgtgaaggaaaaatatcttgggtcccttcaagatgtgaaccgctcagggaaatctgcctcctattctgttcaagtcatccatttgctcacagagacagatgcatattctgattgcctcctttggaaagacttatcagaaactcaaaagaatgcaaccatctgtctctcacctacctgtgacctggaagcccccagtaggggggccttgctttgagctgtcaccgcctttctggacggaactaatgtacttcttatatattgattgatgtctcatgtctccctaaaatgtataaaaccaagctgtggccggaccaccttgggcacatgtcatcaggacttcctgaggctgtgtggtgggcgcggcctcaactgtggcaaacaagctttccaagttaaccgagaccactctcctaaggccttgctttttttttgagcaaaagtttgcttttgtattcttctcagttgactgaattctgttttcacctgatgttttgactaaaatagtattgcaacagaagctactcttggatttttaaagaagaatgtagtttagacactcaaaaatgtctttaaaaaaaaaagtacactgtaaaagcatctccctctagcactaccagacgtttttttctgtaccttatgatgtaaattttgctatttgattttcacctgagttgtttcctttaatgtgcaaatttaaggctatttagctgacaactgcctagggctgtgaaaccagttatctggaatctgaaagtctaagacagaaaaaatgcaaaatgcaggggtcttttgtcgtttttttgtttttggttttttttttttgagacaaagtttcactcttgttacccaggctaaaatgcaatagcaccatctcggctcaccacaacctcctgggttcaagtgattctcctgcctcagcctcctgagtagctgggattaccagcatgtgccaccatgcccagcttttttttttttttttttttgtatttttagtagagacagggtttctccatgctggtcaggcttgtctccaactcctacctcaggtgatccacctgcctcggcctcccagagtgctgggattacagtcatgagccaccacacccgactgggtctttataaatctataaaatgtacttccatctgtatgcctaatacgtctttttgtgtatttatgtgttgtatacaaaatgtttcactactaaaaagagctctagttaattgacataaaaataaaagtgcttaaatcaaatactaaaaaatgactagtcaaatgctttttcaagtttatgtaacaaataaaatctttaataaataagctagctttaaaattattggcaaagtaatattagaaatgtgttaagaattgccagcagacatttttgtttgtatttgttaatcaagcaatttcatacttacccccaccaaatactataaggtgtcaaaatttggcataagggttataaaacccaacccaaatcagaatgatctttgcttgtgtaatttttaataaataggacattgacatgggtataatgaaaatagctgcatcttgaatttagcaagattactataacttctaatcctgcggctgtaggcagtctaattcacagacaatgggaaggtttgttgggaaagggctgttatcatctttgtttcatagctaaattgtaaactaagttcctcccaaagttagttcggtctatgcccaggaatgaacaaggacagcttggaggttaagagcaagatggagtcaattaggtcaaatcttttttttttttttgagatggagttttgctcttgttgcccaggcaggagggcaatggcaccatctcggctcaccgcaacctccacctccaggttcaagcaattctcctgcctcagcctgcctgagggaagaaagagaccctctcatattgctttatactcagtagctatttaaataaaaaaataaggaagtgaaatcaaagacaggcagcccagccccaggtctgaaaccaggcctgggcctgcctggcctaaacccattagttaaaaatcaactcataacttagaaaccgatgttattcatagattcccgacattgtataaaagaacattgtgaaacgccctaccctgttctgtttctttctgaccaccggtgcatgcagcccctgtcatgtaccccctgcttgctcaaatcaatcacgaccctttcatgtgaaatcttcagtgttgtgagcccttaaaagggacagaaattgtgcactcagggagctcagattttgaggcagtagcttgctgatgctcccagctgaataaagcccttccttctacgactcgttgtctgagaggttttgtctgtggctcgtcctgctacatttcttggttccctgacagggaaacgaggtgactgatggatggccgaggcagccccttaggcagcttaggcctgccccgcggagcatccctgcaggggactccggccagcctgagtgacgcgatccaaagagcgctcccggttaggaaattgcccccattggaacgccttgccagagcagcacgtagcaggcccccgtggaggatccacacagtggctgaacactgggaaggaactggcgcttggagtctggacatctaaaagttggtaagactagtctttggaacttgccccactccatctgagtggaagcgtggcttgatcacccacggtgtgcctgcattggcacttttgttctggatttgacttgatttgaattgctggatactttggtttggttttggttttgacttggcttgaattttttggtactcggattttgaatttcgtgattttggtttggcttaaacggtaaaagtgtgtgtttgccctctttgcccgttctttgtcttgtggtgagtgtgtgtggtgtgagcgtggtattctgtcttggagaaaaaaaaaattttttcaagaaagaacttaagggagattacagtgctactgtgacaccaggaaaacttagaactttgcgtgaaacagactggccagcattaaaggtgggttggccatctgaaggaagcctggacaggtcccttgtttcaaaggtatggcacaaggtaacctgtaagccaaggcacccagaccagtttccatacatagacagttacagctggttttagacccccttcccccctacagaagttaagagaacagcagcatgagcagctggcagaggcaaggaaagaccagcagagagaaaaaaaagaccatctataccaattctaggttaatttagactaaacaaggtcttattaatagcaaaggataattgaaatcccaaacttacaaggttttcaacaaaagtgaagtttgctaaaagttaaaagtgtagcatgtattatggtaacttctaatcttgtggccttagacagtctagtccaaagacataaagaaaattcgctttaaaaaaggggaaaaaaggggggaggcagaatttatataaaaagaatgttatatggtaaattcttgtcctgaaataaattaactgattgtttaaagaaaaaaagtttgtaataagtcagaaagttaagacatgttaaaaaattgtctgtgaaagttgtgaaagaaaaaatgttatcaaaaattttatgcaaaaaatgttgtataacttaaaagtaataaggcctcctgagtactactgaagaaacagtttatgtgcaaggtgtataaaaaaatatacctttgataaaaagattataaggaggcataagaatgtgaatttttacctacattaaaaggttaaaaaaatattgttttaaaagtttaagcaagttttaaaacgttaattgtaaagaaaattctgtgtgtaaacatattaactaaagttaaaaaggtatcatccagtttttctgtagactagacattaaagtaaaaatgcaacagatttttcttaaagcatcaacctgctctttaacaaaaattataaaaggttaaagagtctataaaatcttaccttatagtcaaacatgaaaaattggataaatatgtctacaaggttttattaaaattaagtttaacattaataacacactaatataaagataaaatttagcttctctggtataaaaatcatacaagaagcattattaaatataaaatggtgtttagctttctttggtctaaaaactaacaaaaataggtgctaaaggaagcattcattttactaaaggatcatagaagttaaagacttaaaacaaactttggcaattaagacaggataccaagatgcaaatgcctggatgaaatggatcaaatattccatctgcacgttaaacaaaagcaattgttatgcttgtgcacatggcagggcagaggctcagaatgtcccctttccactaggtggtcctccagtcgaccaggtgtgggctgcatggtagctcttttccaggattctacagcctggaataataagtcatgccaagctctctctgctatattccgaagtccctgggggcagccaccgagggccatccagcttccatctcccaacactaacttcacttcgtgtctctcacggcagggaggagacttagcattccttggagacctgaagggatgcagtgagcttaagaattttcaagagtttatcaatcagtcagcccttgctcatccccgagcggatgtgtggtggtattgcggtggacctttactggacttactggacactctgccgaataaccagaagtggcacttgtgctttagtccatttggctatccctttcaccctggcatttcatcaaccagaggaaaaaaaaaataagacatcataaagtgagagaagccccttatgggtctttcaactctcgtatatatttagatgcaattggagccccgcaaggaataccagatcaatttaaagcttgaaatcaaatagttacaggactgaagtcaatattttggtagatgacagtcaataaaaatgtaaattagatacactacatctattacaaccaacagcaacgagcttttcatgagttaaaaagaaaaactcatgtcggccccagccctggggctacctgacctgacaaaactctttacactccatgtgtcaaaaagaaaaaaaatggcagttggagttttaacccagactgtagggccctggccaaggccagtggcctatctctcaaaacaactagatggggtttccaaaggctggcccccatgtctaagggccctggcagcaatggccctgttagcataagaagcagataagctaactcttgggcaaaacctaaagtccccccatgctgtgatgattttaataaataccaaaggataccattagctaacgaatgctagactaactagataccaaagcttgctctgtgaaaattcccgcataaccactgaagtttgcgacaccctaaccctgcacaccttactcctggtatcagagagcccagttgaacataaactgtgtagaggtgttagactcagtctaccctagtaggcccaacctccgagaccaaccttaaacatcagtagactgcgagctgtatgtggataggagcagtttcgccaacccctgcaaagtgactctgaaaaagacgacaagccctgctccagtcgcacccggaagctgactggtccacgcacggccaaaacatgaggaaactcatcgcgggactcattttccttaaaatttggacttgtatagtaaggacttcaactgaccttcctcagactgaaggctgtttccagtatatacatcaagtcactgaagtaggacaaaagattgctacagtcctattattttatagttattatgaatgcctaggaactccaaaaggaacctgtttgtataataacacccaatacaaagtatgtaatccaggaagtgaccagcccgatgtgtgctatgacccctttgaacctcctatgatcacagtctttgaagtaggactgagaactggtcattctctaagtgacacaagtaaagtaatagctagaacagaagaaaaaggggtcccaaaaatgtaaccttaaaatttgacgcttgtgccactattgatagtaagcagcatggaataggatgcggttctctaaattggaaaaaaaagttacacggtaaaaaaaaaaataggtatatctgtccagaatcatatgtgagatgtgtcaatactggtcttgtgtcatctgggctacttgaacagaagataaaaaagatcctgtttggctccaaaaaggaaaagtcagcccctcctgcacaagtgggagctgcaaccttttagaaatgataatcacaaacccctcagaaccagaatgtaataaaggaaaatatgtatctttaggcattgatggaaagggactagatcctagcgtgaacatcctaataaaaggagaggttcaaagacactctccagaaccagtatttcagactttctatgatgaactaaatgtgccagtaccagagactccaggaaaaatcaaaaatttgtttttgcaattagccgagcacgtagcccagtctctaaatgtcacttcatattatgtttgtaaaacaactgtaataagagatcaatggccataagaagcctgagaattagtgcctacagacccagttcctgatgaattctcagcccaaaagaatcaccctgatcatttctaggttctaaaagtttcaattattggacaatattgcatagctagaaaaaaaaaaagaattcactcattctgtaggatgacttagttgcctaggacaaaaactataatagtaccacacacacacaaaacagttacatggtggagctccaattacacagaaagagatccattcagtaaatttccaaggttgcagactgtctgggctcacccagaatttcaccgggactgggctgcccccaccgggttatactggatatgtggacacagagcttatgctaagctgcctgatcggtggacaggtagctgtgtaattggcaccattaaaccatctttctttttactgcccataaaaacaggtgaactcctgggcttccctatctatgcttctcatgaaaaatgaagcatagccataggtaattaaaaagatgatgaatgacctcctaaaaaattatataatactacggaccccccacttgggcacaagatggctcgtggggatatcggacccccatctacatgctcaaccaaatcatatggttacaagctgtttcagaaatcatcactaataaaactggtcaagccttgactattctggcccggcaagaaactcagataaaaaatgctatctatcaaaatagattggctctcagctacttgctagcagctgaaagagaggtctataagacatttaaccttactaattactgtctatacatagataatcaaaggcaagtagttaaagacatagttaaaaatatgacaaaactgacacatgtgcctgtacaagtgtggcacgaatttggccctgaagccatgtttaaaaattagttcccagcactaggagaatttaaaactcttataataaaagttataatagtaataagaacctgcttactgctcccttgtttactacctgtacttcttcaaatgataaaaagcttcatcactaccttagttcaccaaaatgcttcagcacaagtgtactatatgaataactatcaatttattgcacaaaaagacataagtagcaaaaataagagtgagaactcccactaataaaaagtgagagtctcaaagggggaaatgagggaagagagagaccctctcatattgttttatactcagtacctgtttaaagaaaaaaaacaaggacatgaaatcaaagacaggcagcctgatgccaggcccaaaaccaggcctgggcctgcctggcctaaacccagtagttaaaaatcaactcataacttagaaaccgatgttactcatagattcccaacattgtataaaagaacattgtgcaactccctgccctgttctgtttctctgaccaccagtacatggagcccctgtcacgtaccccctgcttgctcaaatcaatcacgaccctttcatgtgaaatctttagcgttgtgagcccttaaaagggacagaaattgtgtactcggggagctcagattttgaggcagtagcttgatgatgctcccagctgaataaagcccttccttctacaactcggtgtctgagaggttttgcctgcagcttgtcctgctacatcccaagtaactgggattacagcatgcaccaccatgccaggctaattttgcattttttttctttttttttttaaatagagacggggtttctccatgttggtcaggctggtctcaaactcccaacctcaggtgatccacccacctcagcctcccaaagtgctgggattacaggcatgagccaccgtgcccggcctagatcaaatcttttttcactgtctcagttataatttttctttcttttttttttttttttttttttttttttttttgagacagagtctcgctcagtcgcccaggctgcaatgcagtggtgcgatcttggctcactgcaagctctgcctcccgggttcatgccattctcctgcctcagcctcccaagtagctgggactacagacaccccgccaccacgcctggctaattttttgtatttttagtagaaacagggtttgaccatgttagccaggatggtctcgatctcctgatctcgtgatccacctgcctcagcctcccaaagtgctgggattacaggcgtgagccactatgcctggctggttataatttttcaatagcagtttcataactttaaattcatgactattacagtattcataaataatctaggtaaataattaaaatagataattaggcaaatgtaatgggaaaaatacttgtagacaaactggtcataatttagaatataaagttatattaaattaaataatagatgtttcattacttgggtattttccaataaatatatattgcaggaaaacattcttgctaaaaaaaaaaaacaaaaacagagaagtgtgtccttttaaaaagaaaagtgaaaaatttatgtctaattcaaagcttatttaaacattatgtataaaacaaggtaaatggaaccaggaaataaaaaatatgtaaagaaagttgtaaaaataaagaggtatttttctgaggtaaaaaaagcttgaagaaaaataattttatataagaaaaaaagtcttgtgccaggcaccaaatacccggcatcataattgttatgttaaaattattgtgtgccacagaggcaacaaatttccttgtcaattgtgcctttcgactatggctgccttaaaactttttttttcagccgggctggtggcttacgcctgtaatccctgtactttgggaggctgagacaggcgatcacgaggtcaggagatcaagaccatcctgactaacacggtgaaaacctcatctctactaaaaatagaaaaaaattagcttggcatggtggcgggtgcctgtagtcccagctactcaggaggctgaggcaggagaatggggtgaacctgggaggcagagcttgcagtgagcagagatcacaccactgcactccagcctgggcgactcagggagcctccgtctcaaaaacaactttttttcatccatggacaattgttgtcttgttttggtcctctttaggaggtggttttataatcagctataaaactccaataggtgctcttgaatgcaggtttctgataactttggagattgtgacaacagaatagaggaagaaccttcaggactcatggagagctaaatgttcatgagtatcaagcaggaattaacaggaattaactgcatggactgaaccaatcttttttactttttgctcaaaatatttgctggtcctttgttttgcgtttccgagtcttatgacttttcttttgagctactgacagattttaacaatttagtatactcctatgaacaaaatttgtggcatagttgtttctatctgatttatccagaatttggaaactatttgtgagtattcttaacttatggcaatacagttatttgcataagtgcagtaagaatctgttttcatttgtaacaggacacatttggagaatttggttattttaccaaggctttgactggaatcatgtgctttccttataaggaatcaaacttgacttacggagccaataaagcccttggaaaaactggcctcatattctgtatacacagtccctgaacagggtttctgactgtgtaagtaaagaatatcactttttgacaagtgcagacgccccaggtttatcttgggccctcaaaaggagaggaaatttcacccaactcatgggtatttaatggcataaatccatggctcggctgggttttacgggttttacaaagtcttatctgagattcctgctatggaacaaagttccatcagagcctacttaaaagcctaagtaaaaaataatcattcttgctgcattgtatacaaatagttaggccaagtataataaacaaaccaatcctaccatgatttgtctttagtaatatgcgaaactgaagagagaaaaacaaattatcttctaaaacaattgtacacctgttgttagagtctagtcttgcctattttttttcaatttttattatttttctagagtttggactgaattctaatttttcttggctacaagccttcaaaataatgttttcaatttttttccttcttttttttttctcaatttttcccaatttggagtcactgaaaactaagctatgctttctaaaaaccctgggaactgaagccagacaacttaaacttcagaaaaatataacataacctatttacgtacataagccactttcatacctgcctactattatggactgcagagtaatgtggcctatatcaattttttcaggattgttcttttgtttgttgtttttttcatcccttcctcccccatattttctcttcacaggacatgagacttcacaacctgctaaaaatgaactttccagacctaccaatctaggaataaaccgtcctagccaggaaaggtcagatgacctttcctgagactggagactcattctgttgtaaaaatgctttctccaaagatgttaaaaaagaaaaggggaaaatgtgaaagaaaaatatcttgggtcccttcaagatgggaactgctcagggcaaatctgccttctattctattcaagtcatccatttgctcacagagacagatgcatattctgattgcctcctttggaaagacttatcagaaactcaaaagaatgcaaccatctgtctctcacctacctgttacttcgaagcccccaatagggggtcttgctttgagctgtctccgcctttccggacggaactaatgtacttcttacatagtgattgatgtctcatgtctccctaaaatgtataaaaccaagctgtggccggaccaccttgggcacatgtcatcaggacttcttgaggctatgtcactgggcatgtcttcaaccttggcaaaataaactttctaaattaattgagacctgtctcaaattttgggggttcacaggtgagtgggctcaggcatgtgcactagtatgactaaaggtcatagactattagactattagtctatgaccttcctctagaaacactcgactggtaagggaagaatgcctcaactgagcatgtgcacaactcccataaacacacttgtgcttgcggagcctctcaagtgctggcaggccactgctcaggtggattcttccctcctacccggagggaagaatcaggggagaagggacacaagcccctgaatgcatgccaacacgtaaaacctcaaatcaaaactcaaaccatgcagtttaacctctcaagttgcccacttggccctcttccaagtgtactttacttcctttcattcctgctctaatactgtttagtacattttcactcctgctctaaaacttgcctcagtctctcactgtgccttatgcccctcagctgaattctttcttctgagcaggcaggaattgaggttgctgcagacgtgtatgcatttgccaccagtaacatactttggtgccacatgactaggatatgttctctagtgctaacatgttcgtttacagttcttaggactccctgatagaaaaaaacacaaaaaaaaacacaaaaaaacccaaccaaccaaacaaacaaacaaaaaaaaaacacaggagtttctcccaaaaagaagtctgcagtgtcttttctgttttctctgaaggtatcccagggtgttagatttctgttgtttttcccttatgtggcaccgaagttggcaagaagaaggaagtgctgatataaataaatagggaaatgaacagagagagtacatgtggttagcaggagtttaggatgagagaaatttagtggaccgagaaatagtctaaatatcagttttaatttgtgaaagaaaaataaaaacctgggaccccaattcactatgcctaaaggaaaaaaattaagctaaaagctgaatcatgcaagaagctgttttttcctttgttcttaagcagagcactacagataaaaaggtgaaatatctccccaggtagctactctatgttcacctgaacttatgtaaagttctgatttactgagcatgagaagaacacataattgactattcctgtacctgctccatttctcctgcaacatgtggatacagtaatatgatcataccctcccttgttcccctctaggccactttcccctttaaatattaacaccatcataatcatctttggagaaagacacctggatctgtcctgaaccttggcaaaaaataaataaataaataaaaataaaaaactcttctcaattgattaatacctgtcacagatacattttggtttacaaatcaatgaacaatggagggaactctgtccttaatcttggtacgagacaatgaaccccaggtacttaccccagacaacgacgccgcttcaccatgatgatggacaacaggcaactttttttttggagtttcagcttgcttccaacagggacggtgagtgtgaggtttattcccatttctaagacgatagaagttttcagcctaagccgtattcctaggtaagcagctggattgcagttttgtcttggaaattctccttaatgactaaaagttaagattaacaactagctggtcttaatttctccttaccattagagtacccagtaatcacataaattctgcaatcatctgtttatttagcttaactgtttttttttatttgttgaagttgttgttgttatttcagtctttttcttattgggttgaccagacttggtaaaatctgtaagaaagttccataattatggggaagatttcctctgaattggctaaattcctgtagctgaaaaaaaaaagaaaagaaaaaaacaccagcaaaagtaaaaaaagaaacattttgattacctgagaggctttatttacatggcaagaccaccttctgctagccaaactaaactaaaggagcaatggtagtcaccctatgcagtagttcagcagcaaagattctgcccttttttttagcatgacagcctgggttggttggttatgaatcaagtcctttctggtttgagatttattttacctttgaaatatcagcagcttttcccagctaaaatatggtaataatatttaaaaggattttttaagacctcaacagttaaaaggcagcttaattaaaagatagtatccgcaatccgtgtgtgtgtgtgtgtgtgtgtgtgtgtgtgtgtatgtaaaaggactttatgtttttttgtcttctaggaacgtgtttttgtaaaaaagtttttttcttctcagtcaactgaattctgctttttctatttacttctgcctgtctctcctttctcttcccaccctctgctgcatgaggcactggaaataattttaacaatggtaatgagacaaattatcaagaaattggagctgggattccttaaagaaaacagagaagatgccagactccttctgggggcaaaacctctgtttttccttatggaaccctaagagtataaacaagttcctctcagatcttaaactccttgcttctatattttgttttctgattttttttaactgaaatagttattattacaggggctactcttgggagtttagaataagaaagggtgcttagacactcaagcaacatctttgtaacaaagtaacaccataaaagcattatgtggcctagtcccatgatttctctctcctttttggagacccaggattgaatgtgggctgtgctcagagctcagagatccagttaaaacagagactacgtttaaaactatctaagtgtgattggtctctttatacaatcctgtggtagatttctgtaattttatgtttgacttggtatccattttttaatcaccctgttaacacaacagattctctctctctctttcctttgagaagtaaattttgctgattttcacctgagagttgttccttcggtatacaaatttagggctatctacctgacaattgcctagggtaatgaaacaaattatcaagaaattggagccaggcaaggtggctcgtgcctgtaatcccagcccttttggaggccaaggctggcggatcacttaaggccaggaattcaagaccaccctggccaacatggcaaaaccctgtctctactaaaaatacaaaaattacctgagcgtggtggtgcttgcctgtaattccaactatttaggaggctgagacaggagaattgcttgaactcaggagatggaggttgcagtgagccaagatcacgccactgcactccagcctgggccacagagtgagactgcatctaaaaaaaaaaaaaattggaagtctaaaataagaggggaaaaaagaggaggtcttacaaatctaagatctatttctacctgtgtgtctaatacatgtctgtatttatgtgtcatgtatatgtttcattatcaaagatatataaaacagctctaattatttggccttaaagggaaaaaaggggcttaaatcaaatactttattagaaaaatagaaaccttaagcccaaatgctttttcaagtttatgtaacttaagtaaattcttaataaataagctggttttaaagttattggtaaaataaaattagaaatatcttcagaattgtcaatatacattgttgtttagagtcattggtcaggcagtttaacatttacctctactagatattataagttgtcaaaatttggcatgaggtttataaagctagaaatgcagcccacaagagtactatatttgttggtgtaatttgttgataaatagggcatttgatatcgttgatttaatgaaaacagctaaatcctgagttaatccaggacttcttggtaaagttgactgaagctatattagatatttccccacaaaaatactatttgcattctcccactccctccctcccttgatgggacaacatcctttatttttccttgggcatacatatcattacttccaatttgaaacaagttagtataagagggagagagagaggagaggagaggcagagagagaggagaggagagagagagagaggagagagagaaaggagaggagagagagagaaaagattgagagaggggagactgttttaagtggtattatttttcccataggctgtccttgtcactctttcatggctacagtttgatcggaattagctgccagggcctccgccggcttgggctcttctgcggaggctgtgggggcccgggccttgggtgtggaactaggggcttcctggctgcggggggtctccttggaagagggggcagcctccgagctgctgcggtttgcgtatcatgctggagcccgtcacttatggtctcctgggtggcaggagctgcaggcgccttagtctttttaggtttcccttcctccttgctgggctcctccccagtggtagggtccgcgctcttggcccgggccgtggtgacttcggcagctttgggggcctcgccgccattagcagggacgggggctgcctgctctttctcggggggtcagccttggcctctgcgcgctctctgtcttctcgggctcttccttcggggtctcctccttggcagccgtggcatccttcttgccctctgtctcctcggccttgccctccgcgtcctggtcagacttcttgccctccatggcctcggcgggctctgcagctgcctggggctcactctccttcggggaccctcctcttcccttgccacgccctcatccttcttgtctttgtccttggctttctcgtcgttcacattgtagcccttcttcttgctgagtttgcctgtcatcttggagtttggctctgggtgcctgtgcagcccctgggtgagcgcggtgcccccaagaggccagggtccctggcggtgtctagctcatgcctggccgctggcggaggctctctcctggctccatggcggaggccagagcgaggagccagttgtagtgctagctccgcctttgtcgcagctgccactactgccaccgggaaaacatttttcttaaaaaatgtgttcttatggccgggcgtggcggctcatgcctgttatctcagcactttgggaggccaaggcgggcggatcacgaggtcaggagaacaagaccatcctggctaacatggtgaaacctcgtctttactaaaaatacaaaaaatttgccagggtggtggcaggcgccagtagttcgacctactcaggaggctgaggcaggagaatggcgtgaacctgggaggccgagcttgcagtgagccgagattgcactactgcactccagcctgagcaacggagcaagactccatctcaaaaaaaaaaaaagtgttcttatttaaaggaaaattatttttgtgtaatttaaaggttattcatgaaacaggataaaaggaaccagtaaataggagagatgtaaagacagatacaaatataaagaggtattctggtgtaaggaagattaaaaagaaaattattttatatgagaaagaatcttgtatggtaaatttttgtcctaaaataaaatgactggttatttagaaaagaaggatgtttagaataaaacaggaagtccaaacatgtcataagtggtttgtgtatgtcataataagggattataaaaagaagatttatgtgaaaaaaattttatgtgatcaagttgtctacaattacaaggaaattatttataatagactttctagagatctatatgaaaaatacactaatacactaaggaattggttagaacaacaaaactttcttaacatattattttaataaaattatgagattttcattttttttacaccagaagttcaatttatattgcatcttgctgtttttagctatctcacctttgagaaggacagcaatgatatctctctctctctcaactttgtcagctcctgtaaatttttcgttcaggttttaactgctattgtggcctgatactaaaacattttatcttaaagttataaaggaaatattttctcccagtataacattctgtgctttggctttaaattgttctatgaaaccaaaaatgttcacttaatgtttcctgtaacccaggaaacactcttcctatgtctaactagttcaaatacattttcattagttttgactttcaggttctctaaatagactccctatatggaaaagcagtcacactgcagagggtgttttttttttttctttgtttgacttttagtaactagactaacaaaaaagatttatgttttatcgaaataagtcctacataattgttattaagttttgatttacttacaaaaactgagttacatttatttttaaagttaaagttactgtgtcaggaattggtgggttcttggtctcactgacttcaagaatgaggccgcggcccctcgcggtgagtgttacagttcttaaaggcggcatgtccagagtttgttctttctgacattcggatgtgttcaaagtttcttcctcctggtgggttcgtagtcttgctggatcacgagtgaagctgcagaccttcgcgggagtgaagctgcagaccttcgcggtgagtgttacagctcttaaggtggtgcgtctggagtcgtttgtttctgccagtgccttcatggtctcactggcttcagaagtgaagctgcagaccttcgtggtaagtgttacagctcataaaggcagtgaggacccaaagagtgagcaacagcaaaatttattgcaaagagcgaaagaacaccgcagtgtggaaggggactcaaagccagaagttcccactactggctcaggcagcctgcttttattctcttatatggccccacccacatcctactgactggtccattttagagagagccaattggtctgttttacagagagctgattggtccgttttgacagggtgctgatcggtgcgtttacaatccctgagctagacacaaaagttctccacctacccactagattagctagatacagagtgtggacacaaaggttctctaagtccccaccagagtagctagatacagagtgtcgattggtgcattcacaaaccctgagctagacacagtgtgctgattggtgtgtttacaaaccttgagctagatacagactgccaattggtgtatttacaatcccttagctagacataaaggttctccaagtctccgccagactcatgagcccagctggcttcacccagtggatcccgcaacagggccacaggtggagctgcctgccagttccgtgccatgcgcctgcactcctcagcccttgggtggtcaatgggactgggcgccctggagcagcgggcggggctcctcaggaaggctggggctgggcaggagcccacggctggggcgggagcaagctcaggcatggtgggctgcgggtccccagccctgccccacagggaggcagctaaggccctcggagaagttgagcacagcagctgctggtccaggtgataagcccctcactgccccggccagcggggccagcttgctgctccgagtgcgggccggcgcccacgcccacccggaactggcattggcccgcaattgctgcgcgcagccccgattcccgcccacacctctccctccacacctccccgcaagctgagggagccagctctggccttggccagcccagaaaggggctcccacagtgcagtggcgggctgaagggctcctcaagcatggccagagtgggcgtcaaggccgaggaggtgccgagagtgagcgagggctgtgagggctgccagcacgctgtcacctctcattattacatctatttaactttgtgttgcttttgaaatccttgtgctgttaagttacagggctttgactccattgattcctgggtctgaaaaagacaccaaaccctgctaacttttaaacattgacagcagttaaagcctcatcttcagacccaggagaagatgacagtcaaaacaaagtgtgtttataataagacacagggacagaaattaaaactcttcaactccccaatcccagggactactgcagaagaggtgagcacgtgagattgtaagggccaattttgagaaagaaaattagttcagggtttctctataaattaaacattagtatcaaaggtacactgatgcaagaccagcaactgggcccctgtgtcagattaatatggcttttgtggagcattaatccacttttttaaaaaatataaaaggttataaaaaggcttattgaattatatcttttagtcaagttgtttaaaatttagtagatttatttataagatttgagagacatttaattggtcttgacctaatgctatctttattagagcttactgtttgggaaattaagtctcctgtctcaaagtataaagggtttggccatttatttttacatctttgagttatcattttggctaaatgaatgacttatttattttacaatgacctgtgatcctatttcgtgatatcctgtgttttaaacttttcatatttgacaaactttctaaaatcaaatactaaattcagtccttttgacctcactaatgttttgatattaggtcccctgaagtccaaaacagacatatttggcttattttctacagaaaaaaattatacaggaagcattgttaaatatgaaatggtgtttaacctactttgggttatatttacataaatgtgttattagtgtgtgtcctaaaatcatagaatattcctgtgattctgatatgtctcaatatatgttgtcagtagtaattacgattattatgtgtaaaattgtcatatgccacaaaagtaaccaaatttccttgtcagttgtgtctctaactatggctgctctacaacttttgtcatctacaattgttgattactttgatcctttcatagtgtggtttataatcagctatagaactttgtggaattcacatttagagaccgtgtaattgaaatggagagaaaatcttccaggactctcatggagagctgatgttttcatgaggattcctgatccaatattgaccagaagttaactgcatggactgaactaacagacaattgaaataatcttttatgactctttgtttaaaacatttgctgattttgtttttcagagtcaagaaaccttttttatcttttaagctatttacagcttttaacatttgagtaaagtatatatatatatatatatatatatatatatatatatatatatttatattttaattgaggcagagtctcgcactgtcacctaggctggaatgcagtggcacaatctcagctcaatgcaacctctgccacccaggttcaagtgatcctctcacttcagcctcctgagtagctggggttacaggcacctgccaccatgcccagctaatttttgtatttttagtaaagatctggtttcaccatgttggccaggctggtctcgaaaacctgacctcaagtgatccgcccagcttggcctcccaaagtactgggattacaggtttgagccaccatggccagcctgagtaaagtgtactcttatgagcaaaatttaaaacaccttctcctgtgaaagaaaaataacaccttgggaccccaaattcattatgccaaagggaaagttaagcttgggaattgagtcatgcaaaaaactatcttccttttgttcccaaacagatagctgccatttcacatgcttactttattttatgtaacgtgcaggtttactgagcatgagaatagtgcttaagtaactttttcttatactaccttctttgcacatttaaaactgttgggagcaagccccccaaagtctggccataaactgaccccaaaactggccataaataaaatctctgcagcaatgtaacatgtccataatggccataacacccatgctggaaggttgtgggtttacgggaatgagggtaaggaacacctggcccacccaaggtggaaaactgcttaaaggcatttttaagccacaaacaaaagctgagcaatctgtgtcttaagggcttgttcctgctgcaattaatttggcccatcccttcttttcccttaaaggatacttttagttaatttaatatctatagaaataatgctaatgactggtttgctgttaataaatatgtgggtaaatctctgttcggggctctcagctctgaaggctgtgagacccctgatttcccacttcacacctctgtatttctgtgtgtatgtccttaattcctctagctccattgggttagagtctccccgagcgagctggtctcggcaagtggcgtccattcgtggaggctcgaatccaggtcaaagggttgctggagcgacggttggaatggaaaactagctggaagacacccaagtactcttaaagcaatccccgtggtgagtaagaaggggagctttctgttcccaaacagatagctgcaatttcacatgctttattttatgtaaaatgcagatgtactgagcatgagaatagtgcttaagtgactttttttctactaccttctttgcacatttaaaacatagactcactgaatgctaatcaaacgtcacaagaatgtaaccacttgcctcattgcctatcctgcctctttttcttcaccccacccccacctccccgcttgctctttcctatttaaatattgaagttcccaaaaccatacttggaaaatgcatggatcacagatcctacagtaacttgcatctgtttcctaagtgtgtcctcaaccttggcaaaataaacctctagtcaattgagatctgcctcagtcacttactggtttacattttggcaacaagggaattatctgactggagtttggccctgacctgcagcaactctcctatcagggccctggtacttgctgaagctctttatcactttgaccaattggacaattggctgaggtctggaggcttcttcctccagagattgctgatctcacaaaagtttgtggttgagatctgaggtttactctgctgaagagctccttttcttagagtttactgcttctatgatgaagagcaatcttcagcttggtccccatctccaataacaaactcatttggagtttcattttgagatttggtagctgaagatcaaggtttactatcagctggctctgacctcttcttatgctcagagatcttgactgtatttaaactgtgtgatcactttctcagctttttggggttttttttactacctaagaggtttcatttacataaaaaggctgctttcccagcctctctctctgtgctattaatttaaaattttagagagatcttattctaagtaagtaatgaaaagaacagattttgaaaaggacacatagcagtgtcgcagcaagccttaaaaattctcttgataaaactaagagcaaactgtatggcctaaaacagatctggtagttaaaattctgtgacagtgttttccacctaaaatgtgctacagaggttgtgtctatgatactatttggtttcattgcaagagtaccaaaagtaaactgggtagaatccaaaggaaattgtatacaaatctaacagtcagtttatagcatttttgttgccaaattataagtaaattgtaggtatttattaatatcattccaaggaatgactagcagtgcaaaaaataggtactttagtggtaacaattatttgctaataatccagaacctacaaataacagaaggaaacagcacactcttaaataaataatgggacaaggaagaaactacaaagtcaattagaaaatactttaagattatgtagaatgagggcccaacaaacgaaaatgtattgaatgcagtgaaatggtgcataaagggaaatttattatttaaatgtttgtatctaaaaaagaagtaagggctcatataaataaacccaatcttccacatacaattctggaaaaagaagagcaactaaacctaaagtgagcagaaggaaagaactaataaaatgttaagtgaaaaataaaggagagaatacaaaaacaataggtagaataaacaaatctaaaagttggtaccttgaaaacatcaacaaaattaacaaacttttcacaaggatgagcaagagaaaaagagagaaggctcaaattattaaaatcaggagtgaaagggggaacattactacagaccttatggaaataaaaagaatactgagggaatactacaaaaaactgtatgccaataagttagacaacatagacaacattgacaaattcctagaaagacataaactactaaagattactcaagaaaaaaatagaatatctgaatagacctgtaataaataaataggttaaattagtaattttcaaattttccacacacaaaaaagctcagccctgggtggctttaatgcttaataaaaccaaaaatttaaagaagaattagtaccaattcttctcaaaaggtagagaggaggagcagacacttcccaactctttctgtgaggctagtattatcctgataccaaaaccaaacaaagatagcacaaaaaagaaaactacagaacaatatattttaggaatatatgtgcaaaaatcctcaaaaagtacttgtagaccaaatccagcaacaaataaaaaggttatattccattccaagtggagtttgttccaagaatgcaagattggtttggcatctgaaaaccaattaatataatatatcagattaacagaataaaggacaaaaccatgtgaccatttgaatagatgtagaaaaatgaattgacaaagtccagcacccattaaggataggggaaaaaacaactcaacaaactaggaatagaagagaactttctcaacatgataaagaacatctacaaaaaatgatctgaatagacatttctttgaagaaggtatacaaatgacaaataagtataataacagatgctcaacattattagctgtcaattaaatctgaatcaaaattacaatgatatatcacttcacaactgctggtatggctataataaaaaaacaaagggatactatatggtccattagttttacttccaggtgtctacacaagagaaataaaaacgtatgtccacataaaaacttgtacacaagttttcattgtacactattttaataacatccaaaaagtgcaaacaatctaaatgttgatcaactgataaacaggcaaataaaacgtgggatattcataaaatgtagtattcgggtaaaaaaatgaagtactaatacatgctacaatatggatgaaccttaaaaatatgatgccaagtgaaagaaaccaaataataaaagttcaatattgtatgatttcactcatatgaaatgtccagaacaggaatatctatacagacataaagtagattactggttacttatggctagagatgatgagagaacaggggagtgactgtaagtgggtacagggcttctttggggaatgatgaaaatgttctaaaattaattgtggggatagtcatacaactctgtgaatggactaaaaacattgtatttatatacactttaaattactgaagtgtacagaatgtaaattatatctcaataaagctgatatgtgcatacacacacacacacacacacccaacagcagaagaaaatacctaaaaggtaatgaacaaaagcattcagattaaagcatgagaatctgaaggtttggtcatctacatcttgttccatagataagcatagactgtctactaaacacagttgtcaacttgatccaaaaatcttcgctggattctgtttctttcaagactgtttctagaggggtccacaaataattatctttgaagtttctgattaggacatctttccagggattctaagattatttatgcctctttaattaaaagactttaaggatcaatatattggagttgccctcttgtgtccattattagcagtatttgatatcaactttttcattcgtgttctagagctttttctcttatttctttaagtcagaacaccagatcttcaggtttacgatcatgcaagtttttaggaagattatgagaaaaggttgcctgtgcctgtggatcataaggttgaatgtgttgcattaattccttgcaatatttcgcagtatccatttgcaatatgttagagtctacaatcagaggtgacatttgtagatatttgtgtaggccagtctgttactaatgtataagggaagagtttatgaacctcaaagaaattgatggcattgacattaaagccatggcaatacctcgggctatggaattttgaaggtttctgagagctttcctgattttagtttctgaatcttctttttttttttttttaatctttcttgaatagtgaagctgatatgggcagtgaagtttctgagtaagtgttaaggttttgtaaaggtttttaatgacagtgccagtacaatggtttttttctgtcacttgaaaaatgggttagaattttgtaggttgggaacacaaaatcaagtaatatttttgctgccattggaactgaaagtattcagaaaggaaatgcttcaattcaatccccaaaataaatgaacaatgagaagaacacgtttaaaatctactgagtgtgtagtgatcatctgtagttgttcaaacgctctctgaagcttatgctcttgttcatgtcccatttttgagttgtgcctacatgatgctggcaacagataagacatgtagttttaataaatcactaacctttatattctgcttatttttaaattataaattccatctgtgtaaatagtttctctcttcttgcactttactaaaagcagttaaaagaaaccattctgaggctgggcacggtggctcatgcctgtaatcccagcactttgggaggctgaggtgggcggatcacctgagatcaggagttggagaccagcctggccaacatgctgaaaccccatctctactaaaaatacaaaaattagctggacgtggtggcgtgtacctttaatcccagctacttgagaggctgaggcaggagaattgcttgaagctaggaggtggaggttgcagtgagccaagatcacgccactgcactccagcctgggtgatagaatgagacttgtctcaaaaaaaaaaaaaaaaaaagaaaagaaaagaaaaaaagagaggaaaaaaaagaaaagaagccattctaagttcttactgcttagagatttcttcattcgtaagttcattgctcttaagttccaccttccataaagtcctaggatatggacataattcagccaagttctttgacactttataacaagaatgacctttcttccagtctccaataccttgttcctcatgtccatctgagacctcattagaagaaacttcactgtcatgaccacttaaataatctctgagaagattcaggatttccctacagcttttgtcttccgagccctcaccaaaattgcccttagtgctcagttcatggcaatttaggttttttctagcattaacttcaatactgtgccatcctctctccccattacctggttccaaatccacgtccacgtttttaggtatttttcataacaacaccttacttctctggtaccaatttttgtcttagaacatttgtgctgctataatagaatatctagctattttaataacagagactggataatttataaagaagataaattaattctcttacagttctggaggctgggaagtccaaggtcaagatgctgacaaatgatgagagctttcttgctgcatcctcacatggaagaaggtggaagggcaagagagaagaaactaatgctaggaaatgcctcttttaaaagggacttagtcccattaacaaagaagcaggtcttatggcctaatcatctcataaaagcaccacctcttaatactatcacattggcaataccttgattttggaggggacacattcaaaccatagcagagaccactaagtatagggaagactaaacccgagaaccaagtggccagaagcctgcactagctcagctgattctgctattagacttagataaagtatgagccttttgctactgaatcaacagaaaggctgcccgaaagcagtgagtctcagatgcctcccatgaagttcacacatcacaccagggacttctactcatacgtgaaaagctagagaatcatgtttaggtaggcaaggggagagaggtcctggacaggttattgaaggactgattttaaattacaa

SEQ ID NO: 204 - DNA, 589619 bp, Homo sapiens
accacataatgaaagtgcatggaactatttgaaagggtaagaggttgtttttgctttttttatatataaaaaagaagtggctatatgatgcatcatggagtgtattccataatcagattccaaaaggatagtaaataatttttcatttttctgaacctaagagcagaagtataacagcattatggaaactctctgggagtttgcccttctatgcacctcccaagtacctaccaacactgttttcagaataatccaccagtaaataatgccattttaattgtatttaagaatcctgtagtctttatatcaaagaatggaacacacacacccccaggctctagttggctcaggaacacagtaaagcggggtagtttacaggtagattttgccagtgggcagccaacctttctgttttcatttctagagatctccgccttcaggttaacctactcctcaactagaaaaggtttcacttgcctggccactgacgtaactaagctccttgttgaacataagaggtcttcaaggaaactaggctcaaagagcacaaagtatggaaccagttacccttggagatgtgtcaggggaggtgcctgtagtatttggagagctcgagggatgagaagccatctcaagagaagacgagggctgggcatgttagctcatgcctgcaatcccagcactttgggaggccaagatgggcggattacttgaggctaggaggtcgagaccagcctggccaacatggcaaaaccccgtctctactaaaaatatacaaattagctgagcatgttggtgcacacctgtaatcccagctacttgggaggctgaagcacgagagttgcttgaacctggaggtggaggtcagagtgagccaagatcacaccactgtgccccagcctgggcgacaagagaccctgtctcaaagaaaaaaaaaaaagaagaacatctctcctggttttgtccttcactttttaagatgatttattttgtgtgttgtacagtttaagttataaatgaacacttttaaacttcatttttaaaaactttttctacttagcttgtaattatcctttttttttttttttttttggagacaggatctcactctgttgcctaggctggagggcagtggcatgatcgtggcccactgcagtctcgatctcctaggctctagtgattctcccacctcagcctcccaagtagctgagactataggtgccaccactaggcatggctgatttttaaaaaaattttagtagagacgagatcttgctattttacccaggctggtcttgaactcctgggttcaagtgttcctcctgcctctgtttcccagagtgtttcccaggcatgagccactgcacctggccagctcttaattaactaatgatctatgataagactcatgtaatttaaaagtttcattatagtttcagcgtcattcattcaaaataactctccttttcttgtttgtgtttcagggtttattttctcttgatctttctactgcttttgttcttccttcacaaaatcaagtctttgttttttgttgttgtttacaggattttgcaggatcgtggtctttccaaatatcctaatctgttaaatcaattacttgatttacaaccaagtcatagttccccctacctaattgcctttcttgtggatatctatgaagacatgctagaaaatcagtgtgacaataaggaagacattcttaataaagcattagaggtaagctggtggggctcagtgctgtcatttttggtatctcagaattgatctgcccaataccactaatatccatgtcccctttcaacatcgttcctcagaattcagtgcagggctatttctggttaggggcagcattgacatcacttggcaacacagccggtgactcttaatagtgtgtcttcatttgaatgtgatttgagttaaattgtattggctcaaaggcatttgcgcttgaaattgaattacatattactttaatttttatttttcattttcagttatgtgaaatcctagctaaagaaaaggacactataagaaaggaatattggagatacattggaagatcccttcaaagcaaacacagcacagaaaatgactcaccaacaaatgtacagcaataacaccatccagaagaacttgatggaatgcttttattttttattaagggaccctgcaggagtttcacacgagagtggtccttccctttgcctgtggtgtaaaagtgcatcacacaggtattgctttttaacaagaactgatgctccttgggtgctgctgctactcagactagctctaagtaatgtgattcttctaaagcaaagtcattggatgggaggaggaagaaaaagtcccataaaggaacttttgtagtcttatcaacatataatctaatcccttagcatcagctcctccctcagtggtacatgcgtcaagatttgtagcagtaataactgcaggtcacttgtatgtaatggatgtgaggtagccgaagtttggttcagtaagcagggaatacagtcgttccatcagagctggtctgcacactcacattatcttgctatcactgtaaccaactaatgccaaaagaacggttttgtaataaaattatagctgtatctaaaaacaatgccatagaagtttgattttttaatagcattgaactatatattatacaagacacattgtctcagcttagaaaagcatttgagaaagaaaatattgctataaaactgtaaactagaaacatgatgtgttggaggaaatgttaaaatgtaaattggtcagttcttgactgaaagtgacaaaatccactcaaggtagtttaaacccaaagggtttattcaggtttataaatatctcacagaagaattgcctgatcttttagaaagacattcccaaaccatgctacacaactggaccgtcccgttgctgctgcctgtgccagaatcaggaaactgctggatgaggagtgaggaagccacgatcctggctgccagctccaggactgtgctgtgtctgcacgttccacgcaaagcacatctgctgcttttcccatgtagtgtggttccaaattaaaggctcactgcagtgcatctgattggaaggaaccaacaggatgtcttaaaagcttaactgcagaggaatctgggaagtgtagtttgtagctttctagccttttatgatgcaggacgccatgccaggaaggagttgggagtggttagcaagctagcttgctgtacctgcacttaatctcactttatttatttttatatattgattttttgtttacaaggagtcccactctgtcacccaggctggagtgcagtggcgtgatcgcagcttactgcaacctccaccgcccaggctcaagcaattctcctgccccaccatcccgagtggctggaattataggtgcccgccaccatgcctggctaatttttgtatttttagtagagacggagttttaccatgttggccaggctggtcatgaactcctgacctcaagtaatctgcctgcatgggcctcccaaagtgttgggattacaggcatgagacaccaggcccggcctcagtctcactttatctgtaatttttgttcaatgtcaaagcaccaaaatacaactaaggaaatcatacagcgttacatagtcatcctttctcaagataaatttaggaaataatattttaatactttttgaagaaaatatatgtagtgttatttctaacattttacatgtttttgttatttttagaatccaaaaatttccagttttatttttgaagctgccataaagtgccatttccatgtagaccatttcaaaggtgtcataaggatcaaaagctacatagaaaagttctcataagatagcaattactctctgccgggcacgatggctcacgcttgtaatcccagcactttgggaggccgaggcgggcagatcatttgaggtcaggagtttgagaccagcatggccagcatggtgaaacccccatctctactaaaaattcaaaagttagccaggtgtggtggcaggcacctgtaatcccagctacttgggaggctgagacaggaaaattgcttgaacccaggaggtggaggttgcagtgagctaagattgtgccattacactccagcctgggcaatagagcgagactcagtctcaaaaaaaaaaaaaaaaaagcaattactctcagaaactataatcggtgacccaaaactgattggatttgggactttggactcaacagagctcatagagacagcttaataaaaagcatagtgaggccgggtggagtggctcatgcctatagtaccagcactttgggaggccgaggcaggaggactgcttgagccctggaattcaagacctgcctgggcaacagcaagatctcatctctacaaaaatattttttaaagttattagtgaagagtggtgtgcgcctgtagtcccagcaacccgggaggctggggtgggaggatcacttgagccagggtggtccaggctgcagtgagccatggtcgtgccactgcagcctgggtgacagagtgagactgtgtctcaaaaactgtttaaaaaatgagtttgtcatttcaaggaaaacaacggaatgttgccagtgataaaatgtgagcttgcttgcttgcttttttttttttttttgagacggagtttcactcttgttgcccaggctggagagcaatggcatgatctcggctcaccacaacctccgcctcccgggttcaagcgattctcctgcctcaacctcccaagtagctgggattataggcgtccgccaccacgcccagctaattttttgtatttttagtagagacagggtttccccatgttggcgaggctggtgttgaactccagacctcaggtcatctaccagcctcggcctcccaaagtgctgggattacaggcatgagccaccgtgccaggccaaaaatgtgagctttcaagtgacaattttaggctggacgtggtggctcatgcctgtaatcccagcactttgggaggctgaggcaggtggatcacttgaggtcaggagtttgagaccagtctggccaatgtagtgaaaccccatttctactaaatatacagaaactagctgggtgtggtggcacgcacctataatcccagctacttggggggctaaggcaggggaatcacttgaacccaggaggcggaggttgcagtgagccgagattgcaccactgtactccagcctgggcaacaaagtgaaatttcatctcaaaaaaaaaaaaaaaagtattaattctcaggggtttggagaatttcctgttatctctgttatttctagttggttttattttgttttagtggtactccaggggttacaaaatattcaacttttcacagcctatttagaatattttgtcacttcagttggcatatggaaacattaccaccatatgtctccttaccgttcaccatttcttacattgaaaaccccatcagaggctgggcgcggtggctcacgcctgtaatcccagcactttgaagaccgaggcgggcggatcacgaggtcaggagatcgagaccatcgtggataacacggtgaaaccccatctctactaaaaatacaaaaaattagccgggcatggtggcgggcgcctgtagtcccagctactcgggaggctgagccaggagaatggcgtgaacccgggaggcagagcttgcagtgagccgagatcgcaccactgcactccagcctgggtgacagagtgagactctgtctcaaaaaaaaaacagaaaaaaaaagacaaaaaaaaaaaaaaaaaaacaaaaacccatcagataatcttataatacttttgtattaaaccaccaaacatattttaaagaactcaagaaaagaaggagagtgtatcgcatttacccagttatttatattctctgttattctttcatttctgttattctgtccaaagaactttctcttttttttgagatggagtctcactctgtcgcttaggctggagtgcagtggcgtgatctcagatcactgcaaactttgcctcccaggttcaagcaacctcagtgcctcagccttgccagtagctgggattacaggcacgtgccaccacgcccagctgatttttgtatttttagtagagatgggatttcaccatattggccaggctggtctcgaactcctgacctcgggtgatctgcccgcctcagcctcccaaagtgctgggattacaggcttgagccaccaaagaactcttttagcagttctgttagagtaggtctgcaggctacaaattctcttagttttccttcatcttagtttatttcaaggttattcctgaaggatgttttcactgcatatggaattctgggcttgcaattcttttctttcagcacttgaaaaacgttgtgccactttggtcttcatgatctcagaggataaattcactgtcattaggattgtgggtcacctacagctcgtggcatttctctttggctgttttcaattttttttccttgtctttatttttcagcagtttgattttgatgtgtctgggcatggatgtctttggatttattgcatttggggtttgctcagttttttgaatctgtaggttggtgtttctttcccaaacttgggaagttttcagccattatttcttcaaaagctttttagtgctttctttctcatctgctttgggattctgatggcataaatattagaccttttgttatgtcccacaggtgcttgaagttttattaattttcccctcctctctgttggtcagtttggataatttctattaatctgtcttcatgttcactgactcctctgtcatttccattctgccattgaatctatccagtgagttttaaaatttgattattgtacttttctattttaaatgtttatttggttcctcttactttctccaagttttttactcatactttcttttttaaaattattattttttatttgtttgagacagagtctcgctcggtggcccaggctggagtacaatggcacgatctcggctcactgcaacctccacctcccaggtacaagcgattctcctgcctcagcctcctgagtgcacctgccaccatgtccggctaatttttgtatttttaatagagacagggtttcaccatgttagccaggctggtctcgaactcctgatctcaagtgattcgcctgcctcagcctctcaaagtcttgggattacaggcgcgagccactgtgcccagccccatactttctattttaacttttgtttcaagaatgtttataattttttgagcattttcataactaatgtctttttcagataatcctaacagtcattttatagttggtgactcttgattatcttttcccatgcaagttgagatttttgtgatggttcatatgcctagcaattttgtatcctgagcattttgaatattatgaggctctaattcttgtttaaatcctatggagaatgttggcattttaattttttttttttgagaaggagtcttgctctgtcactcaggctagagtgcagtgctgtgatctgggctcactgaaacctctgcctcctgggttcaagtgattcttgtgcctcaaccttccgggcagttgggattacaggcatccgccaccatgcccggctattttttttttttttttttttttaagtagagaccgggttccaccatgtttaccaggctggtctcaaactcctaacctcaggtgatctgccctccctaagtgctgggattacaggtgtgagctaccgcgcctggccaacagtttaatttaagcaagcacatgaactagttagggacagcctgcaggttccgatcttcttctggggttcatgttccaaagtgagttctgtgttcataccctctgtggggctatttggatctgtctcgtggctgcatcctcccgtagtttggtacctgaacaaaaatctgttcatgagcacagttctctgagtgtttggtgtgctcgttaagtcgatgatacgcaggtcagcgatgagcccaagagttcaaaaacaactctgtgaggttgcttgccagatgctctcaccttccgctatcttctcagtgtttttaggttccctcaggtttcagtgcgctggtctgaaacttcccactttcagtttggcttgggggagctgcccacttccacaattgtgccacagcagtgggaaacagttaaaaacaacaaaacaccaagtttgtgtctgtcctcttggagctgcagtgctactgaatggaaaggactatctctttccctcagacttttggctgctgaagctttttgctctggccttgggcttgactgggggctggagtgcaaagaaaagaagaaaatagaaagaacagggaattttcttcactccctctgagggttaggagtttccttttctgctccacgagccagaatcagagggtttctcccgagtctctgtgtgtgcccccgacactcagttccaggctttggactaccttcagcttgaagatgggtgacacaaccagtttgatggtgcgtcaaattctgctgttctttttatttttaattttttgtttgaatttaattcctctaatttttcatcagtgttaaaatttcaccttttcccagcacccccaaaaagcctgtgggcacaaaatggtggccacgtggcaaagaactcagcaaggagagctgctggttggtttctatctttgtttgtttgagacggagctttgctcttttgcccaggctagagtgaagttgttggggaaaccagccccacaccacccggcgggtaccccgagtccagcgaagacaaaggaattagaataagagtttaaaaggcgggtccgggggaccggagcgttggaggcttgctcacggccccgagctctcggcctccacccaatttattggtgtatattcacactgttgtgcaaccatcacccccatccatctccaggactttaccatcttctcacactgaaactgtgcacccgttagtatttttcatggctatgtggatgtaatataatttctttcagaaacccctattgttatacattcaggtttctttttttctctattataaatatcttttatcagcaatgcttcagcaagatctcttgtgcatacatcttgcagacatattatttctttttctttttttttttttttttttttgagacggagtctcgctctgtcacccaggctggagtacagtggcgcgatctcggctcactgcaagctccgcctcccgggttcacgccattctcacgcccgccaccatgcccggctaattttttgtatttttagtagagacggggtttcaccgtgttatccaggatggtctcggtctcctgacctcgtgatccgcccacctcggcctcccaaagtcctgggattacaggcatgagccacggcgcccggccacagacgttatttctgaaggataaattcctagaaatggatttgctagggcacgtaggaggaattccaatttacactcacttgtatgtgtgaggaaactttcagactctactgtaacgacaggaggtattaccgctgtttgtccatgtgataggcaaacgtttctgttaattttaatactgtttggatagctagtaccggctcagtttttttaacccacaccatgttactgtcttgattctggactttcgcagtgtgtcagtgtagaagcagctaacgcttccgatgtacacaacctagacgttccatgacccagctgacttcgatgctgcaagcctccctttcggtttcccggagcaagcgcccgagtgcgtgttgggctcccggcagggctcctggccggccctcgacggacttccccgcctttgcccagtcctgcccctccgcggaggcttgccaaggtcttgtctgctgcgcttgatgtgtgcagctcagctttactgcgtctaggctaagccccacagtttcttttacagagcgattgtccaacttcaggcatctgggtccccgagtggcgggtctgggccggagctgggaatcagcctttccagcaaggtccctgcagatgccgcgggtctgaggactacgctttggaaggcctcgcagtgcgtctagatctgacagctgctctgcatgagcctggctccaggctgaagcaatagtcggtcaacacaaaatcgttctcccaagttagggaagcagaagccagacagggagactgggtaggtgcgcgctggtaccgccgcggcgttcgctccggcttcagtgcacggccggaggaggacgccagggggcagcagcgccacgctcacccgcccaggacgcgcttccgaacgcgcaagcgcagtaggcccagtgcgtgctggcccggggtggcaggagccgcagaggcttgggctgcaggtaggtgctgcggcgaggggtgagagggcgaaggggcgagggggcgtgcagctgggtttcccgggggaccctgtacgtggcctgggccgcaccccccgcagccccggccgcctgcccgcggcctgtccggaggctccctaggaggctgcgctgggcctgagcggccgtgtccaccgcgcccagcccctatctccgcgtccacccctgcgcggtagcgggacgttaaagaaccagagaagggcccggcgaggtggctccagcctgtaatcccagcgctttgggaggccgaggcgggaggatcgcgtgagctcaggcgagagcagcctgggcaacatggcggaacttctgtctccgtaaaaaagcacttagccgggcgcggtggcgccgcctatagtcttatctactccggaggctgaggcgggagaatgcttgaacccggcgggggcggaggtttcagtgagccgaaatcgcgccactgcacttcagcctgggggccagagtgagaggctgtttctattattattactttatcattattattattatttgagacggagtctcgctctgtcgcccaggctggagtgtagtggcgcggtcttggctcctgggattacaggcgtccgccaccacgcccggctaatttttgtatttttagtagaaacggggtttccccatgttggtcaggctggtctcgaacgcctgacctcaggtgatccgcccgcctctgcctcccaaagtgctgggattacaggcgtgagctactgggtccggcagaggctgtctctgtttaaaaaaacaaaaaccaaaccaaaccaaaacaaaacaaaaaacaaaaaaaccagaaaggaccgaggactctgtctcagctctttgcctttgggtgtttattctgcacgagatcattgttgccaggaggtgttaagtgtaatcatattctcttttttttagaaagcaaaatttcgctgttttgttgcataatcttgtctttgccaccctttgcctttgctatagaaccttaaggctaaataagcgttcagaatatttaaaataatcctcttaatgtaccttgtgctttattggcgcaatggaattctactctaaactgtattggatgacattactctgtgtcttccctagttgtagaaaatatcttgtaagtcggtaaaaactagttttgtccctttgcttttcttttctttttaagctgtaaatgtggagcagtgggtcccaagcctttctctatcaataagccttcctatcagtgtcagaaatgctttgcatttcagtcgtgcctgaatttcttctgcccaacctgccccaccatctttattccttaatgtgcaggctgttttcaggaccagtaaatttcagtggtttttgcttacttctggacacgaaagttcctttagccacacagcctcatgctatgctctgggcggcctactccagaatatgcctgtgaaacaaaaaagcaaatcggggttgaggtgggctgaagtcttctttaagaaaccggcagtcccagggtaccccagcccagcccctagctgaccacgctgggtttgatttagttcaactcccgagcattgcggtatttaggggaagaatgggcttgaggccagaaaacttggctcttctgtgtatagttcagtgaccttagatatattacttcacctctgactcagttgtcttatctgtgaaatgggaataacaacaattacatccacttcacagaattggtgtgaagttgacagtgtataaaagtcaaatgaattttggggtattttttttatttgttttgttttggtttggtttggtttgtttttgccgagagaggattcagaagtgaatgtgaggacttagggatatataaaaggtttttggggcatatgaaatttggattcagcaagaaatgcattaaaggttttctgagtaatgctgagggtccaagagagattagaaaatatgcatttctagagtcccacagagttttgtagctgatgttggcagcctttgagtggaaatgaagaagtggacagggcaagttacatgggtctggtgaatgacaagcagatctgggtttatgatgaagcctctagcctcttcacttgcacaaataccttccaaaaccttgcacaaatcctcttgccaaaactctggcaagaggctcagcacttttacattcataactattcttctcttaaggaattaccactccttgccccaacttgtataagcttcaggccccataaaacctgaatccactagtggcaaggaaggattggtgggaggttaggggtaaggagggttggagggttgaaaggatttatcgcagggtttgagctgggaaacttggattggagaaggaggtggcagatgagggtcctcagaagacaggagccgtgaggagaggaagagcggattccgtggagcgaacacaggagagggaaagcagcctgtgcggctgaggccatgaagagggagaggtgcagagtgaccaggcagttggtgcgtctttgccgagtacccgctgtgtgccaggcactggggtgcagtggtgaacaggacaggcaggcaggcttcttggtgctcagaatctagaggaagccggggcctgggtatcccagaaagggagcctttgaggaaagctcaggggccagagagtgtggtgcagggagggtttagggaagcagataggggctagatttcaggaggccacataagagtttggacttgatcctgtgggccgagtggggggctgttgaatgttaagcaaggtgggatcagatccgtgctttagaaagctctccctgcatgggccggacatggtggctcatgcctgtaatcccagcactttgggaagccaaggtgggcggatcacgaggtcaggagattgagaccatctggccaacatagtgaaactccgtctctattaaaatactaaaattagctgggcatggtggcacgtgcctgtaatcccagctctgtaatcccagctactcaggaggctgaggcaggagaatccctttaacaagggagtcagaggttgcagtgagctgagattgtgctatagcactccagcctggtgacagagtgagactccttctcaaaaaaagaaaaaagaaaaaaaagaaagctctccctgcatgtatcagagaaacttccatgtatgcctggggagatgtatacacagcttgtctcactaattgtggaaaagtcaaaccagttgaaaatagtgaactgagttttgtgcatctgcatggataaatctcagaaatgtaatgttgagcttttaaaaaaaactggttgcaggaggataataccagcccatcactgtttgtataaagcttgaaaacatatgtatgatttatgggcacatacttgtgaaaataagcatgtatgagaagcggagtttggtaacccatccctgtagtcagtcccagctgcttgggaggtggaggcaggaggatcacttgagtctagcctgggcaacatagtgagactccatgtcttaagtagatagataagtaggtaggtaaatagataagatcgattagatagatagacagcatgtataggaattatatacaccagtggttttcagactttagcatgcatccaaatcacctagaggatttattaaaacacagatgttcatttctgattcagtaggtttggagtgtggacccaagaatttgcatttctcccaggttcctgggctatgacgccacaggtctggggagcacagtttgagaatctctgatgtccaccaacttgaagatagtgatcacttcttgagggggagtagaattggatggggaggagtccagagggtcttcaactctatttgtaatatttaatttctttaaaaaaagatctgaaaaaatgatgcagtgtgacttgacaaagctggatgaatgcttatgattttttttttctctgtgtgtgaaacacttaaagaaaaaggatcctgtttgctgtgtaatcctgagaatggactgcaagagaggaaaaactgggcgtctgcttgggaatctattgtggaaacccaggtgagaggtgctgctggctcacgcagcggggtggaggggaagggcagcaaggaaggagatatgcaagcagttgtgagggaggttttggtgggagcattgactgcatgtggtaatcggttggtttagagtttaggggagggaggaatcaagtcacacacacctggtctgtaacttgagtgggtggttgggtcatgagcccatgacagagggaaccctggaggaggggcctgtggggactggggagttctgcagtggacatcccataccttgataggccagtgagcaaagcataggagagacctgggctgcagtgcagacttagaaagcagcagagttcagatggctgctagtgtcccaggtgtgggtgaggttacctgggtctttggcagacctggaggaatgccatcacctaaggcagggcttggccaaccacagcttctgcttgtttttgcgtagcctgagagctgggaatgcttttatctttttaaatgttagggggagacttcaaggaagatataattcacaaaccataacatttgacattttaaagtgtacaattcagtgatatttagcatatttacaaggttgtacaatcatcatcactgtctaattcaggaacattttagccaaaaagagaccccatccctgtcagcagctattccaccccctgcctccccagcctctgggagccacaaatctatgttctgtgtctgaatttgctgtttctggacatttcatgtaaatggaatcttacagcatgtggcctttttgtcaggcttatttcactgagcatgatgtttccagggttcacccatgttgcagcatgaattagtgctttattttttatggctgaataatattccatttatggatgtaccacattttgtctatccattcatctgccaatggacacttggcttgtttccactgtttggcagttgtggataatgcttccgtgaacattcatgtatgagtgtgtgtgtgagtgtgtgtgttttcataggtacatactgggcagtggagttgctgggtcgtgtggtgactgtgcttaaccttttgaggagcggccagactgctttccacagtggctgcattttactttctcaccagtgatgtttgaggatttcagtttttccacattcccctatgttgttactgatttttgtattatagccatcctcatgggtgtaaaatgccatcttgtcacacttctgatctgcgtttgccttgatgactggtgaagctgagcatctttcatgtatgtgcctgttggccatctgtgtatctactttggagaaatgtctgttcaagtcctttgcccattttaaaaattttatttgtttatttttttgagacagggtctcactgtcactcaggctggagtgttgtggcacgatcacagctcactgcagccttggtctcctggactcaaatgatcctcccacctcagcctcctgagtagctgggcctataggcacaggccaacatgcctggctaatttttaaatttagtttttgtagacaggaggtcttactatgttaccctggctggtctggaactcctaggctcaagcgatcctcccaccttggcctcccaaagtgccgggattacaagtgtgagccaccaatgcctgaccctttgcacatttttaaattgagttgttttttttgaatcttttgagttgttcaccagacatccacatggagatgtcaaggaagcaagccttgggttctgaggagaggctgggaatggagttttacctttggaagttgtcagcaggcagcgatgaaaagtcctgagtctgggtgagctctcccagggagtgtggcagaggcctgagctctgaactctgggggaccccactacgtggactcagagatgaggagctgccagaatgtagtttcctggaaaccaattatataaggcgtttaaggagggagttatcaatcacggtagatgctattgatagatcaaggaagactggggctgtgctttgactgttgtgtttagtgatgtggaggccacctgtgctgactgtgataaggtcagtttgggtgcagtggcagtgagttggagagaatgagaggacagagctgggcgtggggtttgcctgagctgggctcggggccagtttcatggtaacacactgtttgtagtaataggagagtgcaggaacctggggtggggcttgggaactggtggaaatgctctctgattgcttctgtttttctagtaaaataggatgatctcgttagatgatcagctgagagtgaaggtgggggaacaggtggtacatgtttggagaaggagagtgtgagcttccagctagcctaaggccactcgggacacacctatcacttttattgactcactgcaataagcgaggctgcatactggcgggacttgcatatcttcatcagagggacagagagtcatctgagagggcacagggcaggagtccttcggggcctctctgacctggcccggggcagggagctggggatggaagtgccatgagtgcaaatagggagcagggggtcagaggaacagaggatatgggaatgggtggtggagccgggagagactggagctttgccaatgggggcctgggctgagcagggctcagagcatgtggtgatgagccttatggcaggtgaggctcaaggcccagtgtgtgcttagggaagtgggcagcagagcgggtgagggacccgtgggtgtatcacaggggtagggtgttgaggaagttccaaagcaagctaataggggttatggctggagagaggcccagtgtgtgtgctaatgggggatagtgtggtagaggcaccagggtgtgtgctaataggcctctgaggcctcgtgtgtggtgatgggggtgtgtatggtgttagtgctgtgtgtgtgtctgtgggggcctgcagggtaggagagaatggggtgcttatggaggggaggtggttgaaggactcaagtgctgggtgtgcgcttgtgggggttgtgccgtggtgggtgtgtgcatgcgctaataaaggtctgggtagttggagcccagtgcatgctaatggaacagagctggagggacctcatggagggatctgatggagggaggacggtgggagacctgagcctgtgctagcggggatgaggattgtggatctctgtgaggtagggggtggtggtggtgcgggaagggtcttggtaccgtcagaggcccggtgcgctaagggtcaagttggtgtgaggtgcacgtgtgtccctgagcacgaggacactctaggaaggggcagccggatggtttaaggcgttctagaggctgctactgtgggtttagagccatagaggcactgaagtgtgtgccattgctgggagagtcagcagtgtgaggtctggagtacgctcaagagcgccagaacagtatgagcttgtgtgcttgcatctgtggggtactggaatgtgttgaggttccagggaatactgatgcaggggatgagtagagccgtggaggggataaaaataaatttaaaaggccaggtgcagtggctcatgcctgtaatcccagcaatttgggaggctgacgcaggaggattgcttgaggccaggagttcaaggccagcctgagcaacatcgtgagacccagtctctacaaaaaaaaatacaaaaattagctggatgtggtgatgcgcacctgtagtcccagctactaaggaggcagaggtgacaggattgcttgagtttgaggctgcattgagctatgattgcaccactgcactccagcccgagtgacagagtcagaccctatgtcaaaaaaaaaaaaaaaaaaaaggaagaaaatcatagaattttggagatgagtaaagtttaggcaaatttaaatgaagtagtgttttgatgggctcaaagccatgtagaactgagtgtaaaggggccaagatctagtctggactgcaaagtggtcctctttccttggagactaccaggttaacatagatgtgcaggattatctccagaaactccttatctgaaggtctgccctgtttgggaactgaggttgcttctgtgtgtcagagtgactttgatcctccaggaaagcatgggatgttttatcccaactgataagacttcaaactgcaaaatttctggtagtctgtgattgtagagaacagaatttctaggtagtaaaaaaggagtcttcatccaaagggggtttttgacactttatggctgcagtgtgttctaaggagaaatgccgtttcctgttaactttgtggtttcattgacgtcttgtcccagctctgtatatgggagtggattttgttttctcaaggaggaggtaggaacaagcttcctgtcctggatttttcatggctggctcctctcaggcctctagtcacagtgtgaaggtcacctccttagagaggtctcctgggatgcttcctccagggagttcctacacagttactctctatctttgaacccccatcacaggatgatgatagacctatttgtttacttgtttattgtctgtcttccccactagacttttcccctaagctccagcaggataggaaccatgctggtgtaattcactgtgtgtgaatgtctccagcacccactgcagggctgggcacatagaagctgctcaggacatgttgcgggaatgagcagctggaagtcagtgatggagaagaagagagcagactgggacagagagactctgatgggcttccccacggccctgctctgtcctggggcttgagaacctgaggaaacctggacttgaggcaggaggagggccctgggaaagttggaccgtttggactatggcgatttgtctgggtacatagctgcagtttctgtttacacacttcctgtttggtactttgtggcagggtgtttcccgaccagtccctgggcgccaactagagtatggactgaccaggtacctggatggagacctgagctggagaaggagatgcgcttgggaggtaaccctgcatgtcacagctgtctctgacccagttctgtcccagtgccccagcattccagtgctgtttagctggctcccactggcatggccacatccactgttaaagtctccatatacttccattctgctccattctgcttctgtaaatcacctctgccatccacggtcctacttcaggcttctccgcagccaggcccctccaccatggccttgcacggctccagcggtagagcccacacattatcagtggttacttatcgctggtgtgacatctgagtggtcatctctccaatctcatcgctgttattctagctcatgtacttgtcagctcctgtccgtggtcataaccagggcttcttaataactggtctcccagcctcagtctctttcaccccaaatctacctttcataactgctgaagagtagcttttatttcttaaaactgttgaggggattctgagtacctcccagggaacaggacagctgcttagctgagttcgacagaggccctcagcttcccagcctccacctgctaccctaagcagcctccttctgctgtcctttgtccaccctctgtccctgtcccaccagttgactaatacattttgctttcattttactgaatattcatgagcatctatttaatgcatgctactgtgagtcggacagagtcagacacaaacacctcccacctaacctaatctagaggaacccgcattttagtttgtaataaaaagtaatgattatggaaacagctaacattgggcatttgggataagcctggtgttcgatacctgctttaatccccacggtaacgctgcagcttacaggacccttgagtagaagaggcatcagaacacatttttggaaatgaaaggaagtgaaagctgactgtcatgacttcttgtttcattgtgtattttaggaaattgcagaggccgtcaacatggaaaagcagccccagaacagcaggagaggcctcgccccccgagaggtgccgccagctgttgggctgctgctgatcatggccctgatgaatactctgctctacctctgcctcgaccacttcttcatcgctcctcgacaatccactgtggaccccacacactgtccctatggtcacttcaggataggacagatgaaaaactgctcaccttggctgtcctgcgaggagctgagaacagaagtgagacagctgaagcgtgttggggaaggagctgtaaagagagtgagtccgggttcatttgcgattgctgtcatcctgttatttcgcttaacacagtgtcctccagctccatccatgctggcacggattacggaatttcatcctttgttactgccaaagtgtactccattgcatatgtgcaccacatttgctttggttgattctgtatcttggcaattgtgaatagtgctgcagtaggcataggtttcagcccttagggaagcagtgtggcatccagtgttaggagccctgctagctctacgtttttattgttgagctcaataatcttacatctggcactttatctttttttttttgagagtctcgctctgtcacccaggctggagtgcaatggcgccatctcggtgcactgcaatctccacctcctgggttcaagtgattctcgtgactcagcctcccgagtagctgggactatgggcatatgccaccacgcctggctaattttttaattttagtagagatggggtttcaccatgttggccaggctggtcttgaactcctgaccttaagtgatctacctgcctcggcctcccaatcggactttatcttaataagtaatccaaggcaggaaaaaagtcaaatgcataaaagagtgccatagtgatagaaaactagaaacaaaacttttagaatagttcattaaatgatggtccatccacttgacggaatattctgcaactgttgtgtagttaggaaccccaagaggcaacatgaataaaaccttatgatgataagtgaagaaaacaagatataaaattgtataattgacttttcaactgtgaaattacgtgtatatgtagataaatacaaaaatggtcaggcgcagtgtcttatacatgtaatcccagcactttgggaggcggaggtgggcggattacttaagcacaggagttccagaccaacctgggcaacatggcaaaacccagtttctacaaaaatacaaaaattagcctggcataatggtgcgcactacttgggaagctcaggtgggagaatctcttgagcctggggagtttgaggctacagtaagccatgatcttgccactgcattccagactgggtgacagagcaagatgctgtctccaaaggaaaaaaaaaatatgaaaatgatagaaattgtgctagggtgaaagggggattatgggcaatttcttttcctgtttttcaaactctgtgatggtattatactgatttttaacaatttatttttaattggcatgtaataattatccatatttatggggtacacagtgatgtttccatacctacttacagtgtgtagttagcggatcagggcatatctgccatctcaaacatgtatcacttcttttggttgggaacattcaatatcttctcttctggctatttgagagtgtataatatattgttaattatagtcatcctatggtgctatgaaacactggaacttgcttctcttatctagctgtaattttgtatcctttaacaaatctctgcctatcctcgcctttgctctacccttcccagcctctagaaaactgttaggctttttacttctttgagtaagcttttttaaacttctgcatatgaatgagaacttgtagtgtttaactttctgttcctagtttatttcacgtaacataatgtcctccagttcctttcatgttgccataaatgacagatttccttcttttttatagctgaatagtattctattttgtgtatatataccacattttctttatccattcatctgctgaaggacacttaggttgattccatatcttggctattgtgaatagtgctgcaataaacatcgggatgcacatatctctttttttgttgttgttttttgagacggagtttccctcttgttgcccaggctggagtgcaatgatgcagtctcgactcactaccacctccacttctgggttcaagcaattctcctgcctcagcctcctgagtagctggagttacaggcatgtgccaccatgcccggctaattttatatttttagtagagatggggtttctccatgttggccaggctggtcttgaactcctgaccttgtgatccacccaccttggcctcccaaagtgctgggattacaggcgtgagccacttagcctggctgtgcatatctctttgatatattgatttcctttcctttggatatatacccagtagtggaattgctggatcatatgttagttctgtttgtaattttctgcggaacctccatactgttttccataatggctgtactaatttacattctcactaacagagtataagcgttcccatttctctgcatcttcaccagcatttgttattttttgtctttttgataatggccatcctaactggggtgagatggtatctcattgtgattttggtttgcattttcctgatgattagtaacattgagcattttttcacaaatttattggccatttgtatgtcttctttcgagaatgtcagtttagatcatttgcccattttttgatcatattgttatttttttctgttgagatgtttgagttccttggatattgatcccttgttagatgaatagcttgcaaatattttctcccattatgtagtttgtctcttaactctatttgtttcctttgctgggaagaaggtttttggtttgttataatcccattggtttacttttgcttttttttttttttttttttgactgagtcttgctctatcgcccaggctggagtgctgtgacatgatcttggctcaccgcaacctccacctcccaggttcaagagattctcgtgcctcagcctcctgagtagctgggattacaggcgcccaccaccatgcctgtatttttagtaaaaatggggtttctccatgttggccaggctggtcttgaactcttgacctcaggtgatccgccctcctcgacctcccaaaatgctgggattacaggcatgagccactgggcccagccctcagttataattttgcaaaggcggtttcaatccctccctttggggttttgtagcatcttattcttaaggtgtgggctatgaagatggaaaaaggccattgatcactctagcttcttcatgctgacagggggcatagttggggtcggagttgaccctaaggtgagaggagtagaactgctttgcagctgtctgagtatattcatgcaggccgggctgtggttccaaggctttcgtgacaaaggcagtagtatctttatagttttagtacagcatttaaacagacagtctactataaggtaaataatgagttttaggataaggagtgcaatttccagttttaaaagtaaaggtttgaaagcattagtctggggacttatagtccacaaaaatattaggatttagtctaaattgaagaaaaaaaaaactaacaacatgtgtaccatagtttttggaacataatttttctctctttagtccttatttttattaaaacaaatcacgataggactgatttgttggcaaaataaactttaattttattatgcttggcctgattatttgcataaagcgcatcagtaatactttttttttccgagatggagccttgctctgtcgcccaggctggagtgcagtggcgtgatctcagctcactgcaacctccgcctcccgggttcaagcagttttcctgcctcagcctcctgagtagctgggattacaggtgagtgccaccacacctggctaatttttgtatttttagtagagacagggtttcaccacgttggtcaggctggtctcgaactcctgacctcgtgatctgcctgccttggtctcccaaagtgctgggattacaggcatgaatcagtaatcacctggcaagaatactttttttttttttggtagagatggagtcttgctccgtcacccaggctggattgcagtggtgtgattgtggcttactgcaacctccgcctcccgggttcaagcaattcttctgcctcagcctctcgagtagctgggactataggtgcacgtcgccatgcctggctgatttcttttgtattttagtaaagacggggtttcactgtgttgcccaggctggtcttgaactcctgagctcaggcaatccgcctgccttggcctctcaaagtactaggattacaggcatgagcctctgcgcctggctagaataattattttttacataggctttttaaattgcctttgatggaactctgttccataaggaatctcagataagactttctaaagctgagtccagccataggtttgtaccttcaaatacttatgagttgggtaagttcctctcctcttgatgcccctagataacttggggctcctgggcctgtcagaaagtgacattctatacttaccatgggtcaggaaccctgtacagggactgtgtagacaaagtatgagctcagttttcccaagggcttttactggctttacaagtacaagtcaaggttgattccataaaggaaagcatgccattctagtcaaacccttggtaaaataaccagtgttttcaatagtgtcctgttacaaaagaaaacagattcttattgtatttatgaaaataactgtattgccataaattaagaatactcacaaatagtttttaaattctggagaaatcaagtagaaacaaatatgcgccaaattttattcacaggagtgtactttactcagttgctacaagctgtaaatagcttaaaagaaatttccctgactctgaaaaagcaaagaatcagcagcattttaaacaaaaaggttacttcagacttttattagtttagtccatgcatttaacttctgtttgatatttatgaacatttcagctttccatgagagttctaaaagtttttttcctttattctatgtcataatctccagagttatcagaaacttgcattcaagagcacatatcaaagttttatagctgattataaaaccatcttctaaagaggaccaaattaaaacagcagttatctttggatgagaaaagcattttagggaagccacaaagacacaattaacaaggaaatttgtgaatctgtggcacacaataattcaacacaacagttattactgatgacatatactgagtcatatcagaattgtaggaattttatacagttttgcagcacgtaactttatatcacaaatttatatgaatataacccaaagaaagttaagcaccattttctatttgacagtgtttcctgcatgattttaatacattaaataagctgaatatgtcttttgtactttaggggacttaatttttaaaaattttttattttaacttagagcttgattttgaaaggtttgttaaataccaaacgtttaaaacattggatattacaaaatggagtcttaggtttccgtaagtcattcatttagccaaagtaactcaaaaattttcaaaaggaaaaaccattattctggtaggagactcagctttccaaacaagacccaatgaaggtagcatgaggctgattgcctcctctctctcccctcccccttttttcttttgtagtttacttaaaaggtaaataaaaacctttcattatcttttaatattccataaaaatcctttttaaaagagaaaactgaattttatgtttccattagtgtatttttaacgttaaagccagttttaattacatcttataaatctgtctagttctaattagtttgaccataaggtaagattttttttttattttttatttttttcaagacgcagtctctctctgttgcccaggctggagtgcaatggcatggtctcggctcactgcagcctccatctcctgggttcaagtgattctcctgcctcagcctcccgagtagctgggactataggcatgtgccaccacacctggctaatttttgtatttttagtagagacagggtttcactatgttggccaggctggtctcgaactcttgaccccttgatctacctgcctcagcctcccaaagtgttggtataacaggcgtgagccaccacacctggcttgccataaggtaagatttttatgaatcttttataaccctttacaattttgtttttttcttagaacaaaactgttttaagaaaactctgttgtgcttttattccaatttccaatttatggaaaaactgcataacgtgacttaaactttagccaatatgttcacacacagaatctcttacaattaagtttttataaccctttcacaacttgttcaaacctttagacttttcctatctcatttaaaacagtccgttaacactctaaacttaggcaagaaatccacattcccatgccttctcataatcttttaccaaaagtacattttacttcccttacatgcctcgtgtatagaactgtttcttcagtagtctcaagtgcatattacactgttaactcaatgacttttacttttggtggaaagcctggtgagtaagcaatttcaattacgtaccaggagtggagcctaggacaccagaaggtctgactgtttccagtgtagctagggagtgtggctaactccacatgtctcaggccttacctagctataaagcaggcaagttgtacagtaagagtcatagtggcattttatgaagtatttaacaggcctaacaacctttgaattgtacaacatttcttgcataaattgccttttcatgaatacgttcacaacttacagagaccatctacaacatgcttggactttcagacttttcctaaacatccctctttttaaacagtcattttactttaggaccagattttaccatacaagatcttttcttatataaaatttcttggctgggcgtggtggctcacgcctataatcccagcactttgggaggccggggcagaaggatcacctgaggtcaggagttaagagaccagccaacatggtaaaaccccatctctattagaaatactaatattagccgggcgttgtgctgggtgcatatattccaagctactcgggaggctgaggcaggagaattgcttgaagctgaagccgggaggcggaggttgcagtgagccgagatcgcgccattgcactccagcctggggtacaagagtgagcctccgtcttaaaaaaaaaaagtcttgggggtgaagccaagatggccgaataggaacagctccagtctacagcacccagtgtgagcgacgcagaagacgggtgatttctgcatttccaactgaggtaccaggttcatctcactggggagtgccggacagtgggtgcaggacagtgggtgcagcacaccatgcgtgagccgaagcagggcgaggcattgccccacccgggaagcgtaaggagtcagggagtcccttttctagtcaaagaaagtggagacagatggcacctggaaaatcgggtcactcccaccctaatactgcacttttccagcgagctcaacaagtggcacaccaggagattatatcctgcacctggctcggagggtcctacgcccatggagcctcactcattgctagcacagcagtctgagatcaaactgcaaggccgcagcgaggctgggggaggggcgcccgccattgctcaggcttgagtaggtaaacaaagcagctgggaagctcaaactgggtggagcccaccacagctcaaggaggcctgcctgcccctataggctccacctctgggggcagggcacagacaaacaaaagacagtaataacctctgcggacttaaatgtccctgtgtgacagctttgaagagagtagtggttctcccagcatgcagcttgagatctcagaatgggcagactacctcctcaagtgggtccctgacccccgagtagcctaactgggaggcaccccccagtaggggcagactgacacctcacacggccaggtactcctctgagacaaaacttccagaggaacgatcgggcagcagcatttgcggttcaccaatatctgctgttctgcagcccccgctgctgatacccaggcaaacagggtctggagtggacttccagtaaactccaacaaacctgcagctgagggtcctgactgttagaaggaaaactaacaaacaggacgtccacaccaaaaacccatctgtacgtcaccatcatcaaagaccaaaagtagataaaaccacaaagatggggaaaaaacagagcagaaaaactggaaactctaaaaatcagagcgcctctcctcctccaaaggaacgcagctcctcaccagcaatggaacaaaactggacggagaatgactttgatgagttgagagaggaaggcttcagatgatcaaactactgcgagctaaaggaggaagttcgaaccaatgggaaagaagttaaaaacttcgaaaaaaaattagacgaatggctaactagaataaccaatgcagagaagtccttaaaggacctgaaggagctgaaaaccacggcacaagaactacgtgacaaatgcacaagcctcagtaacctatgcgatcaactggaagatagggtatcagtgatggaagacgaaatgaatgaaatgaagcgtgaagagaagtttagagaaaaaataataagaaatgaacaaagcctctaagaaatgtgggactatgtgaaaagaccaaatctacgtctgattggtgtacctgaaggtgacggggagaatggaaccaagttggaaaacactctgcaggatattatccaggagaacttccccaatctagcaaggcaggccaacattcacattcaggaaatacagagaacgccacaaagatactcctcgagaagagcaactccaagacacataattgtcagattcaccaaagttgaaatgaaggaaaaaatgttaagggcagccagagagaaaggtcgggttacccacaaagggaagcccatcagactaatagcggatctctcagcagaaactctacaagccagaagagagtgggggccaatattcaacattcttagagaaaagaattttcaacccagaatttcatatccagccaaactaagcttcatcagtgaaggagaaataaaatactttacagacaagcaaatgctgagagattttgtcaccaccaggcctgccctaaaagagctcctgaaggaagcgctaaacatggaaaggaacaaccggtaccagccactgcaaaatcatgccaattgtaaagaccatcaaggctaggaagaaactgcatcaactaacgaggaaaataaccagctaacatcataatcacaggatcaaatacacacataacaattggtgaatctcacaattatgtgtcttggagttgctcttctcgaggagtatctttgtggcattttctgtatttcctgaatctgaaagttggcctgccttgctagattgtggaagttctcctggataatatcctgcagagtgttttccaacttggttccattctccccatcactttcaggtacaccaatcagacgtagatttggtcttttcacatagtctcatatttcttggaggctttgttcatttctttttattcttttttctctaaacttcccttcttgcttcatttctttcatttcgtcttccatcactgataccctttcttccagttgattgcatcgactcctgaggcttcttcactcttcatgtagttctcgagccttggctttcagctccatcagctcctttaagcacttctctgtattggttattctagttatacattcatctaaattttttcaaagttttcaacttctttgcctttggtttgaatttcctcctgtagctcggcgtagtttgattgtctgaagccttcttctctgaactcgtcaaagtcattctccgtccagcttttttccgttgctggtgaggaggtgcattcctttggaggaggagagacgctctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactccagaccctgtttgcctgggtaccagcagcggtggctgcagaacagcggattttcgtgaaccgcgaatgctgctgtctgatcgttcctctggaagttttgtctcagaggagtacccggccccgtgaggtgtcagtctgcccctactgggggctgcctcccagttaggctgcttgggggtcaggggtcagggacccacttgaggcagtctgcctgttgtcagatctccagctgcgtgctgggagaaccactgctctcttcaaagctgtcagacagggacatttaagtctgcagaggttactgctgtcttttcgtttctctgtgccctgtccccagaggtggagcctacagaggcaggcaggcctccttgagctgtggtgggctccacccagttagagcttcccggctgctttgtttacctaagcaagcctgagcaatggcgggcacccctcccccaggctcgctgcggccttgcagtttgatctcagactgctgtgctagcaatcagtgagactccgtgggcgtaggaccctccgagccacgtgcgggatataatctcctggtgtgccgttttttaagcccgtgggaaaagtgcagtattagggtgggagtgccctgattttccaggtgccgtctgtcacccctttctttgactaggaaagggaatgccctgaccccttgcgcttcctgagtgaggcactgcctcgccgtgcttcggctcgtgcacggtgcgctgcacccactgtcctgcacccactgtctggcactccctagtgaggtgaacctggtacctcagatggaaatgcagaaatcacctgtcttctgcgtcgctcacgctgggagctgtagaccagagctgttcctattcggccatcttgccccttcgatgctttgagatttttaaacccaagattacattaaaagaaccagttgtgcactctcccagtcatctcaaggacacagtacacctgtgtcaggggagctgctcaaagtctggaatgtagatttggggcaacaggtatattaagaagaaagattatagcagagctgggagtcaaatttttttttctcatcgttataatgaaatgacttattgaagggcctgttgtatagtacattaaaaatccatacagtatagcttggatcctgtcagaagagtggatttgattctttctcttaaattattttgtagctctcattttgtgtaacctttgggaggatcccttgtgatgtcttaatgtttgaggctatatttaatgcttaccttctggaaagatgttacatgaacagtctgtttaaagcatggaggaatagtgtccacttcttggcctcttgccagctctgcctcctcatcccttccatcccttctaatcctggacctctcgtcttctgtgcttgtaccccgcatgacgtcatccagccttctggcttcatctgtgcagagactgcttccctgaagttttctatacagctgcctacccgacatgtacctggggtttctgagaggcttctcaaactcaccacgtcacagatctccctcagagcctactcaccttttattatttcctaactccatcagtcctgctgttctggccacctatcttgtcaatatcctgacctctctctcatccaccttcagtacatcagcaagttacattgtttctacttttggaagagacctggaatttgaccactcctcaggcttgcaccaggacccagcccagccccccaaaccaccctgaccctggacttaaattgtttcaccagcctccaaaaatggtctttctgcttcacacttgctccctacctcttcagtctattctgaacacagcactcagaatgcctcttctaaattattggtcaaatagtgtcattcctctgctcaaaatcctttggtgctctctgtctcattctgagtaaaagagcccttgcaacgacaaggccctgcgagacttaacagcctccctccagctctctcctgctccatggtccctgtccggtctactccagcatcagagccatgctgttctggaagcctgtgggcatgctgccactccagggcccttggcccttgctgttttctgtctgggctgtagttccacaaataacaagtggttccttcccttacctccttcacggtcttgctcaaaggccaccccagtgagaagtccttcaaccccgtttaaaattgcaaaccatccctgcttaattcttctctaaagcgcatttctctttccaatatactttatacatttcctatttactttattcattgtttgcctactgcactagtatgtaaatttcatggtggtagggatttatgtttattgacataatgaagacacatttgactacatagcagttaaaatattgtaagaccacattaactaagttaattatattctttttcttttcagagacagagtctctctcttttgcccagtctggagtgcagtggtgcgatcatagcttattgcaacctcaaactccagtgatcctcccacctcagcctcttgagtaactgggaccacaggcgtgtgccaccatgcctggctaattaaaactttttttttttaaagagttgagatcttgttatgttgcccaggccggtctcgaattctgggctcaagtagtcctcctgccttggcctcccaaagtgctaggattacaggtgtgagccactgtgtctggcctaattattttctggatcttgtcttttacatttgcaataaaggatctcataggtaatacattgacccttgaacaatgtggagattaggggcactgatcccccacataataagaaatctgcttatactgtttgattccttaaaaacttaacaactaaaagcctactactgatatcatagttggttaactgtactttatataagtattatatactgtattcttcaagataggtagatttcatgcatgtccgtgtgaagagaccaccaaacaggctttgtgtgagcaataaagcatttaatcacctgggtgcaggcgggctgagtccgaaaagagagtcagccaagggagataggggtagggccatttttataagatttgggtaggtaaaggaaaattacagtcaaggggggtttgttctgtggtgggcaggagtgggggtcgcaaggtgctcagtgggggagctttttgagccaggatgagccaggaaaaggactttcacaaggtaatgtcatcgcttaaggcaaggactggccattttcacttcttttgtggtggaatatcatcagttaaggcaaggagcggccatttacacttcttttgtggtggaatgtcatcagttaaggcggggcagggcaaattcacttcttttgtgattcttcagttacttcaggccatctgggcgtatatgtgcaagtcacaggggatgcgatggcttggcttgggctcagaagcctgacgagagaaatgttattaagaaaaatcataagaaaaaatacatttactgttaattaaatacatttactgttctttaagtggaagtggatccatcatccatcgcaaacgtctttatccttggttttttcacagtgagtgggctgaggaggaggaggaaaggaagaggttggtcttggtatccaaggggtggtaaaggcagaagaaaatctgtgtgtaagtggaactgcgcagttcaaacccgtgttgttcaagggtcaagtatatataaagagctcccagtaattaataagcacaaggcagacaaccctatagaaaattggataaaggacagtgaacagacttttgacagcagaaatacagaaatgcctaaaaagatgacaaatgcctagccttattagtaatcagggaaatacaaattagaagagtaaggtattttcatccattgattggcacaaattacaaacagtggtaataatctggtgtgactaagggtgtattcctaagattctatcatgcgctgctggtgaaagtgcatgctagcacagactttggagggtaatgatggcaatagatatttggtaaattctgtctgcctacctagcttataaaatatttgtgcatgtacatagacatgtaaatataaggctatacactgtagcattgtcattagaaaagggactaacttaaatgtccaggtctttagaaatagatcatataagatcttattaaaggtctttacaaaattatagctacataataatcttaagaaagaatccagtctattttgacagcatcaattccaaattcctggtatttttattatattatactttaattttaaagaaaaaaggtagtagtatctgtaaaagcttactggaaatacacaagtgtaggtattatgcccacactatgaaacattactcagctttaaaaagaatggcctagatctacatgtatatatggaaaggatttctgaggctcagttaaatgaaaaaagagctgcaatgtatgtatgttataacgccattagtataacagcaaacccaaatgctgttttacaagtgtacattaataaataaaggcatagaaaaacttctgggaggatgacagccagttaccaggtttcctttgggtcgggaagtaaaactgggggcagggagacatcctgcctatcctctgtatttgagtttttaccaagaaaagtgttcacgattaattttataataaaaaagtaaagtattttaactgttctttccaaataaaagtcttttagaaaatgattaaaagcaactaaattagaggttgtgagaaatgattcttaaacagtccatgactagcaaattttttatattggaggattcaaatatttgtgtgtgatctcaaagactaatagtatttcataataatatttaataatcttcatttatctgaaacaaaaatgaatgagacacaaatgagggatcaggagccctggggcctgtggctgagcctccccaacttactgttttttttgttgttgttgttacggagtctcgctctgttgcccaggctggagtgcagtggcctgatctcggctaactgcaagctccgcctccacggttcatgccattctgccattctcctgcctcagcctcctgagtagctgggactacaggcacctgccaccatgcccggctaattttttgtatttttagtagagatgggatttcaccatgttagccaggatggtcttgatctcctgacctcgtgatccacccgcctcggcctcttgaagtgctgggattacaggcatgagccactgcggccggccccccacttattgttgaatgtgtagcagcagcttcccaaaagccagcatcgtttttaggtgaaaaatgggcctagaaaaccaaagccattgccagttctggtggtgaccatgcagaggtgggcgtaaggaagccatggatctgaacaaaacctcagttgttcgtattagagccaattatcagattcagtgggatgcaaatctatggagagcgtgtgttcaatatgaaaatttaaaaaaatcttgaacttttagaatgtggtcttatctagtccttaaaaattaggaaatttttagtgcatgtagcagccagagtgaaaaacagcttttttttttttttttttttttttgagacgaagtctctaaccaggctggtgtgcagtggtgtgatcttggctcacttcagcctctgcctcctgggttcaagcaattctcctgcctcagcctcctgagtagctgggactgcaggcgcgcgccaccacgcccagctaattattttgtatttttagtagagatggggtttcaccatgttgccaggctggtctcgatctcctgaccttgtgatcctcttgcctcggctcccaaagtgctgggattacaggcgtgagccaccgcgtccggcccaaaaacagctttttaatagaagttattatccttagtgaaatttctcaaatatgaggattagagagtcttgaaagagttttcatttgaatgttatgagccaatcaaagttatctgggtttttccataatgaacctcccttcttagatccagaaaagatcttcatggtccttgggtctaactccattttatataatatttctttttctttttttttttttaaattcccaatgttagtttttctgaaattttatatatttttgagttaaaaaatttaagttgtaaaagtaatatatgttcatcttggaaaataccaaaagatatgaaggaaaaaaaaatcacccagaatcttaccacataaagacaactaaggcattagcatatttcctttgatttccatgtgctgtaatttaaatttgtctcgttttatgcagttggaacaatattatacaaatggttttgtatacttctcatttgtaacattgctttttttttttttgagatggagtttcactcttgttcacccaggctggagtgcaatggtgtgatcttggctctctgcaacctccacctcctggggttcaagctactcttctgcctcagcctcctgagtagctgggattacaggcatgcaccaccatgcccggctaattttgtatttttagtagaggttttaggttttaggtttcgtcatgttggctaggctggtctccaactcctgacctcaggtgatctgcctgccttggcttccaaaagtgctgggattataggtatgagccaccgcacccagccgtaccattacttttatctgttataactgtataaatatatacattttggtgaccgcatgatatatatatatattgaatgatcctcccacctcagcctcccctgagtagctgggggtacatgtacgctccattacaccctgcttgtttcttaatttctttctttttttttttttttgagacagagtttcactcttgttgcccaggctggagcacagtggcgtgatcttggcttacggcaacctctgcctcccgggttcaagtgattctcctgcctcagcctcccaggtagctgggattacaggcatgcaccaccacgcctggctaattttgtatttttagtagagtcagggtttctccatgttggtcaggctggtcttgaattcctgacctcaggtgatccacccgccttggcctcccaaagtgttggaattacaggtgtgagccaccacgcctggcccaccctgctagtttctaaaaaatgttttgtagagatgggttctcactatgttgatcatgctgctcccatcttttgataagtttcagtgtatgcttttataaataatgtcagatttttattcctggagcttcttacctatttccgattattgccttagatttagatgttagagtctcttgataaataatgcaaaaaactgctttggaaaccataacctttatttgaacaatgacatggcacactgcttgcagaatgagcctggggcaggaatctcctgagtcctgagcctgctttctcttttgtaatcttctgccttctcttgggatttaagcaaaagatcagaggttcttcctttaattacagtgcttcctgcaagcaaatgaaaggtgaaaatccaaggcagaaatgtgaacttgctcttctattagctgtggactctatgagaaggtctagtgtttatgtagcatttcagctcctgcctttacagctgaagtaacaccaaaccacagaacatgcaaaaatgttttccttacatataaatgttcctatttatgatttactatgccaccttttaaaattaatgagtaacattgttacacgtgatgggcagggctctacgccctcatgtaggcttttcggggtctccacacttacccacttttccagtccactcccctgcctcctcttcctccccacccactgtgtggtggtccattggaactggcagtctacttgccactcctccctgccatgcagttatatggagtcttccctcctgagctagcactcccctgccctacattgaatctgcaggtccccctcgttctatgagaccagcttcccaaagccttccagcaccctctgcagcagctctcagtgtcctgcccagaggcaatcgcttcctgccctgaggttccacccactaatgtggcacttgccttgctgaatgctgtgtttgctcatcggtctctcttcataactagacggagagcaactctacgatggggtctgcaccttgttaatttctgtatcttctgcagaacacctgccacttaaaagatatttgttgttctttggtcactaaattaggtgagagttcaggcctgatgctctctatggctttgttgcaggtctttctgtctgagtggaaggagcacaaagttgcactctcacagctcaccagcctggagatgaaagatgatttcctccatggactgcagatgctgaaatctctccaaggcacacatgttgtcacgctgcttggctattgtgaggatgacaacactatgcttactgaatatcaccctctaggttccttgagtaacctggaagaaacactaaacctttcaaagtaccaaaatgtgaacacgtggcagcacaggctggagctggccatggactatgtcagcatcattaattacctgcaccacagccctgtgggcacacgggtcatgtgcgactccaacgacctgccgaagacactgtcccagtatctgctaacaagcaacttcagcattttggcaaatgacttggacgccttacccctggtgaaccacagctccgggatgctggtgaagtgcggccacagggagctgcatggggatttcgtggctccagagcaactgtggccctatggagaggacgtgcctttccacgatgatctcatgccctcatatgatgagaagattgacatttggaagatcccagacatctccagtttccttctggggcacattgaagggagtgatatggtccgattccatttgtttgatattcacaaagcatgcaagagccagactccctcagaaagacccactgcccaggacgttctggagacctaccagaaggtcttggatacacttagagatgccatgatgtctcaggcaagagagatgctgtgaaaaccagtccagccaatgaaggtgggattgaagggctgaatggaagttacagcattctactctgatggtggagttttttgcctgagtttcgtgttttattgttttttttatggcttagccatgtggttcgttgtccacatccacatgtacgtttgtatgtagtccacattggttgttagatttttttttttttctttgagatgcggtcttgctctgttgctgaggctggagtgcagtgatgtgatcttggctcactgcagcctctgcctcccaggttcaagcaattctcccacctcagcctcctgagtagctgggattacaggcacaccaccacgcctggctaatttttgtatttttagtggaggtggggtttcaccatgttggccaggctggtcccgaactcctgacttcctcggcctcccaaagtgttgggattacaggcatgggccactatgcctggccagttgttagatttccatggatttgtagtttccaaagtttctcgttattgatttctacttttcttccattgtggtctgagaaggtacttgatatgatttagatttttaaaaatttattgagacttgttttgtggtctaacatatggtctatgctgcagaatggtccatgtgctgatgagaagaatgtatattctgcagctgttggaagaaagggtctgtaaatgtctgttaggtccatttggtctataatgcagattaagtctgatgtttctttctagatgatctgcccaatactgaaagtgaggcattaaaatcccctgcttttttttgtattaggatctgcctctctctttagctctaatagtgtttgtttatacatgtgagtactttggtattgggtgcatatatatttaaaattgttacatccttttgctgaattgatccctttttcattatgtaatgatcttctttgtccctttttatgttttctgacttagtctattatgaataagtatagctactcctgcacatttttggtttaaatttgcacggaatatttttttccatctgttcactttcagtctatatgtgtttttacatgtgaagtgagtttgttataggtaacatatagttgaatcttgtttttttaaaatccattcagccagtctatgtattttaattggagaatttaaattatttacattcagggtttttattgataggtgaggacttagtcctgtgcatttgttttctgattgtcttgtatatattttttcctatcttttttatttatttttattttttattttgagacagagtgttgctgtgtctcccaggctggagtgcagtggcaggatctcggctcactgcaacctctgcctcccaagttcaagcaattctcctgcctcaacctcccaagtggctgggattacaggtgcccaccaccacacccagctaatttttgtacttttagtagagatggggtttcacctatcttcttttgtattgtttactttacaatttggtggttttttaaatagtcataatgtttgattcctttttctcatttgtgtttctgttctattagtgagttttaagcctttgtttgttttcatgatggtagataccatcctgtctatttgaagatcagatgagattgggcgtgttcagggtggtattaatgtgggaatgaaggaggactggagagacaatggggtgagacaagaggatttttattgagtgcactcagacccagctgataacattcaaaaactgggcccagacaaagacagtacttgacttttatacacacttctaaaagggggtgggctagcttgaaacaagcttatggtggcgtgaagcaaagatacaggggcagaacaaaggcagctaatcaaactgtgacaggttcatgagccaggattacatatgacccttgctgtgcagctcacatggctgttatctaggcttgctcaaaagagccttgcatgggcttatctcataacgttcgctatggcacccagactgccgcagcccaggcctgctcaggcatgtcttacaaccttcactgtgctgcttagttaaaacagagtacttgaagttactggttacagaaaaccggaatctataaactcatatgtttactcataagggaaaggaaaatttgtttttttctccctatgttgaggaagtgctgggagagtctccagagcacattcctttgagcctttgcttatttgataatgttatcgagactttgtctgggtccaggctttgactgttaactgcctttgggatgagtcagcctaatatagaaagcttgtttttctttttttaattttatttttctttctttactttcctgcctcagtatggctttctcttccagatgtaggattcccttaagcatttcttgtcgggctgatctggttgtgatgatttccctgttttttctttttttttgagatggagtcttactctgtcacccaggctggaatgcagtggcacaacctctgctcactgcaagctctgcctcccgggtttgcaccattctcctgcctcagcctcccaagtagctgggaccacaggtgcctgccaccacacccggctaattttttgtatctttagtagagatggggtttcaccatgttagccaggatggtctcgatctcctgatctcgtgatctgcccgcctcagacctcgtgatccacccgcctcggcctcccaaagtgctggtattacaggtgtgagccaccgtgcctggccagtattttttttttaaaactaaattatcattaatgttaaaatttaactgaccatgtatataactgtgtaattgctgctttctcacagaactgtctaggattcattcaacagaccacagaaatgaggtctggcatttaacagactaatgatagaagaaataaactggtttatacaagaatatcaaaatactgtcatgtggtttagtgtagctcaagttatgaattagtgccaactcttgctgcagtgtctctcacacaattttatcttggaacttggcgatttaaattgactttcttcactgaaaagagttctttcatgatactcttcgtgaattgctcatatagcagcttaatctctttcatttgctgtctcctaacaatgctaacttgttgccacctcttttgttgctcttgaaatattttaattagtttttcttcctctcctcagtcttctacatgtctatgttgtattcttgaagcaaagtcagcaactgtataggatatctataattccatttctgcattctgtgttctcaaaataacattcagttatgttctcggtgttgatgcaagcttttgtatatacttttgaggcctttatctttttgcagcaagaccctgtttaatggcagctgcaattacttgtagcttctctacatcaacccccttgtcttcctcatctgtttctgcaaaaggttttctttccctgtgctcatcagtttctggatccttttctccctgttccatttcctgggtggccatgacctgagcctccaactggaccttggcagccctcctgttgctcctcctgccttgggtgcaatcgctagttgtcctgggatgccagaggcgactcctcaaccctgagggacccttgatggtgctccctcacaggacctgtataatgcctcactatgaggctcctctgagggcctggggtcctcctcctctcagtttttacttgtgtgggaaagactttatttgtccttcaattttgaaggatagctttacttagtttaatattcttggctggcagttttttttatttcagcactgtaatatatattatcccattctctcctgacctgtaagtttttttttttttttttaaacaggaaattctcttataagtgacttgatgctttccttttgctgtttttagaattctctctgtgtttgacttttgacaatttgattgtaatgtgccttgcagaagacctttttggtttgaatcttttttgggattactgaacatcctgtatctggatgtctgtatctcttgcaagacttaagaaatgtttgactgttattttgctaaataggttttctgtgcctcttcccttctctttcctgaaacaccgagaatttatttggtctgactgggttatttcaaaagacctgtcttcaagttcagaaaatcttagttttgctttatctagcgtacttttgaagctctcagttgcatttttaaattttattcattgaatttttcagttccaggatttgtttggttatttttctatatctatctctactgactgtcttattcagatcatgaattgttttcctactttgtattatctgtgttctcttgcaacttgctgagtttccctaagatcattattttgaattccttttctggcatttttatagatttccttttcttttgaatctgttactggagaattattgtgtctctttggaggtatcaaatttccttgctttttcatgtttcttgtgtccttacattgatatctattcagctagtggaagagttgcttcttccaattttatggattggctttcataaggaaagacttttttgtaggcatatctgtagttttggttgtgattaggatgttttggctttgattctggtgagcacaggagtgtaggctcaatgatttcttcagctgtaaccaatgtaactggtgtcatgtaaccatgtcactgtgagtcctcagtggcttaagttgccattgttagctgaggctgttgtgaggcttttctggggaaagggatgccagaggggccagtccctgggccttttggtggcatgggcaggctttagctgtggtggcgatgggctgggcatgctagtcctcaggaccccagctggtgtaagtgctggtagtggggggcccaggtgggctggtcctcaagcccccaggcagcatttatggtgctggcagtggcagtagcagcagtgggctagacactggactgtcaggtggcaatcatagctgttggcagtagctgtggcaggatgaatgggacagtttctagccccctaggtgatgcacttgggtgggcactggtggtaggtggggcaggcctgttcaggccttgggattgtgtgcgtgggcaccagtggtgttggatggggtgggccagtcgtcaggcccccctacagagcatataggcaccagtagtggcatgagggaaagatagcgctggagaacactggtgacagtgggtggagcaggcctgtctttaggttcttggatggcacatatggacatactggtcctcaggccccctgaaggtgcacacaggcatgctgttgccctgctgagaggggcaaggttctgttggtggcattggtgttgggaagatggctcccaggttctgggagcttcagctccctttttcctggggtagcctccctggtgtgctatactgcctgttccctgggatataagacacttcatgggtcagagtactggggacctggctgcactgctgggtgattgtgatactgcaaccttctggatggatgtgggaggatgttcttgggggtccagggatgtggactgcaggggcttattggaccccaagtgggcaggatataatctggtgggggctagcctcttaaaatggtgctgtgccacagcagcatgtttcttgggatgtgagtaggatccagtggaattccctttctggaagaacgcatttgcatggattccaggcagctccgtatactggactcagggcctgtgaaggctgacggcatcccctgtgggtgccagcatctgtgctgcgaatgtggaccactgcagttctttgacttttcttttcccagaaatgggattcccctcctgcttctgagccagtccaagacatgctggctgctttatttactgctccctttgtgcctcagaagttccctgttgaatagtgttctgtctttggtgctctacctgacatgtggttaactacttgcttttttggtcctttgttgtgcaggagttgagtgccaggctcacggttttttgattaccatagttttgtagtttttgaaattcagaagtgtgagacctccaactttttctttttcaagattattttggctgttgagtcaattatgattccatatgcattttagatggatttttctatttctggaattgtgccattaggagtctgatagatactgcattgaatctgtagagtgctttgggtagtattgacatcttcccactattaagtcttccagtacatgaacacatgcattttcctgatgactaatgatgttgtaccttttcatatgcttattggctatttgtagatcttcctgggagaaatgtctatgcagactttttgccaattttttaatttgtccatttaaaaatcagggttttttttgttgttgagttgtaggagttctttttgtattccttatactagtcccttatcagatatatgctttgcagatattttctcccaggtgggttgtcttcacttccttggtagtgtcttttaatacacaaagttttaaatttttatgaagtcaaatgtatctacatttttctttggttgctcatgcttttggtgttgcatctaagaatccactgccaaatccaaggtcatgaagatttactcctatgttttcttctaagaattttatagtttttgctattacataaggtctttgagccattaagatctttgacttaacttttgtatatgatgtaaagtcactgtcaaacatcattcttttgcatttggctgtccaggtatcccagcattatttgttgaaatgcctacacttctttatattcccttgactcctctaaccaaggcagttggacctttgctactaccactgccctgaaactgctgtcactgggttactgaggactgggtagcttagttgagtagataatcttttgttgtttcctccttgtaatatacaagccttggcttctgtgacatcatactctcctagatttccccctgtcactgtggcttcttctcagtctctgtccatccctggtgctcctgaaggttctgttctcagccttacacacattacctgggtgatctcattctctgccatgacttcacttgccatatatgtgctgattttccccaaattcctatttctcccgacctttacatctattttatttgcaggtcatatatctaataaggaattgatatccagtgtacatgtagaactcctgtaattcaatacagaaaccaaacagtccaattaataaatggagaagagatttgaatgaacatttttctaaagaacatctcaagctcaagatttcccagataacttttctttcttcaaaatctgcttctgtgtttcctcatctgtaggtggcacagcatacatctgatttcccaagccagaaacctcatagttattcttgactccaggaagaaatattattgagtttttaaaaactcagcttattgactcattgttttatataataaaatgcaacagttttaagtgtatatttcaatgagttttaatacatttatgtacttgtgtcactatcctcatagatagagacaaaacatttctatcacaccggcaatttcctatgtgtcccatcccaatcaatcctttcccctttgctggctccaaacaatgactctttcctatctttttagaaagattagaattgcttttctagagttccagtaatggaatcatacagtgtctaagtctgtttgtggtgctgtaacaaaatacctgagactgggtaatttataaattataggaatttatttctcacagttctggatgctgaaaagtttatgatcaaggcactagcaggtttggtgtctgagggcccagtttctaatttgaagatggtgctttaaacactgtcctcacatggtagaaggggcagatgggcaaaaaaaaaaaaaaaaaaaaaagggcaaatgctgtgtgtagcccctctcataaagggcttaagctcattcaccagggaagagctctcatgacctaatcacctccaaagaccccacctcttaatactattgcattgcagattaagtttcaacatgaattttggagggatacaaatattcacaccatagaatatagtaatatagtatagtatatattttttgtgtctgtctgcttttgctcagtgtaatgtttttgaggttcatctatgttgttgcatgtattagtaggttgtatctattggtgcatagttattccattgtatgtatgtaccacactcttcatttacctgctgatggatattgcattgtttccagttttgggttattatgaataaaactgctgttaaccttaaaatataagtctttgtgtagacatatgttttcatttgtcttgagcaaatacctgattggtcagatggtcatatgtcagtatatgtttaatatcatgtacttccaactgtttaccaaagtagttgtgccattttattttcccactagcgatgtatgagttccatttgatccacatctttgccaacacttgttatttattttagcccattaaattttagctgttttagtgggtgtgattagtgtctcaatgtagggtttttttgtttttgttgtttttttttggattgcctttctctattgcccaggcttgagtgcagtggcacaatcatagctcactgcagcctcaatttcctagactcaagtgatccttccacctcagcctcccaagtagcagttagaatcaaggtttctttccatgtggatatccaattgttccagcattatttattgacaagattatcctttccttcattaaattcctttggcagcttggtgaaaaaccaatgggtgggtttatttctaggctctctatcctgtccctttttgttttttttgtttttgttttgagacggagtcttgctgtgttgcccagctggagtgtagtggcgtgatctcggctcactgcaacccccgcctcccgggttcaagtgattctcctgcttcagcctcctgagtagctgggattacaggcatgcgccaccacgcccagctaatttttgtatttttagtagagatggggttttaccgtgttggtccggctggtcttgaactcctgacgtcgtgatctgcctgccttggcctcccaaagtgctgggattagaggcatgagccaccacgcctggcacctatccttttttagtaaatcttaacatcaggtagttgtaagacctgcaaattcgttatttttcacaattgttttggccattttaggtcctttgcatttccacatacatttttagaatcaacttgtcaattttaacaacaacaacaacaacaacaaaactcctggaactttgactgggattgtattgaacttatagatcaatctggggagaactggcatcttaacagtaatgattcttccaatctatgaacacagtatatctctccaactttttaggtcttaattttgttaaattgtttgtagttttcagtgttctggtcttgtacctgttttgttaaatttaaaaaattcccactttgggaggctgaggcaggcagatcacgaggtcaggagttcgagactaggctggccaaaatagtgaaaccccatctctactaaaaatacaaaaaaattagctgggcatagtggcacacgtctgtagtcccaggtacttgggagtctgaggcaggagaatcgtttgaacccaggaggcggaggttgtggtgaatcgagattgtcccattgcactccaacctgggcgacaagagcaaaactctgtctcaaaaaaaaaaaaaaattccatcataaaagaaaaaaaattcaattgtaaattccagttttttcagtgtcaacatccagttgtttatgtccagaaaataaaaatacaattgatttttgtatactgactttgaattctgtgaccttgccaaactcatgagttctagtagctttttgatgggtagattccttaagatattccacatgtacaatcaggccatctttgaatggagccagtttgtttgcttttatatttctttgccttattgtgtatccttgctttgttcttgatccacagggggaagcatttggtctttgcaagtgtcaggttaggttttttggagatgcctttatcatactaaggaagttccctctttttctagttgctgagagttgaataggtgttgaatctgttgatcacatggggccatatgacttgctctggccagagaaacatgaaggaagtcatagacatctcttctagataggcgcttgaagagccagtgtaggatttgctacattgtcctcccaccgccgcttctgctgtgatgaagcgttgggcatcagtgtgaacaagaaagggattgttgttggggtaagccatgaggttttggagctgtttgttaatgtattacagtctaatgagaaggttcttgccctcaggacaaactccttgccttcatggagcttacattctagtgcaagtggggcagacaaatacacgtaatgtcaggtggagattagtgtaatgaagaaaagcaggatccgaggctccagcaccttttagctttagataacggtttttgtggaaggcctccttaaatgaggcagcagttggcctgagagctgaatgaagtgagggaggagccatgaggtgtctgggtaaggaagggtcttccaggtacaggaacagctatgcacagccctaagacaggaactccagactctcctggacatggagggtgtgacaaagctgtcctccaagtgaaaagagaagggcacattcagccagtgacttctgtggtttaagccagggctgggctagagagggccgctgctgtgtgttaggcagaagatgactagttggccatggcctggccagaccgctccgatgccagcgtccttcagctcctgggatttcgagcgatggggcagggggcaaagaggaaagagggagtacctgaatgtcctgacattctggcataggggctttctttgagaaaaatcatttgactgaacttgagtttgtgagatagctcatgaccattactttcctgagttattctccaccttcaaactcaccaacagcttctactgtacttaggaagaagcctgcactcaactctgctatctagttcacctcctctctcccctctccccttagagaaccctgctccagttgccccaggtttctttcagttccttcacaaagtgacactttctctgcgctgttggaaaggctgttccttctcctgagaacactcttcctgctttctcctggctaacatctctcagggctcaacttaaatgacagtcctcctggaagccttcccagacaagcctgggtgcttctgtcaaatgccaccttagcattttgtccttctcctaatagcactaatcacattgtcttgtagctttaaaaaattatcaaataattcagacacccaaagaagtataaaaaataatacaaaatgcaccgtatcacccaacttaagcaatgaaacactgccagtgaagtccttaaggttctcctcccttcctgctctcaacccttaccggaatttaatgtttatctttctgagacagccaggtgggaaggggtccccagagaaactccaactggcctgcacactggtgtgctttgcatgtctgtgtggtttgtaggtaacttcactgcaggcctccatcttgttttacaatctgggggcatggcctgtaactccctggtaaggctttgtttagcaatcctgccttagggagtgagtccctttctagttcgatagctgcatgttttcctagccctgtctcttaaaggatcccacccagtgactgaggtttcttctgcctgcctgtgtaactatatatatatgttgtgtatgatgtctgtaaaaagagctctaattaatctggcctaaagaaagacaagcgcttagatcaaattttttttaaagagaagataaaagctgtggtacctttcagtttatgtgactttaatctttgagaaataaaaacagctttaaagattattggtaaaaagcagatgccatcaaaatgtaaataggcggactaaattatgcaggccagatgcaaggtttgctaagtgttttaaggttataaactgctttttgggttttgagaactatttgtcttgatggcttcacaattattaagacctgggaacatatggaactaaccacacccttaattatgctaggagtcaaaccttggctgcatctggcacacaaaacagcttaccaagttttacattaaaattaaaaattgctaggagttactgttttaacatgtaattgagactactggaaatagatttatatgcgaggtgtgtaagaacagtaaatttttttttttttttgaaacggagtcttgctctgtcgcccaggctggagtgcagtggagtgatcagggctcactgaatcctccgcctcctgggttcaagctattctcctgcctcagcctcccaagtagctgggattacaggcatgcgccaccatgcctggttaatttttgtatttttagtagagatgaggtttcaccatgttgcccaggctggtccctaactcctgacctcatgatccacccgcttcagcctcccaaagtgcttgggattacaggtgtgagccaccacgcccagccaaatgtgtttttttgtaaaaggttataagaaggcatggaaatgtaaatttttgcctagggttaaaggattgttttaaattaggatgaagttgcaggttcaaacaagtggtggaagcattgtggaaattaatcttgcaaaggggttttctatgtgaacatattgactaaatttcaaagggtattatatgatttttctgtaaattgagcattgaaataaaagcacaacaaggtattcttaaggcactgatctgctcttcagcaaaatttgtaaggggttataaaagatttttgcttctttaaaatttctgagtcatcattttggcaaaataaataacttatggtaatctggaattctgtttcataacatcaagtgctttaaacctcgaacatatttaacagccttcccaaatcaaacttcagtttcaaaattgtctttcctgatgtttggctttttggaccgtttggagtgcccctgaaatatccaagaaataggtaaacaggatcatttgacatgtttaggtacatgggattgccaaaatgatgttcagttttctttaggttatatttttgtgaataatgctaatgtatgttccaaaattatatgggatttctaaaactctaatgtctaagtatatgctatcaaccataattaaggttgttaagttattgtaaaccacagagatagccaaacttctttgtcaattgtgtttctaactgcaactaacctggacatttggctagtcacagacaattgttgtcttgttttaatcattttcaaaagatggtttataataagcaataggactctggcaggtactctcaaatacaggtttctgataactttggagattgtcacattggaataaaggcaaatgtacaggattcataaagagctgaagtgttcacgaatatcaagcaaaacaagaactaaatggactgaactcaaagctgaagcaaactttttgacttttgctgggaatattgttgatccttgttttgtttttcagagtcagggaaacttattttaaactatttatggtctttaataattgactgaggtatactcctgtggacaagatttggagcatgcttgtttctctttgcctggttcctttttttttgtggacagactgttactctttcgcccaggctggactacagtggagggatcttggcccactgcaacctccgcttccctggctcaagcgattctcctgccacagcctcctgagtagctgggactacaggcgcgggccaccatgcccaggtagtttttgtatttttagtagagatggggtttcactatgttgtccagcctggtctcgaactcctgacctcaagtgatctgcctgccttggccttccaaagtattgggattagctgtgagccactgcgcccggcctggttcctctagaatctggaaactatctgtgagtatttttaacttgtggcaatatagttgtctggatcggtgtgataggaatccatttatcttttgttaacaagacgcaattggaaaaactggttattttcccgaggctttcactggaaggctatgcttctgtttaaagaatcaatctcgacttgcagggccaataaaagcccagtggggaagttggcctcatactcttgtctacacagtccctgtacagggttcctgacctgtggtcagtaaagaatgtcacttgctaacaggtccaggagctccaagtttatcctgggaccttaagaggagaggatcacccaacccaaggtgtatcatgggaacttaagaggagaggattagcccagttcatggctgggcttggctttatcttatctgagattccttgtggaacagagttccatcaaagccagtccaaaaggcctttgtagaaataattattcttgctgcactttatgtaaataatcaggccaagtataagactgaagtctattttgcaaacaactgagtcctatcataatttcttttcttttctttcttttcttttttttttttttaacaaaaacgaggcctggagaaaaattatgttccaaaacttaccataatttgtcattcaattctaaactcagttgtttttaaatttttgcctgcatttttagactgaccctgcttgtgaaccaaccagcaatctccagctgcagctcagaaagaacaagagggatgggtaatgtaaaaaaatctggattagtattctagttatgagcaattatcctgcaaattctgctaggcaatgggaataaatagggtgcccatcatccagaggtttccttttgggaaagtaagaccaagggagctaaccaaagccaagcaccatgcacccaaatcctaccaaacataactgtagccaccagttatctgggtgtgtcacaagacatccttttctctcccttgttggaggactcagttccacagtttttccttagcatttggcttacgagaaggagtccatgcaacccctcaacccctgagcataagtgaggtctagggaactccaagactactgacagcaggggtgatagggcattcatgggtagaggagataattcccaccctctagacccctgcttcatggatgcaagccattttggcacccatggtagcactttcgaaggttgcatggggatgcaaggatggaagaggacgctattccttctatccctcacgtaccccaggtatttgctaggaaaagaaccagggatgcctgctcccctctttctatgtgggtagccatttatcttcagtctgcaccactttcaaatgcatctggaacccttcggattcctttgaaaaaatgccttcttttttcctttctcctcctcggttcacaatgacaatcctaattgtgtctccatactatgggacactcccctcagatgcattttccaaactggaaagagttaatttcctaaaccttaaactggctggcttaggattggtttcaggggaagggaacccagaagcccaacatgccagcaaaagggtaaagttgtttaccattcggacttttggcccccttctccgtgtacaaattggtaaaaagcctcaggatttttgagctgtccttatccctccccttgtttcttttcttttctttttttttttgagacagggtctcactctgtcgcccaggctggagtgcagtgatgtggtcttggctcactgcaacctccgttcaaacgattctcctgcctcaacctcctaagtagctgggagtacaggcaggcaccaccactgctggctaatttttgtatttttagtagagacagggtttcaccatgttggccaggctggtcttgaactcctgacctgccaggctggagtgcagtggcataatcttggctcactgcaaactctgcctcccggattcaagtgattctcctgcctcagcctcccaagtagctgggactacaggtacttgccatgacgcccggctaattttttgtatttttagtagtgacagggtttcaccatgttggccaggatggtctcgatttcttgacctcgtgatccacctgccttggcctcccaaagtgctgggattacaggcgtgagccactgtgcccggccatatgtgtttaataacccagtttgtctcttcttgccttcaggacatcaaacggtcatgctactggaagctcggaccatggccccttctgctgggcacccttagataggcctctgagggagatctgattgccattttcccgaaacagtgccccctatcagcaggaagcagttaagatctgtctttgtccctattcttatcctagtggcagttagatagacttctttagagcgaggaatgagccagatgggaagggttccctggtaaaactccaactggcctgtgcactgctctggggtggagccacagaagttcgctcctcagtttgcagctgggaggagcctggccctcctcttcctcgggagaacctgggatttaatctgtgaggtgggaagcctacaactaggagaactctggctctgctgagtccctgttcccctttttcttcctttacacccaataaaaccctgccttacccttcaaattgtctgcgagcctaatctttcctggcgtgtgacaaggacctccaccgtctttagctgaactaaggaaaagtcccgcaacattttcatgtgtgcctttgtatttttattacatatatggatgtccctaaacaacatacattattgttttgctttatatattaaaaaggcattctgcaatttgcattttccccagccttgtgttttgagatttatccatgtggatgcgggaagctgtagagcacttcccctgctgtggggcagtttgttttctcgctggcggacattcagcttgttgacaaggttttgcaattacaagcacctctgctataggtattactgtacctgtcccttatacctgcgatagtgtctcccggcatacagccaagaatgggtgtgcacactcctcgacctgctcccttccacttcgtcagcctggccgggggctctttcaagaggtggggccgcttggtggcttctaagtcgtgcctctccctctgggtaataaacgccttgggggcagggactttgcagtcttgcttattgaggcgttttccaaaacagggaccgagggctctaacacccgtgcggagggtggccggcgggggcgggagtttggcagaatgcggctggagaaggtggggcgagggaagaaggctcctggcctgcaggggcctctcttccggctgtttttcctcccgaagacaaacactcccaacgcaggggcgcagagcctcggcttctttcctggccagctccctcaaggcagggcctagcatggcccggcccagcccctaggttcccccgcccgcggctcccgggcgcctccgcctcccgcggtgactcaggcggcggtgacggcagcggagggggcgatgacgggcgcgcgggcgtccgcggcggagcagcgcagggcggggcgcagcgggcaggcaagggcggccgagcgggcggcgggcatgagcggggcgggcagggcgctggccgcgctgctgctggccgcgtccgtgctgagcgccgcgctgctggcccccggcggctcttcggggcgcgatgcccaggccgcgccgccacgaggtgagtgcacacctcctaccgccgcccggccggctacgagcgcagcgtctcctctccgcggcgccgcccctatctccgtgcgcggcgccgagcgctaggccgggccggaaccgcccccgtggcctgggctgttgctgcgacttcgcggtcccgcgccccagaccggaggccggacttcggggtgctgcggccgggccccgcggaggcgggggagggggcggttcggaccgcggcggagtggaacctgggcgcccaggcggcgcccaccccagcggagcctgcgtcctggcgccttccgtctaaacagaggccgcggatcgggacgccgggaccccacaaactggcagccaggaggcgggccagccgaggatcgggggggctcggactccccctgcacccagtccactgttcggagggacttagagcagggtcccttccctgagggcctcgcccccgaggacgtggcgccggagccgtgcgacccattggcttcagcgggtgggaagcctggggccgggacgcgcgttcgccccgcgctggggttgaacctgcgtggatgtgcggcgggtgaggaaccgcggagaaggcggtgggggcgcggcctgcagcccggtcccgggcgagccctccgcgcgtctcccctcggcgcgttttccctccagggtgactgggaagccgccgccgccgccgccgccgcctgggaggggccgggctgggcgcttttgccccgggccccggaccccgggcgtttgtccggtgcgctggcttaagaggcgctcagctcataccgtgattgcacaactggcttgctctccgaactcggtggggaaaacggtgacaaatacagattccaggtctccatctagacccctgcaccggggagccccaggccctaggtccttcgcacacgcccctcccagaggggtcgggcaagcatcgcaaacccctttgggtaggagggacggtgggagtcacctgtctttcccctctcgcgcccttttcttggtcagaatacgaagttttagtgtctgtgtatggagttcaaacgacccctcctctccaagcagaagctggaggagaaaggcgttgtgaattttggaaaagcggctcagaggattacattttgtgcgatccttgatccacccaaccttcatctcctgcgctcccctcctttaaaattgcaaggaccccggggaggttatgtaatctgcctgatcacaatttgtcagggactgatcccgccgaacactctttgcattttagcgccagtattagcttatcaaagggcacttacttttagagagaggtggtttgtaaatagtaatcacacgtagtgaggggaagccgcgttgggaccgcaaggctttccctgtcacctggagcccatgtttgggccgcacagctttcctactaaaaacgtcatcatcttccttctttttgaaaattcagcatttgcttgaagaaaaaaaaaagtagactatgtctttaaaaatatgcccagcaaagataactcacgagcagagagctagaccagaaattaaatatttggaaaggaaataaaggtgtaatacacaagcagcacatttatccccgcaccattggaaggtgactttatttggtaatttgcccaccaagacgaggtagaccagaggagagagaaggaaataattgttcttttgtctgtaacgctctgggggtattgccctggaatttcttaggtcagctgctgtgtgggaaggtgacagctttttcttgaagctgaacatcaagctcagtttcgaggtcatatttgatgacttatttgatggcttagtaattgggtcctttggtcgtgtctgtaagtgatacagactgttattattatttttaaaaaccacattcaaataatgcaaagtgaaaaaaaaaggtgtcaaaatccgctggcgttactctgacagtctctagctgtggttccctagctgtggtcttcaccctcggctgcacactcgaatccctttgggaggttcgttgttttttgtgggaaattaaaaaaatcatgctgattgggcagagattctgatttaattggtctggaatggggccagggcattggtaacttttgtagtttttttagagcttcctcaggtaattttgacattcaatgaagactgagcccctctgcacattcccaaatagcatagttagtaacaatgacaatgaagagctttcagcctaaaattcgtgtggataatctaagtataaaacaagtaccttattccgcccaccaccaaaggcttagagaaacatgagtacacacagtacttattccatctacgaagggatgatgatgtgtggagaaattacgaaggaaaagctcatggcttcatggtctcttgggtatgatcaagtgtaggaaaaagtctacagagagtgactagaaatgtgaaaatggaagccattaaaactgaagaagggaaatgaaaaagaactattttaaaacgatgacaaattgacaaaggatttaatatttttgtctttaatgtagagaagttatgcaaatacctcagaaggtgtcagggattaaataaaggtggttaaataaataaatgattcaggaattaatatgaaagtcacatactgatggtaaacatttggaaaacatgttcaaacttgttaatcacaaattcaaaactaaaataattaggacgtgccattttctatccaccaggctaacatatgagggaaacatggaaaggctaatctggctgggcttatagggagggatctgttgaggctcaggagactggttagccgttatgtgcacagttagactgacctcagcttaaatcctggctgctagtaggtgactttgggcaagctgcttgacctcttcaggcctcagatgcctcatcccaaaatggagacaccaggagctatttctttctttcttttttttttttttgagacagagtctcgctctgtcgcccaggctggagtgcagtggtgcgaactcagctcactgcaagctccgcctcctgggttcacaccattctcctgactcagcctcccgagtagctgggactataggcacccaccatcacgcctggctaattttttttttttttgtattttttagtagagatggggtttcaccgtgttagccaggatggtctcaatcccctgacctcatgatccaccctccttagcctcccaaactgctgggattacaggtgtgagccaccgtgcctggcccaccaggagctatttcatagggctcttggggcctggtggttctttggtaagtgtggttctttgtattacctgggagatctcaaccatcacagttgtcattagaaatcagcacaactgaattggagagaaattttgtaatgcatatcagaagctattcaaaagcctgtttttggttaaagattttactcttgggcccggtgtggtggctcacgcctgtagtcctagcacttttgggaggtcgaggtgggcagatcacttgaccccaggaagttgagaccagcctaggtaacatggtgaaaccctgtgtctacaaaaaaagacaaaaaaaaattagctggatgtgctggcatgcccctgtagtcccagctacttgggaggctgaggtgggaggattgcttgaactcaggaggttgaggctgcagtgggccgagatcttgccactgcactccagcctgggagacagagcgagactctgtctcaaaaaaaaaaaaaaaaaaattttaactggatgttcccgatcctgaagaggctctgttggtctctgcattggttggatgtggcctggatcactgtaatgtctatgtgttgagcacttgtttctgtgccagccactttgtagatggtcaagtttagatttcccaacggtttcatgaggcacatactcttatgacccttaatttattggtgaggaaactgaggcaagttgggcttcagattcaagtttaacttgaatttatcccactatgtcatactccaggtcccaaacatcgcttccactgaaagctttccaggagaccaaagaacagaaaaaatgattgtgaaagctttctttggcctagagaaccaaaagctatagtggattattattattattattattttgctgaaagctttatttgttctcacttagggtaaatgaaaaatttcaagatttggctacaacttcattctttgaaaagtaatgttttacagaaagagaggttaggggtactggctctgaagacaaagcttagattcaagcccagcttcaccacttacaccagtcccctgattttgccgtttccttgtgatataaggcactcaggaacacaagccaggcacacagtaagtgttcaggaagtgctggcattatgaagttcaaacagcaccactggtaaatgaagttcagatttcagaggtggagactgtgtatgcagcctcacagctaagtggatgccatggtgaaatgtttagatcataggcctttgagaagaattatcagaatgttagaggaatgggcctcccttggcacccagaaataaacgttaaaggaggctatttcatcatataacaacttccgaacttctagaaaagtgaaaagagaggcttgggtaaggaagatgaaagccctcccaccaccctgcgtgctgacctagggcatccttccttctactctgttgttagatcctcatgatggccaaaaaaaagcattctttaacctaaagcatccccatggctcaatctctaccccttcatcaccaaggaaaagccagctctagtggattaagagttttatactgcagggcttgtcttcactgagagctaaataagggtaaagtaagataaacttaaaaatgagggattgaggcccggcacagtggctcatgcctataatcccagcactttgggaggccgaggcaggcagatcacgaggtcaagagatcgagaccatcctggccaatgtggtgaaaccccgtcactactaaaaatacaaaaattagctgggtttggtggtgcgtgcctgtagtcccagctactcaggaggctgaggcaggagaatggcttgaacccgagtggtagaggttgcagtgagccgagatcgcgccactgcactccagcctgggtgacagagcaagactccatttaaaaaaaaaagaaagaaagagggattgagctggctacgtgaagaattcatgattctgccattcaaatgagtgactagggagcccagaggaagctttcccattacaaaatagagaccgagttcttaccttcctcattgtgttattaagtagttccccatttttttcttttgggtaaatttactcagaggataaattaacttctcttttatataatatcatataaatggcccagttggttgacatgaaccactctgctttgacttttagacaagagcagttcactttatttttcctaccaaattggcacacgtgattttagaatgtgcgtcatctttctgtcatcctcagcacatcatctagtgaactggtgagctgtgtgagtttctggattggggcatgctcccaatccaggattcactgctcccaatccaggagcagtgagtttctctgcccttcagactgaggcttgtcttaaaactgtctgcttacccctctccgatctgccatggaaattaggatattccaaactccaaaacaaagtgatagaaagcagcacttctcaaactttcaagacacgtgcaccccgcccctgggcctcgctaacctgtctgactcaagcaggttctgcatttctaacaagctgcctggctacaatcgcagctcagtaacgtggtaggggagaaagcttgaactttagagtaatacaaattgggttcatatcaattatttcattgaaaaaccgtggtcacaggcagttatctaattcttgagaggcttaatttattcatctgtaaagtggggaaaatacctagctcataagattgtcattattatagggaaactactaaattcagtacatgtcacatcttagcactcgatgaatataagttccttacacgatcctttgatgcactagatttgagtggtgttgactgaatcctcttgtagtagagacatctgtgcaaaaggagacctgtgtgtgtgcacatgcatgcatgtgtgtgtgtgcacatgcatgcatgcacgcacatatatctgcgcatacacaaagtaatgtgtgagagaccccagaaatcccagagtgtaagcttttgagaagcactactggaagcaactgttcacacgaatgtactttgtctctaacacatctttcgggtgccttttttttttttttttaacttttcctaatttctaccagacttagacaaaaaaagacatgcagagctgaagatggatcaggctttgctactcatccataatgaacttctctggaccaacttgaccgtctactggaaatctgaatgctgttatcacgtatgtatcagttcacactcagttctgtttgctttggggcttgtttgatatgatccttaatgctctcatgtctaaagcccttcacaagttaatttcagttttgcagctaaagaaacaaagaagctatataaagagtcggaagaaatacagtcaggggaggatgcctaggaatgcacagcatctatttttatcttttcatctactcatcctttaaaaagccagttctcagggatgaacaaccttgatagactatgttttattttcctcctctctagtgcataaccctcttgctggaccagagaaggaaggagtgagacaccagggtattctccaggggccagcagagtggtgcaagttgagggagtggcagttattccagggccctgcctccctgatgataacaaatgcattttctctgaaggttttactcctattctagaccttgttgctttttaaggacaaggctattctttcatgtaaaataaaatattctactatgcaaccataaaaaaagaatgaaatcatgtcctttgcagcaacatggatgcagttggaggccaatatcctaagtaaattaacacaggaatagaaagccaaatactgcatgttctcacttctaagtggagctaagcattgggtacttatgaacataaaggtgggaacaggagacactagggactatttgggctgcagtacccaagcagtactgaaaaacttgggtactagagctgagtagtacctatagggctgaaaaattacctactaggtactgtgctcaccacctgggagacaggatcattcatgccccaaacttcagcatcatacagtatacccatgtaacaaacctgcacatgtgcccctgaatctaaaataaaaattgaaatgataaaatgtttttgccaggcacagtggctcacgcctgtaatctcagcactttgggagaccgaggtagggggatcacctgaggtcaggagttcgagaccagcctgaccaacatggagaaaccctgtctctactaaaaatacaaaattaccgggcatggtggcacatgacttgtaatcccagctacttgggaggctgaggcaggagaatcgcttgaacccaggaggtggaggttgcagtgagccgagatcgcgccattgctctccagcctgggcaacaaaagcgaaactctgtctcaaaaaaataaaaagaaaaaatttttattgccaaattgagagcttcgttatacctaccatcagaggttgaattttaatttatatttatatttaatttatattaaatttatattaaattcatatatatagtaatgctatatcaaggtgttatgctgtcgtcaaggtgttaggtgtagggcaagtaagaccattattagaataaaacaagtaggatcattggcatacaacagtgatgctgtggacaaattaaagaattaaaaaagaggccaggcatggtggctcacacctgtaatcccagcactttgggaggccaaggagggtggatcacctgaggtctggagttagagatcagcctggccaacatggtgaaaccccatctctattaaaaaatacaaaaaattacccgggcatggtagcaggtgcctgtaatcacagctacttgggaggctgaggctggagaatcgcttgaacctgggtggaggcggaggttgcagtgagccgagatcgcaccattgcactctaacctgggcaacaagagcgaaactccgtctcaagaaaaaaaaaaaaaaagaaagaattaaaaaacaggaagacaggccgtgcacggtggctcactcttataatcctagcactttgggtggcctagtgggcagatcatgaggtcaggagtttgagaccagcctggccagcatggtgaaaccccgactctactaaaaatacaaaaattagctacgcacagtggtgtgtgcctgtaatcccagctacttgggaggctgaggcaggagaatcgtttaaccccgggaggcagaggtggcagtgagctgagatcgagccactgcactccagcctgggcatcagagcgagactctgtctcaaaaaataaataaataaataaataaataaataaaggaattaactacacgagactgttttaagaaaaaaattgccgatttatttaaaagagcatggagataattatgtcaggaaaatgtataaagaagtgacacagggtttgtatttaatcatagtggtagaaaatatcccattattgcaaaaaagattttaccctggaaactggaaagacacttatgactcttttaactagagactgataaaattatgtctagacataaacttttaaattttgaaatttaatgataatttttaaaattttaggccgggcgcggtggctcacgcctataatcccagcactttgggaggccgaggcgggcggatcacgaagtcaggagatcgagaccatcctggctagcaccgtgaaaccccgtctctactgaaaaaatacgaaaagttagccaggcatggtggcgggcgcctgtagtcccagctactcaggaggctgaggcaggagaatggcgtgaacccgggaggcggagcttgcagtgagccgagatcgggccactgtactccagcctgggcaacagagcaagactctgtctcaaaaaaaaaaaaaatttttttttaaattttaagcagatgtagattataggagacacaagtatgcaaaaaatgcaaattataataacttcatacatttagtaaaccagataataaaaatctggggctgatggaaggatatctttaagatatttaaggtgaaggtatgcccaagagatcagttactagctgagttgaagaatttcctgttctgtttccctctttatctcacttccttaaagtagaaagaccttttattttatttatttatttattttaagacggagtcttgctctgtcgcccaggctggagtgcagtggcacgatctcacctcaccacaacctccacctcctgggttcaagcgattctcctgcctcagcctcccgagtagttgggactacaggcgcccgccaccgcacccagtaattttgtatttttagtagagacagggtttcaccattttggccacgctggtcctgaactcctgaccttgtgatccgcccgcctcagcctcccagagtgctgggattaccgacgtgagccaccgcgcctggccaacatttagttttttataagtaagatgttctcagtatggtaaacagttaatgtttctgtatctttaaaatattgctaaaaaaagaagactgagccctgcgaggtagttcacacctgtaatcccagcactttgggaggccaaggtgagaggatcacttgaggtaggagtttgagaccagctggggcaacaaagtaagtcctcatctctttcaaaacaaaacaaaacaaaaacaagactatacaatgtggaaaatacataaaaaagaaaagatattgtgagtatttaaaattgcttttggaggccaggcgcggtggctcacacctgtaatcccagcactctgggaggccaaggtgggcggatcacaaggtcaggagatcgagaccatcctggccaacacggtgaaaccctgtctctactaaaaaatacaaaaaattagccaggcatggtggtgggctcctgtagtcccagctactcgggaggctgaggcaggagaatggcgtgaacccgggaggcggagcttgcaaagagccaagattgcgccactgcactccagcctgggtgacagagcgagactccgtttcaaaataaataaataaataaataaataaataaataaaataaaattgcttttggaaagagaagagctatatatatatacattagtaaataaagtattaaaaactaaaatattgcactcataaagaatacaatgaaaacttgtactttttgatgaagtagatattagaataaaaggggctagttaagcatttgcataaatagtaaatactaatgctaaaatatgaacaccctaaataaaaaggcaccaaatttatgtgggtccccaaagtacatcgaaaataatggtagcagctaataatacaaaacaaagtcgtagtagagacaaatgataagatactcttaccagggcaaacattttgaaggtttcatcatagagctggtgaactgagctgaataatgtcagggagtgaggtggttaagagcttggattctgcagtccaagtgtctggtttgaatcccacctctgtcacttgtgttactttgggtatggttctcaccttctctctgcttctcttcccctgtgaagctggaaaaataacggaacctgccgctgagctccttgggagtgtttcgtgactgagtgtctgtaagctgaagcagagcgagacctctccacgtgtcagtgttactggcaatagaaataagtaacacgtgtggcagaaattaaatgaaaaaagtagataattaaaaaattcctgtatatattcgtttcacaaaacactcatcatatgttaagtcaaaagagactggataaattaaaaaaagcagggattatgtattctacctcatacttctgcacaacaaagaaacaaactaatataataagggttataatataaatacgagcatttcgttgaaaatctttagatcaggccaaagcaattcctatgaaaaaaatgcatgtaaatgttcataataataaagacgatggtaatagaaattgcagctactgtttcctgaggacttgttcagtgttttaggtctgtctcatttaacttacaacactccagtagagagattctatccaggagagaggatttgctggagatactgaaattaagagaaataaagtgacatttttctgggttacctagctgttaggtggcaaagctacaattcacccctccctgtagctttggaggttggtatttatgttaatcagaaagaaaaggggaggctggatgcagtggttcatacgtctaatcccagcactttgggaggcccaggtgggcagatcacttgaaggttgggagttttgagaccagcctgaccaacatggtgaaaccccatctctactaaaaatacaaaaattagctgggcatggtggtgggcgcttgtagtaccagttacttgggaggctgaggcaggagaatcacttgaacctggtaggcggaggttgtagtgagctgagagcatgccattgcactccagcctgggtgacagagcgagagtccatctcaagaaagaaaaggggaaatgcaaagctattcagtagggatctcaaggtttttgaaagcaaacagtgtaatcatccaaacaaaaagaaaaagaagcaataatattaataaatacataaggtagaaaatgatagcagaatcgaagtaagaacaagctgagaaatgattttttatttttgaggcagggtcttgctctgttgcccaggttggagtgcagtggtgtgtgatcatgactcactgcactctcaaactcctgggctcaagaaatccttctgcttcagcctctcaagtagctaggactataggcgtggaccatgacacccagctaattttttatttaaaaatttttgtggagacaaggtcttgctatgttgctcagactggtttggaactcctggcctcaagtgattctcctgcctcggcctcccaaagtgctagaattacaggcgtgaaccacagatctggatgaaaatgatacatttaaatgagaaaaataaaggttaagtggagagatagccaataaccattgatatcaagactaaacaggaaaaatatcagtgtttcccaagttaattaatatacttaatttctattaatatgtaaatagaattcattatatagtctacataaataatttcaaaattcatatgaaaaagtaaatgagtcagaggatcaaaagacggcccaaattggtctgagtattgtgggttattgttaagctgatttaatattgtctcccccgacaaccatgcttgactagcttaaaagaaaaaaaaaaaggcccaaaaggagattgggcaatgtggagacttgctgtattagataagatatattgtgaggccataatcgtttatgtagccaaaaaagagaaatgaagactaacagaccaatgtaagtgtgagaagtagaatctaatttatgtaagaacctagagtattataactaagaccatggggaaaggtatttaaaattactgtataccatgtatcaagtactccaagaggattcaagttaaaaagtaaacccacaaactaaaaaaaattttaaaaggcagaatacatttttaaaaagttttttttttaattgacataataatggtacatatttatggggtacagtatctcgaactgctgagctcaagtgatccgcccacctcggcctcccaaagtgctaggattacaggtgtgagccaccgtgcccagccaatgtacacgttgggtaatgatcaagttagggtagttaacatttccatcaccaaaacacttgtcatttctttgtggtgcgatggttcaaaatcatctcttcatctattttgcaatatacattacattattgttaactatagtcaccctactgtgccatgtgtcaccagaactgatcccattgtaactgtgacttttacacctgttgatcaacctccatatctcctctttcctactaacctctatttactctctacttctatgaggtcacatttttagcttttacatacgagtgagatcatgtggtatttgtctttctgtgtctggcttatttcacttaacataatgtccattaggcttatccatgttgctgcaaatgagaggattttattcttttttatggctgaatagtattcctctgtgaatatattgcacatttctttgtccattcatcggttgatggatagttaggttgattccatatcttggctattatgaatagtgctgtattaaacatgggagtacaagtatctctttgacaaactgattttcttttcttttcttttttttcttgaaggatgaaaatgagattgatctttattgtagaatccaggccagggggctgctttgaaggcaagaatttcatgctagaaattccttattagccacacaaacttcttgtagcaagatagacttgtattactttttttttctttattatactttcagttttagggtacatgtgcacaatgtgcaggtttgttacatatgtatacatgtgccatgttggtgtgctgcacccattaactcatcatttaacattaggtatatctcctaatgctatccctcccccctccccccaccgcacagcaggtcctggtgtgtgatgttccccttcctgtgtccatgtgttctcattgttcaattcccacatatgagtgagagcacgcggtgtttggttttttgtccttgcgatagtttgctgagaatgatggtttccagcttcatccatgtccctacaaaggacatgaactcatccttttttatcgctgcctagtattccatggtgtatatgtgccacattttcttaatccagtctatcattgttggacatttgggttggttccaagtctttgctattgtgaatagtgccgcaataaacatatgtgtgcatgtgtctttatagcagcatgatttatattcctttgggtaatccagtaaagggatggctgggtcaaatggtatttctagttctagatccctgaggaatcgccacaccgacttccacagtggttgaactagtttacagtcctcccaacagtgtaaaagtgttcctatttctccacatcctctccagcacctgttgtttcctgactttttaatgatcgccattctaactggtgtaagatggtatctcattgtggttttgatttgcatttctctgatggccagtgatgatgagcattttttcatgtgtttgtgggctgcataattgtcttcttttgagaagtgtctgttcatatccttcgcccacttgttgatggggttgtttgtttttttcttgtaaatttgacaaactgattttctttcttttggatctatacccagtagtgggattgttggatcatgtggtagttctattttaatttttaggaaccttcatattgtttcccacaatggctgtactaatttatattcccaacaacagtgtgtaagagtgcccctttctccacatccttgccagcatgcattattttttgtctttttgatagtagccaatctaaataactgagttgaggtgatatcttattgtggttttgatttacatttccctgattattagtgatgtgcattttttcacatacctgttgggatttttatatcttctttttttcccctgatacataatagttgtatatgtcttttgagaaatacctattttgatttattgcccatttaaaaaatgagccttttttttgctattgaggtgtttgagttccttatatattctgtcagatggtagtgtgtgaatattttctcccattctatagcttgtttcttcactctgtggattgcttctttcactgtgcataggcttttttactttagtataatcccatttgtctagatttgcttctgttacctatgcaccagtgtcatgcaatgtttcccccatgcttacttctagtagtttcatagtttcaggtcttacatttaagctgttaatccattttgagttggtttgtgaaagatatgagagataggggtctagtttcattcttctacatgtaaatatccagtttcccagcactatttattgaagagactgtcctttcctcaatgtgtgtccttttttttttctttttttaagatggagttgtgctctttttgcccaggctggagtgcaatggcacatctctgcttactgcagcctctgtcttccgggttcaagtgattctcccatctcagcctcctgagtagctgggattatagacacccactaccatgcccggctaattttgtatttttagtagatatggggtttcaccatgttggccaggctggtctcgaattcctgacctcaggtgatctgccagcctcggcctcccaaagtgctgggattacaggcatgagccactgtgcccagtcacctacttttttgatgtagacatttattgccataaacttctctcttagaactggttttgctgtattccataggttttggaatgttgtgcttccattttcatatggaaacaacatttttagttttaaatttctttttacattttctcaagaaaattttaaatttcttttaaattttttcttttctgagacagagtctcactctttcgcccaggctggagagaagtggtgtcatctcggctcactgcaacctccaccccctgggttcaagtgattttcctgcctcagcctcccacgtaactgggattataggtgcccaccaccatgcccagctaatttttaaaattttttcattgactcattggttattcaggaatatgttgtttaattttcatggatttgtacagtttccaaagttcctcctgttactgatttttagttttattccattgtggtcagaaaagataattgatatgattttgatttttaaactttgtttagacttgtttgctccctttaggtctattaataattcctttatatatttagttgttacaatgttgggtgcaaatatatttataactgttacatcttcctgctgtattaatcattttatatggccttttatataatggccttctttttctctttttacagtttttggcttaaagtctatgtcttttgtattagtacagctactcttgaccttttttgtttccattttcatagaatacctttttccatcccttttctttgagtctgtgtgttcttaaaattgaagggagtctcttgtaggcagcatacagttgggtctgttttttttaatcctttcaactattctatgtcagcagaatacatttttgaattaatgaagcaatagaagaaacaacaagccagattagtatggctatattaaaaatttaaaacttataattgaaaacataatatagcaggatgaaacagaaagcactagaatggagaaatatttgagagggttaaaagtttaatattatagtatatgaggacatatttctaagattatgtcaagggaacttggtatgtaaacagtgtttcacaccataggaaacaaaataacaaaattattgaattatttaatttgtgatcattttaaaatataatcttaatgctgtgatataaatatctagtaactgaacaaaaaatgattttaaaatcctagtaaagctggtgagaaataaatatattgctttaatttgatttatttaactaatatttggtcatttgtaacgggagctattaaaatgactatttttttaatccagtaatcttacccttagaaatctgctttagagaaagaattgaaaagaataagaaccttggccaggcatggtggcttatgcctgtaatcccagcactttgagaggctgaggcaggtgcatcacctgagttcaggagttcaagacaagcctgggcaacatggcaaaaccccatctctaccaaaaagtacaaaaaactagctgggcgtagtgatgcgtgcctgtggtcccagctacttgggaggctgaggtgggagaattgcttgagcctgggaggtgaaggttgcagtgagctgagatcatgccactgcactccaacctgggtgacagagtgagaccccatctcaaaacaaaaataaaacaaaacaaaaaagtaataagaacctcatgtgtaggtcttttaaaacacataatttatatagcaaaaacaataaatagattaaaaaagctttgaaaccagcctaaatactcaaagtatttgatggactgactagaatacatatattaagttacaaatatgcacattagataaaatcatggaaacttacttgttaatattaaatttatgcaagacttaatgcaagacttaatgtatgttctacttattgatttgtgaagtttacctatgaagattgtacaattccatagtgacacagtgattttttttttgttttgttttttgttttgagacagagtcttgctctcttgccaggctggagtgcagtggcgtgatctcagctcactgcaacctcctactccctggttcaagcgattctcctgcctcagcctcccaagtagctgggattacaggcatgtgccaccacgtccagctaatttttgtattttttagtagagacagggtttcaccatgttggccaggatggtcttgatttcctgacctcctgatccgcctgccttggcctcccaaagtgctgggattacaggtatgagccactgcgcccagcccagtcattgttttagtacaaaataataggtaaatttaaattattgaaatgtagaggtttttttataagtatgaaggaaaagtcatgtcaggatctccagttggatatttatgtcctccagcaatcaacagatgttgaaaaacctctggcggttgacctgttgtgcttttatttacagtgcttgtttcaggttctggtaaacgttcctcagagtccaaaagcagggaagcctagtgctgcagctgcctctgtcagcacccagcacggatctatcctgcagctgaacgacaccttggaagagaaagaagtttgtaggtttgtgcctgctttgttgtgatctaagtgaagtctgcattttctctttttctattttggttttagctttttttctctttacagtatttttctttatcttttctggtccgtacccaggaacatgtattattctgcctccatgatattagcaaaatccaacttcttattttctaatctaaccacttgtcttaattttacctaatgtttgtaggttggaatacagatttggagaatttggaaactattctctcttggtaaagaacatccataatggagttagtgaaattgcctgtgacctggctgtgaacgaggatccagttgatagtaaccttcgtacgtatatgttctctgctgattttcacatttgcattttcagaggtttcagtttttgagtactgtttgtaaagcaaagcagtccatgacgctttctgtagttgaaaacctaaatcttaggtcattgatgagcaccactccccccaaaaaatccacataaattataggttatttctacttagttatgatgtatttaaaatatgtttattgtattatctgtatataataatacaattatgtgacattaaaaaattatttattggcctggcatggtggctcatgcttgtaatcccagcactttgggaggccaaggcaggcagatcactcgagctcacaagtttgagacgagcctgggtgatgtggtaaaaccccatctctacaaaaaatacaaaaattagctgggcctggcgatgcgtgcctgtagtcccagctacttgggaggctgaggtgggaggatggcttgaacctgggaggcagaagttgcaatgagccaagattgtaccactgcactgcaacctgggtgatagagccagaccttgtctcaaaaaaaattatatgatatatcaatacattctcatagtttttagtttaattatgaagcattaataagccaaaaatgttaatgcagtggaaagaaactagaaatagggtaattgactgtcaaatatctctccttgttttaggagtgagcgtatagtatttcctgtatatcttctgctgccagtccagagatcctcttaggttaaggagggatcattcattatctaataaccccactgaagaaaatctgccattcggaactccctattaggtaacaatgtatgtgctgccttttgaaaggcagtaacaaatccctgtggtgtgaacaagtactgttcacagggaagctattaaagactatgaggttatatcaaaagaacgcaggagccgatatgaaagggccaatgtaggacaatttaagcattaagaagaataatatatgtagtggaagaaaaataatgaatgtataaaaaccatgaggtcatatgaaactaagatgagcaaggcctgccttcccaaagaaaacaaaaacaatgctttgtctttataggtaatcagggcacctgatgttaactgtgtgatttaaaattgtcagttgaaaggagagatttaagcatttattttgcccgttttaactgtaattcagggtaaccaaagatagtccctgttgagggaaaattctgtggagaagaattccaggtaataaatacagcaaaagggcaggatatgtcgcaacccttaatgaagtaagtgattgtgattcaggcatatactatatgagtggatgaaaccacgaggtgaaggggaatttttaccagctgaacacatccaccagtcatggggcaaccgcaacaggtacactttcagtgttggccaggaagttattgttaatttcatatgacattgtgtttatataacaaaaggcccatttcaaagatacttttagttttgaaatagttttagatttgtagaagtgttgcaaaaagagttctcaaatatccttcacttagcttcccctaaaccctaaactgtaaaatcacagtgtaattatcccacatactattactgaaaccagcaacttaacattgttcttaacattgaacataatattgatacagtactgattggggttatttaaatttctctaaatgtcccttttaatatccttctccggtgctggatttgaggtaggatcccacactgcatttagctttcagatctcctttgtctcctccagtctaggacagttcctcagtctttctttgtctttcatgaccttgatggtttgaagggtaatgtctggttgttttgtcaactgtccttgatttggatttgcttgatgtttggtgttttctcatgaataggtagaggttttgcattttttactggtatacagcaaaagcgaggctgggtccttctcagtgccttgtgtgaggaggcacacagtgtcaggctgtctttacaagggctttagagacacatcctgaagtatgtagggatgaaataacatgatgtcttggattcctaaagaaatagtttagccagaaaaagcaggacatgggggtgggtgggtagttatagatgaagcaacagggacaatatcttgataattctaggatctgggtgatggattatatatagggtgatggtaccattctctgtgcttttgtttatgtttgatattttttataatgacaattatcactcccttcagggtgagcataggaaattcagcatgagaatataggcttcccctcactggttttcatttatagataaatgtaatgatgtgatgtctttgatgttcatgatgacatttttgggggctaatgtgttttcttctctttttctagctgtgagcattgcattccttattggtcttgctgtcatcattgtgatatcctttctgaggctcttgttgaggtaagatatttggggaggacgccactggaaaggcagagtatagaaataacacattcagaaggggcagctgtcaccctcaagtggccatattcttcgatgatatgaacatttctgtgtcccccatgtccatccagtgctaggcttcagggactcatgtagactaagacgtggtctctgactttagggaagtgatattaaaggtgcttgtggattttttccttccttcctcccacatggctgaagaggaagaaaatgcttgagaaatcattatttcctaaagcatccgactttttaacgagcagaagtggctcatgacaattttaggaggaggtcgctgcactgaactcccttccccctctctggccctgagccctgaggcaccttctagtccagctgcccaacctctgccagcccaggcatctggtggcacagatgtatgcctggtggctgttcttctggacctcgcacggactccctgtcccttggttagtttgttagccaatgtggagaagggactggtcctgctctgcgtggtgaatagcgattctggtaagagtgaattagtagactagaacaagaaagtaaaatagatccagttttaattaactttcaaaggaaagtttttttcatgttttaaaaagaataagagtgaattttctcatgcttatcttgttagggtctcaagaagaaccacaaggttttattgatgagcaatatccaaactgaaagaatgaaaacctaacctctaagtcggctagcttgggaaaccctgaagctttggggaatttctgcactgtgatactctagctttgtacatcttagaaatagtataattccatgtgtgaggaccccaactgtgtatagggtaaaagaaccacatgttgcccagaagccggtgtgtaacctgttttttagggatagaggaagattctagcagtggagtttcatttctttgagttaaggtattatctcatcaaccttttgataaaatgcaaatgctatttcagtatatcaggatgcttttcacgtaaatggatctattatggattttttttttttttgagacagagtctcactcttgtcatccaggctggagtgcagtggtgccattatggctgactgcagccttgacttcctgggctcaggtgattctcccacctttgcctcctaagtagttgggactacaggcatgcatcaccatgcctggctaatggtttttttttttttaatttttgtatttttagtggagacggggtcttgatatgttgcccaggctggtcttgaactcctcgactcaagtgttccatctgtctctgactcccagagtgcagggattataggcatgagtcaccacacctggtcatattacatgactttttaaagtaattggtagctaggccgggtacggtggctcacgcctctaataccagcactttgagaggccaaggcagatggatcacttgaggtcaggagtttgagaccagcctggtaacatgatgaaatcccatctctactaaaaatacaaaaagtagctaagtgtgatggtgggtgcctgtagtcccagctactcaggaggctgaggcacgaaaatggcttgaggttgcagtgaggtgggagggaggttggaggttgcagtgatctgagattgtgccactgcattccggccggggactctcaagaaaaaaaaaagtaattgatagctgagatcaagcattttcaaagggaagagattccaccttgccccatgtggaactgaaactactctttgcacatgatgctgcccttccagcctgcgggcagaatgctcttcttgacaaagcaggagtcccttattccttgccccctcgctttccaacatacccagggaggttcagatgactgtgagccaaaaaacaaccagaaaaagtcgagagaataaagagcccctctctttttcacttaggcaacaagcatgaacaagaaaattaagtatttttgttttatttttagaaatcttaacttctccttttcaccctttttttttttttttaattttttgaggtggagtctcactctgccacgcaggctggagtgcagtggtgcgatctctgctcgctgcaacctctgcctctgggttttaagaaattctctgcctcagcctcccaaatagctgggattacaggcacgtgacaccatgcccagctaatttttagtagagatgaggtttcagcatcttggccaagctggtcttgaactcctgacctcgtgatccacctgcctctgcctctcaaagtgctgggattacaggcgtgagccaccatgcctggccacccttctttagatgtgtctattttaacattttacatgtgatggtgatgttatccatgttgaataaactagaaatcagagttgagttgtgagggaaaaagagaaattgcaaatgtatgccttgggcatatggatcatatttggatactgaattgaaccactgaactataaaaacatgttatgaaacagggaaactgcactggctatgtgacggtattaaggaattactgctaacatttaaaaatgtgataagggtattgtggttatgtttagaaataaaaatagtccatatccattagagatacatactaaattgtttttgcatgaaatgatatgatgtctaggattttctataaaacaatccgaggcaggaatgagggacagtgggtgagaggacatatgaagtaagattggccatgtgtcgacacttgttgaagctggatgatggaggtccattattcaggcaaaccctgtgttattgtgctttgctttattgcacttcacagatattgcatgttttacaaattgaaggttcgtggcaaccctgcatccagcaattcttttttttttttgagacgtggtctcattctgtctcccaagttggagagcagtggtgccatcacagctcactgcagccttgacctcccacactgcagccttttgatttaaagcgagagacgtgcagccggacaccatggctcacacctgtaatcccagcactttggggggcctaggcaggtggatcgcttgaactcaggagttcgagaccagcctggccaacatggtgaaacccccatctctactaaaaatagaaaaattagctgggcgtggcggcgcacgcctgtaatcccaggtactcgggaggctgaggcaggagaattgctggaacccaggaagtggaggtttgcagtgagccgagatcgcgctactgcactccagcctgggtgacagagtgagactccatctcaaaaaataaaaaataaagtgagagacatgcaactctttcttttactcaaacgcttagaagccattgtagggcaattataattggcctaatttcaatattgttgtatctgaatgaatagagaggcccaaagagagggagggagatggaggaacagtcagaacatactcaacgcttattgaccttattgacctcccaggcacaagcagtcctcccatctcagcctcccaagtagctgggactagaggcatgtgccaccatgataatttttttttttttttttttttttttttagtagagatgaagttctcactgtgttgcccaggcttgcattgagtaattctgttggcaccatttttccaacagcatgtgctcacttcttgtctttgcattacattttggtaatcgttataatatttcaaactttttcatactattatatctgttatggtgatctgtgatcaatgatctttgatgctcctactgtaattgttttgggatgccatgaaccctgcctgtataagatggtgaacttaatcagtattgagtgtattctgactgttccacccactgactgttcccccatttctctccctctctttgggcttctctatcctttcagatacaacaatattgaaattaggctaattaattatcctacagtggcttctaagtgagtaaaagaaagagttgcatgtctctcactttaaatcaaaagctagaaatgattaaacttagtgagaaaggcatgtcgagagccatgataggctgaaagctaggcctcttgtgcccaacagttagccaagttgtgaaagttcttgaagaaaattaaatgttctactccagggaagacacaaatgataagaaagtgaaacaggctgggcttagtggctcacacctgtaatcccagcactttgggagcctgaggccagattattgcttgaagctaggagttcgagaccagcctggccaacatggcaaaaccccatctctactaaaaatacaaaattagctgggcatggtgttgcatgcctgtaatcccagctactctggagcctgaggcaggagaattgcttgaacccgggagtcagaagttgcagtgagctgagattgctccactgtactccagcctaggcaaaggagctagactctgtctcaaaaagaaaaaaaagaaaaagaagaaaatgaaacagccttactgctgatatggagaaagtttgaatggtctggatagaagatcaaactattcccttaagccaaagcctaatccagagcaaggccctagctcttttcagttctgtagagactaagagaagtgaggaatctgcagaagaaaagttggaaactagcagaggttggttcagaaggtttaaggaaggaagccatttccataacataaaagtgcaaggtgaagcggcaagtgctgatggagaagctgcagcaagttatccagaagatccagctaagataattgatgaaagtggctacactaacaacacagtttccatgcagatgaaacagccttctattggaagaagatgccatctaagacttttaatagccaggaaggagaattcaaagcttcacaggacaggctgactctcttgttaggagctaacgcaactggtgactttaagttgaagccaatgctcatttaccattctggaaatcctagggtccttaagaattatgctaaatctcctctgtctgtgctcaataaatggaacagcaaagcctggatgacagcacatctgtttacagcgtggcttactgactattttaagcctactgtcgagacctactgttcagaaaagaatatttttttcaaaatattgttggtcattgacaatgcagcaagtcacccaagagctccaatggagatgtacaagcagatgaatgttgttttcatgcctgtaacacaatatccattctgcagcccatggatcaaggagtaatattgattttcaagtcttactatttaaaaaataggtttttataaagccgtatagctgccatacatagacagtgatttctccaatgaatctgggcaaagtccattgaaaaccttctggaaaggattcaccattgtagatgccattaagaaatttgtgattcatgagaggaagtaaaattatcaacattaacaggagtttggaggaagttgattccagccctcatggatgactcgggggtttaaggcttcagtggaggaaataactgcagatgtggtggaaataaaactagaattagaagtgaagcctgaagatgtgactgaattgctgcaatctcatgacaatacttgatcagacaaggagttgcttcttatagatgagcaaaggaagtggtttctcaaggtggaatctactcctggtaaccatgttgtgaacattgctgagatgacaacaaaggatttagaatatcacataaatgtagttggtagagcagaggcagagtttgagacgattgactctaattttgaaagaaggtctaactgtgggtaaaatgctatcaaacagcatcacgtgctgcagagaaatcttgtgaaaggaaaagtctgtggcaaactgtattgtcttgatttcggaaattgccacagccacctcaacctacggcagccaccaccctgaccactcagcagccatcaacatggaggccagatcctccaccagcaaaaagattagaacttgctgaaggctcaaataatcattaactttttattagcaatacatttttaaattaaggtatgtaaactgtctttttgtgcataatggtattgcacacttaatagactatagtatagtgtaatatataacttttatatacactgggtcacagaaaatttgtgagagtcactgtattgtgatattggccttattgtggtggtctgggaccaagcctgcagtgtcttgagctatgcctgtactggtttctctgcttctgtgtaactgttcatgaccaaaaaataaaaggggaaaaaatcctatgcactggataatttgtttatgccagggtagggtatacttttcaaaagatttcttcccaggtagaaatctcattttaaagaaaaaccagttaatatatttatcttttgttagtcatgtaaatcaatttaatgttatctggatatctttcttttctttctttctttttttttttttgagacagagtcttgctatgtcacccaggctggagtgcggtggcaccatctcggctcactccaagctctgcctcccgggttcacaccattctcctacctcagcctcctgagtagctggaactgcaggtgcccgccaccatgcctggctaatttttttgtatttttagtagagacagggtttcaccgtcttagccaggatggtcttgatctcctaacctcgtgatccgcccgtcttggcctcccaaagtgttgggattacaggcgtgagccaccgcgcccagcctggatcattttgaattaaagcaaccatattcaaaaagaacccagtacattaactatttgaatcaccccaaagttgctttcaacttttcccagtgtgcacatatgcatttttgtttgtaattgaatgtaaatgttaggtttttgctttttgtatttaatagttgatctttttttttttttttttttttttttgagatggagtctcgctctgttgcccaggctggagtccagtgggcgtgatctcggctcactgcaacttccctccgcctcctgggttcaagcaattctcctgcctcagcctcctgagtagctgggattacaggcgtgtaccaccacatctggctaatttttgtatttttagtagagacatggtttcaccatgttggccaggctggtctcgaactcctgacctcaagtgatccacccacctcggccccccaaagtgctgggattacaggcaagagccaccatgcctggcctaataatttatatcttcatcttaatgtttctttgtgtgggcagagcccacattcttttgctttcatgactgtatcacatcctatcacacagctgtcatattctgtgtttagtcatccttgttttgagtaaatttggttgtttccaagtttttgctattttaattttaatagtattattagtgagaatcccagccacggggaatagttacctcatttaccttctgaagtctttaatgaaagctctgtcatcattcctgttttattgatgaggaaactatgctgtcagagttgagtatttataagtagagctgctgaaaattgtgatttctatttttatattgttaaaaaatgtttagaatgtttaattacttagtaatatagaatatgagctttaattttatttccatataatatccaatcatttaaaaaattctgccaatgaaaataaattaattgagccctttatttattttcagtttggatgactttaacaattggatttctaaagccataagttctcgagaaactgatcgcctcatcaattctgtaagttatgagatgcatagtgtattgcccaggtggttttctaaacttggaatttatagtttcttatttaatcattattgtccagttttatgtttatattgaggaaggccaggttgtagctcccgtattcctaatagagagcagccctctcttcagctgctgggaagggctccatcccttctcttgcttcagtgacattggaacgttccgctctatcaggatacctgaggtagagacatttttcactctgcaggcagcattgttgaatcaatccagttaagtagagagtgtcaaagttaaaacaaagaaataagagacaacaatattaaatctataaatgctgatggcctcctctaatgatttaaatatgtcattaaatttttgttaataaattcaggctcatttatggggatgttggcttctgtgcttgtgctagatgcacttacgactagtttttttggtgtcatttatcaatgtggccactggcaaactcagtaaaaggcaggaaaagctgataaagtacaaaaccagacctctagatgggatctttacaaaagcaaatccaagtattgtttagaaaaacttttttattttttgagacaggatcttactctgttgcccaggctggagttcagtggcgtggtctcaactcgctgcagcctcaacctcctgggctcagatgatcttcccacctcagcttcccaagtagctgggactacaggtgtgtgccactccacctggctaatttttgtattttttgtagagacagggtttcaccatgttgcccaggctggtctcaaactcttgggctcaagagatttgcccaccttggcctcccaaagtgctgaaatcacaggtgtgagccactgtgcctacagaaaaactattttttagctttctaaactatttttagatttctactatatcacattctttcctaaagaaataaaaaattgatgccggttgcggtgactcacgtctgtaatcccagcactttaggaggctgaggcaggcagatcatgaggtcaggagtttgagaccagcctgaccaacatgatgaaaccccatctctactaaaaatacaaaaattagccggacgtggtggcgcatgcctgtaatcacagctacgcaggaggctgaggcaggagaatcgcttgaccccaggaggtggaggttgcagtgagccaaggtcttgccattgcactccaggctgggccacagagcgagactctgtctcaaaaaacaaaacaaaacaaaacaaaacaaagaaatcaaaaaatgacaaaatgaaatttaccccttagcattatgagttgtcatctttctccctttttttctgaaggagctgggatctcccagcaggacagaccctctcgatggtgatgttcagccagcaacgtggcgtctatctgccctgccgccccgcctccgcagcgtggacaccttcagggggtatgtgggcctccctgtagcacagtgggtgcaggtagtcacaggactacataattgtacatacacacacttttagcttttaaggacttttacatatcttttactttctaggctaggaaggatttcttggatgtaaaagtaaactctgcagcctctccagtctggaagaccatcatgatcctcagtgtctgtattgacagaggagtagtggatgaggccagagccagtgtccacttggatacgtggtctgctgagtgaagggcatttttatttgggcaagtcgctgttacttggggctgcagactgtatcccatgtccagtcagtagcttgacggctcagaagatgcactagtctagcaaggaaacaccagcatgtggcagagggagggctgatcctgcgctgctagcagagtgacttgagtatcaggccctcgtgctagcaaacccatagccctggtagaagaacaagggccaggactgaaatctgaaaataaagtttaaaaactgtatagcgaagaataaatacacaggtatcagctcttttatttctacatactgaagccttctgaactctagtgacaaccctataactttgccccagtctcaccagagccctgagtgccctggcaggtagattggaagcaggtagtaagaacaatatgatcataatgaaacttgctaacaattctggagttctcataatgtgccagtcactgttctaactcgtcttaatttatttaatctcttagtaatcctatgagatatatacttttaatgtgcctgattcacattaaaagtaaaagaaattgtgctgctgagtgaagtaacttgcccaagctcactcaggtaccaaataggaaagccagggtttgatggcaggcacttgggttacagagtctcccaaattagtctgttgacacctaaggtcagcaccctcagcattctgcacagttagcctcaaacagtagcacatccggaatctattactctgtcttttagatttccattgctacttttggagataagatggtcacagatagacaggaactaacatttattaagtgtctaaaatatgctgggcactggttagctgctgtaaaatacatcattctccttaaaagtcacatgtggttagggcactttcttttacagatgagcacactgagtttactgatgagaaccttgcccagggtcttatggctaatgacagaaaaggatctaagattggaattctgagctcgctgactcagctggctgtgtgccttccaccagagttctttaacccgagacatctaaataattagcacaaaactgagttattggaaatattttgcaatgttttcaagttacatagtttaagactgcagtatacactttggttaagacatcatgttggcagtgttggcaatggtcctaactgtagtgcatggtcctaattgcgatgactagaaaataatcgcttcttggccttgatgtctcatcttgtgtaataaaatgctcagtagaattgcattgttgcatgattgcaccttgtgagtataaatgtgtcttcagttcagcccttccttttcacatagcaaaccctgaaaggcttctctttgttggcttcttctaggattgctcttatactcatggtctttgtcaattatggaggaggaaaatattggtacttcaaacatgcaagttggaatggtaagatatttcctaaaagtaatgttgcttatatacgtccttcacagagcttcagggcaggagaatcactcagcattctccccagaaactccagaaatgagccccagcagcctcctctgagccactgagctcctgctccctcctagggtgacctgtagatgattctgcgagccctttagttttgttcctccttttgtgtgctgtgaatctgtaaagcttcactgtaataacagactctagaagtttctgctgtgggactgagggactctgcagaatatgttatggatttggttgtaaatgatcatggtcatattctagatatgccttctattacagccaccatgctcttgggggctctgtcttctaggacttatggtcctttttgagatggcgttgaactaggattggtctgagtggtggtgaataatatctgtaagtctggcttggtagttgctttacaaatggattagtgcttcttaaacataacaaacgtgtctacatatttctagtttggttttcctgtgtctagttatgttcataggaagtgtcccagccaggtccagtgcttggttgcagagtctcaaggaagagtttgtgagtttactttctttttttaaaggcagagtcttgctttgtagcccaggctagattgcagtggtgtgataatagctgaccacagcctcgacctcctgggctcaagcaatcctcccacctcagcctcctgagtagctgggactacaggtgtgtgccaccatacatggctagttttttaaaacaatttttagtacagatggtgtctcactctgttgcccaggctggtctcaaactcctgggctcaagcgatcctcccaccttagcctcccaaagtgctgggattacaggtgtgagccacaccacacctggcctatgagttttctttttctttttcttttttttttttgagatggagtttcattcttgtcacccaggctggagtgcaatggcgcgatcttggctcactgcaacctctgcctcccaggttcaagtgattctcctgcctcagcctcccaggtagctgggattacaggtgcccgccaccacacccggctaatttttgtatttttagtagagacggagtttgatcacgttggccaggctagtctcgaactcctgacctcaggtgatctgctcgcctcggcccccacaaagtgttgggattacgggcatgagtcactgcgcctcccctgggtttactttctataccagtgtgtaatgaagtccacactagatttaggaggtatttgtattctagagtccttttgcttatgctttgtacttgttctgcagggctgacagtggctgacctcgtgttcccgtggtgagttgccggtctgccctcttctcttccacgggttgactccaatctcctgtttttcagatgatgctggagcctctcttctgagacgggcatgtgttatgtggttaggaagtccttccaaaagtcctgttactggatagttctcatacttgacccagtgcctacacgtgtgtataaaagagtgatttggggccgggcgcggtggctcacgcctgtaatcctagcactttgggaggctgaggcaggcgaattacctgaggtcaggagttcaagaccagcctggccaacatggtgaaactctgtctctactaaaaatacaaaaaattagctgggtgcagtggcacgtgcctgtaatcccagctactcgggaggctgaggaaggagaatcacttgaacccaggaggcgggggttgcggtgagcagagatcacgccactgcactccagcctgggcgacagagtgagacttcatctcaaaaaaaaaaaaataaaaaaaataaagtgattttatagggaatattttgttagtgtagatatggtatgccagatcctgaaaccttgtaggaaattatacattctgaacatgtagttcagttccattaatcctgaaaatacttataaaatcctatttcctgaagaattacagtatattggtatcagtgaatgctaataaatatgtaggtgggcaatgatagtcataaactaaaatttaaaataacagttgagtagctcaattctgtctctgatcattcatagcttcttattcttgtgaagggacattgcctatgtgatgtggaatttgtatctttgctatggtgtattaagtgacattgctccctcattagcaggtagtaccagccttattattgttattttttatttcaaattttaaatttttgtgggtacatagtttatatagtatggtagatatgagatattttgatgcaggcatacaatgtgtaataatcacatcagggtaaatggggtacccaccccctcaggcatttaccattttgtgttataaacaatccaattataattttttagttatttttaaatgtacagtaaattattgttgactgtagtcaccctgtcatgctatcaaatacttgatcttattcattccatccagctatatttttgtactcattaaccacgccccctccttccctccccactacccttcccttctggtatccatccttctatcgccctgagttcagttgttttaatttttagctccacaaataattggaacatggcttatttcacttaacataatgtcctcgagttccatccatgctgttgcacatgacaggatctcattcttttttatggctgaatagtacttcattgtgtatatacaccacattttctttctaagtgtctgttgatggatgcttagtctgcttccagatcttggctattgtgaatagtgctgcaataaagatgggagtatctcttcaatatactgatttccttccttttgcatatatacccagcagtgggattgctggatcatatggtacctctacttttaggttttgaggaacctctaacctattgtccatggtgattgtactaatttacattcccaccaacagtgtacaagtgttcccttttccccacctcctcatcagcattggttattgctgtcttttggataaaaaccattttaactggggtaagatgatatctcactgtagctttgacttgcatttctctgatgatcaatgatgttgagcaccgtttcatattcgtgtttgccatttggatgtcttcttttgagaaatgtctgttcagatcttttgtcctctttttttttttttttttttttttttcaagatgaagtcttgctctgtagcccaggtgggagtgcagtggcatgatcttggttcattgcaacctctgcctcctgggttccagcgattcttctgcctcagcctcccgagtagctgggattacaggtgcgcaccaccacacctggctatttttttgtatttttagtagagatgaggtttcaccatgttggccaggctggtcttgaactcctgacctcaggtaatctgcctgccttggcctcccaaagtgctaggattacaggcgtgagccaccgagcccggccttttaatccatttttaattggattattagattttttttcctatagagttgtttgagctccttatatgttctggctatttattgcttgtctgatggggagtttgcaaatattttctcccattccatgggttgtctcttcactttgttaattatcttcttttctgtgtggaagctttttacttgatatgatcccgtttgtccatttttgctttggttacttgtgctgtgtgaagtgttaatcaagaaatcttcacttagtccagtgtgctggagtgtttccccaatgttttctcttagtagtttcatagtttgaggtcttaagtttaagtctttaatccattttgatttgatttttttaatatgatgagagataggggtctaggttcattcttctgcatatgaatatccagttttctagcatcatttttttgaagagactgtcctttctccaatgtgtgttcttggcacttttgtcgaaaatgagttcactgtagctatatggatttagctctgagttctttattctgtcccactatctatgtgtctgtttttatgccactaccatgctgtttttgtttctatagctctgtggtataatttaaagtcaggtaatgtgattcttccagttttgttctcttgctcaggataactttggctacgctgggtcttttgtggttccatataaatttcagcatttttttttctatttcagtgaagaatgttattggtattttgatagggattgcattgagtctgtagattgctttaggtagtgtgaacattttaacaatattaatttttctaatgtatgaacatggaatttctttccattttttggtgccctcttcaatttctttcatcagtggtttatagttttcattgtagaaatccttctcttctttggttaagttaattttgaggtactttattttatttgtggcaattggaaatggaattcctttcctgatttctttttcagattgttttctgttggcatatagaaatgctactgatttttgtatgttgatttgtatcctgcaactttactgaatttgttgatcagttctaatagttttctggtggagtctaggtttttccaaatataagatcacgttatctgcaaacaagggtactttgacttcctcctttccaacttggatgccctttatttgtttctcttgtctgactgctctatttttgtactcattattagtgccatgttgaataacagtggtgaaaagtaggcatccttgtcatgttccagatcttggaggaaaggctttcagtttttcctagagacaccaaggaatgcagcaagagcaaactttcatctctgtgatcccttgccaagtaattagaaaaatcagtattctaacttttttttttttaaagagataatttagggccaggtgtggtggctcatgcctgtaatcccagcacttttgggaggccgaggcgggcggatcacaaggtcgggagattgagaccatcctggctaacacggtgaaaccctgtctctactaaaaatacaaaaaaaagaaaattagccgggcacggtggcgggcacctgtagtcccagctactcaggaggctgaggtgggagaatggcgtgaacccaggaggcggagcttgcagtgagccgagatcgtgccattgcactccagtctgggcaacagagcaagactccgtctcaaaaaaaaaaaaaaaaaaaaagagtaatttagtaatttagtatggtcaaagaaaagaaaggaaatgtgtattacttagactaaatggagagagaaaaagtaagctttcatttttctttcaggtgcagaagggtgtatagaaatgattgaaatgtctgtgtttcaagggctttgagggtgtgcttgtgaatgtcaagttatttgaagacattactgtggcttcgaatcatcatttctttttgataacgaaatgggagggttgtctttggaaattccatttaatattaaagaaattttctcctaagacaggacttgaaggtgcactgtcaaaaaccttccagccccatggggctatattctgaactcttcctctactgttagctcagtattatttcagtaattggctactttaaacaaattatggttgcttctcttttatagcatattataaaatgttactgatatatagacaaaaaatttggaaatggccacctattaataactagattctttttaggtttgtatttattatgggatcttccatttttctatcgatgacttctatactgcaacgggggtgttcaaaattcagattgctggggaagattgcatggaggagtttcctgttaatctgcataggaattatcattgtgaatcccaattattgccttggtccatgtaagtactttttccctctgttatatatattcaggttgaaatatggaaactatatgttgtaatttgagagaaatgcaattcctccatctcaggtgcctgcaaatagaataatcattaggaaagtatatacaatggttgtctaactgtgagcattattattattatttttgaattttagacctgggaggagcctctgagactactcaaacccttctcttgtgcagaggaaaagtctgaggccaagagcgattgaaggttttctctggattatctgagtgtagtgagaggcacagcagggaccagaccaggccgccttggtctccaactttgccccctgctaatgtgatttcatcagctttcttttttttttttttttttttaaatttatttatttattttttattgatcattcttgggtgttgggatttggcagggtcataggacaatagtggagggaaggtcagcagataaacaagtgaacaaaggtctctggttttcctaggcagaggaccctgcggccttggccttccgcagtgtttgtgtccctgggtacttaagattagggagtggtgatgactcttaacgagcatgctgccttcaagcatctgtttaacaaagcacatcttgcaccacccttaatccatttaaccctgagtggacacagcacatgtttcagagagcacagggttggggataaggtcacagatcaacaggatcccaaggcagaagaatttttcttagtacagaacaaaatgaaaagtctcccatgtctacttctatccacacagacccggcaaccatccgatttctcaattttttccccacccttcccgcctttctattccacaaaaccgccattgtcatcatggcccatccccaatgagccgctgggcacacctcccagacggggtcgtggccgggcagaggggctcctcacttcccagtaggggcggccgggcagaagcgcccctcacctcccggatggggcggctggccgggcgggggctgacccccccaccaccctcccggacggggcggctggccaggcagaggggctcctcacttcccagtaggggcggccgggcagaggcgcccctcacctcctggatagggcggctggctgggcggggggctgtcccccccacctccctcccggacggggcggctggccgggcagaggggtcctcacttcccagtaggggcggccgggcagaggcgcccctcacctcccggacggggcggccggccggaaggggggctgaccccccccacctccctcccggacggggcggctggccgaccccccccaccgcctccctcccggacggggcggctggccggacagaggggctcctcactttccagtaggggcggccgggcagaggcgcccctcacctcccggacggggcgactggccaggcggggggctgatccccccacctccctcccggatggggcggctggccaggtggggggatgacccccccacctccctcccgggcggggcggctggccgggcagaggggctcctcacttcccagtaggggcggccgggcagaggcgcccctcacctcccggatggggcggctggccaggcggggggctgatccccccacctccctcccagacggggcggctggccgggcggggggctgaccccccacctccctcccggactgggcggctggccgggcggggggctgacccccccacctccctcctggacggggcgtctggccgggcagaggggctcctcacttcccagtaggggcggccgggcagaggagcccctcacctcccagacggggcggctggccgggcggggggctgacccccccacctccctcccggacggggcggctggccgacccccccccccaccgcctccctcccggatggggcggctggccgggcagaggggctcctcacttcccagtaggggcggccgggcagaggagcccctcacctcccggacggggtggctggccgggcggggggctgaccccccccacctccctcccggacggggtggctgctgggcggagacgctcctcatttcccagacggggtggttgccggacggaggggctcctcacttctcagacggggcggttgccaggcagagggtttcctcacttctcagacggagcggccgggcagagacgctccccacctcccagacagggctgcggcccagcagaggcactcctcacatcccagacagggcggcggggcagaggtgctccccacatctcagacgatgggcggccgggcagagacgctcctcacttcctagatgggatggcggcggggaagaggcgctcctcgcttcccagatgggatggcggccgggcagagacgctcctcactttccagactgggcagccaggcagaggggctcctcacatcccagacgatgggtggccaagcagagacgctcctcacttcccagacggggtggctgctgggcagaggctgcaatctcggctctccgggaggccaaggcaggcggctgggaggtggttgcagcgagccgagatcacgccactgcactccagcctgggcaccattgagcactgagtgaacgagactccatctgcaatcccggcacctcgggaggccgaggctggcggatcactcgcggctaggagctggagaccagcccggccaacacagcgaaaccccgtctccaccaaaaaaaaccgaaaaccagtcaggcgtggcggtgcgcgcctgcaatcgcaggcactcggcaggctgaggcaggagaatcaggcagggaggttgcagtgagccgagatggcagcagtaccgtccagccttggctcggcatcagagggagaccgtggagggagagggagagggagagggagagggagagggagagggagagggagagggagagggagagggagagggagagggagagggagagggagagggagagggagagggagagggagagggagagggagagggagagggagagggagagggagagcatttcatcagctttcgatagtgtgcggcagttcacgaatccaccttcactggcacttgtatggcagctgggtttctggaaggagtaatatctttgtcattagtttagtggtgcgcagggacagcagagctgagggaaggcttgtgagccctctgctttgaatgagtatcagagtcgggagggcactagtcactgtcctcaagggccttgcaactgtcgttagcagaagaggacacaaacatctagacaatggccaaatggagccctcaggcaatatgtactttaataggcactagcaagaggtggaggtcacttctagatggtgtttcatatgaatgtggacttggtggatctccaaaaagggagccactgcttccagtaggattcattttagggtttgttgtcaggtctgttcttccggtcatacggttgggtagcagatagggcagggagggtcagtcagtggcgttcttggggtgatacagctgggtagtgggtagggcagggagagtggcttgtgttgggcctgcaaggtcctagcagacgtgcgggttgattgcaaattcctaataggaaagagccagggtcaggcacaggcctggctttatccccacacctgagtaagacgctttggttcttatcccagtctctcatctggccagcttcctgttttgagtttgagccatgtccctgactgaccctccctctattaagagggattggcctgtttttggaagctgggctgagcccatgtctcttgaccgtatatatttccatgtccaagagcttaaaaaagacttacttagatgcaatataggtatgtcttcccctttaggaaacaaataatgttgtcctgggatgagaggagaagtcctggctaacacttgacctaacttgtgtcttttgcagtgtcttgggacaaggtgcgcattcctggtgtgctgcagcgattgggagtgacatactttgtggttgctgtgttggagctcctctttgctaaacctgtgcctgaacattgtgcctcggtgagaaaccatgttttaattaagaaaaactttttttaaattaaaaaaaatgtattgtgtggtgatacggtctcactatgttgtccagactggtccctcactcctggcttcaagtgatcctcctgccttggccacccaaagcgccgggattacaggtgtgagccaccatgcctggccagaaactgtgttcttgttgttgttgatacagggtcttgctgtgttgcccaggctggggtgcagtggtgtgatcttggctcactgaagcctcaacatcccaggcttaagcgatcctccctcctcagtctcctaattagctgggactacaggagcgcaccaccatgcctggctagttttatttattcttttgtagagacaaggtctcactatgttgtccaggctggtttcaaactcctggactcaggtgatcttcctgcctcggcctcacaaattgctgggattacaggtgtgagccaccatgcccagccaaaacagtgttttttaaaaaaagggagaacaaagggggatatggtttttagaacttctaaaatttctgcatgcaatactgtacatctgctaatcaaatacattctgattttcactttcattagttatttttaatctttatgtcaatttttttattataaaatacacgacatgagatctatcctcttaacaaatttgtcagcagacagtaatcacatgcattcttttttcctcttatttttagttgatatgtaatacttgtacatatttatgaggctcagagtaatattttgatacctgtgtatcatacagtgtgtaacgatcaaatcagggtaattagcatattcatcacctcaaacagttattatcatttctttgtgtcaggaacatgcacaatcctctctgctagtttcaaatgcattctgttttatttacttcttggagacagggtctcactctgttacccaggctggagtgcaggggcacgatctcaactcactgttgccttaacctcccaggctcaagcgattctcctacctcagcctcctgagtagctgggactataggcatgcactaccatgcccagttaatgattgtatttattgtagagacgaggtttcactgtgttgcccaggctggtcttgaactcctgggctcaagtgatttacccacctcagcctcccaaaatgctaggactacaggtgtgagtcaccatgcctggcctcattttttttttttttcttttgagagggagtcttgctctgtccgccaggctggagtgcagtggcgcgatctgggctcactgcaaactccgcctcctgggttcacgccgttctcctgtctcagcctcctgagtagctgggactacaggcgcccgccaccactcccagctaatttttttttaaattatcctttaagttctagggtatatgtgcacaacgtgcaggtttgttacataggtatacatgtgccatgttggtatgctgcacccgttaactcgtcatttacattaggtatatcccctaatgctatacctcccctttccccctgccccacaacaggccccggtgtgtgatgttccccaccctgtgaccaagtgttctcattgtttaattcccacctatgagtgagaacatgtagtgtttggttttctgtctttgtgatagtttgctgagaatgatggtttccagcttcatccatgtccctacaaaggacatgaattcatccttttttatggctgcatagtattccatggtgtatatgtgccacattttcttaatccagtctatcattgttgggcatttgggttggttccaagtctttgctattgtgaatagtgctgcaataaacatacgtgtgcatgtgtctttatagcagcatgatttataatcctttgggtatatacccagtaatgggatggctgggtccaatggtatttctagttctagatccctgaggaatcgccatactgacttccacaatggttgaactagtttacggtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtctgttggctgcataaatgtcttcttttgagaagtgtctgttcatatcctttgcccactttttgatggggttgtttgatttcttcttgtaaatttgtttaagttctttgtagattctggatattagccctttgtcagatgggtaggttgtaaaacttttctcccattctgtaggttgcctgttcactctgatggtagtttcttttgctgtgcagaagctctttagtttagttagatcccatttgtcaattctggcttttgttgccattgcttttggtgttttagacgtgaagtccttgcccatgcctgtgtcctgaatggtattgcctaggttttcttctagggtttttatggttttaggtctaacatttaagtctttaatccattgtgaattaatttttgtataaggtgtaaggaagcgattcagtttcagctttctacatatggctagctagttttcccagcaccatttattaaataaggaatcctttccccatttcttgtttttgtcaggtttgtcagagatcagatggttgtagatgtgtggtattatttctgagggctctgttctgttccattggtctatatctctgttttactaccagtaccatgctgttttggttactgtagccttgtagtatagtttgaagccaggtggcatgatacctccagctttgttcttgtggcttaggattgtcttggcaatgcaggctcttttttggttccatatgaactttaaagtagttttttccaattctgtgaagaaagtcattggtagcttgatggggatggcattgaatctataaattaccttgggcagtatcgccattttcatgatattgattcttcctatccataagcatggaatgttcttccatttgtttgtgtcctcttttattttgttgagcagtggtttgtagttctccttgaggaggtccttcacatcccttgtaagttggattcctaggtattttattctctttgaagcaattgtgaatgggacttcactcatgatttggctctctgtttgtctgttattggtgtataggaatgcttgtgatttttgtacattgattttgtatcctgagactttgctgaagttgcttatcagcttaaggaaattttgggctgagatgatggggttttctaaatatacaatcatgtcatctgcaaacagggacaatttgacttcctcctttcctaattgaataccttttatttctttctcctgcctgattgccctggccagaacttccaatcctatgttgaacaggagtggtgagagagggcatccctgtcttgtgccagttttcaaagggaatgcttccagtttttgtccattcagtatgatattggctgtgggtttgtcataagtagctcttattattttgagacaggtcccatcgatacctagtttattgaaagtttttagcatgaagggctgttgaattttgtcgaaggccttttctgcatctattgagataatcatgtggtttttgtttttggttctgtttatatgatggattacatttattgatttgcatatgttgaaccagccttgcatcccaggaatgaagccgacttgatcatggtggataagctttttgatgtgctgctggattcggtttcccagtattttattgaggatttttgcatcgatgttcatcagggatattggtctaaaattctctttttttgttgtgtctctgccaggctttggtatcaggatgatgctggcctcataaaatgagttagggttgattccctctttttctattgattggaatagtttcagaaggaatggtaccagctcctctttgtacctctggtagaatttggttgtgaatccatctggtgctggagtttttttgttggtaggctattaattattgcttcaatttcagagcctgttattgttctattcagggattcaacttcttcctggtttagtcttgggagggtgtgtatgtgtccaggaatttatcaatttcttctagattttctagtttttttgagtagaagtgtttatagtattctctgattgtagtttgtatttctgtggaatcggtggtgatatcacccttatcattttttattgtgtctatttgattcttctcccttttcttctttattagtcttgctagcagtttatcaattttgttgatcttttaaaaaaaccagctcctggattcattgatttttttgaagggttttttgtgtttctatctccttcagttctgctctgatcttagttacttcttgccttctgctagcttttgaatgtgtttgctcttgcttctctagttcttttaattgtgatgttagggtgtcaattttagatcttttcctgctttctcttgtgggcatttagtgctataaatttccttctacacactgctctaaatgtgtcctggagattctggtatgttgtgtctttgttatcattgatttcaaagaacatctttatttctgccttcatttcgttatgtacccagtagtcattcaggagtgggttgttcagtttccatgtagttgagcagttttgagagagtttcttaatcctgagttctaatttgattgcactgtggtctgagagacagtttgttataatttctgttcttttacatttgctgaggagtgctttacttccaactatgtggtcaattttggaataagtgcaatgtggtgctgagaagaatgtatattctgttgatttgaggtggagagttctgtagatgtctatcaggtctgtgtggtgcagagctgagttcaattcctggatatccttgttaactttctgtctcattgatctgtctaatgttgacagtgggttgttaaagtctcccattattatcatgtgggagtgtaagtctctttgtaggtctctaaggacttgctttataaatctgggtgctcctgtattgggtgcatatatatttaggatagttagctcttcttgttgaattgatccctttaccattatgtaatggccttctttgtctcttttgatctttgttggtttaaagtctgtttaatcagagacttggattgcaactcctgcctttttttgttttccgtttacctggtagatcttcctccatccctttattttgagcctatgtgtgtctttgcacgtgagatgggtctcctgaatacagcacactgatgggtcttgactctttatccaatttgccagtctgtgtcttttaattggagcatttagcccatttatatttaaggttaatatcgttatgtgtgaatttgatcctgtcattatgacgttagctggttattttgcactttagttgatgcagtttcttcctagcattgatggtctttacaatttggcatgtttttgcagtgtctggtaccggttgttcctttccatgtttagtgcttccttgaggagctcttgtaaggtaggcctgctggtgacaaaatctttcagtatttgtttgtctgtaaagtattttatttctctttcacttatgaagcttagtttggctggatatgaaattctagactgaaaatccttttctttaagaatgttggatattggcccccactgtcttgtggcttgtagagtttctgctgagagatctgctgttagtctgatggacttccctttatgggtaacctgacctttctctctggctgcccttaacattttttccttcatttcaactttggtgaatctgacaattatgtgtcttggagttgctcttcttgaggagtatctttgtggtgttctctgtatttcctgaatttgaatgttggcctgccttgctgggttgcggaagttctcctagataatatcctgaagagttttttccgacttggttctgttctccccgtcactttcaggtacaccaatcagacacagatttgatcttttcacatagtcccatatttcttggagctttgttcatttctttttactcttttttctccaaacttcttttctcgcttcatttcattcatttgatcttcaatcactgataccctttcttccacttgactgaattggctactgaagcttgtgcatgcatcacgtagttcttgtgccacagttttcagctccatcaggtcatttaaggtcttttctacactgttgattctagttacccatttgtctaatcttttctcaaggtttttagcttctttgagatgggttcaaacatcctcctttagctcggagaagtttgttattaccattcatctgaagccttcttctctcaactcatcaaagtcattctccaaccaggtttgttccattgctggcgaggtgctgcgttcctttggaggagaagaggcgctctgatttttagaattttcagcttttctgctctgttttctccccatctttgtggttttatctacctttggtctttgatgatggtgatgtacagatggggttttggtgtggatgtcctttttgtttgttagttttccttctaacagtcaggaccctcagctgcaggtctgttggagtttgctggaggtccactccagaccctgtttgcctgggtatcaccagtggaggctgcagaatggcaaatgttgctgcctgatccttcccctggaagcttcgtctcagaggggcacccagctgtatggggtgtcagtcggtccctactgggaggtgtctcccatttaggctacttgggggtcagggacccacttgaggaggcagtctgtccgttctcagatctcaaactctgtgctgggagaaccactactctcttcaaagctgtcagacagggacgtttaagtttgcagaagtttctgctgccttttattcagctatgccctgcccccagaggtggagtctacagaggcaggcaggccttcttgagctgcggtgggctccactcagttcaagctccccacctgctttgtttaccttctcaagcctcagcaatggcggatgcccttccccccagcctcgctgccaccttgcagtttgatctcagactgctgtgctagcaatgagtaaggttctgtgggcgtgggaccctccgagccagatgcaagatataatctcctggtgtgccgtttgttaagaccattggaaaagtgcagtattagtgtaggagtgtcccgattttccaggtaccatctgtcatggcttcccttggctaggaaagggaattatccgacctcttgcacttggggtgatgctccaccctgctccgtgggctgtacccactgtctgacaagccccagtgagatgaacccggtacctcagttggaaatgcagaaatcatctgtcttctgcgtcgctcacactgggagctgtatactggagctgttcctattcggccatcttggaacctcctccacgcccagctaattttttgtattttttagtagagatggagtttcactgtgttagccaggatggtctcgatctgacctcgtgatctgcctgccttggcctcccaaagtgctgggagtacaggcgggagccaccgcgtctggccgcctgaccccattcttgatagtattaaataataccaccagcatccagtttgctggttcagtctcttggggcattattgcgattttttcaatttccttgtagcataacatatatatgtgtaaaattcatgtaacgttttggtatctgttcaaatgctgtaaagttcaattttgaggataatccccaggtagggcatgggagagtgatggtattgtgcttggctatttgcattgcttctttatcagaagcatgtcggagtcccatctcatttgtgattacttcctctcttactataaattgctaggtggagttcactcaggtgacagttacttctttcccccacccaccattagtgacaaaaattccgacggaaatgtttaaattcttccatttggggtcctattcaacaatcagttaataaagccgtgttgtcttctagcttctttcaagatacgtaactagcaagttcatcactgaatctcactttctctgggtgcttcctacaatgttagttatctagtttggggggcgttttagtcattgttactctttccccctctgcccttgtcattaatgtgtcctctggctgtggatttccttagggtgaaggacaggcgagacgtgcctgagtgggcacagagcttggtcagccatggatatgaaagctgctattttcagcccttctgtgggacctgagggtccgcggaggtgcatcctgggccatcaccatagggtcaggggttcagtgggacactaagaacaggtgggctgcaccctttcttccttcaaccacagagatccaaaagtttgaatttcgttagtttacttattttatttttaaattttaaatcacaggtatattgatgtataatttacgtaccataaaactcccatgttgaaagtgtacaatttgatgatatttgctctattcagagttgtgcagctgtcaccagtctgtaattctggaaggttttccttaccccacgaagaaccctgcactaaccgccagtcactccccacatcacaactcccccagccccaggcaaccccagcctacttgttgtctctacacatgtacctgctctagacagtccgtatacatgaagtcatataacgtggctttttgtgcctggctgcttccacttagcatattttttgaggttcatccatgttgcatatgtcagcacttccttccaaaattgctgaattagattccgctttagggatacaccacattttgctcacccatttattagtcagtgaacatttgacttgtgtccccttttttgctgttgtgaacaatgctcctatatgtatgtgtacaagtttttgtgtgaacatatgttttcagttctcttgggtataggaatagaattgtctgctgatttcttttgaatgggtgttttgctgtgagatttcatggagagggaacatctggagaacctaacgtagtcagtaagtttttgtattactgccaaaaaggccaagaaatgagtcaccgggaatttcctaaagacatgtgcttagttcccttctatttgcatttagttcacccgtgttttatttttctgcccccactcaggagaggagctgcctttctcttcgagacatcacgtccagctggccccagtggctgctcatcctggtgctggaaggcctgtggctgggcttgacattcctcctgccagtccctgggtgccctacgtaagcgaacccctgggggtcatcccttgtgcatgtcctgttctgcccagtcagaggttctgggctttcacaggtctcgagtcagaggaattctctttccctcttccttctcctttgaggcctgctttgcatggggagaggagattggcacgtgtccagagtgatttccctgtgggtggtgtgagggtcagcttgaatagaattcgggcctcccaccttcatagtgtgggagcagtttgtcagtgagcgtgcatgagccagaaggacgttttagctggctcatgtttggggctctctgaattgggctgcatacatagccaatataaaccatgttttttttttctctttttggagatggaatcttgctctgtcgcccaggcaggagtgcagtggcatgaactcggctcactgcaacctgcgcctcccaggttcaagcgattctcctgcattagcctcctgagtagctgggattacaggcgcacaccaccatgcccggctaatttttgtattttaatagagacggggtttcaccatgttggccaggttggtctcaaattcctgacctcaggtgatctgcccgccttggcctcccaaagtgttgggattacaggcgtgagccaccgtgcccggcctgaggtttttttattcttgtccctctgttcgcccttatgaggtcttgtcatttacatatgcttttcaccttcctagtggttatcttggtcctgggggcattggagattttggcaagtatccaaattgcactggaggagctgcaggctacatcgaccgcctgctgctgggagacgatcacctttaccagcacccatcttctgctgtgagtgagactcgagttcgcttagaactggaactcaggctttcagaagtgaaggaaagtagaaagagccagcaaacgttaaaccatgcccatttaagaaaacacactgagaactgatgattatttgaaaagtcagctaacttaatgactttagggatcactgtatggcagtgtgtaaacattattttggattttaaagtgagaatgtggagctggacacagtggctcacacctgcattcccagctactcgggaggccaaggtgagaggattgcttgagcccaggaatctgagaccagcctgtgcaatagtgagaccccgtctctgtaaggaaaaaaaaaacaaaaaacaaaaaaaaaagcaagtgagaatgcattgtgtaaatgatcatagcacagtgcttttctgtacgtctcaggtcggatttcctggcagcagaccctgagacagagggtcacatgcaggaagtggatcaggcagtccttgcgggggaataaaggaggcaggaccgtgcagagggagaagttgacctgcacggtcaactttgtaggtagccccagcaaaggccccagccaatcttgggggcaccggggtggcgctgcagaattgttctgaattgaggcaaaggtttgggcccttcctacccctggatggtgcggaaggccccctgcagaaggctgatccctggagaggtagctctctttagtcaagggcagatccagaagaggcacctgtctgagagctgtggtcatgaatacttccagcagctggaggaatgaaggttttgtgctgaaagggttggagggctctgagggtgtgtgacagcacctaattacactgttcatttccagatttctacaatttctgcagtaacatttattttataataaaaaaagaaacatatttaaaaatgttatttgccttaaaagaagataggaagctgttgttgctacagtagggttgaccaaaaagaataaatctggaaattaggaaggtaccgtgcattgcatttgaagctggtcaggaaggcgtcatgtcacaaggcctggagccagcgctgtttgctgcccccgctgcaatcacagtggctgctggactgtgacttgtccctgggagtctctgttccctgctgagtgtccacactgcacactttcttagccggaagcattctgcctgttatccctataagttggcaatgaatttctgcagcaaaaacagaaaaccatgacatactggagtgtattcaggtttgtatttggtctaggagctgtttgtacgtgttttcagatcagtgagtgagtgctgccttctgcttctgtttgttaaggtactttaccacaccgaggtggcctatgaccccgagggcatcctgggcaccatcaactccatcgtgatggcctttttaggagttcaggtatttgttcatttcattaggttactttttctgacaatttatgatattttattcactcatttaaaaaccatttcattaaaataattggaagcatattctctcttgtgctatgggcctaatatattctgttatctttgacagattgtgcagaaccaaaagttactgaaattcagcacattcaagtaattagatataattcttatattctcaaaaaaattcttacttatatggcttatcttagcacggcagtttctagataaaaggtttcccttgccaagctgcagtggctcatgcctataacgccaacattttgggaagccaaggcaggaggattgcttgagtccgggagtttgagaccagcctgggtaacatagtgagaccctgtctctacaagaaattaaaaatattagccaggcatgatggcacacacctgtagtcccagctacttgggagctgaggtaggagtatggcttgaaccaaggaggttgaggctgcagtgagccttgattgcaccactgcactcctggctgggcaacagagtgagaccctgtctcaaaaaagaaaaaaaggttttcctgatggagtgtgcagagtgtgtgggtattggtaacattgggaagtcactgtgtcatttgtcacacttctttcatgtacactcatattagtctgtgtgtcctgacctaacaaaatacccgagactgggtaattcataaagaacagtaacactgcaggttcatttgtctggtgagggtctgggctctcctcccaaggtggcaacttgattggggcatgtccttcaggggggacaaatgctgtgtcctcacacggtgtccccaccagctggtgaaagggcagagacaggacttactgcctcaagcccttttctaaggccattcatgagggtggagccctcacgctgcatcccgtgaatgggattgttgcccttatgaaagagaagccccagagacctgccttgcctcttctaccatgtgaggacagaacaagaagtcgccatctatctgaaaacaggccttcaccagataccgaatctactggtgccttgatcttggacttcccaaccttcagaactgtgagaaataaaattctgtttttcagaagccaacaaaaaattttttttctcctctgtgctatctagtgggacagtccctagccagggtcgctgttgagcatttgagatgtggggagtgtgactgaggaactgaattttaaattttacttaatatgattttaaatttagatggtcacttgtggctagtggttcggctgttgggtagtgcagatctgaagcatacacaggtgaccctggaacacctcggggcatggggacactgtccccccatgcagtggaaaatctacagaggacttttgactcccccaaaacttaaacactaatagcctgctgtggacccaaagccttaccaataacatcaacagttgattcacacatattttatataaatattatatactgtgtttttacaataaagtaagctcaagaaaagaaaatgttattaagaaagccataaggaagagaaaatctagtcctattcattaagtgggagtggatcatcatgaagatctgcatcttcatcatcttcatgttgagtatgagtagtaggaggaggagaaggaagaggaggaggaggaggaggaagaagaggaggaagaggaggagggagtagaggaggaggaggatgaggaggaagagggggtggaggaagaggaggaggaggaagaagagaaggagggtgtggaggaggatggggtggaggaagaggaggaggaggggctggaggaggaggagggtgagggtgtggatgaggaggaggagggtgtggaggaggaggaggaagaggaggagggggtagaggaagaggaggaagaggaggaggaggggtagaggaagaagaggaggaggagggtgtggaagaggagtaggggtcggtcttgctgtctcaggggtaacagaggcagaagagaatccgcatataagtggacctgcgcagttcaaacctgtgttgttcaaggatcagctgtacattttggtgatgaaataattttgtatttagaaatacggcctttatctctgtagcactttctagttgatattgtgcttttccatatattccgtatattcatgtaatccctacatacactttctaggtagatcactggagcggtcagtccagtggggaggctaggagtgcagacctggagccacgctccctgggtttgtgtccagctctgccacttcccagctgggtgacctcgggcgtgtggctgactccctcttgtgcttcaacagcacctacttcagaagggtgttgcaaggattgaataagttaattcatgtaaagttctaagaactggcacataaaaaatgttgattaatattagctattactataaattatttttaaagcttctcatcctttgatgttttcaaaaatgaatacctaatttcagagggattgtatgtgaagtccatatttcactgtttttaaatgtttccctgcctcccccaccctgcctctggttccaccctgtcccggtccctcttcctagtgctgcccagactgggtcaccaaacaggcctgtctgacggaacccttgtcacctttgtggagaattctctttgggccctgcctggaagtaagagccacggagcctgcccaggtgccccttctcctcctttccccatgacctgggcttctgcattccctgcagcagtggagatgtggtgtggctaccatgcttcccccgagctctgtgcctgctgccccattctgctcaggagcctcttcctgcggggaccctctggtgctctggcctcacctctgtggctcgtcctctctgatgcctcctcctccccagagagggcgttcatctctggtcccatgctcctctgttagtctccactagtcaaaggcagaggtgatgtttcccgcctccctgtaatcccagcacctagtagcgtgcccagcaagtgaatctctttgtcaggtagttaagacagtggattaatatgaaataaaaatatccctttggcgattcttttggtcacactgtgttatctcctccaggcaggaaaaatactattgtattacaaggctcggaccaaagacatcctgattcgattcactgcttggtgttgtattcttgtaagtaagcagcattcctcgctaaaattcctttccttcacatgtatagatatttaaaaggaataaaatgtttagcaacactgagctagccattgtcaccacatggcagcaggtaccattttcttcacttgaataacagagaggaacaaatctttccacctaaatgcacagatttattttcttaggaaaatgtctttatcaataaggcagtgtttgccatcagatagccaggaatgcctgaagaaatgtgaggtatgggctctgtgtggagaggcgtatcagagagactgggcaaatcagaccaggttgcagacatcaacttccagattatatgggaaagagagttgcaaggttgactgtttgttcatttcatcctgaccgcagccatgcctcctcttcagagtcactgtcatttaatcagtaagcttaccctcttcaactcagtagaatggtgaagagattttgggagagtatttttcagttcatacatttaaaaaaatatgtttccatttaaaagagaaaaatataaggcacaagtttcagccctctctacgtgattaaataactaatatatattggtgttgaaaccaagtgttttctgagataataatataaaatgttaacatccttctcttccccattacaggggctcatttctgttgctctgacgaaggtttctgaaaatgaaggctttattccagtaaacaaaaatctctggtatgtatggaaaaagcatgattttatggatgactgttcatgctgaaattggatttgttccgtacgagcactgaaacgtctcctccacccctcccaggtccctttcgtatgtcactacgctcagttcttttgccttcttcatcctgctggtcctgtacccagttgtggatgtgaaggggctgtggacaggaaccccattcttttatccaggtaagtcacctccaacctcaaacagagctgggatggtgaccaggaggcaggcccagggacctctggagcatccttggtgctggggtcttgagccactgccctagcggcaggtgtccaaaagccaggctgagggaggaagcagcagggcccacattgtcccagcccacaccagatgtcactggcctgctccagagcagtccaccccattttcaccgtgtaggttgtggagtcgttgtatgacagtttgtgactccacctgtttcttcaggctataccaaattgtggaggagcggaaatgattcagggcacattatccagtttctggttctttttttttttttttttttttttttgagacagagtcttgctctgttgcccaggctggagtgcagtggtgtgatctcggctcactgcaagctccgcttcccaggttcacgccattctcctgcctcagcctcctgagtagctgggactacaggcgcccgccaccacgcccagctaattttttgtatttttagttgagatgggatttcacagtgttagctaggatggtcttgatctcccgacctcgtgatccgcccgcctcggcctcccaaagtgctgggattacaggcgtgagccaccgtgcccagcctctggttcttaataatggtgctatgcttgctttcttaatataaatccactactatagagattgtgcattagaagaaatagcaagaggtgatatcaagggataaatggaatgatttagatgcagttccaaccgaggacttagaaacacatcagatcatttcaatgcctcatttcagccctttgattcgaggaatagttacattctttggacctcagattttctgcctagaaaatataagttattaataataattttagctttcctttcagatttagttttcaagaattgtactgttataaaatgaatattatctaataccttttttgtgtttttgagacacagtcttgctctgtcgcccaggctggagtgcagtggtgtgattttggctcactgcaacctccgcctcccaggttcaagtgattcttgtgcctcagcctcccaagaagctgggattacgggcacaccccaccacgcccggctaattttgtatttttagtagagacggggtttcatcacgttggccaggctggtctcgaactcctggccttaagcgatccacccgctttggcctcccaaagtgctgggattatagtcgtgagccactacaccaggcctttcaataatttttgatatggtttatatttaaatacctaagatatgcattacttatttttggcagtagccaacaatggaagtgcacactttctgttttttcattgaactggtttcaagaattaaatagatggttagatgtgactcatctgtgagaaacatgatcttctgtatgtctctctccttaaggaatgaattccattctggtatatgtcggccacgaggtgtttgagaactacttcccctttcagtggaagctgaaggacaaccagtcccacaaggagcacctgactcagaacatcgtcgccactgccctctgggtgctcattgcctacatcctctatagaaagaagattttttggaaaatctgatggctcccactgagatgtgctgctggaagactctagtaggcctgcagggaggactgaagcagcctttgttaaagggaagcattcattaggaaattgactggctgcgtgtttacagactctgggggaagacactgatgtcctcaaactggttaactgtgacacggctcgccagaactctgcctgtctatttgtgacttacagatttgaaatgtaattgtcttttttcctccatcttctgtggaaatggatgtctttggaacttcattccgaggagataagctttaactttccaaaagggaattgccatgggtgtttttcttctgtggtgagtgaaacaatctgaggtctggttcttgctgaccttgttgccctgcaaacttcctttccacgtgtacgcgcacaccaacacgaaatgccatcactcctactgcggctgctatgaagcttactggttgtgatgtgttataatttagtctgtttttttgattgaatgcagtttaatgtttccagaaagccaaagtaattttcttttcagatatgcaaggctttggtgggtccaaaaaatgtctatcacaagccattttttccttttcctctctcgaaaagttaaaatatctatgtgttattcccaaaccctcttacctatgtatctgcctgtctgtccatcatcttccttcctccctatctctgtgtatctggatggcagccgctgcccaggggagtggctgtggggagggcaggtactgtctttgcctgtgggtccagctgagccatccctgctgggtgatgctgggcaagacccttggcccgtctgggccttggcttcctcacttgtgaaatgagcgggaagatgactctcagttccttccacctcttagacatggtgaggtaacagacatcaaaagcttttctgaaatcttcagaagaaatagttccattacagaaaactcttcaaaataaatagtagtgaaaacttttaaaaactctcattggagtaagtcttttcaagatgatcctccacaatggaggcagcgttcctacttgtcatcacacagctgaagacattgtttcttaggtgtgaaatcggggacaaaggacaaacagagacacacggcattgttcatgggaggcatcgtcaccctcctgggtgttctgtgggaatttcctgtgtgaggaaaacgtggccacagggttgtgctgtacccacccttccccggcgagatggccctcggcctgtgccgctgcttccaccctcgccactccatggcagcttttggtctgtttccggctctgccctctgccctgaactctcatccggcttgtacctgcctgctggacccctccacctggaggccagcccatgtctcaggcccagccctagcctcttctcctcaaattctaagtgttttctctttaggtttccctggctttgtgaatggatcatgtgtctctaggtataaacctgacatcatctttccacccggcttacctccaccagatctccccagttctgtctccatcttctacctgcagctgctctgttctcatggtcactgctgcatcactgagtctggacccttgttatcattttcaaactggcctccttccctcgttccccacttcttaaagtcacctgtccattgccaccagattaagctttctccagccagatcacctctctctgagaaacctccattgacatggaaacaccattgtctggcacacatactcacatactcaccttcccgtcttgatccccacacatctttccagcctcccctcccactccactccctgctctctcctccacctccccatcctcttgtctcccctcccctctgaatccagcccagcggggcttctcctgcctccatcacatcacagaagtacctcctgcttctggttttaattagagccttccccgattacattttcctctgaattttttcctatctacatttgatctgtcatgtttaaaccccctacttctaagggaacttctctaatctcttatcctcatccccaaatagtgttttcttcctctgggttcttataatgttggtatcaatctcacagcatttagtgcttcctgcctggtgtgacagttacctgtgtgcatgtgcaatttctaatttcccacgctagactgtgagcttcctaaggcaagaatcatgccttgttggtttctgtattcctcatggtgccaaacacagtgccttctacattgcaggcgctgaataaacatttttaaagcaaaatgatgtggatttttaaaataaatatttaagtgctggtaagatgagcatgtatccggggtgcccatgaaatgttcttggggccgtgtggggacagtcgtcattcctcctcctgccacccttttctttcagtgagtcactgtggatggtcccagctgtgtcatcccaaagttcagcagggaaagctgagctgggcctctccaggtgagttttctagaagcatttctcaaactgtgggttacatcaacttgggtgtcttgagctgtaaggaaggaactccggagtcagctgggctacaggggagcttctctaagtcctgcgggaggccagacccagcctgagcttgctgttagctagcggaggcagctgctggtggcccaggtgctcgacaccaggcatcccctctcctcccacgaagggtgtgccataatccccttcaacaggaaatgcttcccagaagcctctcagcagcctcccctcctgtcctatcagctagaagcgcctcgcttgtcccaagaccagcagggacagggaactgtccgagcccgtggctgtgtggaggaaggcgacccccagcacaagattggtttcctttgggaagggaagagggagtgtgttggggtaaggggtagagcagaggaatggtcagggggcaacaaccgctgacagctgcaacaggtgcatggcatctcacagggaggcagggaggtgcgagctcctaagtaatggagcaaaaaaattctattctgtagaatggggagagaaaatgtgacattttaatttttttttgcatttatattcctaattcctacttaaagtgaatatactgccgctgtagatcataaaatgtatcttttccatggccaacaaggggcatcttttataaatgcataataacccagtttgtatcaaagggtatcgacttaagtgaaatttcaacatgctgttactttttccttttaatgtaattctgttttccaaataaatgggggagacaaatggactttgagtaaatttcttagcatatcaaactgcctttcacaaacagatctttgtatggattctaagaagactaggagtaactgggtgcagtggcgtgtgcctataggcccaggcactcgagaggctaaggtgggaggatcccatgagcttaggagttcgaggctgcagtgagctatgattgcacaactgcattccagcctgggtgacagagcaagactctgtctctaaagaaagaaagcaaaacaaaattagggatagagttttaaaagtgctaagcaatacaccatataatccatgaccctattaataatgaagcttctggcataattccagcttttaaagtctttatcacacctcttggtaagctttgaaattaagtggggaaacttaccagttacatatttgtgtaatctatcagttttcactagaatgtagtaagccagcatttttcttttagtaataggtttctgttgagcattcattttaaaattgttcttcaagctacatgcatttccaaattcaaagtggatggaaatgcttggccaggcgtggtggcttacgcctgtaattcctgcactttggccaaggtgggtggatcacttgaggtcagaagttcgagaccagcctggccaacatggtgaaactgcttctttaccaaaaaatacaaaaagtcaggcatggtggcaggcacctgtaatcccagctactctggaggctaaggcagagaattgcttgaacctgggaggtggaggttgcagtgagctgagatcacggcgctgcactccagcctgggtgacagagcaagactctctcaaaaacaaaaaaaacaaaaacaaaaacaaactaacaaaaaacaaagttaatggaaatgctagatgtttgcattatgccataaaatgcctcggacttcataaatgccttatctaattgtgtttgtcaaaagactgtaataggcaaaatacgccatcacctgctggctgttctttccagaattccatccaaagtgctagatgtgaggacagctgtcttgcccactgtcaggaggagcttgtggcttcccacagtgtccattaccatttgcggttcggtggaatcctactctgactactggaaatttttctgtagaaatcagttctttttctgattttccacctttcatggtcagctgttcttgtattttatcgtatatgtagtcacacctatacttccataaacgagagtttctattctgatatttggtcacagtctgagtgtcatttggctacaaactggtgcctccctctccctacatcctatgcggctctgtccaggtcacagctggttgagcagaggtacagcccggcagtgtgacaaccccaggtgatgctttcctgtcaaaggacactaagaggacactggccactaacactgtcacagcagggaggtgcagcgtgaatggagagcaaagactggagacgtcttaaagggcggggtgcgtcaccgaggaggcactgagcgggatggctgtccttgtgaccacgccacctggattctgttcattggcgttgtccgggggagaaacaaaccgtctgtctttgtaataggaggcagcgatgcaagttgtaggaagacgcccactgaattgtggcttgcacaggcaggagggccctggcgtgaggggtggccagggagagcccagtgagggacgcagctctggggccccgcgcccctggaggttgccccggaggcagggcctcgaccttgacccacagggctgggtggggctgaaaatgggctcccagaccagcgcgaggagctgcgcccaggcctagcaggcggtttggccgcggctgcagcttagcgtctaggccacgccaggcaggctcccggagccgtccactgccccaccaggaacgttccgggctcttctgctgcgcgcggaagcaagtgaaatccagcctcaaagactctgatggaagaacacctgtgaataccgcgccctctaggcgtccgccacaccccacggccccccagacggggtcttcttttgttgcccaggctggagtgcaatggcgcagttatggctcaatgcagcctcgacctccctggctcaagccattctctcgccttagcctcccaggctacaggcgcgccaacacgcctaatttttttaaactttttttttttttttggtctagcgacggggctcactctattgcctagggtggtctcaaactcctggactcaagcgatcctctggcctcggcctctcaaagttctgggatttcaggcatgagccaccgcaccggtccttgagacttttgacctccgtgcccgcccctccggaatgcccaccccagccaaactcctctctctcctccagctggtggctggggcacggccctctccaacacctctgcccctccgctattgaacttcacatccaagtttatgtcacttctctgtgcccaggccatcggatggccccagctgacagtggcatcccgtccctacagtttggggcttcacccatattcacaaaggaccaggggggtaaggacccccaaccaggcacccacgttggtgaaggctccccacttcctccatcagaatccaccgctggggaaccctggccattcgcgggagctcccaatattccccagtaggcgccccgcccaaactacatcccttctctccactagacctgggctactctctgggagaatgaaatggcctctgccagacagggactcacccaggacacaacccctcatcccgttgaacagactgcgtatgtcctctaggctcaaggaaacctgacttgctgggcctggggcccttaggcctgctcttattcagtattcataagaatcagcaaagcgtttcatagagtccacagattcatgcaaaaagaggagaaaagcacaaacacagcagcacacatgcacaagcacacacacacatgcacacacacatgcacacacatacatgaatacacacaagcacaatgcacaaacatacacgtgcaaacacagacaagcacacacaccacacacacaagcatacacatatgcatacatgcacaagcacacacatacatacgcacccaagcacacatgcaaacatgcacacatgcaaatacaagcaaacatgcacaagcatacagatataagcacacacaagcacacacacacaagcacatatacacccaagcacacatacaccaagcacacacacaaacacacgcacaagcacacatgcacaagtgtgtagaaacacacacaaggacatacgcacaagcatgcacatgcataagcacacacaagcacacatgcacaagtgcacacgcacaagtgcacacaagcacacgcataaacatgcacgagtacatacgcacaaatgcacacgtgcaaggacacagacacgagcatacacatacgcacacacacacacaagcccgcatgcacagagaccttcaaggggctcccccccggcccaagaggaagtcattccgacttcctgcctaggtcctgcagccagagcagcagcaaatgccccaggagacggtcctttcaacttcctgcgcccctcggctctctgacaggcccaggccaggccttattatccctcagtgtggagcccagtgcaagcgccatcacctgctggagggagccgggactccgcacccgggcctgcccgtagaagcctcgtgcgctcgtggctttagtgtgcccttttcctccatgcctgcagtaagagctgaggcttgaccaaacattccgtttgtttcgagcattggtaaagagcaggccaaagggcccgaggccccacgttggcggctgccttgggactagcaggcacgctttgcaggatgggtccagtaggtatagagatcgtttgcgttcttggtccatctctgtcattcccctagagagcagggtaggcctagcccccatctctgtcattcccctagagagcagggcaggcctagcccaaggaaggtctattcggccacaggtttgggccacagcccctggtttggcgaaaaggggggtgcatgcggctggcctgggcagaggacataggcaacctttgccgatgggttcctgggccccgggtcctgtccacccgtggtcatatgtggacatgggtgaagctccaaactgtagggatgggatgtaactgccaacaggggtgagaaggtcctgggcggggaccgtgacagaggctcctgtgtgagatgtttgacagtggaggggcaggaagtgatggagggggccgtgttcaggccatctgtaagaggagagagagaggcagctggcagtgggtgtgcagtaggggtggccacagagagcctagaggccccctattcccagacagactcccatccaaatccttggagaaccccattagtacagccgggaggggaaacggtatggaggttcttcaaaaaattaaaaatagaactgtgatatgatccagctgtgctaagtatttatctaaaggatatggattttgcatattgaagagatatctgcattccagtgttcattacagcattgttcataagagccaaccttatgaagtcaacctaagtgttcatgaatgaatgaatgaatccagaaaatgtggtatatattgacaatggaatactagtcagcctttaaaaatagaaaagggaatcctgtcatttgtgacaacatggataaacctggagggcattaactgaaataaactaggtacagaaagacaaatcccacatgatctcacttatgtagaatccaaaaaaggaattcacagaagcagagagtagaatggagattgtcaggggcagacgagttgattgaggagatgtgggtcaaaggatacaaaagtccagttagacaggaggtataaattgaagagctgcatagtgcaacatggtgactagagttaacaacaatgtgtttacgtctgtgaacctgcagagagaagtcacttgagaactgctgagacagtagattttaagtgttctccccacaacaataaaagtttgttaagtgaggattatgtgaattagctggacttaggcattctacaatatatacatatatcaaaacatcacgttgcgcacatacatatatacaatttttatttgtcaattaataaaactttgataacagaacaccattatgatattgactattgaagcttatactttgaaaattttctaatagcaacattgtgtatttacttcatactttatattactgtattcagtttactgggttcttatgaaataaaataatgcagcaaaaacaaaacacatcatcttctttgtacatttctggcaagacatctgcatagtaagtaatttggctttgcccaaagagaggtctggccccttctgttgacttcagggaggtaacccatatcacacctgacagagtgtccttgtgtagagccgggctgaccacactggatctaatggagaggctgcccacacctaacagtctcagggtatggggtgattatgccagaaagaccaatcatgtaacctagggtagtggctttggtcccctgatatgagtttgtttacctgatgactgacttgacccatgtgagaaatcatcagtcagtcagtcatgtctacataggaaagccccggtcagatctctggacagcagagtgtgggtgggcttccctagctaaaaatactcctagtgtgttgttgtgtatccatgcaggtaggctaacacatccggaggacagtggaagctttgcatttataaatctcccagactcagctctgtgggtctcctcctttggctgatatgagtttgtacccttgccctgtaatacactataaccatgagtataatagcttccactgagctctgtgagtccttctgtgaattactgtatctgacagtggttttgtgaacaccccaagcttgcaaaggcagtcttaaggaatgtgccatgagactttgcagtttggctacttctggggagtactcaacagccaatctcctagcatactattattctataatatgcatcaggattaatcaatatgcacttgggcttagctgtaaatttatgaaaaataattaaaatatgtatctggtaaaataaataccagtagctgtatgcattcggccctaactaaatgctaggtactagacaagtattatttgcttggtttatcacaccaacctgtgagatacatagttatgcctaattctaaggaagaagagaaataaaaaatttaaaaaaaacccagttgattagaatgctactcacacactgtgttgggagaatgttattttaacagtatagacatggtgactataacatgtttaaaagctgtttcttagaatgctttctatacactatgttgcaaatagttttatttcagagactggatatggtggtaacacaataatgcctatagtgtaaagacatatttaaagatgtttctgagaaagctatgtacacactatgttgagatcagtgtcatttccaagaatggatgtggtgagcactctgtatgtagcgttaaaagacacatgtttacagatatttctaagaatgctacacgtacactatgttgtcgtagtcttattacacagaacggatatgaaaacccccaagtaatgcatgaggtggatgcagagacacacatttcacagctgtttgtcatcatgtttctcatacaccatgtggagaacagtgttacttcaggtggaggtgaagcccacactctaatgcatgcagagttgggctaaaagacacttgtttaaaagatatttcttacaaggctacttgtacactatgtcgcatacagtgttgtttcaaagaatggatgtgatgaccataaaataatgcctatagcaaagtactaagacacgtgttttaaagctgctttgtggtattctacatacatactatgttaagaacaatgttttggcagtgagtgatgtgatgactgcaccgtaatgcacttaaggaatgcttaaagagaggtattacaggccaggtgtggtggctcatgcctgtaatcccagcactttgggaggttgaggtgggcggatcacctaaggtcaggagtttgagactagcctgaccaacgtggcgaaatcccatctttactaaaaatacaaaaattagctgagtgtggtggtgcatgcctgtaatcccagttatttgggaggctgaggcagaagaatggcttgaatctgggaggcagaggttgcagtgagccgagattgtgccattgcactccagcctgggagacaagagcgaaactccgtctcaaaaaaaaaaaaagacataggtattacagatgtctcttgaatgttactcttacactatgctgacagcagtgttatttcagaaaatgtctgtggtgaccacactccctgaaactaaaacgactagatgaacacactggggaaaatctctatgacattggtctgggtgatagtgttttggatgtgacccccaaaagtacggacaacaaaagaaaaattaagacaaatgggattacatcaaagcaaaaagcttctgcccagcaaaggaaatagagtgatgagataacctaaggaataggagagagtctttgcaaatcaaactcctgaaaaggagctaatatcccatggcttctaccggcatccatgaaaatggcaggttaatatgacgacttacaataggatggaattgaagaagctgcacacttatggaaagttttggtaatgaggctgggatgctgagagatgactttctggcccctttgtaggcctggtaagaggacctgtgaattctcttggccaagtggtgagcaaggtggggatgagtgtcctgcactgtcctgtctgcgaatgtagcgacgagtgggtgagacaggattgaaacaagcagcctgagtactttgcttgttcatgtttctcctgctaggaaaaaggggtaaggggtccccagagctgacactgagccttgaatgaatccaaagcactagaagttgatatggttgatctgtgagtggcaagaggctgctagaaactaaaggaaaatgtgctttgttagtggctttcttaccagcatggaggtgcccattccctctgcactccgtaatcacccatccaccagtatccaacttcagcatcttgaaagattaagccaagtatgaatgggtatttgagagaggagagtaactctttggagataggtgttcagttaaccatcctgtgtagtcccctggagcacacggggagctctgggtgcagggtaggtggaagccccagaggactgtagggtctagagtggtggcaaatgggcagaaaggagtaaattccggatcctgggtgctctccaaatgctgggatgcccacaggggagaaggtagcacaacccttagagaaaaatcccatcacccaaaccctctcctcaccctagccccttctggccccttgtgcctccacacccttgcacaggggatggtgcaatcttaagtcagcccctgactcagacaggtgtgaatcaccatggtctgtgcttactgagctaatgctaagcgtgcttcatggctctctatagtaaatcaaaaatttgtttgggtgacatatgaccaatgagagttctgtaaatatgggtattaatgaacactatgtgacaatgaagccttttgtattatagaagcacatattcaatgaattctaagcacaatcccaatagtacttatctcattcttaggtcatctttgcaaaggaggcaaagccaagccaggtcctgctgctttgactgatggtgggaagaggcggagtgcatgggtcaccaggcagtggggaagagaggaaaccagcgtggattgcacttcactcacccagctctgtcctcctcctctgattgacatgctacaaagctcagtagggtgtggtttcatagcctgggactcaagaatccgggaattatatgaggacccagcccaggtgcgtctttgggaggcacacgtgagtatctggagtatacagaagacagatgcactgtttactcagggcatggtgtgccaagccgtgtgctaacagcaggttataggctctgggtgacttattctttgggctaactcaacaatggaggaactcattatccttattttacatgaggaaactgccgtttagatggaataaataaatagacaggattaaatggctggtaaatggtaaactgatatctcaaagacaggtcatctgatcgtactttaggtgagctaggcagcctcatgccagctctctacgaaaatgccacaagcagcagagggtgtcatttgagcctttgatgaacaggagaaaacctcaaacgttgccactcatgagaatggggttaagattgttacaacatttgacgggacacctatttgtaacttttttttttacttcactgggaaggagggagacacccatttttatcttaatgcagtccatgaaagtgcctgtaaggcttatatgggttcaggccgggcacggtggctcacgcctgtaatcccagcactttgggaggccgaggtgggtggatcacctgaggtcaggagtttgagaccagcctggccaacatggtgaaaccctgtctctactaaaaatataaaaattagccagatgtggtggtgggtgcctgtaatcccagctactcaggaggctgaggcaggagaatcgtttgaacctgggggggtggaggttgcagtgagaggagatcgtaccacttcactccagcctgggggaaagattgaaacaccatctcaaaaaaaaaaaaaaaaaaaagacttacatgggttttgagtctatctcttggataagactttacgtggaatatattttatctcaaaaagcatttattcagccactgataactctatgaagctctgtaaaatatgtaatgattagacggattaggtgtttcatctgagatgagtaactgtgtttgtaataaaatgtatttataaataagtatgatcatgaatatttaataactagtaaccacttgaatacatgtctttggccagaatatttacatatatatgtacctacactatataatacctattatgtataatttttatatatacactttatattatattacaatatagctgcaccttctgtggcttttgtgggctttattacccaccaaggtgtcagccatcaggtcctcaacagtggcagtgaggaaatcaggcgtgcatgggccaagccactgggcacagtggatctcccacgagaggggtccacagagttcagggggtatggcagctctgctcctgctgagagggtgccaggcagcttcctaagcctataggacctctaaaagtctcctttttctagacacaaggtttggtgaatggtgtggctcggatgttatttgtccccaacaaaactcatgttgagctgggtgtggtggctcacacctataatcccagcactttcggagactgagatggggggatcacttgaggtcaggagtttgagacaccagcctggacaacatggcaaaaccctgtctctactaaaaatacaaaaattagcccagcgtggtggtgcgcacctgtagtcccagctactcgggaggctgaggcaggagaattgcttgaacttgggatgtggaggttgcagtgagccaagatcatgccactgcattccagcctgggtgacagagcgagactccatctcagaaacacaaaaataaaaaatctcttgtgaaatttgatgccaatgtggcagggttgggaggtgggccctagtgggggattttaggtcatgggtgtggaccctcataaagaatgccctcttccaggggtgagttctcactgtcattatttcctgcaagggcaggttgttagaaagagtctggctctcttggtttctctcttgattcacctcttgccgtgtgatctctttgcacacaccttccactctccaccatgagtggaggcagcacgaggtcctctctagaagccgagcagatgccagccccatgcctcttatagttcgcagcctgtagaaccctgagctaaataaacctcttttctttatagattatccattcttaggttgtgtgatagcagcacaaaaaggatgaagacagggagctttgctccgattggcccagcttgatcctgcccctggcctgggccactcaagatgccagtgctcactcccaccgttgtgttcctgtgggccagcccctcactgggatgccattggtgtccacttggcctagaagtgcccatgataggaccctggtcatcctagtgaccaaacctaacctttcatttgactttttattgtagaaagaaatgcgttctggctggtggtagctcatgcctgtaatcccagcacttcgggaggctgaggcaggtggatcacttgagctcaggagtttgagaccagcctggggaacatggcaaaaccccgtctctagcaaaaatacaaaaaattagccgggtgtggtggcatcgcttatggccacagctactcgggaggctgaggtgggaggattgcttgagcctaggaggtagaggttgcagtgagccgagattgcaccactgcactccagcctgggtgacagagtgacctatctcaaaaaaaaaaaaaaaaagaaaaaagaaaaatgtgttcttcagtggaaaaccttaccctctttagaagataccacgccaggttatctgactctagtctgcactcaatgtgtgttttgcaaccctttttaagttttaggtcactgatagacatgcacaatgtgttgtccagtccagggtcaattttctctcctctcacagaggaaggaaatgagctttcttcccatttacatactcatttaaatactcctggttaatattcctctgtttgttggattctttttttctactggttattgtatctgctaatctcttataagttaaataaaatattttaacatgtgtttgtatctttatgagtgccagacttaatttttttaaaaagatgtattttaagcatttttaaggtcacaccaatatgcccaattgattcaactactaggaccagataaatttctatgacagaaagttgcatcaaatgcataactgaagcctgggcgtgtcttttcttggctctcctgcgtgactgcaaaacatcagtggaaatttgttgactctgcttttctcatttcaattttccattctgttaatttcatgttgatgagttttttgccacatttatagctgaaaagctgtttccacttttggcacaagggtttggagtttatttaattctttttattaagataaaatttatataacatttaatatattaatcatgttagaatttacaactcagtgctttttgttgtgttcacaagattttacaatcatcactatgtagttccagaacagtatgacacccccaaaagaaacctcacacccattaagtgctcgtttcctattgctcccctcactccccaaggccctggtaaccactaatccagtttctgttcctatggatttgcctattctgggcattttatacaactagattaataaagtctctggctttgatgtctgccttttgtcattgatcatgttgttttaaatagccgtccatatagaggcacatatcagtgcttcattcctttgtatggctaattgtccattgcatgaatgtgtctcggctgtgtatctagtcttccattgagggacatttgggtggtttccactttttggtgataatcaataatcctcgtatgaaaagcatatcaagtctttgtgtgggcatatgttttcatttctgttgggtatatcttcaggagtggaattgctgggccatatgataaccctatgttaaccttgggagaaacttccaaaatgttttccaaaatggctgcctcatttcaccaaccccccagcactgcatggggctctagtttcctcatgttttcccccacacttgtctgtcttctgaactacacccatactaacaggggtgaagtggatgttgagaatgtcttctgtgctcattgccctcttgtatcatttatttctctatcctgatgtgttgtcatcactaataattgaaagtcctcagaatatttatcccaagttaatttacacatgaaggacatttacaagggtataaaatgatttcctcagtgaatgtagttgtctcatttatttgcaatgtactggatgatagatttgattttcttattagcatactctgcaccctttttgaaataaaccatctgtcatcattttgtatacttagctagtaattttatgtcaaaattcataattcttcctggcctattttaaaagtttgggtatagtggatctaatagcacacacagtctttccatggcttttcttttttttcatgattaatgaaatggatttgaaagatgaatacctaaacttgaaaaacatgggaaaaagtgtcattgaaaacaatgaccacttttggtgaatgcttccaaatattaaaaaaaaaattttttttagtttctaattattcccagttgagttgagttgacacctcctaggagggcagaggctccgtttctggatcacactttctgtcacgggactgctcatagtggtgcttcaacctcggcacggggagagtaaataactgcacagtgtagaagcaatcaaggcagcccacataaactagagctatgcgactaacttaggagattgtctagtccttccacagcaggcagagctaagcctggatgccctggtcatggcccatgaggacaaaggggctgactgtgggaaaacaggcagtgatgagtgcagccatagaatggcaactatattatatagaaatcacttttctctgttttctaatttattaccataaggttgtttatattagtctctacgggtttaaaaactatcaattgttttaatcgtgtttattaatatttaagttagtctcttcatctttttctcaccattgcactaggtctgtgtattttatcataattttattccttttttgttatattctatgtaataattattctatattttactgtctaccttatgctttgttgttacacattactgtatttagcctatgcttctatgtataagttccagagactgacattaagcatgcatattgtcggcatcctttattctagtaattgaatttgcagttatcttattttgcctaaaactcttgaatcaaatagcgtgcacaactttgatttggaggagttatattgtcttctcgtgtaaaaaataatattaggaatattgcctagttttaatctttaaaatttaaaattctttaatatattatttacaaatattattacattataagtagcaaagctaatctctttgattaaaatattttatgcttggtaaaactttctttgaggccaggcgcagtggctcatgcctgtaatcccagcactttgggaggctgaggagggcagatcacaaggtcaggagatcgagaccatcctggctaacacggtgaaatcccgtctctactaaaaatacaaaaaaattaaccaggcgtggtggcaggcgcctgtagtcccagctactggggaggctgaggcagaagaatggtttgaacccgggaggcggagcttgcagtgagccgagatcgcaccactgcactccagcctgggctacagtgcaagactccgtctcaaaaaacaaaacaaaacaaaacaaacaaaaaaactttctttgatatacctaatgctaaatgatgagttaatgggtgcagcacaccagcatggcacatgtgtacacatgtaaactgcacattgtgcacatgtacttaaacaagtataataataacaaaaaaaataaaataaaattacattcaaactataaagttggagtttttatcaaaaagtacagacatttataataaaaacaaagtattttcataattaagccttgtaagttcctattttttttattttatatcaataataaccagcatgaaaaagcaaaaaaaaaaaaaacaactttctttgagaacaaaatatttcaatggtttcattgtgctgaaaaatgtgatacaaagctcagattcagcatatgtcaattaggacaagcatgtgtgtcgtattgttgaaaattttgaatcatcaataaatgttatctgtgttatcacaaatataatcacatcacaaagggtctgttaaagtttttcactgtggtcaaagaactgcacattttatcttatgattctgtcaaaagttcccccttactattcaaaccagcaattatcttccctaaaaaatgaagccatggccgtttttcccagataccttgtcttcagctcctccatggacagtggacggttccaccatagattccttcccaaagatcagaatgtgtggttcatcccacttctttctttggagcaggctaattgagattatcacttgagagataagaatacagaatattctacctccaaagtgttccaaaaaccagttggttttctctatgatccctctccctctttttttttttttttttttgagatgaagtcttgttctgtcacccatgctggagcacaatctcggctcactgcagcctcttgactcctggttcaagcgatcctcccacctcagcctcccaggtagctgggattacaggcatgcaccacctcacctggctaatttttgtaatttttagtagagacggggtttcaccatattggtcaggctggtctcaaactcctgacctcaggtgatccacctaccttggcctttcaaagtgctgggattacagacatgagccaccatgcccggccacaattctaatatttattagctgtgaatcaagttctaattaaaacttcttgataagattcttggctgggcatggtgggtcaggcctgtaatcacagcactttgggaggccgaggcaggtggatcacctgaggtcaggagtttgagacgagcctggctaacacagtgaaaccccgtctctactaaaacttataaaaattagccgggtgtggtggcaggcgcctgtaatcccagcttgtcgggaggctgaggcaggagaatcgcttgaacccaggaggtggaggttgcagtgagccgagatcacaccattgcactccagcctgggaaacagtgagactccgtctcaaaaaaaaaaaaaaaaaaattcttgtgctcactttgccccacccaggccattctgtttacttttacctgaaaatatttgaaaaatatgctactctcttcccaccaaaaaatcacatatctcaaatgattaactttcttttcaggatttaaggtaaaatgacaaaactggtctttgatgtcctgcagtatctgatacaccgttttccttcatgcttcattccaggccacttgctgtggtgttcctgcttttccttttcactttcttgataagcaattactcagtcttttccattttattaaactcttcttatatttctgtgtccagttaatttcaggatatttttaattaatcggttctacattacatactcgtataagctttccattgtctccaagttattagaggcccatttaaaaaagagaaaagagtttttagcttctaaacttctccactaaaatgtttaataaatgaaagttataccagcactttgggagaccgaggcaggtggatcacctgaggtcaggagtttgtgaccagcctggccaacatggtgaaaccccatctgtactaaaaatacaaaaaattagctgggcgtggtagcgggtgcttgtaatcccagctacttaggaggctgaggtaggagaatcgcttgaacctgggaggcggaggttgcagtcagccgagatggcgccactgcactccagcctgggtgacaagaatgaaactcagtctcaaaaaaaaaattataaaatcattttcaaaacatttagtctacacctgccattctcaccccatgacaatcctacgaaggcagaggatctgtttccagatcacactctctgtcatgtgactgctcacagtggcgcttcaacatcggcacagggagagtaaataactgcacagtgtagaaacaatcaagacagcccacataaattagagctatgcgactagcttaggagattgtccagtccttccacatcaggcagagctgagcccgaatgccctggtcatggcccatgaggacaaaggggctgactgtggggaaacaggcagtggtcagtgcagacgtgttcaccagccaccagctggggttagggtacttagccaaaaatggtgtgaagacagaggagagggtatagaatgatgcaaaggtgctcactagaacaaggatgctttgggtcactctgaactcaggggaggacctggtggggaggttagtcctgtgaaggtgttggacccactccctgtgcctgtgccgaataaagaccatggacctgctggcccaggtcatgaggcccaaacacaaaacatcgtaggatcatgacaacgttgtatgtagtaatcctgtaattctgttattacttactgcacaacaatatcccaaatctcttttccgtgtgttatgtttgttactccacttgtcagtcatactcctaagaaaaatggtatttaccagcatgttcagcacctagcacaggagggtgaaggccccaacgtatctgggagcttatagtttcagctctgcccacgtggaatttgtggggccgatcgtgatggcctggaagatactcagaaatcaggtggtgcccatgcacacacccctgcccactctgtggaaacagaaaacaaatttgcacccaatgtcactgaggaaatggccattgtttgtgggactcctttagagagaatgaccaaggagttggctatagtcaggtgctggagaatcagatctgtggactttaatgtgcatctggtgaaataaaggaaactataatgataaagaagaaagcaattgcccaggaatcctactgtggcctgagataagaagatcattcctattgtcacatccctggaggccatttgccatttttcaatgactgatcatcctattcagagtgagaagatcctgcatgaaaacaggaggcctgtggtaccatgacaactgaaatccactcttgtggaccatagttttcaaaccattaatttcctattaaatttcattttcctttttctgagagttttgctataaaaatatatatgtgtatatagatacatattcctagcataagagtgttataacagtgttttatgtataactgttacaacaattctctgaagggctttattgttcccatttgacaggtgaggcaatcttgggcacaggaaagctgaatgacactcccaaagtcacttccttgtaagaggcagtgtcagaagctgctagtgtacttgaccactatgctgtcttagcagcagatatatttatttatttatttattttgagatggagtggagtgcagtggcaccatcgcggctcactgcaacctctgcctcccacgttcaagtcattctcccacctcagcctcccgagtagctgggattacaggtgcgtgccaccacacctggctaatttttgtatgtttagtagagacagggtttcaccatgttggccaggctggtcacaaactcctgacctcaggtgatctgccctccacggcctcccaaagtgctgggattacaggcatgagccactgtgcccggcccagatatatttattttttaaaacaatccacatacttaaaaaaatattttgtatctcttgagtttttaaaagaatggttgtgagtcttgtttttcttttcaattgtgattgaaaacaacattgcttgttttctaggcaaacattatagtgattagagatccaagtaaaatatagatgggctgattttagtataaccttaaaagaataattatataaaccaaatggaatttattgaatgcacaaatggaattaaaagaggaggttcttttccatcttaaccaggaaggagcatacaatagaatgggcatgcgctaagcaagggagcaggaaaatgagtaggagggaaaacattgcaggagaaactaaattaccatgagtgtagaaagaaaatgagtatttgtgaatgcaaaaatatcaaatatagtatttcaatgtcagactggttcactatattaaaacacgagtccaccatgcaaaagaaaaactagaggtaaagattgtacattgactcaaaatagtactaagatgagcactgagactgcgaatggcatgaaaacatttttacaccagaggaaagatcacaaaataatgcaattctgaaaactgctgaagagtgtaacttttttcctgaatacaaaaacctaaggtcagttacctttctttgctgatttcatgaaggaaaacagcctcaccataataaagagacaacagattttttttctgtcacggcacagttacggtctccatttggtatattctatgcacagagttggtgaaaacactatatttactatttctgaacagaataagataattcaatcagctacatcttatacatgatcacaggcatggaggtgtcatggaaacaagtctacaaatcttagaaatgttcatgtagataagagagagcagctggcaaattaatttccaaattatattagagaacttaaaaataggccgggtatgatggctcatgcctataaccccaaaacttttggaggttgaggcaagaggattgcttgaggccaggagaccagcctgagcaacatagggagagcctgtctctacaaaaaattttttaaaatttgctgaatgttgtggcacatgcctgtggtcccagctactcggaaggctgaggtgggaggatcatttgagtcaaggctgcagtgggccacaattgtactctggcctgagcaacagaaagagaccctgcctcaaacaaacaaaaaaagatttaatgactttattgaaaccaacaatgatgaacagcgaggattacattaaatgagaagcagttaggggctggtttatggtcttgacctccattccttctccatgagtccagcccatgacccagtgattatttccctttccctgcattgtgttggcactgacttagtttctagcccagaagattcccatttcccagacaaaagcctttgctccatctcccagtacacttccttctggtgcaggctatgccttctagactgaaatagaaaatactcacctgatttttcccttgctgctgggacaatgcaggtttatgctcaggacagccagcagatgagtgtgcggagggaggcagccagctctcagatatgggtttttgtcctgtgacctcaccatttctcagcacttcaatgagcatttcacctgtggcaacaatgacagtgcacacttggggagctaaagatagtttaaagaaactttgtcacagttaccaatgaccaaaaacaagtataattttctagtgagcatctccagagagatgagagtgtttggcagaggttcttgctttccacgatcccttggaggcaacaggaagaggctcccaaggagggagcaggaagggctgagtccagactgaggggttggcagcagagcacacgcgtcttgccggagtctgtgctttcctgagatggtctcctatggaaaatccaattttctgctaatcctcagattcctgagccaaactatcatttgattatgaatagagaaatgggatcatgccaagaacttgagaaggatgtgtcagcaggttacagtgcaaacagcaacttgaagtccaatactgataggaaaaataaatggaaacaaatttgggcaatccaatgtaacttaacctgcaaatgtagatgttatatattctataaatatatattttatcaacatttacccccagagagatagaagttctaaattgtacaatatatataaaagaaacagacgtttatcagagtccctcacatacacaaaagcaccaagttcatatgatccagaaaggaattctactaatgaactgattgataaactgatgctacctaaactatttgaatcttaaagtagtctatcttcccaatagtttttaggaaaggtgcataaaggtgatatgagaacttaccatggtttgagccacatattacaaaaatataggacatatgaatataactataaaaaatttaaatattagaagcaattggctaggtgctgtggctcacgcctgtaatcccaatggtttgggaggccaaggcaggtgaatcacctgaggtcagaagtttgagacaaacctggccaacatggcgaaaccccgtctctactaaaaatacaagaattagctgggcgtggtggtgcacacctgtaatcccagctacttgggaggctgaggcaggagaatctcttgaacccaggaggcagaggttgtagtgagccgagatcgcgccattgcactccagcctgggcgacagagcaagactctgtctaaaataaaataaaataaaataaaataaaataaaataaaattaaaataaaataaaaagccattagggcagtcaccaatgttctatgagggatgtgtcttggaagaaaaagtctcttctgtaaggattactcaactggtacatgggcaggcaaggtgatccctagtggcctgccagtcttaagaaaaattttatgcatctagggaaaaattggtcacaaccaggcaattagatcgcagcctccccaccaagtaaaacaaaattctgtgttaagcacatgtaaaacaaaacaccagtacaaacccaaaatattttctcataggcattgtagagttttttgtttgttctgttttttgctctcgagagattaataagcagaatgggaccctcaaatttcaaagcatgcaataatggtccccccactcctgggacccctgccaggtatatgtttaaaaactaattcacaactgattttggctgggcgcggtggctcacacctgtaatcccagcactttgagggccaaggtgggcagatcgcctgaggtcagaagttcgagaccagcctggccaatatggtgaaaccccatctctactaaaaatacaaaaattagctgggcatggtggtacacgcctgtaagcccagttactcgagaggctgaggcaggagacttgcttgaacctgggaggcagaggttgcagtgagccaagattttgccattgtaatccagcctgggcaaaaagagtgaagtgaagctccatctcaaaaaaaaaaaaaaaaaaaaaaaaaaaggaaaaaagaaaaattaaggtcctctgtcttgcatgttttaatttttatttgtataaatttaagcggtacaagtgtagttttgttacatggatacactgggtggtgatgaagtttggtttatcacctgaatagtgcacattgtatccaccaagtaatttctcatcccttacaccctcccactcacccacccttctgagtctccaatgactatatatatatatttttttgagatggagtttccctctgtcgcctaggctggaatgcaatggcgggatcccggctcactgcaacctcccgcctcctagattcaagcaattctactgcctcagcctctgggtggctcggactataggtgcacgctatcacacccggctaatttttgtatttatagtagagacggggtttcaccatgttggccaggctggtctcgaactcctgacctcaggtgatctgcccactttagcctcccatagtgctgggattacaggcttgagccagcgtgcctgacctccaatgactattattccactttctatatccatgagtacatgttatttagctcccatttataagtgagaacatggaatatttgactttgtttcttttattttacttaagataataacctccatttccatccacattgctgcaaaagacatgatttcaaggctgggcatggtggctcacacctgtaatcccagcactttgggaggctgaggcgggtggatcacttgaggtcaggagttcgagaccagtctggccaacatggtgaaaccctgtctctgctaaaaatacaaaattagccaggtgtggttagtgcatgcctgtattcccagctacttgggaggctgaggcaggagaatcacttgaacctaggaggtggaggttgcagtgatcctagatcttgccatcgcactccagcctgggcaacaagaatgaaactctgtctcaaaaaaaggacatgattttatttattttttaattttgtagtttatcttagatataggaatacatgtacagatttgttagatgggactattgtggattttattctttttatggctgaagagtaatccattatatacataccacattttctttattcagtcatccattgatggacaatagcaaagatatggaatcaatctaagtgctgctctgagcatacaagtgcaggtatctttttgatataatatttttcctttgtgtacatatccagcagtagaattgctggatcgaagggtagttctatttttagttctttgaaacacttacatactcttttccatagaggttgtactaatttagttcccactaacagtgtataagtgtttccttttctccacctcctcaccagaatctgttattttttgactttttaataattgccattctgactggtgtgagatagtgtctcattgtggttttaatttgcatttctctcatgattaataatgttgcacattttttcatatgcttcatggccatttgtatggcttcttttgaaaaatatctgttcatgttctttgcccactttttattttatttatttatttttagtataatctgtacaacaatctttgcccgctttttggtggggttattttttttttggtgtgtgtatggagttgctttagttccttggaaattctaggtatcagtcctctgtcagatgcatagtttgcaaatatttcctcctattctgcaggttgtctattcactctgtttattatttcttttgttctgtagaagttttttagtttaataagacccatttctatatttttatttttgttacttgtacttttgaggtcttactaataaattctttgtgtggacaaactgttcaaaagagttttgcccaggtttcttctgctatgtttatagttctacaacttatatttaagttttggtccatcttgggttgatttttgtatatggtgagagatatgtgctcagtttcattcttttggatataaatacctgattttcccagcctccctgagtgaaaatggtgtcctttttccagtgtatatttgtgttgattttgtcaaaatcagttggctgtagacatgtgactttatttttggcttctttcttttgttccattgatctatttttatacctgtaccatgctgtttggttgctatagctttgtagtataatttgaagccatgtaatatgatacctgcagctttgttctttttgcttaggattgctttacctcttcaggtttttttggttccacacgaattttaggatttttttttaattctgtgaaaaatgacattgatattttgatagggattacactgaatctgtacatagctttgggcagtatagtcattttaatattacttcttcagatccataataatgggatattttcccacttgtttgtgtcatctacaattacctcatctttgttttgtagttctccttgtggagatctttcacgtccttggttaaatgtattcctaggcagtgggagagaatgataattgtggggatggaatttaaacattatgtatttaagataaaaaatattgtctcaaacctgtaatcccagtactttgggaggccgaggtgggtggatcacgaggtcaggagatcgagaccttcctggctaacacagtgaaaccctgtctctactaaaaaaaaaaaatacaaaatacaaaaaattagccaggcatggtggcgagtgcctgtagtcccagctacttgggaggctgaggcaggagaatggcgtgaacccgggaggcggagcttgcagtgagctgagattgcgccactgcactccagtctgggcgacagagcgagactccgtctcaaaaaaaaaagaaaaatattgtactgagcttatgatttgggggaagtttccaagtcatttaatatagtaagaaccttttctgtcatctttgctaaggctgaattgcaatgttatcatctttagggccccaaaagtaattatgttcacagatttttaatgctttaatctcatgtgtttattagacagtgaatgtttacttaaaattaacccctgacattttccaaattgactcacaaattggataaaagttatatatgcttttatctttaagtctactttaaaagagagtcttaaatttagaaatgccagaatgtatttacatgtttgtaattcaaaatggagtttctgcaaacacttaatttccaaattatatcaatgacatttaaatagattataattgaaatttgatgctaggagtaataatcataatgcaaattagttagaaaagttatgactgctcaaatattactgtcttacaaattacttataattatcatgccgaagttttgacacccatttaaaattcagtttcttagagatttaagcattataaggaaataagaatactctcttcttgtatagatgttaaataaaatatcttgtttcctttaaagatccaagaaattaaaatagcattttataacatgacttatgatagtcaacaatcatgtctttttttaaagaaaattgtaaaaattatttgaatccatgaatattgtttgttctcatttctctgaagccatattaggctaattttgagtgtcaaagttactccatcatgtggttttgagtgttaaaagcaaaacaaatagaagtgaatattctggccaggcacagtggctcacgcctgtaatcctagcactttggaaggctgaggcgggcggattacttgaggtcgagagttcaaaacaagcctggtcaacatggtgaaaccccgtctccactaaaaatgcaaaaagtagccagacatggtagcaggtgcctgtagccccaccacttgggagactgaggcaggagaatcgcttgaacctgggaggcagaggttgcagtgagctgagatcatgtcactgcattccagcctgagtgacagagtgagactccttcacggaaaaaaaaaaaaaaaaaagaagtaaatattctgtggtaacataatagttttttaagcaggacacacattgaccaaatatcttaaattttctttctaagttgttatgaactcccccacatgaaatagtagtcagttatataataaaagttttactgttcttattgaagttggataattaacagcagagtaagctcaactaatttacatgggaaaagacaacaatagtataaataaatttccttcatttgacaccatcaaacaaagttgtttaaactttctcgttcgttttcacatcgttatctcttcaatttatccaaagcatttaaaatatgttcttgttattcttcataataggtaccctgtgagatactgatttttcttttttaattattaacaggcaagaaaacgagagctcaaacaggatgaatttcaagatggcaatggcagaactcaaaattgcatttgtcagtgtccaaaaccactgttcttccacaagtcttttttatatagaattctttttctgtaatctattttgtttatgatagctaaacattcagtttcatttatattatgtattttatcttattgtttttatagtattttctttctctccatacattctaatcagtttattcacatggtcaaacattaacagcagatatttatgacaatttctatttaaaaaccttaaacattgattacattttcaattattttctccatacaggcatacctcagaaatattgtgcgttcagttccaaaccacaacaataaagtgaatattgcaataaagtgagtaacacagactttttggtttctgacacatagaaaagctatgtttactctatagtgtagtacattaagtgtgcaatggcattatgtctaaacatcaatgtacataacttaattgaaaatactgtattgctaaaaaatgctaataatcatctggaccttcagcaagttataacctttttgttggtggaagctcttacctcaattttcatggctgctgaccaatcagggtggtggttgctaaaggttggggggctgtggtaatttcttaaaataagaaaacaatgaagtttgctacatttactgacatcttttaagggaagatttctctgtagcatgcaatgctgtttgatagcattttaccctacagtagcatttctttcaaaattggggttcaccttatataaccctgccattgcttcatcaactaaatttatttaatatttgaattcctttgcagttatctaaacactgttaatagcattttcttggctcatccatgtaaatcattctagaagatccattaaaattttatgatgagattgcagcaattcagtcacatcttcaagctccactgctgattctaggtctctttctatttccaccacagcagtgcttccttcttccactaaagtcttgaatccctcaaagtcatcaatgaaggttggaagcaacttcttctaaactcctattaatgttgatattttgacctcctcccatgaatcacaaatattctttttttttgtatacatagagatgggatcttactatgttgaccaggctggtgttgaactcccggcctcaagcaatcttcccatctcagcctcccaaagtgctgggattacaggcatgagccaccgtgcccagcctccatgaatcacgaatgttcttaatggcgtctagaacagtacattctttcttttttttttttttttacttatttatttatttatttattattattatactttaagttttagggtacatgtgcacaatgtacaggttagttacatatgtatacatgtgccgtgctggtgtgctgcacccactaaatgatagactggattaagaaaatgtggcacatatacaccatggaatactatgcagccataaaaaatgatgagttcatgtcctttgtagccacctggatgaaattggaaatcatcattctcagtaaactatcacaagaacagtacattctttctaaaaggttttaaatttgctttgcccaaatctctctgaggaatcactatctgcggcagctataatcttatgaaatttctttctttttttaattaaaaaaaatttaatgttggtgggtatatagtaggtgtatatatttatggggtacatgagatgttttgatacatgcatgcaacgagtaataatcacatcatggagaatggggtgtccatcccctcagcatttatgcattgttacaaataattcaattatactcttttagttattttaaattgtacaattaagttactgttgagtatagtcagcttgttgtactatcgaatagttgaaatttatttctcagataatatgacttggaagtcaaatttacttcttgctgatccatgggctgtagaatggatattctgtgagcagacctaaaacaatatgaatctccttgtgcatctctgtcatagctcttgggtaactaggtacattatcaatgtatggtaaagttttgaaaaaaatatctttttttctgagcagtaggtctcagcagttggcttaaaatattaagtaaaccacactgcaaacagatatgctgtcatcaggctttgttccatttccagagcaaaggcagagtaggtttagcatcattcctaaggtccctaggattttctgaatggtaaatgagtactggcttcaacctaaagtgtccagctgcattacccactaataagagagtcagtctgtcctttgaagctgtgaaaccaggcattgacttcacttcttagctatgaaagtcctaggagacatcttcttccaatgcaagactatttcagctgcactgacagtctgtcatttggtgtggtcactttcctcagtgaccttagctagatcaaggtaacttgctacagcttctctatcagctcttgctgccttgccttgcactttcatgttacggaggtgacttctttccttaaacctcatgaaccaacttctgctaacttcaaacttttcttctgcagcttcggtcacttcctcacctctctcagcttttacagaattgaagagagttagggagtttctctggattaggctttggcttaaggaagcgttatggctggtttgatcttctattcagaccactcaaaatttctccatatcagcaataagactgtttgctttcttatcattcatgtgtttactggaccagcacttttgatttttttcaggaacttttatttgcattcacaacttagctaactgtttggtgcaagaggcctagctttaaggctatctcagtttttgacatgtcttcctcactaagcttaataatttctagcttttgatttaaagtgagagaaatgcaactcttccttttatttgaatacttagagaccattttagagctattaattggcctaagattgttgtgtctcagggaatagagaggccaagggagagagatggcaaaaagagaagaatgggtggtcaatgtagcaggcagaacacatgcaacacatattgattaggtttgctgtcttctatgggcacagttcatggcaccccaaacgagtacagtattaacatcggaaatcacgaattacagatcaccataacagatataacagaaaggaaaaagtttgaaataatatgtgaattaccaaaatgtgacacacaggcatgaagtaagtacacgctgttggaaaaatgatgccaatagaagtgtttgatgcagcgttgccggaaaccttcaatttgtaaaacactcaatatctgcaaagcacaataaaatgagggatgactgtatactgttcaatatttttttacttattatgaacatggtgcttttttaaatgatttttttgagatgtatctaaatagctgcaaagacattcattgtatgaatgtacaataatttaatgtaacaactatttttaatttttctaaaatatatttaaaaatttttaaatcacccataatattattattgaaattcatgtaaagcagtaaaagcaattagctgggtgtggtggcatgtgcctatagtcccagctactcaggaggctgaggcaggagaattgcttgatcctgggaggcagaggttgcagcgagccgaaatcgcgccactgcactctagcctgggcgacagggcaaacaagactccatttcggaaaaaaaaaaaaaaaaaaaaaaaaaggcagtaaaagctccctcttctgttcatgctgtaattttcccaaaggttaactttcttgtgtggatctttcacaataattttctaagtttgtaattatacatcaataagtatgtatgtagatctgacacagatctcagtcaccggtttccttagcgcacctgtctcatgtatccttggccatctactctgccaccagccatgccctgtggtttcctgctcaggcccaagtagctttgctgcctggtgacaaccagtgtgctgtctgtcctaggagtatagcctctgatacacagccaggtccagcagtgattgcccagagattccagctttttcctctgtaggaactagcaacccataaaatagcttgggctttggcatttgaactcactattgaaagaatgatgcattctggaggtatgagggagttaatgtcctatggggaatactttgtcaatggaaaaagaaggtaggaggaagctgagaaattaagcttctcttcccataatctactctgaagtgggatacctatttttggctcatccagaaaagtgttctatctcaagcagataattgtttcccactaatttactatagttttgtggtttctcataaagtaataaccactgactcccatttctagccaaccttatttctctttctcttacctatgctgccctttttctcacctccaaaagaaaacatctaatacgtgtatcagaaaacacaatataaaataatagatatgtacacatgtgtattaaaaaattaaacagaacaaatattaaacaaaatagctctgaaccatccatcatttcaacaagaaatcacaagggaaattagaaaatatctggagtggattgaaaagaataacacaataaatcaaaatacatggaaagaagctaaagcaatgcttacagggaaacttatgaattcaaatgttttgctagaaaggaagagcgtctcaaatcaattacctaatcaacttaagaaacaaaaacaaaaacaaaaataaataaaataaaagaaataataataatcagaacaacaattagtgaaataggaaacacaaaaacaatagagaaaacaatgaaacctaaaattgtatctttgaaataacgcaactggtagagattttactggactcatcaagatgaaagagagaaggcacagattgtcaatatcaggaatgaaaggcagaaccttacaacagattcaacagaaatttaaaaagaatttaaggctgacatggtggctcacgcttgtaatcccagcactttgggaggttgaggtgggtggatcgtttgaggtcaggagttcaagaccagcctggccaacatggtgaaaccctgtcactactaaaaatacaaaaaaaaaaaaaaaaaaattagccggggtgtggtggcacaggcctgtagtcccagctactgggaagactgaggtaggagaatcgcttgaacctgggaggcagagtttgcagtgagccaagattgtgctactgcactccagcctgggtgacagagcaaggctccatctcaaaaaataaaataaaataaaataaaaaaagtaaggtaatgatgaacaactaatatcaacaagtttaacaacataaatgaaataataaaattcctagatagatattaagtagaaaaactgacttaaaaacaaaatagaaaatcttaatagatgtatataaagtaaaaaaaaattgaattagtaactaaatatattcccctgaagaagagtgtagtgccagatggcttaacctgtgaattccatctaatatttaaggaagaaagaataccagtcatacacaaacattttcagcaaatggagaaaagagcatatgcccaaacattttagaaagccagtattagcttgataccaaggcaggatggcgacatcagaggaaaagcaccaagcaatatctgtcataagtttacatgcaaacatatttaacaaaacggaagcaaattaaatccaacaacatgtaaaatggtgatacactgtaactctctggaattaatcctagtaatgcaaatttggtttactatctaaaacccaatgaacatagtacatcatataaataaaataaagtagtaaatcaatagaatcatctcaaaagacataaaagcattttgacaaaatccaatgctaatttctgataactcacaacaaacatacgtaaaaaagtgaaaaaaactagcataaaggacagaggagagtaattggaattataccattttaaggctcttgccttaaacaaaaatgttaaaatattaattcaagatagactatgataaagatacatattgcaatctttctttctttctttctttttttttttttttttgagacagagcctagctctgtcacccaggctggagtgcagtggcaagatctcagctcactgcaacctccacgtcccaggttcaagcaactctcctgcctcagcctcctgagtagctgggattacaggtgcctgccaccatgtccggctaatttttgaatttttagtagagacagggtttcaccatgttggctaggctggtctcgaactcctgacctcaaatgatctgcccgcctcggccttccaaagtgctggggttacagtcgcgagccactgtgcctggcctacatattgtaatctttcaattaacaaaaaaaatgaaaacaaacagatatagctaagaagacagcagaagtgataaaacagaagactaaaaaataggcacactaaagaaagaatagtttaaaaaaaagaagaaatagaaaacaaataacaacagggtacacttaaacctagtcattttcaacaattacattaaatataaaagggcccaggcttcatggctcatgcctgtaatcccagcactctggaagctgaggtgggaggatgacttgagaccaggagtttgagaccagccctggcagtgagatgctgtctctgtctctgcatgcactgtgttttttttgtttttttttgagggagtttcattctggttgcccaggctggagtgcaatggcacagtctcagctcactgcaacctccgcctccaaggttcaagcgattctcctgcctcagcctcccgagtagctgggattacaggcatgtgccaccacgcccagctaattttgtatttttagtagaaacggggtttctccatattggtcaggctggtctcgaactcctgacttcaggtgatccacccgcctcgtccttccaaagtgctgggattacaggcgtgagccaccgcgtgcccggtcaaaattttttttttctttgagacggagtctcactctgtcgcccaggctggactgcagtggcgcgatctctggctcactgcaagctccgcctcccgggttcatgccattctcctgcctcagcctcctgagtaactgggactacaggctcccgccaccatgcccggctaattttttgtatttttttttagtagaaacggggtttcactgtgttagccaggatggtctcgatcttccgaccttgtgatctgcccacctcggcctcccaaagaaaattttttttaaaaaataaaagattagctgggcatggtgccatgtccctgcagtcctagctactcagaaggctgaggcaagaggatcctttgagcccaggagtttgaggttacaacgagctatgatcatgctactgcagcccagcctgtgtgacagagccagaccctgtttctaatacataaataaatatagaagggctggatatctcaatttcaaagttcggattacttatgagattaaaaaaaataaataagacccaaccctatgctgttcacaagaagcatattttagatatagaaacaacacgtaggcaaaagtatgggtataaatgtgtcatacaaatgctcatcctaaaagaattggtgtgcccatattaatattagataaagtggtcttccaaacaggagtactgccaaagataaaggggtcaagtcacaatcaaaataggccagttcataagattaacaatcttaaatgggtgagcctaatgaaacttcaaaatgtgtgaaacagacatcaacagtaaaggtgacgataatcagatctacttttttaagtgtctgtggaacattaatcaagacagatcaaatactggaccataaaacaattctcaataaatataaaatgatttaaatcatagagggtttgtatactgagcaaaataggactaaattaaacatcaacaacaaaaatatactcagaaaaccttaatatttggcaattgagcaaagaacttctaaataacaatgaataattctcagatatatatgttaatttttttattgtgttaaaattttaacaattttaagtatataattcagtagcattaagtacattcacagtgttgtacaaccatcctattaatcacaagccaaaataaagtacccattaaacagtgactcaccattacttcctttggtattttaggtagagtatataatatatatttcgtgtactttgatattttatgtacagtatataatatgtaattggtgtaatttgatattttatgttcagtatataatatgtatttggtgtactttttgatattttatgtacagtatataatatgtattttgggtactttgatattttatgtacagtatataataagtatttggtgtactttgatattttatgtacagtatataacatgtatttggtgtactttgatattttatgtacagtatataatatgtatttggtgtactttaatattttacatacagtatataatatgtattttgtgtattttgatattttgtgtacagtatataatatatattttgtgtactttgatattttatgtacagtatattatatgtgttttctgtactttgatattttatgtacagtatataaaatgtatttggtgtactttgatattttatgcacagtatataatatgtatttggtgtactttgatattatatgtacagtatataatatatatttggtgtactttttgatattttatgtacagtatataataagtagttggtgtaatttttgataatttaagtacagtaaataataagtatttggtgtactttttgatattttatgtacagtatgtaatatgtatttggtgtactttttgatattttatgtacagtacataatatgtatttggtgtactttgatattttatgtacagtatatagtatatatttggtgtactttttgatattttatgtacagtatataatacgtatttagtgtactatttgatattatatgtacagtatataagatacatttggtgtactttttgatattttatttacagtatatgacatgcatgtggtgtactttttgatattttatgtacagtatataacatgtgtttgctgtactttgatattttatgtagagtatataatatgtatttggtgcactatgaaattttatgtacagtatataatatgaatttggcgtactttgatattttatggacagtatataataggtattttgtgtagtttgatattttatgtacagtataaaatatgtatttggtgtactttgatattttatgtacagtatataatatgcatttgatgtagtttgatattttatgtactctatataatatgtatttggtgtattttgatattttatgcacagtgtataatacaccaaatacaatttatatactgtacataaaatatcaaagtacaccaaatgcattttatatactgtatataaaacaccaacgtacaccaaatacatactatatactgtacatagtttgaaagtacaccaaatacatattatatactgtacataaaatgtcaaaaagtacaccaaatacatattatatactgtacctaaaatgtcaaaaagtacacgaaatacatattatattctgtacatatattatcaaaaagtacaccaaatacatattatatactgtagataaaatatacgaaagtacaccaaatacatattatatactgtacataaaatatcaaaaactacagcaaatacatattatatactgtaaataaaatatcaaaaattacaccaaatacatattatatgctgtacacaaaatatcaaagtacccaaaatacatatgatatactgtacataaaaaatcaaagtacaaaaaatacatatgatatacagtacataaaatatcaaagttcaccaaatacatattatataatgtacataaaacatcaaactacagcaaatacatattatatactgtacataaaatatcaaatagtacaccaaatacatactatatactgtacatcaattatcaaagtacaccaaatacgtattatatactgtacataagatatcaaagtacacttaatacatattatatactatacataatatatcaaagtacacaaaatatatattatatgctgtacatataatatcaaagtatacataatatatattatacactgtacttaaaataccaaagtacacaaaatatatattatatactgtacataaaatatcaaagtacaccaaatacatattatatactgtacataaaatatcaaagtacaccaaatacatattatatactgttcataaaatatcaaagtacacaaattacatgttatatactgtacataaaatatcaatgtgcaccaaatacatattatatactgtacataaaatatcaaagtacacaaaatacatattatacactgtacataaaatatcaaagtatgcaaaacatatatactgcacataaaatatcaacttacacgaagtatatattatatactgtacataaaatatcaaagtacaccgaatatatattatatactgaacataaaatatcaaatcacacatattatatattatatactgtacataaaatatcaaagtacaccaaatacatattatatactgtacatgaaatatcaaagtacaccaaatacatattatatactgtacataaaaagcaacgtacacaaaatatatattatatactgtacataaaatatcaaagtccaccaaatacatattttatactgtacataaaatgtaaaaaggtacaccaaatacatattttatactgtacataaaatatcaaaacgtaccccaaatacatattatatattgtacataaaatatcaaaaggtacaccaaagatatattatatattgtacataaaatatgaaaaagtacacctaatatatattatatcctgtacatcaagtatcaaaaagtacatcatatatattatatactgtacatcaaatatcaaaaagtacattatatattatatactgtacatcaaatatcaaaatgtacaacaaatatatattatataatgtacatcaaatattaaaaattaaccaaatacatattatatactgtatatcaaacatgaaatagtacaccaagtacttattatatactgtacatcaaatatcaaagtacacaaaatacttattatatactgtacacaaaatatgaaagtacaccagatacatattatatactgtatataaaatagaaaagtaccccaaatacatattatatactgtacacaaaatataaaattacagaaaatacatattatatactgtatataaaatatcaaagtacacaaaatatgtattgtatactgtacataaaatatcaaagtacaccaaatatatattatttactgtacataaaatatcaaacataccaaatacatactatatactataactaaaatatcaaagtacaccaaatacataatatatactgtacataaaatacctaagtacaccaaatacatattatatactctacataaaatatcaaagtacacaaaatacatattatatactgtacataaaatatcaaagtacaccaaattcatattacatactgtacataaaatttcaaagtacaccatatacatattatatgctgtgcataaaatatcaaagtacacaaagtacatattatataccatacataaaatatcaaagtacactaaatacatattatgtactgcaaataaaatatcaaaatacacaaaatacatattatatactgtacacaaaacatcaaagtacagaaaatacatattatatactgtatgtaaaatattaaagtacaccaaatacatattatatactgtacataaaatatcaaattacaccaaatacatataatatactatacataaaacatgaaagtacaccagatacatattacatactgtacattaatcatcaaagtacaccagatacatattatatactgtacataaaatatcaatgtacacaaaatacatattatatactgtacataaaatatcaaagtacaccaaatacatattatatactctatataaaatatcaaagtacaccaaatacatattatatactgtgcataaaatatcaaagtacacaaagtacatattatatagtgtacataaaatatcaaagtactctaaatacatattatatactgtattcaaaatatcaaagtacacaaaatacatattatatactgtatgctaaatattaaactacaccaaatacatattatatactgtacataaaatatcaaagtacaccaaatacacattatatactgtacataaaatatcaaactacaccaaatacatattatatactgtacataaaaaatcaaactacaccaaatacatattataaactgtacataaaatatcaaagtacacaaaatacatattatatactgtacataaaatatcaaagtacacgaaatatatattacatactgtacctaaaatatcaaagtacacgaaatacacattaaatactgtacctaaaatatcaaaatacacgaaatacatattatatactgtacctaaaatatcaaagtacacgaaatacatattacatactgtacccaaaatatcaaactagacgaaatacatattatatactgtacctaaaatatcaaagtacacataatacatattacatactgtacctaaaatatcaaagtacaccaaatacatattacatactgtacctaaaatatcaaagttcaccaaatacacattttatactgtacctaaaatatcaaagtacaacaaatacatattacatactgtacctaaaatatcaaatacaccaaatacatattacatactgtacctaaaatatcaaagtataccaaatacatattatatactgtacataaaatatcaaagtacacaaaataaacacttatctttgttctgtcttcacaaatttgcctattgtagatatttcatatcaatggaatcacacaacatttgtctttttatgtctggcttacctcacttagcatcacgtttccaagtttcacccatgttgcatgcatgagaacttcattccctttaatggatgaataatactctattatatatgtatcatattttgtttatccattcatttgttgatggacatgggctgtccctgccttttggctatggcaaataatgctacaataaactttggtgtaaaaatgtctgttccagatcctgctgtcaacttttttgtgtgtaatacctaggagtggcatttctgggtctatgtgtgattctgtgaggaaccaccgaactgctctccacagcaactgcatcattttctgtttttagcagccaattcatgagggcttcattttctccacatccttagcaacatttattttctgtttcattgttgttatgaaagccatatcggaggatggaaagtggtatttcattttggttttgatttgcactttattaatgaataatggtgtttagcattttttttgtccttattagacatttgtatattttctttggagaaatgtctattcaagtcctttgcctattttttaattggaatgttagaaattttgttgttaagttgtgcgatattaagcttttatcggatatatgttttgcttttatcagataaatattttctcacatactacgggtggtcttttcactcccttgatagtgtcctttgatgcataaaatttttcgattttgattaaatctaacgtgttttttcttttgttatctgtgcttttgtgtcatatttcaaaaagcatttaaaactcaaaggtcataaagatttacgtgtgtgttttcttctaagagttacatatttttagtccttacatttaagtcttttgttaatttagagttaatttttgtatatagtgcaaggtaggggtctaacttcactcctgtgcatggatatccagctgttgaagagagtgttctttcctccattgactggtcttggcctccttgctgaacagtcattgaccatatatatgaggactaatttctaggatctcaatcctattctgttattttaaatgtctattgattttatgccagtaccacaccctcttgattactgtagatttgtagtaggttgtgaaactggaaaatgtgagttttccaatgttctttttcaagattgttttgtctatgtcagattctttgaatttttgtatgaattttataatgggtttctctgtgtctgcaaaaaatgtctttgagattttgatggtatcgtattgaatctctagattactttagatggtatggtcatcaaatattgtcttacaacccatgaacacagaatgtctttccagttatttaaactcttcagtttctttcagcgaagttttgtgcataccaccatgtttagatttatgcctgaatatcttattctttgatgctattataaatggaattttaaaaatgtttccatagttcattacagctatatagaaatacaactaattagcatgtgtttgtcttgcttccttcctcttttattagttctgatgggttttgggtattctttagagctttatacacataagatcatgtgtagatataattttacttctatttttcatttctaatttagatgccttttatttctttgtcttgcctaattgctctggctagaatttccagtgctatgctgaacagaattggcaaatgcaccatccttgtcctgttctagatgttaggaaaacagctttcagtgtttcaccattgagcacgatattaactgtcagttttttatatcccattgtcatgttgcagaagttcccttctgtgcttagtttattgggtatttttatcataaaagagagttgtatatcatcaatgctttttctgcatcaattgaaataatcatgtgcttattcattttactgttatagtatattacactgatcggtttataatatgttgagccacacttgcatttttgggataaatctcacttggtgatagtttacaatcctttgattatacagtagtgctgctagtattttgttagtattgctagcattttgctgagatttttgcctatattttcataagggatatcgtgctttagttctctttttttgtgctttgtctggctttggtatcaggataatgctgttatcaaaaagtgagggttgggcgcggtggctcatgcctgtaatcccagcactttgggaggctgaggcagttggatcatgaggtcagtttgagaccagcctgaccaacatggtgaaacccccgtctctactaaaaatacgaaaattagctgggtgtagtggcagggacctgtaatcccagctactcgggaggctgagacatgagaatcgcttgaacccaggaggcagaggttgcagttagccaaggtcgtgccactgcactccagcctgggggataagactctgtctccaaacaaacaaacaaacaaacaactccccgcccccaccccacaaaacaactgaattggcaagtattctttcttcatacattttgttggaagagtttgagaagaaatggtattaatttttctttaaatgttagatagactcacatttaaatgttaggtagatttatgaccaaatatggctatttggtcataaatctttttttgttaaatggtttttgattactagtccaatcttcttgcttgttatctgaatgcaggtctattcagattttctctttcttcttgagctattttggtagtttgtgtctttccagcaattcgtccatttcatccagggcacctaatttgttaatatgcagctgttcacagtattctcctataatccttttttatttctgtaaagttggtagtaatggctctactttcatttatgattttagtgatgaaagtcttccatcttttgctcagtcaatacagtgaaaggtttgatcttttcaaagaatcaacttttagctgtgtttatttcttctactgcttttcaaccttctattttattgatttatactctaatctttattatttctttccttctgctagctttggatttagttttctctggtttttctactgcttttaggtacacagtgaggttactgatttgagattttttttttaatgtgattgtttatatccatacattttcctttgaactctactttcactgcattcaataagttttggtatgctttatttttattttaatttgtctcaaaatactttataatttcacttgtgatttatcctttcactcactggtagtttaagagtacattgtttaatttccacatatttgtgaattttcccattttcattttttatttatctgttgtttcttccattgtggttgtaaattatattttgtatgatttcaaacttttaaaaatgattaggacatatttttgcagaggaagatatggcctatcctagagaaagttccatatccacttgaaaataatgtgtattctgctgttgttgggtggactgttctgtatctgtatattagatctaagcggcttatactattgttcaagtcttctgtttctcatgaagcttctgtctggtttttctacccattaattaaaatgaggtattgaagtgtccaactgttattatagaactgtgtgggtttaaccttttaatcctgttaaattttttcagctttactgaggtataattgagaaataaatgtgaacatattcaaggtttgcaatgtgatgtgtttctatctatatgcacattctgaaatgattaccaaaacgaagtcaattaacatattaattacctcacataatagctttttgtgcgcatgcgtgggataagaatacttaaccccatccccagtgactgcagagtggcccttccagctgttccaggctctggcagaggaggagcagagcgggtggcaccgccaggggagccctcaggcctggcgcgcacgcattccggaggtcgccaggccatgctccgtcgcctgggcgcccaagctgcagccccaaatttttgggtggattgtggttttggggtggatcgcggatttggggctgcacttgggcgctgcccggcaactccccagcccgctcacactgccagcatcgcagagccggggccagaagtcccggtgctgcggccaagccaggcgttctgcccggcggcggctgcacaggggcgagaactgagaacctgccgctcaaccccatcctgggtgactgcggagtgcccatgccagcggcttctgtctccctgcggcggaggagcggggcgggaggcacggcctaggggccctcaggctggtcgcgctggcgatcccgaggccgcccaggccatgcccctccagcccgcctgggcacccaagctgcagtcgccctctgtgtgcaggcagcagcctccgggaaacctctaagcccgcctgctctccgaacatctaagaaccaggaccagatgtccctgtggctgctgccgagccaggcggtccgcccgacggcggctgcacaggggcgagaacctgccgctcaatcccatccccggtggctgcggactgcttctggccagcggtcccgagctccgtcagaggaggacggcgggtggcacgaccagggatttgagggtagattgcggtttttgggtggatcgcggatttgggggtggatcgcagatttagggctgggaggcggggtggaaaggctacctggagccgcggcggctcaggagcgggttgttgagcgtctgagaagtcgccaccacgaggaagcgcttcagcttctggagacgcctgggccaggcggtcctgctccatcgaccacgagtacccggatcccgggtaccacacctgggacgcggaactgcggaagatccacagggcggcagtgaggggcgacgccgcagaggtggagcgccgccgcagaggtcgagcgccgccagatgcgcagaagccgggacttgtacgcccgcgacaggaaagacaggcagcggggcctcagctccaggtgggagggggccctaggcccggcttcccgcagccccgcagccccgcagccccgcagccccgtagccccgaagccccgcagcacctggggcggggatcttggagggcgccgggcaccctcggaacagcgaagccaaacggagcctcagctgctttctatcgctggcaattccccgtctggagcacttggtggagaatttgatttatctcacaaagttaggcatatacacgtttaaaagataagtctcatatacatgatagggaggtgcctaatgagaactcattcccatatcaaaaatgccatgagtcattttcagtaggcgaaaagttctccgataaaaccctgcgtctgttttacatccgaatccacctatgtagataaattctttactggggctccttagagggaaacttggaagtgggaggtgggttccgtgttcttgaatgggaagactcagttttctcaaaatgtgagctctttctatatttatcagttttacgtaaaccaagtgaaaatatcaacgttttaacatttttgcatgacacttgctgtctgtctttttctcttgcgatgacatttaaacatttttataatggagtgaaaaaagtcttgctcctctagatatcaaaatgtgctattaattcccacaattaactgttgactaacagctgaaaagacgtaaatacatggaacaggataggaaatcccaaaacactgagataaatgtaagatatatacgtagggattgtggtaacatttcagatgagtaggaaggtatgagttattaataacgtgtcctatttgaagaaaactaataaaattttgtgcgacaaaaatgagttcctgaaagaatacagattgaaattattacatatgcaaaacgaagaaagtaccagaagaaaacagaaatgcttatttatacaggtacattttatattgacaaaggccttcctaagaatgacctcacaagtaggcattctgaaggttgatttagcaactaaaaattaaaaccccttgtgtatcagaaaaaattaacaaaagatgacatacttgaaaaatgctataattttttactatatataaatatatattaatacatattcagatgaaaagtgtgtctttattctacagggaacttattacattttttattatatataatatatattactgattataacaaattgtatatattactgatataatatgttatatatatcagttttatacacacacacacacacacacacacacacacacacacacagataaaaagcacatctttattttacagggaattctttcaaataaaatccagaagaaaagaactctaaaagtgagcaaagtacttttttgcagatccacaacttaacttacgtacataggaaaaaatccttagtgtttctcataagagaatttaagttaaaagagaaatgagactgttttctatccacaatgtttgtgagaataaagagcagtggtagttatactgctgcttaaagtttaagttgctgatgacttttcaagtagataatttggtggtaattaccacatttaaaaaatctatatgccctttacctatcaattccattatattaaaatacctttagaaaatagagatacatgcactttgttttttctcagcacttattttaacaagaaatgataggatagatcctataaataaatttcagttgcatccataggatggaataatatgtgaccattttgttatagccagtgagaaaaaaaagtcagtttgcttgcatatacacacaaacatactatggtcttgtgttagccaaaactatgtacaaaatatgataaaaattgtaacttctgagcattggtattttaagtaaagtttcttgctcctttttcttatctgtgatttccgcaatgatcatgtataaaacttctagtaaaagtttattattaatggaataatccttgggaagagagaatatgaatcttgcacaggtaaaaataatttctcgctgtctattttatcattattattgcgtgggttgttatcttctttgaacttttagcctcttcagaagtaaaaagggaatctttttatgtatgcttgcagattttattatgtatatattttattaggtacatatgcttttcttatgtatagattcattgaatatatgcaaacaatgacagattaaacatttcattttgtattcttacaaaaataataaatagcaaatataattactatcacaaaaatattgttttataaaagttttatttaaaaatattgaactccacaactgtatttatccattctttcaatccatttattcatcaaacataacatgaatgcttgttatgtaacagacatattctactatctctcaggatccttccatccttaaaaagttcatgtttacctgccctgactgagcagtttaaagaatgtatatataaattacatgtatatatatataaattaattcttttaatttaattagtttagcttagaattcagagttatttcagaagttagttgtagctaattcataatctcaaacagtattgtctggaatcttctgatccatagtcagacacgttatccatcgcaccactggcccgcggtttctcaaacagtactgtctgaaacaaattcatttacctaattatgatccctgaaattctatatatttttgtattaatataaacaagaaattagacttttaagatttttaagttagtgtgttgtatttttctctatagtcatattataacaaattggacttatgcaaatggttcttctatttaatttttataataaatggtttgtatttagtagataaatattaattacacttgattcttgaataatgtgggggttagggactcttatttctgtggaattgaaaatccgagtataacttttgacctcttccaaactagcctaccattgactggaagctttactgataacataaacagtcgaggtacatatatttggtatgtgctgctgcattatttactatgttcttaaaataaagtaagctagataaatgaagctgatataaagaaaatcatagaaaagaaaaaatatacttactattcataaagcataaatgaatcctcccaaaggtcttcatcttcatcatcttcaggtttcctgccctctgcctcttttaatctggtggacctcattctttaagtctcagctcaggcatgatctctagaaaagccatccccgaaggttttattcctattctttacaccccggtgcctaccacttagtaggaactcaataataaatatttggtaaaataaagactgtttatacaaagatgattgctacagtctagctgcaaaggggatagacatgcaaagacatgatgtacagttcaggtggtgaagtgacactagaaaaattgacaaagtactaagggagccccaaggaaggagatgcctgtgtatgtggagaaagatagtcagattcaaggaggatttcacatagcattctgagcctttttttttttctttttctgtttttggagacacattcttactctgtcacccagggtggagtgcaatggcatgattaagactcatagcaaactcaaactcctgggcttaagggagcctctcgtctcaacctcttgagtagctgggactacaggtgctcaccaccatgcctggcaaattttctgtagagtcagggtttctctgtggtctccaggctggtcttaaactcttggcctcaagcaattctccttcctgggccttccaaagtactgggattacaggtgtgagctactgtgcccagcctacattcagagtcttaaaaaatgaaaataaatttgtcagaatagtagaggaaaacatttctgatgtaaaaaatagggtgtacactaataaaggtacaaatggtaacaataattttgcaaattattagtaaataccaacttgcatagcatgttgttaaaaagatactattatgaagtagagaatagtaaagtgttactttatatgtttttactgtatttttaaattttgttttgtttccagaagttttgtttatttatgttgggtggaacaatttgtgagcaaaccttagatttttgcatggcttgaacctactgatacctagtgtctccccaagtggtgcgttgaagtttcagataactagaagtatttcttaaagatgtaaatattccagtaaacattaagctttatttaaactctcaatttataaaataagagtatatattattttgtatcaatttttataaagattatagtcgttatctaaccgttctaagtcactcattttaattaaacatgtggatttgtcagcagaacacgacttaaaagtggcttcagaggaaaagcaagaaaggcttgaaagatgtgaaaataaacagccacaggtatataaaaatttaaattttaatttctggcttactattggtttgtttgtttctttttctttaataacatggtatagtccaaatgaagtgaccttctggactatcccttttagaatccaacagataatcatttcatatttaattttaaaacattttaaccagttataaaatttaaaaaattcttacagtctgtagtaactcatagctatctttacccttggaattgaggccagaaatttccagaagtctctttgctcttttatttttataaccttcttcatgataaagaaggtaacatcaaaaattgagttgtgctactaagcaagagaaattacgaacaatttaacagtgatggccactgaattcaactcatgttaaaggactcatcattgccagtggcccaaactttgcagttttatgttgccagtcactagtggctgaggttaaagacttctgttttttggtctctggttgcctccagtgtctatgttcagggagagaattgggtcataaaatcaacccaactgcctattaagagaatcatgccttccagaatgggacctttggtattaggatacaaacaaaaactttcttattttaacataaatagtaaatgttattaaaaattttaagtccactgtcactagtggaacttagaatatattagaactggatataagcagataatctatctagatacataacactatcatattacagtatagcatttgaagtagaatctaaaaattttcttctctttctaattggtgttcattttggcttctaataatttggcatttgcctaccctacagttaatctttagaagtataaattcactgtaggggttcactatttatggtatgctgaggtaaaagtcttttaaagagagaaagcttttataatactacatatcttctgtgaacctatttctggtagatttaactcataatgaattaaatttagtcccaagaaacaacgagagttaagcttgatggttcatgtttttctcctgtgttagaccaaggcaaattagtttttacttcttagttataatccagtagcttaggggtagcaaaacatagaataagcttcacagttaaattttaattatgttataatttttctttgctcatacttgattacttcagaataaagttaattttaaaacatgcactctgacagagaaggcatctgagaaacaaaacaagcaaatgaattttccacctgcaaaaaaatgtctcgagaacaagaactgagtaagaattgtgataaagaggatatgtctattcagggcttcctttaaaattcattttaaaaacgttcaactgaagattggtgaaagttttgaaatattcaaaattactgtttgtcctgaggaagcgttcgtacatagtaactctaaagagggacaaacttaaagggagtgccctctaatctgatgaatcatatccctgatcatgaggaagcagatgcatctggagtgtctaactgtagtattccaggcattgcctgaacagaaggaatgtctgttcattcttcaaacatgtcttgtcattgcatttataccttgggttcctcaaacaaacttgccagtcatcttctaagctttattcaaatgaaaacaaatcagactataaaaattataacaaacagttataaacagaccatagcctgtttctaacagcgatgaagaaaatggttgaaatgatacagaaaatgaaaaattaaggagctcagtagttacggttgaaataaaagaaaacccagagtttgataatgcaagtgataaaaaatataaaccaaaataccactgattggaaattacacattagacattggcctcagtctagagatccaaaaagtctttttgatttgtggtttggccactccaaagaaatgtatcatgtgatacagatagaaagccacagtatttccgctgttgcagacacttataaaaatagaaaaccaatacagcacttgttccacaattcatgtggatcttagaggctcttctaaagcttaaagatgactggcaagtgtgtttcagggacctacatatgacagtcccactgttaataactataaaagcataaaacatgaattagaagttattctccaccctgtagtgacagaacatcaaaagcatatctagaagaagacttacagcaagatatccaaaggtttaagaatgaggtgggcatgttacaagtagagtccctggctttgaagaaagagaaagtttaactacaaaatgacagaggttcacttgctgttctctttttataagttatctgattcattctgattttctactcaagaaaatctcatgtgtatggttacactgtggttatctaaatgtgtaattatgtgtcaaagtaaattagtgctgctatctaaatgacacttctggaaatattcttgtaatctttgttgattactcaacccaagtctcactattagtctttcaagtggcttatgggctgggaaactaatttagccatataccatgtgatcttctgaaccagataagcataaagaaaattgctaaagaaataagctctagattcttttttctgtattcatttaaagacgaattacatttatttaaatgataaaatggtaatacagtgggagggaagcaatgactgagaagagacataaaaatatatcttgccttgagagttgcaacaaatattcccatccaaagaagtctgtttaatgtgctttcatgcatgcaagtttatctgtttgactcaaactgtttaaacttattattccatcatggtcattttaaatatttttggaaacaaatacatatactttcacatattaaaaaaaatcaccactctccaatgtttctgttgaatcagaatttacgttatgttgtttattaaaatatgttaagttttgacatgtatgattttgtcatataagtagcataacccctcagccaaaaatttagcatttgattctttagttgaaagctgagttctgtacattttgttctaaagatagacaaaaatctagagattttcttttttcaaagtaaaagcagatgaggcctcccactaccctcggaggcatgatctaggagacagcagaaagcagtttcaattctagtcatatttctagctctagctctacatgcaagtacctctgagaagtattttcattggcctatacacaatgaggatactgatacatgtatattataaaataaaaatgtgaaatacagatgtagctaacattttacaactgaagcattcttctagtcactggtaaatgaaaacaccttaactaaatcatatggcaactacatgtgtgaagcttactaaataaattgtttcataaggcattttttatagagaagtatttattctccccagtcattccctgcttactccactttctattgggctttttgcatgtcaaatttgaaaacatgaacaaacaaaataaagtgaacatggtagtttattattatgaaagtaattgtaatgtataagttagatgtccctgtgctattgacaaaattctctaaaaaccttttgaataaatgtgacaaagactacctaagttgatgtccacaatttgagagaaaagaaagacaaaaacagtccttgaggactcagatgcctcaggaagatttaagaagtttttatactttgatggagcttttaagaaaaattcatctatttttttccttgctctggtcacatactgagaggacttacagactgcttacttaatagtatggatttgtatttttcttagagtaaagtagcatcctgattttgaaatagttcctgtagtttgtttaaagaaagcaggaaagaaacaaaacaagaaaaaaaggaaagaaggaagaaaaaaagaaagtgaggaaggaagaagggaaggaagaaaaaatatggaagaaaggaagaatttcttttagagtagtggaaagctgtcaaaatctgcttaagaaaaccgtttgtataaaatgttttgtcttgccctccaaagctcaaagtctctggtcctgctgatggctttcctatctagaatatacagatcttccacaaattgaaaaactaaaatatagaaatatattttgtacaggtggcggatttgaaatgttttatcaaggctaaaacaggatgtatatcattataatacttttccttcacattctgctctgaatttgctcagtcagcaccattccacttaataaggcttagatcaaatcaaatcaaactttgatttgaatattacagaagagaacacatggtaggagcttgtatattctctgtctctcttactctctctcatgtctgagagagaataccttggggttgaccagctagacagtttatgagaaggtagtatctccctgttttcattctccaggaatactgaacagtgtattattgaattatatttgattaaaatatactgatggaaaagagcacttcagagtgtccaaaatggaagtaaatgtaaatctttttataatttataaataccaagtttataaaacgaatcttctcttgtagatttgtagattgtagatttctgctcatagcagaaagcagaggccaagataattttaaattatcttacttttaaaaatataattattttctaaagtgaacttaaagcaaaatctaaatacagaaaaatgcctgattacaagggtgcagctcaaagagcttttacagagttaggcacctgtgaaagcagcacagattaagaaacagcactgagcctccccacccaactcatcgccgtgtctctccatagctacatcctaacttctaattagatttctagattggatttctcaggctttgagtttctcacaagtggggtgatacagtaagttttcttttgtgccttctttttacaaatgattttttgtgaaattcattcatgttgttatgaatagttacaggtcattcattttcatagctttattgcagtccatgtgaatatagatactttgtttatccattttcctatttacagacctttgaggagtttctggagtagggttgatgctaattgtgctgcaataataatatttaacattttttggaaacatgtacacatttttagggcatatttctcagaatggaattgctgggtcatagaacatgtaaagtagatattgccagcagtttttcaaatttatatttttcaaatttatacaagtacttctagtatatgtgaattcaagtcactccacttccaaaccaacacattgtatgtttttaaaaaatatttacatttggatgagtttgtagaaatattatatttaattttgcattttttgtgtgtaatgaagttgagcatctgtttgtgtttatgctggctgtttgaatatcccatcttataaagtgccttttaaaatattttttctatatttctacttgattgcctatcatttattgaatactatagatatgtagaatatacacataaaatatctccttatatctttggccttcatttttattatgctaatagtgcctgtggattcacagaatttctccctttatttgtttgcttttgagacagggtctcactttgttactgaggctggagtacagtggcacgatctaggcttactgcaacctctgcctcccaggttcaagcagttcttgtgcctcagcctccctagtagttgggattacaggcatgtgccactaagctcagctgatttttttgtatttttagtggggacgagtttttgctatattagcaaggctggtctcgaactccttgcctcaagcaatccacctgtctcagcctcccaaagtgctgctgcgatttcagatgtgagccaccatgcaaggccagaatttcttaatttgacataacaattttgttctgttactgttaggtttgttttctaacaccctgtttaagaactatttatcccagggggaataaagttacttatcaaatttgttctgttacttatcaaatttgttctgttactgttaggtttgttttctaacatcctgtttaagaactgtttctcccagggggaataaaattatatttacttatgtaagtgttaactacatgtctcaactgtggggaaaatggattcctagataactctttgtagtactacatccattgtttgaagtgtagtgtgcataaaatttaatgaagacaatttgcattgaaaaagtcacatttctataaagccataaattaattagttctaagacttagcctacttggatgttagtaagttcagtctcagttgcttacattgtgttctcataccctgcatagaaatgatccaaatatgaataggaatttgaggtataagtgttagcagaaaaagaaaatcaggggtgctccatggcttctgtccacagtgggcactgggttggcctttgccttacctaggagatggggtggtggagtgctcaggccagttgtctgcccttgggtgctgctgtcaggaatgagactctcatctcctttcttgaagacatcagtctctgctaccttgctcctagtctcctcctcaagctcaggaaagactaaaaatccctcagatctagttggtttccacctgtaccagtctttcacatctctgtgctttgagataaagcagtaccagctctttcagtgagagttaagacactggttaaatagagtttgatcttcctgcacagtgatagcaggcattaaagatggtaacacaagttaacctttttctaaataatatcaacaactataaaagaaaattcaaaatatgaaaatattctaaaattgtatttaggataaaagtaactatggtacttggatattcactaataaatattcaggatctaaagtttattaatgctttcaaaaaaatagtacctatttttaatttttactttttttgtttttagagattgtggtctcactctgtcaaccaggtgttggagtgcagtgggacaatcatgggttactgtaccctggaactatggagctcaagtgatcctcttgcctcagcctcttgagtagctgggactacaggtgcatgctaccccaactggctcatttaaattttttttttttgtaaatattggatctggctgtgtcatctaggttggtcataaactcctagcctcaagcaattctcgtaccttggcttcccaaagcactggtattacagatgtgaacaccatgcatggccaagaaacagaatgtaatattataaagctatcaactgaagaaaatatatttgatacatatgtaaaatgtaaaacctaaaatctgattttttctcctcttcctcaccacgtgtattattccattctcacattatgataaaggactaactgatactgggtaatttgttaaaaaaagtgggggttagttgactgacagttctcagactatgcaggaagcatggctagagaggcctcaggaaacttataatcatggcagaaagtgaaggggaagcaaacacatctttcgttgtgagagcaagaggaagagagagaagggggagatgatatacacattttaaaagccagatctcatgagaattcactatcaggagaatagcaagggagaaatctgcccccatgatccaatctcctttcatcagcccctcctccaacactggggattacaatttgacatgagacttgggtagggacacagactcaaaccatatcattctgtcctggcccctcccaaatctcatgtccttctcacatttcaaaatacaatcatgtcttcccaacagtcctccaaaatcttaactcatttcagccttaatgcaaaagtccaaagttcaaagtcttatctgagataaggctagtcctttttgcctgagcctgtaaaatcaaatcgatattacttattacttacttccagcatacaatgggggtacagtcattgggtaaatgctcccatttcagaaaagagaaattggccaaaacaaagaagctacaggctccatgcaagtctaaaacccagcaggacagtcattaaatcttaaagctccaaagtaatctcttttgattccatgtttcacatccagggcatgctgatgcaaggagtggtttcccaagtccttgggcagctctgcctctgtggatctgcaggatacatggctgcttttacaggctgatattgagtacctgtggcttttccaggcacacaatacaagctgatggtgaatctactattctggggactggaggactgtggcctttttctcacagctccactaggcagttcccctgtgggaactctgtggggggcaccaacccacgttttccctctacactgccatagcaaacattctccataagggctctgcccctgcagcagacttctgcctggacatccaggcatttccatacatcctctggaatctaggctgatattcctagatgctcagcctccgagcatctgcaggcttaacaccacatagaagccctagtggcttccagcttacaccctctggcacagcagcctgaaacatatctgggacctttttagccttagctgaagctggatgcagggagcagtgtcctgagattgcacagggcagcacagccctgggcttagcccatgaaaccattcttttcttctcagtctccaggcctgtaatgggagggatggcaacaaagttctctgaaattccttcaaggcaattttcctattgtcttggctattaacatttggttcctctttatttatgcaaatttctgtagctggcttgaattcttcatcagaagatatgtttttcttttttaaaaaatttattattattatactttaagttttagggtacatgtgcacattgtgcaggttagttacatatgcatacatgtgccatgctgctgcgctgcacccactaactcgtcatctagtattaggtatatctcccaatgctatccctcccccctccccccaccccacaacagtccctggagtgtgatgttccccttcctgtgtccatgtgttctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacatacgtgtgcatgtgtctttatagcagcatgatttatagtcctttgggtatatacccagtaatgggatggctgggtcaaatggtatttctagttctagatccctgaggaatcgccacactgacttccacaatggttaaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccagtttttcatggggttttttttctcttgtaaatttgttggagttcattgtagattctggatattagccctttgtcagaggagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtgcttgcccatgcctatgtcctgaatggtagtgcctaggttttcttctagggtttttatggttttaggtctaacgtttaagtctttaatccatcttgaattgatttttgtataatgtgtaaggaagggatccagtttcagctttctacatatggctagccagttttcccagcaccatttattaaatagggaatcctttcccctttgcttgtttttctcaggtttgtcaaagatcagatagttgtagatatgtggcattatttctgagggctctgttctgttccattgttctatatctctgttttggtaccagtaccatgctgttttggttactgtagccttgtagtatagtttgaagtcaggtagtgtgatgcctccagctttgttcttttggcttaggattgacttggtgatgcgggctcttttttggttccatatgaactttaaagtagttttttccaattctgtgaagaaagtcattggtagcttgatggggatggcattgaatctgtaaattcatgatattgattcttcctacccatgagcatggaatgttcttccatttgtttgtatcctcttttatttccttgagcagtggtttgtagttctccctgaagaggtccttcacatcccttgtaaattggattcctaggtattttattctctttgaagcaattgtgaatgggacttcactcatgatttggctctctgtctgtctgttgttggtgtataagaatgcttgtgatttttgtacattgattttgtatcctgagactttgctgaagttgcttatcagcttaaggagattttgggctgagacagtggggttttctagatatacaatcatgtcgtctgcaaacagggacaatttgatttcctcttttcctaattgaataccctttatttctttttcctgcctaattgccctggccagaacttccaacactatgttgaataggagtgatgagagagggcatccctgtcttgtgccagttttcaaagggaatgcttaaagcttttgcccattcagtatgatattggctgtgggtttgtcatagatagctcttattattttgagatacgtcccatcaatacctaatttattgagagtttttagcatgaaggattgttgaattttgtcaaaggccttttctgcatctattgagataatcatgtggtttttgtctttggttctctttatatggtggattacatttattcatttgcgtatattgaaccagccttgcatcccagggatgaagcctacttgatcatggtggataagctttttgatgtgctgctggattcggtttgccagtattttactgaggatttttgcatcaatgttcatcaaggatattggtctaaaattctcttttttggttgtgtctctgcccagctttggtatcaggatgatgctggcctcatataatgagttagggaggattccttctttatctattgattggaatagtttcagaaggaatggtaccagttcctccttgtacctctggtagaatttggctgtgaatccatctggtcttggactctttttggttggtaagctattaattattgccacaatttcagatcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgcatctatttgattcttctcttttttctttattagtcttgctagcggtctatcagttttgttgatccttttcaaaaaccagctcctggattcattaattttttgaagggttttttgtatctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccttctacacactgctttgagtgcgtcccagagattctggtatgttgtgtctttgttctcgttggtttcaaagaacatctttatttctgccttcatttcgttatgtacccagtagtcattcaggagcaggttgttcagtttccatgtagttgagcggtttagagtgagattcttaatcctgagttctagtttgattgcactgtggtctgagagatagtttgttataatctctgttcttttacatttgctgaggagagttttacttccaagtatgtggtcagttttggaataggtgtggtgtggtgctgaaaaaaatgtatattctgttgatttggggtggagagttctgtagatgtctattaggtccgcttgttgcagagctgagttcaattcctgggtatccttgttaactttctgtctcattgatctgtctaatgttgacagtggggtgttaaagtctcccattattaatgtgtgggagtctaagtctctttgtaggtcactcaggacttgctttatggatctgggtgctcctgtattgggtgcatatatattcaggatagttagctcttcttgttgaattgatccctttaccattatgtgatggccttctttgtctcttttgatctttgttggtttaaaatctgttttatcagagactaggattgcaacccctgcctttttttattttccatttgcttggtagatcttcctccatccttttattttgagcctatgtgtctctgcacgtgagatgggtttcctgaatacagcacactgatgggtcttgactctttatccaattttccagtctgtgtcttttaattggaccatttagtccatttacatttaaagttaatattgttatgtgtgaatttgatcctgtcattatgatgttagctggttattttgctcgttagttcatgcagtttcttcctagtcccaatggtctttacatttttgcatgattttgcagtggctggtatcggttgttcctttccatgtttagcacttccttcaggagctcttttagggcaggcctggtggtgacaaaatctctcagcatttgcttgtctgtaaagtattttatttctccttcacttatgaagcttagtttggctggatatgaaattctgggttgaaaattcttttcttcaagaatgttgaatattggccgccactctcttctggcttgtagagtttctgccgagagatccgctgttagtctgatgggcttccctttgtgggtaacccgacctttctctctggctgcccttaacattttttcctcatttcaactttggtgaatctgaaaattatgtgtcttggcattgctcttctcgaggagtatctttgtggcgttctctgtatttcctgaatgtgaatgttggccttccttgctagattggggaagttctcctggataatatcctgcagtgttttccaacttggttccattctccctttcacttttaggtacaccaatcagacgtagatttggtcttttcacatagtcccatatttcttggaggctttgttcatttctttttattcttttttctctaaacttcccttctcgcttcatttctttcatttcatcttccatcactgataccctttcttccagttgatcgcatcgactcctgaggcttcttcattcttcatgtagttctcgagccttggctttcagctccatcagctcctttaagcacttctctgtattggttattctagttatacattcgtctaaatttttgcaaagttttcaacttctttgcctttggtttgaatttcctcctgtagctcagagtagtttgatcgtctgaagccttcttctctgaactcgtcaaagtcattctctgtccagctttattccattgctggtgaggagctgcattcctttggaggaggagagatgctctgcttttcagagtttccagttcttctgctctgttttttccccatctttgtggttttatctacttttggtctttgatgatggtgatgtatagatgggtttttggtgtggatgtcctttctgtttgttagttttccttctaacagacaggaccctcagctgcaagtctgttggagtacccggccgtgtgaggtgtcagtctgcccctgctggggggtgcctcccagttaggctgcttgggggtcaggggtcaggaacccatttgaggaggcagtctgcccattctcagatctccagctgcatgctgggagaaccactgctctcttcaaagctgtcagacagggacatttaagtctgcggaggttactgctgtcttcttgtttgtctgtgccctgcccccataggtggagcctacagaggcaggcaggcctccttgagctgtggtgggctccacccagttcgagcttcccggctgctttgtttacctaagcaagcctgggcaatggtgggtgcccctcccccagcctcactgccaccttgcagtttgatctcagactgctgtgctagcaatcagtgagactccgtgggcgtaggatcctccaagccaggtgcgggatataatctcctggtgtgccgttttttaagcccgtcggaaaagcgcagtgttcaagtgggagtgatccgattttccaggtgccatctgtcacccctttctttgactaggaaagggaactccctgaccccttgcgcttcccgagtgaggcaatgcctcgccctgcttcagcttgcgcatggtgtgcgcacccactgacctgcacccactgtctggcactccctagtgagatgaacccgatacctcagacggaaatgcagaaatcacctgtcttctgcattgctcacgctgggagctgtagaccagagctgttcctattcggccatcttcacataagatcatgtttttcttttataccacatggtcaggctgcaaattttccaatcttttatgctctgcttcccttttaaatataatttccaattttagataatttatttacttaggcatattaccgtaggctattagaatcagccaggtcatatcttgaacattttgctgcttagaaatttcttctgccagataccctaaatcattcttttcaagctcaaaattccacagatccctagaccagggcacattgctgccagtctctttgccaaagcatagctgagtgtccttttccccagtttccaatgagtttctcatctccatctgagacttccttagcctggactttattgtccatatcactattagcattttggtcacaacaatttagcaagtcacgaggaagttccaaactttccctcaccctcctgtcttcttctgagccctccaaactttttcaaattcttcccattacccagttccaagtcatttccaaattttcaggtatctggtttttttaatttttcaaaaattcagtttattgagagaagacatatatggtaaaatgcacccatttgaagtgtagagttcagtgagttttgacaaacataacctcaagccacaatgaaaatacagaatattctcatcatgcccagaaagttcccttgtaccccttggtagagagtctttccctccacacccaaccccaggcaaccacagatttgctttccgtccctatggattcgttagcttctagaattggaaataaatgaaatcgtatggcacatacttcattgtgtttggtctcttttcctgttttttgagatccacagacactgctgtgtgtattaatagtcattcatttttactgctgtgtggcattccactgttacaaacataccaaatatccatttcattcttgatggatgtcaggattattttcagtttattgatattataaataaagtagtaacagtctttgcatggacataggtttttgcttatcttggggaaataagagtcgaattgtttggtcacatggaagtgttcatctgcctttataagaatctgccaaactgttttccaaaatgattgtaccattttacattcctttttttttttttggcagggtctcattctgtcccccacactggagtgcaggggtctgatccctgcccaccgcagcctccgcctcccaggttcaagtgatcctcccaggttccagcgattgtcctgccttagtcccctgagcagctgggaccacaggcattcactaccatgtctggctgacctttccatttgtagcagagatgtgtttcgccgtgccggccaggctggcctcaaactcctaaccttaagtgatccacctgcctcgaccccgcaaattgctgggaccacaggcgtgagccactgcaccctgccccattttacattcctatcaacatgtgagcgtttcaactgctctgtatccttatcaacaatgaagactgtctcttttttattttaaccattccagcaagtatgttcagatagctcattatgggtgaatttgcatgttcctgatgaataattataccctgtgtgtgcttaatgcccacccatataccttctgtgagatgcgtgtttaaatctttcacccattgttttactgggttgcttgttttcttattattgagttctaagagttctttatatgctcgatacaagtcctttgtcctatatatgtattgtaagtattttcagagggtgtggcttgcctttttattttcttaactgtctttcaaagaaagagagtcttaaattttgatgagatcccacttatcaactttttcttttgtggcttgtgctttttgtgtcccaagaaatttttgcaaatgttcactgtttttcctgtgactactctgttgccagagccacctgcagataagacaattcctccaccttgaattatcccggtacctctgttgaaaatcaattaaccaaaagtgtgtgggttgctttctgggctccattccaccccaatggcctgcgtgccagtcctcttaccagcaccacattctcatcgctgtagctgcacacagtcttaatattggggtgagtaacttacactgttttggctactcttactcatttgtatttccatatcggttttagattcggcttctcaatttctacaaaaaaattctgctataattacaatagattgcactgaaattatcaattagtttggggagaactgatgtaacactccacgagcaaagtctacatctgtttttatttaggtcttattatttcaatgtgcatgtcctacaaatattttcttaaatttattcctccatatttcaagtttttatatgctactgaaattcctaatgaaattgaatttttaaaatttcattttccaattgtttactgctaatacacagaaatacaattggtctttgtatactgaccttgaattcttcaaacttgctaactttacttattagttctagtggcttctctgtgggttccttaggatgttttatggacactctaatgttgtcttctctatggttcccttgcttcacctcaattcctggcccacctcaattcccagtgaccctgatacccattgtaaggcagggaggcagctgctttctgtcatctgtgctgcagtagtttgggaaatgccctcagttgaaaagcagaaaacgtaaaaatgtcacgtggttcccccctgtctttcaggggtagatttatctttggtctctgcttacccttttgccaggctttctgggatcgccactgtgaacgtgtagtttagtggtcggcctgggatttgggcagttcctactcagattcgggcctcacctcttggtagttttctcgcttctgggattttcgtattaaatttccagtattcttcaagttccagactatctcctctaccatcttaggagagtaaagcctatgtctcacaccactctagtgtggagattatgaaaaacccttaggcaagagagccacaggctcccagttcaaacccactgcagctgctgctttataggagcaaactctcctccagctctggcctgcttttggacactctgaggtccctttaaataattttctgggccgggggcggtggttcacgcctgcaatcccagcacctcgggaggccaaggcgggcggatcacgagttcaggagatcgagaccatcctggccaacacggcgaaaccctgtctccactaaaaatacaaaaaattagccgggcgtgttggcgggcacctgcagccccagccactcgggaggctgaggcaggagaatggcgtgaacccgggaggcggagcctgcagcaagccgagatggtgccactgcactccagcctgggcaacagagtgactccgtgtcaaaaaaataataataatgattttctgtccaaattttatatttatctatgggacagtttgtgcaaccatggttaccagaagttaccagaagttttggctaaagccttctaaatatcttgtttctttctcctttgcgggagtgtagcttgcttcttgagtgactgcagcgagcagctgcttgcgtgcactggctgcctagtgcagccaccctgcttcacctttaagagcaggtctgtgggctccagataccagctggcaaccgcatggcctgcttcatggtatgccacggtcttctcctcaggctgcagaacctgcgttttcttctctaagcgaccaatcacttgctcaattgcctgttcgaagtgtttctgatttatggaatctgacaggtgtctcgcagcaatctacgcagcttcattacagacattagcaacatcagcacctgaaaaccctggagttaaagatgccagttttcttgccaatttctccttctccagggtactgtccagttttagtggtcggaggtgaactttgaaaatagaaccccttccttttatgtctggtagtccaataaagatttgcctgtcgaaacgccccggcctaagcagcgcagggtccaggatatccggttgattggtgctggccaaaatgacgacatttgttgttgtattaaaaccatccatctccaccagcagctggttgagtgtgtcctcctgctcattctgccctccaaagttgccttttcctgtcttccttcccaccacattggaagaggatgcaaggggcattcttccgagcaagggcaaataagtctccgactctagctgggcccacaccaacaaacatctccagaaactcggatccactaacggtgatgaaagggacattggcttttccagctgtggccttagctagcagcgtcttcccagtgcctggagggccagtgagaatggcaccctttgggatttttgctcctaggtcttgatactgctttgggtttttcaagaaattcacaaatttcatgatctctagcttggccttctcacagccacatctttgaactgcacatcaatttcatcctttaagaccttggtttctctgacactaaagagttggcccatccctcggcctgtccggccaatgccagcaggccctcttctgatggtgcagagcaagaaggcaatgatgagcaccgcgggcagcatgctcagcaggaaagagtcatcactttcagcaatgtagacaacaggcacccgattttctccttctatgcccaattcctgctgtaaagtttccagattccattcaaaggtgtccacactgccagtattaaaccaaacgtgttgcccatcaacaggagttcttcctggtgtaaaggtcactcgaacaaaacgctcgttgacaactttcagtctgtctactactccttttgaaacatagttattgacaagttccttccaagtgacttctctcccggatctcttgagcaggaagtaaaacatgactctaccccagaatagagcagtccagacgaagaacatcctgaaatccttgtcgtcccatggaaagtcacccttctggaacctggaccaccagtgagaatcatctttcttgccacctcgttttccaccgccaccacctcctccttcagaagagtgtgtggtagcagctggctttgattcttttttctgtcccataacttctttaggttcattagcatttttcccccatttttttccattaggaaagtatttttcaaatccttttgggggtcgagaacagaatatttgataagcagcaattacatctgtcaaaagagaatttctgctggcccttgcttgagttgtaataaatccataaagcgtccgaaggcagggctgctcgccagggcccatgcctgccatgcacgaagagctgctttaggccgcggggcccagcagccgacccggccccacagctgcaagcagcagcgagccatggccaccgcagtggccctcttggcccgggacgctgcgcaggcgcaagcaggcgacaacgggctgcctcgggaagcgggctccactccgggagaggctgccaggcagcgaagtgcgcccgtggctcactgcagagcgcaagctctcaaccaggtatctttatagtaatattccacttctctggtaccaattttctatatttgtctgttcttatattgctataaagaactacctaagactgggtaatttataaagaaaaaaggtttaattgactcacagttctgcaggctgtacaggaagcatgactggggagccctcaggaaacttacattcactggggaaagtgaaggagaagcaaacacatcttacatggcgggatcagaagaaagagtgagaagaaggaggggacacacacttttaaacaactagaagatattgtgagaactcactcattatcatgagaacagcaagtggggaaatgtgcccccttgatcccaccatgcccctcttccaacactgggggttacaattcaacacgagatttgggcagggacacagaccctaatcatatcatcatggatatcacctttgagaaaaacaaaggttaatcaaaaaacaattcttatcagagtatttttatttgtgttttaaatagttgtcagacaaatcttcagttagaaatcaggccaattttgacttttggtttttttctaagtttaactcctataagtatgtattaaattaaaaatatccagacatcttcaaaattgcgtgatggaaagaagtgatgcctgagtggttcactcttcattttatggccagattgaagttaaggttgtgagttatcaatgactatgatcttccttaggagaaaaaaaaatgtggcttgagtgaagcctctaatctcagtaggctaatagcctccatcactctgttcttgggtgactcatggcttcaaatccctgagttcttgcttgaaaaactttgggtttcccttctgcccacccatggctcaaatcattttatctcccctctctgacacctccttcaatgactaattttagaaaatatatttagcttattttaaacaaaatcttatttttattgaattggaactctgaacttaatttgataaattgaacttaatagggcatataaataggatatctaatataaatgaaaattcaacaaatatgcagagaggtgattcattatttgaaaaaaaaaactgcttccagcatgagaagggtaaagccatgatattctttaacttgtctgtttctttaactcatttatcacgtccaaaaacagaaaaagggtttttttctattacagttaatattgtgtttatcaataaagaattcaaaataaatatcctacatgctttggatgtcttctaggcaatcactaattgcagctaacacagaaaagatgtcatgtgttttggtgacattgttgtatttgataaaagatttttcttcattttctgcagctcctaagcccatgaccgttctgtctccttaccctagttcctcattatgacaggcagaacaagtaggacactgtgcagggaatggaaaggacactgggtggttgtaaaaggttgtctccactcccctctgtgtttgaaaaaactgaacattaagtgctgcatttaaatgcacacacacagttatactgtttgaaacaggttaaaaatgtggtgtgctttgtgatgacttcctccagagtttctcagaagtacattaatatgccaatgtactctcatttttctatgtataccaattataagataaagtgttaaaataattctgaaaaatgtaactgtaatcaattagaataattagaataaaagaccctggtgaccccatccttctgaaaacttcaaaatctgtagaaaatatacaaaaaatacacccagttttagcaaaaattactaaatcctcatagaaatttccattgatcttggacttccaagcctgtagaactgctcagagatactttcttttcttctcttccttttaaagagcttcatggtgtgagtggagtgtctgaggagtagcacctcccagcttctgcctgggcactcacctgagctgaggtgctcacttgagcagaggtgcagcttcggccaccatgggaaaaccagccctccctgggaagcacctctctcccagccttgcctagtgggggcctgggccatcctgcagggcaggtgctgctgcctcccctgcaggtctgcagctctgtattcagggctcacggctggaagcggagcctttatgctatgccctgggtggcacgggagggcaaacaggctccagggctgtgcacaacagcgcagctaggtggtccctgcctggtttcctggcctctgtaaacagaccccagaggggaccctcctcagcctcagtcacacctctgagaaatgctggggactggcatctctgccgagaggaccaggttgtctaccaaaggcccagctagcccatccctccctgcacagcaggcttatgcctggcctggaggcctggcacatacagcagcaaagggcaaacagagcagccggtaggatcgccagcaaaggcaagggtagacccagtggcagaagcctccttggtcagcggcaggcaaggttctccctcccttccctagagtggccagctgccctcacagaactagacctcccttaatcatccccccagggtggcggctgcctggggacccggtccccagcaagggcccctgatcttggctgccttcctctcgctgctgcacagagcctgcatcctcctcctcctcggatcctccttaccctcctcctctacctcctcctcctccttgtgctcctccttcttctcctcaccctcctcctcctcattctcatttccttcttgccctccccctcctcctcttcctctcactcctcctccttctgatcttctcctcctccccctccccctcctcctcctgctcctcctcccctcctcctcctccctcatcctcctccctcttcctcctcccccttcccttcctccgtctcctcttcctccccctcctcctccttcccccgtccctcctcctgcttcccctctctctcctcctcccactccttctcctgcttcccctcctcctcctccacttttccttgccctcctcgtccttgttcttgcatttgctcttctccttcacagcctttccttcctctttgcctttttcttgggctggtccttggagggaatttgcctttctaatcttccttgctgctctccttggggtctgcctcctccagccccagccttgaggtctgagcagcttctgtctgaaggccaggaggtaggactgggttgcaggggctgctgggcagggccctcttcctcctatcacatcagagatgttgtctggcacgggaaacatccaccctccgctgtgtgtcccacgcttctctctcaaagttgggttcattcatgaagaaggacagcatttagcagcggtgggcccctcagggtcgctgacaaagatgcctgctccttcttccctcctcgggtctgagagaggggccctcggcaggggcctgggcctgccccgcttctgagagcgcctgggagcccaggtgcagccctggtgggagcttcccgctcctcggcctctaggcctttgtggaggacatgtggtctctggctctgcccactgctgggtagcccggacagcgccttttgagggacctgccacctcccctgttcgtcctccctggaaagagtgatgttttgactggggttggggaccgagggtggcaggggcttcctgtggtgctgggctctgaggcccatgtcgtcctggagaactgccagggtttctgggggtgtggctctcgcccagggcctccccagattgtggctgttccgctgtggccttggcttccactatctttgtgtccctgggggtgggtgtgtggccgtttctgccaggaatatggagtccaggtgggtgctgggaaccaagtcctccacattctggacttttgctgaggcttctgcagccggggccagctctggaggtgaaggggctgcattggccgcgtgatgtcccagacagcctggaggtgacgctgcgcggtggggcggggtgaccagacgggccccagcggcatgtgggagccggcagggtctccgaccctgggatgttgaggacgaagaggacggtggcggacgggggacaggctgatggggcattgaggggccgctgtgggggcgggcggggtgagggggtctggagctccgggtggacactgcgctcagaagcgtcactggctcctgggaggccaaggaccggctttgcctgttggccgccagcggggacgcggagctgcggctgggagcccccacgtggaggaaagtgcaatgcttctggtcctcagtctcctgctgcaccaccgctcctccagcgtggagtccacctccaactgctttttctccctctgaagctgcaaaaatggaatattgaaaaattcgtgaaggtgctttaggcccgagctgttcttcctggaagactcggcggaggggaacaggaggagcggcctcagcaggatgactcccactggctcctgtcccgcagtccccaggacgcacacctgcgcgtgggcagcactttctgaagccccagagaatgcacttgaaggcgcactgcttggtgatggggatcacctggccagccggtggcagttcttgggcacgtccaggaacttgcatccaggtccattttggactccgcctccttgggttgttctccacctgcaagccccggtctggctgtttgcattttccaccctccactacctccgagacttcaactctcacgacgtcttcagtggtggggtggttcccgtagatgctgtggcctggatccctgcgtggggatatccacctccaccaaatgcttgccctgcggaccgtgcctcagcgcggtggggcgggtggccccgtctcccggatagccatcttcatgttttcacgccacggcgaagcgcctccgtggcctcagctcctggcctgcagcacgcaggggatgttcttgtccccgccggggcctgctccgaccccaccagcttcttcagggcgggaaccatctttctactgggacgtccgagcccggtggcggccgggaagctcagcggcagcggcggagcagctcgactcgcactgtgtccccgcgggacaggcctcccgctaggcccgggacccacggcgccacgcggcctccagccagggctcccgacctcagcgcagctccgccatgtcctgcggcctccggagccgccgcctccagccctcggcgccgccacctgggagccggctgcgcagggcgccagcgaaaatcgcatttctgcttagaagccacccagttcacggtgttgtgttatggcggcctgaacggactgaagcacatagtgactatgtctgtgctcgcttttaaatttacttttatctttttaaaatttttattagttttcccggaaatcttgatgttttacatagcctcaaattccttcttggcaaagttatacttgctaaatatttagtagtttcagcaactgtctgaaaagacacaattatgctgctaaaaaaacaaggaagaaagaagagacagcaacagacagagtttgagaatttgaattttctatacacacagattaaattttgcaaataatgtttctcttcttttctgttgaagtaaaaacacccaaactttcctgtatatatttgtacaactgaaatcccccctggactgtcacccttgccctaactaaaaaatcagttatattctagaaaatgagaaagaaaatataatgaagataaaaacatgtattaaacatggttatctgaacggactgaagcacatagtgactatgtctgtgctcacttttaaatttacttttatctttttaaaatttttattcgttttccccggaatcttgatgttttacatagcctcaaattccttcttggcaaagttatacttgctaaatatttagtagtttcagcaattgtctgaaaagacacaattatgctgctaaaaaaacaatgaagaaagaagagacagagcaagagacagagtttgagaatttgaattttctatacacatagattaaattttccaaataatgtttctcttcttcttttctgttgaagtaaaaacactcaaactttcctgtatatatttgtacaactgaaatcccccctagactgtcacccttgccctaactaaaaaatcagctatattctagaaaatgagaaagaaaatataatgaagataaaaacatgtattaaacaaaaatgcagtgataaaatcgtgagtttcaaaataccctgtgagctttgtttgttaagtccagggaaagagtaacaaagataggcattaggtgtgcaggtcatttacatgtgtttatgtggccatgtctaccattttctctttaacttttcataacgtggaactcatttctttaggtagaagttatgagttaactatcttggtagtgtttaaagaacaagcattctttaaaagtccattctttttcttcatttttgaatatgcatagcattacagaaaaattggaaagtaaaccagaaaaatacccataatctcaccattccaatacaatgctgtctgtgctttttcaaaaaaaagggacctcaatttctaaacttagagaaaaatctctagcttttgaatttttttatattctgaatttttgatgaagagttatgaatttttgatgaagaagtatttgtttactgcctctagcattgtattttaaaagagaccggtcaaaatttgattttaaaacaaaggattaagaactcttccatttgtgcttattttacatctatcaggtgagagtaaaatcactgatttaaagacctctgagttttcacaacacaaggaaaaataaatagacaccacccttactgttttgtacattccactgaaatataagttccttgtggacaggggttttcatctgttttatttgctgctgtatcccagtacctggcacctagtgccacgtaggaagtactcaagtacttgttgactgagctaattaaaatagtttcaccatagcagaattgcctttattctgtgggggcgacccatgtaagtttatcttttatgtcaaaaatgccattttaatgcatttatgaacatcttcaaattgcatcataggttttgttaatttttttaactagagtacttcagacatattttgcctgctgactcaatggtgtcattatgaatattactataatttttaggtgggccagtgaagcttgtgttaattaccatgaactgttgttttgatgacttggaatagattaggatgaatgttgtaaaggtttttctatttctgctggaatcttctgtcattctactcatcatcatctaggtaatggtctaaggctggcaccatttctcttatcaagtaacgcaaatggactttttggcagatagttgttgtttaacaacttttgtttttagtttcagagactatgttctggaatgttgagatttcttcatacatgacctctagagaaataggcatattataaaatgagttacactgtgtaactgagggcatgtgctgatggcaaaattattatcttcaagaattttttttttagtgttctgcatttgcccacactgttagaaatggaatgttagagaatatttattattttgttgctatcaaagcaaaatttgcagaaacttgaatttattgtaattactgtattaactctgaaatgcatggctatgttttaagggaggtttttgccttccatattgttctcgttctactttttcttttactcagaaggacttaatctctaaacattagaaaatgttttatacagagacaggtctcactgactacaattagaattataagaatctcttcatttgtattagttgataaaagtattttttcctgtttttagataacagtcctccaaaatttatattactattatcaattcacttcttaagataagcacaatgaagtagtgcctctgggtgttaggattatgtagttttaacatttacattgattatctgtattttctactaaaaaaaaaagcctatacgatttaatcaatatgttaccaatagataacaaaagtatagaatactgtttctgctcctttaatagcgagactttactctaatttcatggtggttctaaggtagtagtaagatgcaaaaaagaggtgcagatgtgacaagaaaagtgagcaaaaagtaataatgaacccacttaagaaattacatgtctgtataagtattaaagataaagcttaggcagggcgtggtggctcaggcctgtaatcccagcactttgggaggccaaggagagtggatcactcgaggtcaggagttcaagaccagcctggcgccaacatggtgaaaccccgtgttgaataaaaatacaaaaattagccaggaatggtggggcgcgcctgtaatcccagctacttgggaggctgaggcaggagaatcacttgaacccgggaggtggaggttgcagtgagccgagagctccccattgcactccagcctgggcgacaagagggaaactatgtctcaaaataaataaatacataaataagaagaaataaaaaggttaaggatctgacacagaaatgcacacattttcttctcaactatcaaaagcaggaggaaaatttttaaacttcccagagatgagttttctaagttttattttccaaacttcactcttattaacctttaaaacaacactggtagatcatttctgaagtgaagttttaaaatattcccttcactgtctgaaagcaaaatataacccttagttttatcaatttgtaatttttagttaaagaaacaacttgataatggggactaagggaaataaagtttctctgcgggagtccctgctgaatgccgccctgagctagcgggcgacgctgcgcttccccgctggagggcgccatcatcccatccacagagagctcagcaggccacgtgccgcggcctgctgcgaacccgcagggactgctccctggctggcggcacccttattgttcaataaagacctggttcagagacaaaggtggccctgtcagtagctctgaatagccccaagctagttgctgatcctaacaggcccaattaactgctactcatttagcaaagcggcccgggacccatcccgcttcccgctccaccttctgaaactctccctgcctgggtaccttggctatgggctttgcagtctccctttagcggatcaaaggtgtgtgggaaagaatgacggctggatccgcctccacaggtccttacacagacgcacacatcacagccagacccaaagcactcatggtggtgagcgagagcccgaggtggaattccagggccggtctcagaacaacgccttgattgccgtgattcgaagagctatctcaaaacatttcgcttcagtgaagtgcctgagaagaaacactcgtcacaactcactctgctgctgacactggatgtactcaccttaggtcctcccactgccaggctgcctggcctcgggaacacgctgacacacacaagaatacacactggagctggcttccttcctcctcacaactaagtatattcctgttctagaagtcccccaggatcatgttagacaatgtgggaaacagacgggcagaaacagaaagggaagaaagagaacccaatgtccccatgcaacaattagactttggtgatggaattttctcatattatagaaggtgccttgtcaacatcatgggtagtgacaatataatattctatactgttctcattcatttcccattctctaatacctgtggccacttggttttttaattttttgtcattatgagcattattgtacataaaaatttccccatatttttgggtaatttacttatttttccttttttttgttttttttttttttggagacggtgttttgctcttgttgcccaagctgtatgtagtgcagtagtgcgatctcagctcactgcaacttctgcctcccgggttcaagcgattcttctgcctcagcctcccaagtagctgggattacatgcatgcaccaccacgccctgctaactgtatagttttagtagagacggggtttctccatgttggtcaggctggtctcgaactcctgacctcaggtgatccacctgcctcagtctcccaaagggctgggatgacaggcatgagccatttttgggtaattttcttagaatttattttgaaagcaaaattaagtcaaatttcagcctaatcaaaactaggtaaaaagatgctaggtcaagggatattgatacatgttgctaaattgttttccaacagaattggaacatcttttttttctgcccagcaatcattgacaccagtttatcagatatccaccagcaatgtgttatccttttttggaaatatttatacaattttatgttagactattactgtaattaaactttcccacgtgcttgttaacagtatgtggaaattttccatgtgtttcatcaacttgccgtgtccataacaatttttctaattgattgcctgattgctttatatagcataaatatttcctgttgtttcattcaattttgattttttgtagatacatctattttttcatttttaggtagttaaatatatcagttttttaatttattctatttattaaccttggttatttgttatttttatgtattttacttttcaaatttatttggaatccagcttctgaaggtacaaattattttctgtataccaaagcaatgaacatttcatgtgtcattttagtaaaatgttttatttccttttggatatatactacgaataggattgctatatcagatggtagttctgtatcaagttctttgagaaatctccaaactgttttccacagtggctgaactactttgcattcccaccaacagtgtataagtgttcccttttctccccagcctcaccagcgtctattgtttcttggcttttgcatagtagccattctgactagtgtgagatggtatttcattgtagttttgatttgcatttctttgatcagtgatgttgagcattttttcatgtgtttgttggccgcttgtatgtcatcttttgaaaagtgcctgtttctgtcttttgtccactttttaattggcttatttggtttttgcttgttgaatgaagttccttatagattctggatattagacctctgttggatgcatagtttgtgaatatgttctcccattctgtatgttgtctgtttgctctgttgatagtttcttttgctgtgcagatgctcttcaggttaagcaggtcccacttgtcaatatacattttcattgcaattgcttttgaggacttactcataaattctttcccaaggccaatgtccagaatgatgtttcctaggttttcttctaggattcttatagtttgagatcttacatttaaatcttaaatccatcttgagttaatttttgtatatgatgaaaggcaggggtctagtttcattcttctgcatagagctagccagctatcccagcaacatttattgaataagtagtcctttccccattgcttatttttgttgactttgtcaaggaccagatggctgtaggtgtgcagctttatttcttggttctctgttccactgggctatgttgttttgttttgttttgttttttaccagcaccatgctcttttgatatagtttgaagccaggtaatatgatactgatacctccagctttgttctttttgcttaggattgctttggctatttgggcttttttttggttccatatgaattttaggatatcaacttgggttacatcagtggtggattggataaagaatatgtggtacatatgcaccgtggaatactacacgcagccaaaagaaatagtgaagtcatgtcctttgtagcaatatggatgcaactagaggccattatcctaagccaattaacacaggcacagaaaaccaaatactgcatgttcttacttatgaaaggaagctaaatactgagtactaatggacacaaagatggcaacaatagatactggagactaatagagggaggagggctggagtgggggaaggattgaaaaactaacctgggtactatcctcactatctgggtgatggaatcgttaatatcctaaacttcagtgtcaggtgatctacccatgtaacaaacctgcacatgtactccctgaatctaaaagaaaagttgaaattgttttaaaaaattgttgaaagaaaaaaaaataataagtatgaagaacatttcttaacagtattttgtagtccatctcttccccactgatgtggatgactttcttcaagtatcttaagttttatgtaactataatctacgtctgaatgatatgtcctcttcttttttcttttgttctccagcaacttttcttggtcaaagaatgcagaaggatatatggtgtctgtggtttaattaacaggattgtttgtaaaacaactttacatttatcttatttttaaaattcttgcttttgaatagctgatgtattagaatagacactctcctatcccatgcaaaaagctgttaaaaaatgagcagcttgcaaatctatcataaatgagacattgaataaagcattcttacagtgagggctaaggagcagttcagtctagaatttgcttcagatactttttgaaataaaatattcaaggcataaaaaagcaaaactcgaaatatctaaaacagatacctactgatatttttaccctagtctcttcccacagtttttatgtgtctctgtgctccactgattcaaacaaacaacaagagcagtaggcatcttctaactaaaagttaatttactagtcttcaactaaaaagtcacagtggaagaacatatgtaaggtgaagaaagctttttaacctttcagacttaaataatactgtatttcaactttaaagaaaggctccactatatattttctgcattgacattttaaaatatatgaacaagtctttgtggtacaatatatacttcaatatatccaatataccttatatgaattaaaaacatgtcaacttgataactgtagtaaggcatttaagtattcagaggagccataaagaaatttcttaatgagtgctgtccttttaatattaactggatttagtaggtttccttaaaatgaacaggaaacaggccgggcgcggtggctcacgcctgtaatcccagcactttgggaggcctttggcaaattagaccccaccccatctgagacttcacctcctgcaactctgccgtccaccacccttactctagccacattactgccaagcataatcttaccatagggcctttgaacgggctatgcctccaccagaaccacttttcccgtttatctgatcactccttcaccttcaagtcttgatcaaatgacagcttcacagtgacaactttccagtccatcgtaatacagattatgcttcccctctactcagccccaccccttgatatctgctttattttcctttatatgacttatcactttctaactttttaaatatttcagatatttgtgatgtttgttgtttgttggctccccctaaaatgtatgatccaagaatgctgggattgctgcttgttctgtttcctgctgtatcccaagcacacattaaatctctttggtgtaagactcaatgacttaaatacttttcaattttatctcttgacttggtttgatcatccatatttttttcattcaaaaggaaaacacttctataatgtcactattgatacttttttcatgaataaatttgttttcaaacagttttactgtactttattttctatcttgtgaatgtttgaacaacactttcaattctttattcagcgttttggagatttggtgtttacaaatgttgtttttacttctgaaattaattttattgccaaaatatattttatcaacctcaagaagtaattgttgattattcctatggagaatttgccaggtgaataatatttctcccatgatcttttctcactttcctcccttatttaattgaaattatcttgaactagcagacccatttttaaattttataattatgaatatcaatatacatgtcttcttaaatcatgtttaattagctttgttttggaaagcgtttatgactataaccattgatctacatataattacatgtttatatggttccaatgcttgtcacaaacctttctactacttgttttattcctgcttctttgaaattcatcatagttttttatgtaattctcaaaggtacatttttttaaaggaaaactatgggagataagtttatttaattccttgctcctataatcttatcaatggaacaataactttgctaggcatgcagttattaggtaacaatgtttcctttctctggcctctttttgtgtgccaattctgagttctggagatatggttccctcctctcctagtattcaatgcatggagggtatccctgccttcccttcttctagtagataatttttgatagtggtaatctttgtgattgttgtttttctatctagaagtttgcattatttcttcttctccttcgtcaactcctcctttttcttcttttttttccaaaactcaacttcttaataatttgtactagtaccaaaaagcttctttactttaaggtatgagagatttccttacgtttaactcacttttccacatacatatttctgattgttgcttctgccctttttcattcttgcctctttttttatttaacttatcttgtttgttctttcattctttatcctgaaatatttcttcatatactgatgatgtatttatatcctgatctttcccttattaaagtccataatttttaccttaatctttgtttctaatttcatacatatccttttatatttctaccttcatctaatctatctccttgtgttatcttcttgtcttttatttctcatatattaggactcttatttgcaagtgacagaaactgaagctgcactgagccgagcatacaggagcttaatggtttataatcctaaaacattataatagcgtgtggagtaccaatgcaataacacatcaattacaccatgaacacaccattaaaaatgagaatttgtaggacactcaagagacatataaaatgctaccctactagagaaaaatgtgataatattaaatataggctaaaaaagattcctactgtcaaaaaagttggttattttacatctatcccaagtttaagtctggtcataattacccaaaaataaatttaacaaacaggtcccagagttcacctaatgaataaaaatggcttagcggagttttggttaaaaaccctgtagaagttgcatttcaaacatccactaaatcacagatgttactgaattattgggccacccattgaaatacctagcagatgatatggtccataagcatcccagacatttaagaagtatagtgaaccaaactctcaatcaacagaagactaatcacccggccaattaatttgtgtaggctaaggctaaacttacatcaagctccaatactgtgtattctgtgaagatcaatagagaaagatcttcttcccttcttgtcctcaccctactctggacctctgggttcccaatcccctgaaggcaaatatccattattattgtggctcaatttgtactttgacaaatattgacatctatttcaaagagactgcaaagaaatctggtgttcctctgagttttgttttcatcttgcctttctcaagcataaattaagatattatgttaaatgtttgtttttgtagcctaattacactgaatacactgtcgtcgatagtgtttacatactgcaagctacttaacatattatatatagtaggaaagatgtgtttaaatatgtttgcatggcttaaacttgtatatctcaaaaatagtcttgaattgttatcaagcattgccattagtatgcttttttcagttctaatcaaaatatatcattttattatgctttccagttttactctagaaaatgttgaactgtaactgcacattcaagtctaatgtactgcttcaaaagcaatttgagcgatcttttatctataaatattataatttggtgatggtgtatgtggaacagaaaatgcttgttcaggatgtggcaaatacagccacctgcctgggacagttcacggaggcaggaagactccaggctggaggggaaattaggggatgcttccgagggcaggaggcagacataaagaaaaatcgtggaggtgatgtgggagcataattcatggctttgggtgccaggaaaggaggtgaaaatcctaggaaaatccaagtagggtgaatgagattgcagcaaatccataacactattgaaaggggaatcccctgttctctagagtttaaaggcccttgtttattcactgagagttgtcaggctaattatgggctctggttttctgctccttgagggaagtggcctcttgactcataatactaacaataaacaactccactttgtagggcttgagttgagttacggtttttattttagagaaatggaatttttcccctaatactcagacccagacctgtcacagatttcggtggtttcacagagactcctccaagtctacggcactcttggtcgctttgctttatggcaacaacatgccctccatctacttgattttctttcacttggtttggtgaaatagaaacgtgatgctgaggcctgtgttagttgagagttatgttcttggagtggcaagactcagggtccagggcatctgctcttggagtagctcccttgtgacccggatatttgccgctaggcgatctttccaggtcagcatctcacgtgcaggagacactcgtccgttcgatgcctctgaccgcaccgtccttgcttctagtctcacctggacaccaggagctgcctcttgctatcagcactcaaagcagatgcagccgtttggtgcctgtgcaaggttgcaagtgtgtggttggatgggaggcttctcctcgaccccctggtcccatgtctcatgcatagaagaggaaagtcagggccagaggtcacctggcccgttgaaggtccttactccaggagcagatcctcaatgggagtccagatttcaggtgcacaaggcgtgcggtctttcggcagctcacgccaccatgcacgtggtgtgtttctgctccatgcttctcctacggaggccattccaccgccatggcgtaaccagggaggtgggcgaggccagggccagttcctcacagtcgggggaactaagggacctgactccagcaggtcctggattaccttgatgcatcccagggggagaggttgtgttctgaagattggaggagtgtttgatttatttacatgggatttgttgcaatacatgttgtgaataaattttctttataactgtttcagtataagtagatactgattatctataagaaaattctacaatcctttcaaaagtactaagtaaaataagaagtagaaagtgttatctcggccgggcgcagtggctcacgcctgtaatcccagcactttgggaggccgaggcgggcggatcacgaggtcaagagatggagaccgtcctggctgacatggtgaaatcccgtctttattaaaaatacaaaaattagccaggcgtgttggtgcatgcctgtagtcccagctactgcagaggctgaggcaggagaatcgcttgaacctgggaggcggagggttgcagtgagccgagattgggccactgcactccagctggtgacagagaatgactctgtctcaaacaaacaaacaaacaaacaaacaaaaaaccaaaaaagtgttatctcttgaaatttttaactctgaaaatccaccctctgcacatcttacatagaacaagacaggcagccacaatgtgccatatgtgttgatataataccgcttaatgccagcacgtgtaagatctgtgtcccttctctgtgttccaatgagcagacaaagcttcaaaacattagaaatgtagaaagaacttaaacttattgcaacttactctttattcccactgctaatcacactttgtcatctgatttttatgtaatttttcttccaggtggcctttagcttgaaactcaattgtatagaaataaagtatattattttatataagatatgcctttaaattgatattacatgttcatgttacattcaatagggagcgactttattcttggcacaaacagtccctgaaaacattaagctcactgttgacctcaatcgtggtcattgttttcttgtgtgtatttgttgcacaatgactttaaatataatgtctgaaaaatcacagcatggggctgtgaatactggttgccctgtatagctggagatttatagctcctgtcagtctcccagggatctctgagatggatttaaggtgtgagtggtctccacactttctgggcggctttctcttctctacccagtgaaaccgactgctgtgatgagctggggttggagctgtggctggggctgtcaagatactcttgttactatgatcaatcacagccaggtccatgaagcagttgctagttgagctcagcaatgggattagccccttttttcaagtacttatttagttttataaattttagttgacaaaaatatatatttaaggtgtacaatatgatgttttgaaataagaatactttgtggaatagctaaatcaagctaattaacatatgcattacctcacattttttgtcgtgagaacaatgaaatctactcttagcaattttcgagaatatgatacattgctattacctgtagccaccgtgaagtgcaatagagctcttaaacttgctcctcctccttgtctgaaattttgtaccttttgtccaacctctctcaattctgtccctcagccccatcctccgcagcctcccttccactctctactcccataagtttgagtgtcttcaggtaggtgagatcttagggtgctcggcttcatgcatctggcttatgtcacttaataccatgcattcagggttcagccctgctgccagagacagcagggtttgcttcttgtttaaggatgaacatcgctgctgtgttcatgttccaccccattatctgtgtgtcagctgatggatgcttagggtgattccatgtcgtgtttgtttctgtgaacgatctcattgatgcctcatgcatgccacctgagtcccgcatgtctggtgctctctgcctctgaaatccctggccagcatccgggcacgggggcctgcagggcagatcccagccccactgcctccagagtctccacactgagcaccttgcagcctgccctcctggcacagctgcctccaggaggagccgctatgggaacgtttttgttctcagtaatttaaggtgcttgctgagagcctgatgagaaggaatttgtagcataggaagcctctggtgaaatttctccttggcattattgggaccaaatccccatagtgtcacattgaagtcaacgcaacaaatgtgaactgaaatgtcgcagtgtacccgatcctgtggcccccgagtgccctgtcgctgatggtccggtgttctgggtgcggaccaaggaggagccggtggcaaaggcgcctcaggcaggccctgggctccatgggcggcttgtgctccgcgattttgaggccatttgcagcagctccgccagcccaccgctctgagctgcagccgctgccagccacaacagcaccaccacgagtgtcttgggggctttcttcagaggaggctgtcagcgtcctcaagttccaggcgctctagcctgctacaacaggctttttcccacctgcggcctctcctcaatggcctaaaagcttggccaactcccacaaagtttggcagtaacacaggctgtcactgacatttgtggcgccaggacttgcccacgcgggttgcaaacgtcagccactgtctgtgtcacgtgcagtgacgccgcccgaggtgcgcacggtgcgcacaccgcacgcgcacgcccacgtaacggcttggctgggcacccccgcttggcttggtggtcctggtttggattggctttaccctggcattcctttgctgggcttgaccttttcttgctgggcttggcattcccctggctgggctgggtgtttccccggtggggcgtgcactttccctgggtggtggagggggcgtgggctctccccgggtggtggggggacgtgggatctccccagttggtggtgggggaggggtcgtgggctctcccagggtggggttttggctgggattgacctttctcccctaacagattggaaactcgtaatttcccgctttttggtgaaactcgttgacagacaccatctgctcgctactaccaggctgttgaaagcagatggtggctgaggtttctccaaagctggctgcctcccctatgaagaagccctttggcttcaggggcaagatgggcaagtggtgctgctgctgcttcccctgctgcaggggaagcggcaagaacaacatgggtgcttggagagaccacgacgacagcgccttcacggagccaaggtatcacgtccgtcgagaagatctgggcaagctccacagagctgcctggtggggtgaagtccccagagcggatctcatcgtcatgctcaggggccctggcattaacaaaagggacaagaagaagaggtaaccgggcctggggctgggaggaggcgggaccttgggggatggggttggacgtgccctcgtgtgtgtgtgtgtgtttgtggggggcgccctggctttcttgcctcctcaggtcccacgccacccggtgtgtggatacttcagagagctcggggcacaggcctctttatgagcagcaacacaaaaacaaaactttagttgatttccaatcccataataatttcccttatggaacacttaagagactgttttaaagtgatttaactctcaaaattaagtcgatgcagcagattatttttaatgtacacattttaaaacaatgttatatacattatagaaaggagtataatgagaactaagtcccataatatatcaaattctgagattaaatattcttcagataaaatccaatatgcattttatatcaatgtacccctatgtaaatatgttctttactgaggaaccttagaaggaaactgaaatgggaagatagttcgtgtccttgaataggaagatttatttttcttaagatgtgagctcttttgtgtttatcacttttacccaagccaaataaaaatagtaaagttttaacattttaaaattacacatgctgtcttttactattgtgataaatgtttgtgacagaatggaaaaagacttgctcttccagatatcaaaatgttcatgtgctatttccacaaattgtttactaacagctcaaaagacataaataaatagaacagaatacaaaatccagaaatacccaaatatatgaatttagaacttgatagtggtgatgtttcatagtagtataaaaagatgaattattcataaatgaaatgcatgctgtttggagaaaactagctagattttttatgtcacaaaaataagttcctggggtatacattaaaaattttaaatatacaaattaagaaaagtgccagaaggaaacacaaatgtctatttttatatgcagatatattttatgttcacagagacctaagaacctcaaaaacaagtattctgaagggtggtttggcaaaataaaaattaaaacaccctgtaaataagaaaaaaattaacaaaggacaaaacacttgcaaaacatgtattttcattttacagagaattctttcaaatcaacaagaagacaactaaataaaacaagctcaatttaaaattgggcaaagtacttttttgcatgtctaccaatgacctatgcacataggagaacatagtgttcctgataagagaaggaatttaaattagaagagaaatgaaatactcttttctatctaagttagaagaggaatgaaattctgtttctatccacaaagtttgtgaggatgaagaacagtggtacttatacagcttcttaaggtttaagttgctgtgagttttcaaatagacattttggtggtaagaaccacattttaaaaatgtatatgccttttacccatcaattccattatactgaaatatcttttggaaatagatacatctgcttttcttagtattacttaaatagcagtgtattgagaagaactcatgtaaagattttatgaacaaatttcagtccatccatatgatggaataatatgtaaccattgagggtgtcaatagatacagagataagttgacatgcaaagatgtacttaggtatatatcaagtgagaaaaaaatcagttatacgcaaacagaatctgctcttgtgttagctgaaaatatgtcaaaaatatgataaaacttatttctggggatttgtattgtaagtgaagtttttccctttatcttatctgcgatttctgcgatgaacgtctgaaaagttttagttaagtttcactagtaatgaaataatccttgggaagagaaggagtatgctatttgcataaatacaactaatttctcacattctagtatttatttttctttctgtggatgcgtatcttctgtgaatttttttttttttcgacacggagtctcactctgtcacctaggctggagtggggtggtgcgatcttggctcactgcaacctctgcctcctgggttcaagtggttatcctgcctcagcctcctgagtagctgggattacaggcacgtgccactacgccatgctaatttttgtatttttagtagagatggggtttcaccatggtggtcaggctggtctcgaactactgacctcttgatctgcctgcctcggcttcccaaagtgctgagattacaggggtgagccaccatgcctggcctcttctgtgaactttcattcttttcagaagtagagggaatctgtttacctgttactgtagattttattgtgtatatattttattatataattatcttttcattgtatatagattaacatgtgtaagaagtatggattaattattttagttatatatgaaaattaaaatagcaaatataaatgattattactattgtgaatgtattgctgtactatacaggagttttctttgaaaatattgaattcttcagctgtgtttatcaattctttcaatcgatttattcatcaaacataagccagacacctattatgtggcaggcatattctactatctcttaggatccttctatctttgaaaatttcatgtttccctgccaggcctgagcaaactgagagatttaaaattggactattaggacttaatctcaattgacgcttttcctctctcctttcagaaaaaagcgtttcggaaggtagaaaataataaaacgtaaactttaactgcctttttgaaaatttataacagtcacgggtaaagactagtttaggacttttaagaactaaaacatgatacttaaacagcgtggaatattatgcagccatagaaaaagaacaagagcatgtcctttgccagtgacttggatggagctgcaggccattattcttagcaaactaacccaggaatagaaaaccaaatactgcatgttctcacttacaggtgggagctaaatggtaagaatgcacagacacgtagaggggagcaacacacactggggcctatcagagggtggaggatgggaggaaggaaagaagcaggaaataaaactaatgggtactgggcttaatacctgtgtgatgaaataacctgtacaactaatgcccttggcacacgtctgcctatgtaacaaacctgcacaccctgcagatgtacccctgaatataaaagttgaaaaaaaattccacaaatagtttcataaatccattttaaaaaataaaatttataacaatcttaaatcctaatattaatgattgtaaatatctgatttacatacattctacaaatctaagtattgaaaaaaattagctacacctattcatttgaattccatgttttctttggcttaaagatttttgaacaccaaagtaagaattagtttattttagaaatttgtttttgttttcacctcagccctcttaatgtgtagttcttttaagaactaaaattcatctaaatgtcagtcatctgaccagaactgccccagacctgttatagataccatattctacttaatgtaaggcaccatagattttatgatgccccattattttatgtcacaagaagagagttatttaaatgctgccaattatagtaaattgtgaattataagcggtattccagtgtaagaaatgtgaaaacatggagacaatgaacatcttagaatcaataaaatacaatgttatctgtaatctttaagacatatctcaaagtgtaggtgtaattgtatcatgtcacttatttcaaatagtcttcattaagtagtagtattaatacaaattataatatctgacaattattgagctgttatttgtgttaggaactattctacatattttgtgtagagtctcatttaagcattatagtggttttctgtgagaaagctattttttgcatccccattttattgatgacgaaattgagacacaaaaagactaagcaacagctaggaagtgacagagcttaaaacagttttccagctcaagttgaatggaatccaagggctgcgctctttctgttctgatactctgctctttcattaacacagtgagaataagaggtaataaatagtgtgctttcttcacaggaatattaaatatttgttttgaaggctgggatagcatgctattcagcatttgcaattacatgagtcattggtatggctttagatagtgcattacaatttcctaaaaaagtctctcactctcttaggactgctctacacttggcctgtgccaatggcaattcagaagtagtaagtcttctgctggacagacaatgtcaacttcatgtctttgacagcaaaaagaggacagctctgataaaggtatgcagtagccaactatatcagcatgaggtagatttaagataattaaaaaaatgagttttctcatgtaaatataacttggtgaaatctgtggaatgtttattttgaattcctaggatttacaattgatttcttggtctaatactgacaggccgtacaatgccaggaggatgaatgtgcgttaatgttgctacaacatggcactgatccaaatcttccagatatgtatgggaatactgctctacactatgcagtctacaatgaagataaattaatggccaaaacactgcttttatacggtgctgacattgaatcaaaaaacaaggtacagatctaccaattttattttcaaaatactgaaatacatttgttttaacatcgacttgtgtaagggtcagtttgccatatttggaagctcaagcataacctgaatgaaaatattttgaaatgacttaattatctaagatttaattttaaatattgttacttttaaagaggcatcagcaggtacagctttttttatgcacttgtggtaaaatttttttgaaaacactgaatttgtaaaaggtaatacttattttttttcaatttttcccttccaggttttcttttccctaatcaatgtaaaatgacaaaatttgccctggaagcaagtttttcattaaaactccaagaaaactaaaacatgtttcagtgaatagaaatcttgctgctttggcaagttcctaaaaaaaaaaaagtaatagatatgaagcgatgtatcttttagtggcaaggcttaagatatttctgattccttataaggcagaaatagaaaatgaaaaggagagcaatcagaaatatcgaggccaatttggaaattaggtaatggaggaaaaagaccatgaagagattctgtgtgtgtgtgcttttttttgttgtttgttcatttctttcctttgcgtggtgaaacaaggttctcttcagttttagagaatgacagttttttagtttgggagagggagttagtgggttgtaaactgcctagagattaattttaggagccctctgaggaagcagattggcagtgaataggtggtatgtaatgggaaacccttgagcagagggaatatcagggaattatttgacttattatcctattctggtagaaatggccacttagatagagtctaaactctgctttcaaatctagaatgtcttgatgggaaggtgggagataaagagcttataagtaataagatcaagttggattttgagtttactaggccctgttctaaccccatccaggaaaattaagtggtgttttcagcaaatgagtctctcactctttccttttttttggccaaaagctcaaatgataaagggaattggccatgtgggtgagagatgagactgaagtaattgtctgttgcactagttttcaactagaagtgtgcatctcagtaacttgaggaacattttaaaataatctacaagcctagaccctctcctgaagattttgatacagtaagtctaataaagcctggatatgtccatttaaaaatgtttccttgaaggcaggcatgctggttatggatgccttcctcccagctgctagagaggctgaggtgggaggattgattgagctcaagagtttgaatctagcctggacaacataatgagaccatgtctgtaacaacaatgacagcaacaacaacaacaacaacaacaacaacaaattccttaaaatgcagatacacttctgcttaagaaccactgaatagataagtgtaatatgtaaattctcatatctcagaaacttaagacatctctagaagagttggagttggatatgcgcaatttcctttaaatctttcctttccaataatattagtttgactttctctttctttctttctttctttcttctttctttctttttttctttctttctttctttctttctttctttctttctttctttctttctttctttctttctttcttctttcttctttctttcttctttctttctttctttttttctttctctctctctttctctttctctctttctttctttctttctttctttctttctttctttctttctttctttctttctttctttctttctttctttctgactgggtctcacattgtttcccaggctggagcacagtggtgcaatcacagctcactgcaggcttgacctccccaagtacaggtggtcctcccacctccagtttgtattttatttatttatttatttttttagtagagatgggttttttgccatgtttcccaggctggtcttgaattcctgtggtcaagcgattcagctgcctcagtgtcccaaaatgctaggattacagttgtgagccaccatgcctagcctagtctgactttcttctctgtggttgggacattaaaatgaatattattggtagtatctatcagcttacagaataataccttttccttcctaccatcagttattcactgccattcagaaggtctttagaaatttgcagtgagtattctttcaataagtagaggctggccctctcaggattttgtgtctctttgttattcaagtgcttaagtcagtaagtcattactaagagcagagttttctcaattaaaattgtagcaaattccaaaccatttttgtcaattaaagccatattatggactatccagtatgtctcttaagtttgtagaactttggcataatcaggatggtagtattaaacactaaaaaccatgcagttattaagaatacacatgggaattctgttaatttagtttcagcagtcctatgaactgattatttagttaacaatcaggaaaattaaatataaatagatttcaaatgaataaatatgggaaaaattcttgaaatgggcagtatgagccttaatagcaattttttactgcacattggagcttgattttttgggtaaaacatctgaaactgaagaaatattttacatgcaaattcttgctttatacacaacaatttgtcacagggtttgaggatatagggataaaagatacagaccctgccctcaagaagatttttgtttagataggaaaaattattatcatccaataataccatgtcacaaatgctgggatagagtcaaagattcttgaaaccagtaaatgtttaaagtgagttttcaagatgaccagggttaatgtggtgaggcagaggaggggtgtttccaagggaagagcagtgtgtgggaaagcacggaagagtgagaaggaaacaactacattttatttactttctatgagtataagtccataggatctttatataaagtttccaattcagttgagaaatatataattttttcagttacatattatttttggtttctattgttttacagggtggcctcacaccacttttgcttgctgtacatggacaaaaacagcgaatggtgaaatttttaatcaagaaaaaagctaatttaaatgcacttgataggtttggaaggtatagttatttcttttaatctctgtgttgttctagattgatagcagtcactcaagtcataaatattaaattaataatactaacttatacttattgggacatagttatcagtagcaacacaaatcagttaagtagaaaaaaacagttatttagactgggcaacataaagaacagttttagtaggactcattttattattttgactgatgttatttgttatgtgatgttattggttgtatgttcttatgttagctaaagggatttcatattagttttagaaagtgtgaactttaactttcagttatgactcagtcttgaacttcttaaccctttctagtagtttttaacctctgcttcttatatggttttccactaaatatgctatattaaacataaataggagttgcaaatcattttgtcttttgaataactctgctttaagttgctttctttaaagaatattaatgttagcttatccctacttgacaatcaattgctattcccacatactgtgggttcatcagatttttccctttttatttccagtgtattttgatgtttttatttttaattagtatggagagagggagcgaagatagtcttaagtggatacacttttcctttcatgaaggcaagccataggtgggtgataaagagaaaagagctaggctttagagtcacacaagactgggtttaattcctagctttcttacttgctaggtgtgtgacattgtgaatgttatttaccaccaaatatgttgtcatgtatgaaaaggaggagaatatatccttcaaagttagctgtgcatagtaagaaagatatatatatatatatatctttatatatatctttttatagcatttaattcagggcctagcacatgcttattggtattcattaactgaaaccactatgaccactattcttaccatttgttattactgctttcagcatgcagatagctcttatttatctgatccctagctgattttctattacagtgtatcagtctagggacctgggaagaaaacttcacttaaatctttgtctacttcagataagcagccctagcatagtttcttgcccatcaaaggcctttaaattagtagctgctactatgcaataccccactgagataagaggtttcctttttgtcccttccttttaaccttgatggtactttataaagatgaacccttgagcacccaagatgcttatgtcttttagtacatgtaaatgtttaattctgcatggacgggcaagatattaaattggcaaagtatattgaattagcttttaaaatcacttgaagttcctaagggagaaattatctctatattattttagaactgccctcatacttgctgtacgttgtggatcagcaagtatagttagtcttctacttcagcaaaatattgatgtattttctcaagatgtatttggacaaactgctgaagattatgcagtttctagtcatcatagtatgtaagtgtttacattaaaagtctagttaaaactacattgaggtttaaaataattataatgattgcatcttatatatcaggtgagatgtgatagattgattcaggtagttttagagtggctatgatttagtccactgcatcagctagaaatgaaacaaaaaactagactagttagaagtaccaatgggtgcaggattctttatctcgggacttttaagacctttatccttagagattccaacattgttcatttcattccatgtataacacctatgcatgggataaaaaatagtgccatatctttaatttttctagttagttatttgggtcttgaaatgttcagtttaggagaaagtcttgtactgtcttctggggactgtctcctatatactccctgaattttttgagaaccaaagggattcactaagtccaaggaagacagtcctttttttcaagtcataaggaggagaaaaaaaggacattttaatcattcttttgtttctgttgattctgttgctgcatcgttgccactgaaactggtcctgctgcctggtaatggttggcctttgacatcaagatgcgcttactgattcaaatccctcaagtcttcatggtgatccatacatggacttcaaagttataaaattttttacattcacatacctatgcctatgtgttcagccattgttcccaaagcaccagcaccctgctctggcagcttagcatcctggctttatccacacacaaagtgagcaaattgacccttccacccacattcaaaacctgatgtggaacccacatgttatcctacacttaactgagactgtcatggtaagagatcctttgagtcccatgttggtcttttctctagcagatattagctgggcttgttctaaactgtcagagaggttcaaataatgtggcagaaagaggtcagtgtttgtttattcttctttgctaccatatctgtaccctgaggcacatttatattgtgtatagtaccttaggcagtagaaagtcccatattaaccttccccagagcagtgagcacccagttatagttgaccccttgaatgatccattttccataataatgagaatctcccaagctacttgcatctcttcctcaagatttaaaaatattttcaaattctacctcactggaagatattgaagagatttctcaggatctcaagtaggttagttggacttagagccaaaccttgtcaatgactcatcactgtccatgtgtaaaagtagagctttgtgcttgcttaggcagcacatatcctaaaattggaacaatacaaagaaaattagcatggtgcctgcataaggaggctgaaccaatttttgaaggattccaagttttgtgcagtcactggaaggtcatttgactattttctgactagctccaaggaaatggtgtgaatcaaagcaaaatgggtgccacctaaatattgaaattgtgattttttgctacaaaaatattcatgtaaggtggtctaagagatgaccccagagctgaataatgtgtggggtgttgtgtgaaaaatatattgccagcatgtgacttgaaaattcaagaaggtcaacttacaacttcttcatggaacctaaaaaaaaaaaaaaaaaagtagggttttagtctcccatgtcagctggagatgagcagggagatgaagcatcatcctaacaaacatctgctggtttagagtttgagtctgtagagaaggatcattggtccaagccaggtgttgacatccagtggattttctgcccttgttgtgattggtaaactccgtaatagtgggcaatcatgttttctactttaatgagatatttatgaataaatttagttacaaactatgaaatagttgagattccttgaattataagccataaagagtaggacaactaataaggaaaattaggacttaacatttcctgaaaattacaacatttgcatattagggcctatgaacaaaatatacattgggttttatttgggattctgagataatttcagtataaagtttaggaatagattatttcattgctttactatttttctgagcatttagaaaatgttatattgttaagtctttgtaacaacctagtgaaataacaacctagtgaaataaggcagcaaagtccccactttgtagaaataacaacctagtgaaataaagcagcaaagtcctcactttgtagaagaagacattgagcctaagagaagtaacttgtccaagaacaagttgagcacttaggcataggtatggatcagctgttcattatggagctaggccttatgcagagttgggacactttctattgtgtcaagctaatgcaagttagtttattgagtcataatgcccttgatttatgagtatttcaccttacttttttcttctttaattagaagcttaatgagaggtttgtagaatgtacacagaactgtatgggataatattgttaagttctgatattctgatactgtttgaaatactcaaagaatttttgcatttggtaagcatttttatatcagtattaaaatagtaattttatttattacatttttatacatagaatttgccaattactttctgactacaaagaaaaccagatgccaaacaactcttctggaaatagcaatccaggtaagacttctgatagtgaattactttaggtcagttgtccccaaccttttcgccttcttggcagcagggaccagttttgtggaagacaatttttgcatggactaggtgaaggtgtggatggtttcagaattattcaagcacattacatttattatgctactttatttatattattattaccttataatatataatgaaataattatacaacttaccataatgtagaatcagtggaaactctgagcttgttttcctgcaactagatgtcccatctgggggcaaagggagacagtgacagatcatcaggcattacattctgataagaagcacacaacctagatccctcacatgggcagttcacaacagggttcatgctccaatgagtatctaatgcaaccactgatctgacaggaggtggagagcaggcagtaatatgagtcatggggtgtggctgtaaatagagatgaagcttccctggcttgcttgcttctcaccttctactctgtggcatggttcctaacaagccatggactggtaccagtccatggcctgggagttgtggatgcttgatctgggtggtcctatcacagataaaaaggtaaaagtaaggaagttttgatcacaaaagaagagcgaagcacaggttatgtttcatatgcttgtaccaacaaagtctcactattactgacttcattcctcctaatttgaaattgaaagagatagatttactttgttggaacaagatgtattcttctacctgctggttaattgtcatgataaacagtaattttgttagaacaagatgctttgctgccagtcgccaaaagattgtcataataaatacacaaattgcccaattctaggctcagcagattataataaaagtacaaaaatgtttcacagtaagaaaaatgctagtatgctacctggatgtggacacctaacgcatcgtacaatccagactctataaggacatctttaatttagccctatgtttatcaaagagcttctgtaagttagattgtgtacattgcaagagacaaagatggaatagatgtagttctgatctttaaggtgctcataatagaatacagctgcctctatttcatttctctgccttttcaacagaatttacaaagaaaatatttttatgttttcacttgtccacttaacaaataactataaaatgtcttttaggtactaagcatttttctaatgctagagaacagaaacaattaaaaatacagacaggagtttgtcattatcattgtcatttttattatgttcctaccttattcagtgcttactgtgtgctagatgcccactggaagtttataattatgatttattgtatattatattgattatgtgccagacatacgtgatgaggaatgaaagctttaaaaaaaagtaggtaggatttaaggtaagcatgcagagtgagtagaatttttctacgtaaagaagtagaagaatgatgtttggcagaaggaacatgtaatgagattgcctgttgggaggaagagcagcaagtgcaaaagacaagatgcttaagcgaactttgtagggtttatgagcagttcacttttgctagtacaactagtgtgagataagagaggttgggaatgaggtgaatatttagctaaggcaagtttatgatagactttttaatactgttgaaatgagtaggtcttattctggggaccacgggaaatttaccttcgatatcttccagtgaggtatttgctttggactgcaaatactagatgagcagtggctaaaacagtaggaaccagagttgttttggttgttcagtgatatactaggttccccttgtccctctttcagctgtgcttcatgtctcctttcatggttggctaatccacaacagttccaaacatcttgttctcacaacacaacatcacaagggctgcttttcttcacacatgtcttttaaatagggagaaaccttagaagcatgcagtggacttcctgtaacatattattggctaggtcacaacatatgcttatccctaaaccaggcactggaagagcaaatgtaagtatgtgattagcttagaataatcatttctctttctgaagctgaggagggggattggaatactgtctcagaagacttgtgtttcttctgcaagaaagaataaggaataagaaagaataagggagccagcaatgtttgctgcagggactcattggagaaatttgagcaggggagtcacaagattaaattagagtattaaggccttttggtaatgttgtaaaacaggggttggcaagctttttctgtaaatgaccaggtggggaatgttttagactatgtggtctctgtcatatctacttaaccctgctgttgtgtgagagcaactatggataatatgtaagcaaataggaatgagtgagctccaataaaatgttattttttttttcacttttggcatttttaataggatttttaggcataacatcttacataaccacacagaaactgtttctggtctttttttattattatactttaagttttagggtacatgtgcacattgtgcaggttagttacatatgtatacatgtgccatgctggtgagctgcacccactaactcgtcatctagtattatgtatatctcccaatgctatcactccccactcctcccaccccacaacagttcccagagtgtgatattccccttcctgtgtccatgtgatctcattgttcaattcccacctatgagtgagaatatgtggtgtttggttttttgttcttgtgatagtttactgagaatgatgatttccaatttcatccatgtccctacaaaggacatgaactcatcattatttatggctgcatagtattccatggtgtatatgtgccacattttcttaatccagtctatcattgttggatatttgggttggttccaagtctttgctattgtgaataatgcctcgataaacatacgtgtgaatgtgtctttatagcagcatgatttatagtcctttgggtacatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcactttttcatgtgttttttggctgcataaatgttttcttctgagaagcgtcttttcatctcctttgcccactttttgatgaggttgtttgtttttttcttgtaaatttgtttgagttcattgtagattctggatattagccctttgtcagatgagtaggttgtgaaaattttctcccattttgtaggttgcctgttcaatctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacctttaagtctttaatccatcttgaattgatttttgtataatgtgtaaggaagggacccagtttcagctttctccatatggctagccagttttcacagcaccatttattaaatagggaatcctttccccattgcttgtttttgtcaggtttgtcaaagatcagatagttgtagatatgcggtgttatttctgagggctctgttctgttccattgatctatatctctgttttactaccagtaccatgctgttttggttactgtagccttgtagtatagtttgaagtcaggtagtgtgatgcctccagctttgttcttttggcttaggattgacttggcgatgtgggctcttttttggttccatatgaactttaaagtagttttttccaattctgtgaagaaagtcattggcagcttgatggggatggcattgaatctgtaaattaccttgggcagtatggccattttcacgatattgattcttcctacccatgagcatggaatgttcttccatttgtttgtatcctcttttatttccttgagcagtggtttgtagttctcctggaagaggtccttcacatcccttgtaagttggattcctaggtattttattctctttgaagcaattgtgaatgggagttcactgatgatttggctctctgtttgtctgttgttggtgtataagaatgcttgtggtttttgtacattgattttgcatcctgagactttgctggagttgcttatcagcttaaggagattttgggctgagacgatggggttttctagatatacaatcatgtcgtctgcaaacagggacaatttgatttcctcttttcctaattgaataccctttatttccttctcctgcctaattgccctggccagaacttccaacactatgttgaatagaagtggtgaaagagggcatccctgtcttgtgccagttttcaaagggaatgcttccagtttttgcccattcagtatgatattggctgtgggtttgtcatagatagctcttattattttgaaatacatcccatcaatacctaatttattgagagtttttagcatgaaggttgttgaactttgtcaaaggctttttctgcatctattgagataatgatgtggtttttgtctttggttctgtttatatgctggattacatttattcatttgcgtatattgaaccagccttgcatcccagggatgaagcccacttgatcatggtggataagctttttgatgttctgctggattcgttttgccagtattttattgaggatttttgcatcagtgttcatcaaggatattggtctaaaattctccttttttgttgtgtctctgcccggctttggtatcagaatgatgctggcctcataaaatgagttatggaggattccctctttttctgttgattggaatagtttcagaaggaatggtaccagttcctccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggaccggtggtgatatcccctttatcattttttattgcatctatttgattcttctctctttttttctttattagtcttgctagcagtctatcaattttgttgatcctttcaaaaaaaccagctcctgggttcattaattttttgaagggttttttgtgtctctatttccttcagttctgctctgattttagttatttcttgccttctgctagtttttgaatgtgtttgctcttgcttttctagttcttttaattgtgatgttagggtgtcaattttcaatctttcctgctttctcttgtgggcatttagtgctataaatttccctctacacactgctttgaatgcatcccggagattctggtatgttgtgtctttgttctcgttggtttcaaagaacatctttatttctgccttcatttagttatgtacccagtagtcattcaggagcaggttgttcagtttccatgtagttgagcggtttagagtgagattcttaatcctgagttctagtttgattgcactgtggtctgagagatagtttgttataatttctgttcttttacatttgctgaggagagctttacttccaagtaggtggtcaattttggaataggtgtggtgtggtgctgaagaaaatgtatattctgttgatttagggtggagagttctgtagatgtctattaggtctgcttggtgcagagctgagttcaattcctgggtatccttgttaactttctgtctcattgatctgtctaatgttgacagtggggtgttaaagtctcccattattaatgtgtgggagtctaagtttctttgtaggtcactcagaacttgctttatgaatctgggtgctcctgtattgggtgcatatatatttaggatagttagctcttcctgttgaattgatccctttaccattatgtaatggccttctttgtctcttttgatctttgttggtttaaagtctgttttatcagagactaggatcacaacccctgcctttttttattttccatttgcttggtagatcttcctccatccttttattttgagcctatgtgtgtctctgcatgtgagatggttttcccgaatacagcacacactcgactctttatccaatttgccagtctgtgtcttttaattggaccatttagtccatttacatttaaagttaatattgttatgtgtgaatttgatcctgtcattatgatgttagctggttattttgctcgttagttcatgcaatttcttcctagtctcgatggtctttacattttggcatgatttttcagcggctggtacccgttgttcctttccatgtttagcacttccttcaggagctcttttagggcaggcctggtggtgacaaaatctctcagcatttgcttgtctgtaaagtattttatttctcctttgcttatgaagcttagtttggctggatatgaaattctgggttgaaaattcttttcttgaagaatgttgaatattggcccccactctcttctggcttgtagagtttctgctgagagatccgctgttagtctgatgggcttccctttgagggtaatccgacctttctctctggctgcccttaacattttttccttcatttcaactttggtgaatctcacaattatgtgtcttggagttgctcttctcgaggagtatctttgtggcattttctgtatttcctgaatctgaaagttggcctgccttgctagatggggaaagttctcctgggtaatatcctgcagagtgttttccaacttggttccattctccccgtcagtttcaggtacaccaatcagacgtagatttggtcttttcacatagtcccatatttcttggaggctttgctcatttctttttattcttttttctctaaacttcccttctcgcttcatttcattcatttcattttccatcattgataccctttcttccagttgatcacatcggcccctgaggcttctgcattcttcacgtagttctcgagccttggttttcagctccatcacctcctttaagcacttctctgtattggttattctaattatacattcttctaaatttttttcgaagttttcaacttctttgcctttggtttgaatgtcctcctgcagctcagagtaatttgatcgtctgaagccttcttctctcagcttgtcaaagtcattctccatccagctttgttccgttgctggtgaggaactgcgttcctttggaggaggagagatgctctgctttttagagtttccagtttttctgttctgtttttttccccatctttgtggttttatctacttttggtctttgatgatggtgacgtacagatgggtttttggtgtggatgtcctttctgtttgttagttttccttctaacagacaggaccctcagctgcaggtctgttggaataccctgccgtgtgagatgtcagtgtgcccctgctggggggtgcctcctagttaggctgctcggggtcaggggtcagggacccacttgaggaggcagtctgcccgttctcagatctccagctacgtgctgggagaaccactgctctcttcaaagctgtcagacagggacatttaagtctgcagaggttactgctgtctttttgtttgtctgtgccctgcccccagaggtggagcctatagaggcaggcaggcctccttgagctgtggtgggctccaccgagttcaagcttcctggctgctttgtttagctaagcaagcctgggcaatggcgggcgcccgttgcccagccttgctgccgccttgcagtttgatctcacactgctgtgctagcaatcagcgagactctgtgggcgtaggaccctctgagccaggtgcgggatataatctcgtggtgcgccgttttttaagcaggtcagaaaagcgcagtattcgggtgggagtgacccgattttccaggtgcgtccgtcacccctttctttgactcagaaaaggaactccctgaccccttgtgcttcccaagtgaggcaatgcctcaccccgctttggctcacacacggtgcacgcacccactgacctgcgcccactgtctggcacttccaagtgagatgaacccagtacctcagatggaaatgcagaaatcacccatcttctgcgttgctcacgctgggtgctgtagaccggagttcaataaaatgttatttagaaaaccataagggagactggatttggcctgtggcctatagttttctgacccctcatagaggattgatggaaggtaaccatgtaaagaaaccaggagacaaaggaagatttgctgtagtcagctacagtttccttgtcacatgtccttggactagtatcaatttattataaggttttcacccatccatcgtgaaataaataaagttaggaatctcagttattcattttaaaatgttggcctttttttggtgttatgcctttttcatttgttttgttttaattttttttcatgtaagaaataacattaacagctgggttttttaaaaaaataaaagccactttgtaaatgtttatgttcccagtggcagtgggaatataaaatggaagcagaagagaggtatagtcaatatgatttagtgactgttgaatgagaaaatttaggggacagagagaaatcccagatgattcacaggtttccaggttgtacagtattatttaacctgaacatgaggaaggagtaggaaattttctggtgaatacagaagagcaaagaagagcagctcaagaggaatgactaattatttttctgtgcatgtttaatgggatattcatataggatttttgaatagatcattgaatatcagcatttatagctggcatcctactagtttgactctcagtaataagacttgtcaaagatccaagaatctgaaagttgatgataaatttccatgtgtatcaccatcaatgactgaaagtcagcatccacagaattgggagagatgaacttaatagataaagatgaattggagttgtgtttctcttagagaatgatactctccatgacttgtgtgagtcacagctgccagaaaacaaagaggccaaggaacatattaaagaagcacagcaaattcagtcctagagtgcctctgcttggcttcgtgttatagttctgacttctaaaaaatcactttttggcaaaatatactttgtgtttcttcccctcttgcaaactgcaaccaaacagaatcctttttagcaaggcatttttgtgttctttgaccaaagcaacatataaataacaaaaagaagtaagagaaagaacttttttttgtgtgtataggctagtatttaacataaacttgagagtgagtgccagtattatatttaggatttagggactagataggaaaactggatagaaatctaaagattgctgactcaaacacaatgtggtttctttgctttattttcacagctctgaattcacaactattagttatatttatatgcactataactttagaaagcaccttcccaaaccaaattttatgtgatttcttataatttagatgactttattatagaattgaatttccaactgttcataagaattattgagcatttgctgcatagtatcatctcagctgtgtccacatgagctacctatcaccttgtgttaatgaataatggttcaccaggaatattggttttggcatttaaagtgatctgtatttaatgcagataggaccagggaccactcttgaacattaatgtccaagcatcttaaaattacacagaatgctttcataatcagaattctgcctcactctccatctttagcccttttccccatgtgccctttctctggcattactgaactgcctgcaatgccctactcactcatccttctcttgtaggcaaatacattcactctttcacaccttactccctctcttgctgcttcctggcatactgccaacctttcctgccctctaccccttgtaatctggctagcctcaatatttaagtctctgcttggccatgatttctagaaaaccatccctgacatgctttattttcattctttttaaatcctaatgcctactatgtatgtagcaggactcagtaaaaaattgctgagtaaaataaagaatgtttatacaaaggtgatatgcaagactgtcccctacagtcttggagccgaggggacagacatgtggagcaataacgtacatttgagatggtaaagatgcagtagaaaaataagtaaagtattaaggcagcctcaaggaaggaggtacctgtttatctggggaaagacatgcagaatcaaggaagacttcacatagcattgttttaaaagatgaaaaaaattgtcagaatagtggagggaaacatttaaatattaggaagacattgtacactaataaaggtgtcagcagtgattttggaaatcatttacaaggcactattaggaagtggagaacagtatactgtgttaccttatatgtttctgccgtattttaatattgtgttcctggtggttttgttcatttacgttgggtggatgaatttgtgagtgaatgtttgacatgtttgtatgtcctcaatctggtggactctggtatctccccaagtggtttgttgaagttttggagaattattacttaagtaactatttcatgaaagattaagcttcatttaagcgctcaatttatgaaatgaaatgtcttaaatctatttttataaaaacaatagttttaaattgttctaagtggttcattttaaccaaatatatggatttcacttcagaacaagacttaaagctgacatcagaggaagagccacaaaggcttaaaggaagtgaaaatagtcagcatgaggcatgtaaaattttaaatttaaatttctggtttaatgttcttttctttgctttgataatagtagatagtccaaatgaaattacctttcagactaggctttgataatcaataaattttttaaaataattttttaatagattcttaaagtttattttaatagatttagtgaccttattaacagaagaatcaatagaatctaatttaatatttgatatttaacttaaagattataacccactataaaatttaaaatattcttatttaaaatattcttatctgccttcttgattggcttatagctaatctttccctttggaatagaggcaaaacaaatccagaactttatttgttcttttatttttacaacatccttacatgataaagaaagtaacatcaattattggatcatattatcaagcaattgaaattatgaacaatgtagcagtgatggtccctgagctggattcatggcaaaggagtaatcatggccagtgattgaaaatctgcggttttatattgccagtcagtgatgccaaggttaaagatgaattctacctgtggtctctcactgacctcagggtttctgttcagggagagaaccaggtcttaaaagcaacccaactgcctattacaataatcatatcttgcagaatgagacctttgttgttagtgtacaaacacagtaacattttaacatttcagttgcagaacatcagtacatattatttaaaaatttttatcctctgtcattagtacacattagaatatattagaactggacttaagccgatagtctagatacataacatgatcgtattatagtacataatttcaattaaaatgtaacaatttgcatttctttctgtttggtgttgattttggctcctaataatttaaagtgtgcctacactccagttagtaatcttttaaaaaaccacctaaatgcactgtaggggctcactacttaaggtatggtgaagtaaaatcttttcaagtgagaaaaaccctacaaattacctgctaattcattttggtagatttaacacataatgaattaagtttaatccaaacaaaaggtgacaaagttaagttttccagttcatgtttttcttctttctttggctaaggtgaatttttttatgttttagtcagaagccagtgatgtggcagtagctaaacatagaataaaatgttaattcttcattttagttatttaattattatttctttaattattttaacaggtaaattttaattttaattattttctaattttttattgtccatacttgattacttaagaataaaattattttaaaaacatgtactccaaaagagcagacatctgagaaacacaacaagcaaattaaccttctataattgcatctgcagaaagtgactcaagaaccagacataaataaggattgcgatagagaggtatacctttatattcaaatgtttccgttgaattagatttttacattatgttgtttaacaaagtataataagtttaggcatgtatgattctatcatgtaagtagcataaatcatcagtgaaaaatttagtatgtaactcagaaagctgagttgtgtacattaagttttaaagagagacaaaccctagaaatattcttcattattatggaataatcctgaatggtgccaaaaatgctacgtaatgctactttaggagctttggatcaatcattttatctttcttggtattagtctgattatcaatagataatatggctaaagaagataatttgttattctgtatatcctctagctagaaagttttatggccactgaatgtgaaatttggggagcgtctcatttactggaattccatgctagcacctcagcagttttattctgctttttgtgttgtgggaaactttggttcccatgtttcagtgagcactttcatgtttttgatatcccagcaaccatatgaaaaagcaatgatcacaggcagtgggggagaagaatattttagtgcaggaaagggaaatcttcctttctattcctggagcccgacagtgtctcatcctctaaatctgactgcttaatggaaaatccaggttgtaaagatggaagaagacacattttgcatctttgtgtttttatttgtgtgttcccacaagtcaaatggggtgaatatttatattagattctgaagagtggttgggaataaaagcacaaaatgaaattttgaaattttggaaattttgaaattttggaaaattgttctattcattcaaagagaaataaagcaaactttacaaaaattttaatgatatactaatgatgtaataattacatcttaaaattatatggtaacagttctgtatatatgatcaaatttaagtgtgaaatatttttaatgacaaattatgacaaactgagtcaaatgataaaatcaattaaaacaaaaaggtactttttattcaataaagcaataactgtccttaatatcaaacttccactcaaggttgaagaagaaatgcagaagcatggaagtaataatgtgggattatcagaaaacctgactgatggtgctgctgctggcaatggtgatggtggattagttccacaaagaaagagcagaaagcatgaaaatcagcaatttcctaacacagagattgaagagtatcacaggtaagcctatggcaacatttaacaggagataactatgtgctatcaaactaatccgaatttggactaatattcatgatgaaaaaattttatacttttcctaggatattcagccttgcctggtaatcagaagaatgaaaatcagcaaacaatgagttatattttttccagtcattaatttatttgaaaaataaccagtgttggcaaatgtgagggaaaaagcattttcttttctttttagtgaacttttattttagcttcaggggtacacgtgcaggtttgttacataggtaaactgtatcatggagattggggttacagattatttcatcagtcagataataagaatgatacccaataggtagttttttggtcctctccctcctgccatgctccaccctcaagtaggccgcagttgtctgttgttctcctctttgtgtccatgagttctcattgtttggttctgacaaatgagtgagaatatgtggcatttgattttctgttcctgcattagtttgcttaggataatgacctccagctccatctgtgttgctgcagaggaaatggactcactgaaaaggatattttcatacactgttggtaaatacattttgagtgttaatttagtagcatattcacacacacacatatataacagtaaggatataaaatatatgtatgttatggatatttgtatagatatattacatatatacttatgtataaggacatttattatagcataattatatcaaaaagttggagctagtccaaatccttatcaataggaaatagctcagaaaataatatagtatgcaatcagttttttaaaatgaagttagatctagagtgtactgattatttcacaattaacatgtatttaaagcatttagtttgctgacccatcttaagacaattttgttagaattcttgtagtatctgctgtgttgcaaatggaagctacatgctatgttgacactgtaccttgttagcaacaatatcgctagttattaaattatggttgtcagtgcctgagtgctgaaataattggaccctcaactgaacattgccaaaggattgcacatggggatctgtattttatgtaaatatttcagtatattggataaaacttgtttaaatacatcaaaggatctttgatctactaaaacaggaattggccagcttttttctgtaaagagccagttggtaaatattttaatctttgtggactatatgtacttatttttttgagacaggttctcactctgttgcccaggctggagtgcatttgcgtgatcatggctcactgcagcctcaactttctgggctctagtgatcctcccacctcagtctctctactagctgggaccacaggtgtgcaatatcacacccagatgattgactctatggactataaagtaaataagcatggctgtgtttcaagataccttacttaaaaaaacaggcagtgggctggagtgggcccacaagtgttaatttgctgacccttgtgctaaaaggaaggtgttgctaatgcagtgaatcttatttgtaagtgtcctgcatgcatgacattatccttcctttgaaaaaagaatatatttcagtattcacctcaccatagttttcaagtgacttcatataatttttatattgatgtaattcatgtaattatacttcataaaatttttaaaatttcatttataaaataagattattttctgcatttctcctattttattcctgttaataggactcagtattttactgtgatcaattactttgtatatgtgatgagtatcaactgtcctagatttcactgatttttatcaagcaagaaatactcctcttgaaacttttagtattccttggtctttatttttattcatttatttttattttattttattattattatactttaagttttagggtacatgtgcacaatgtgcaggttagttacatatgtatacatgtgccatgctggtgtgctgcacacattaactcatcatttagcattaggtatatctcctaatgctatccctctcccttccccccaccccacaacagtccccagagtgtgatgttccccttcctgtgtccatgtgttctcattgttcaattcccacctatgagtgagaatatgcagtgtttggctttttgttcttgcgatagtttactgagaatgatgatttccaatttcatccatgtccctacaaaggacatgaaatcatccttttttatggctgcatagtattccatggtgtatatgtgccacattttcttaatccagtccatcattgttggacatttgggttggtttcaagtctttgctattgtgaatagtgccgcaataaacatacgtgtgcatgtgtctttatagcagcatgatttataatcctttgtgtatatacccagtaatgggatggctgggtcaaatggtatttctagttctagatccctgaggaatcaccatactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgaacattttttcatgttttttggctgcataaatgtcttcttttgagaagtgtctgttcatgtcttttgcccactttttgatggggctgtttgtttttttcttgtaaatttgtttgagttcattgtagattgtggatattagccctttgtcagatgagtaggttgtgaaaattttctcccattttgtaggttgcctgttcactctgatggtagtttcttttgctgtgcaggagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatgtggctagccagttttcccagcaccatttattaaatagggaatcctttccctatttcttttttttgtcaggtttgtcaaagatcagacagttgtaggtatgcagcattatttctgagggctctgttctgttccattgatctatatctctgttttggtaccagtagcaggcttaggattgacttggcgatgcgggctcttttttggttccatatgaactttaaagtagttttttccaattctgtgaagaaagtcattggtagcttgatggggatggcattgaatctaaaaattaccttgggctgtatggccatttttatgatattgattcttcctacccatgagcatggaatgttcttccatttctttgtatcctcttctatttcattgagcagtggtttgtagctctcctcgaagagttcctttacgtcccttgtaagttggattcctaggtattttattctctttgaagcaattgtgaatgggagttcactcatgatttggctctctgtttgtctgttattggtgtatgagaatgcttgtgatttttgtacattgattttgtatcctgagactttgctgaagttgcttatcagcttaaggagattttgggctgagacaatggggttttctagatatacaaacatgtcatctgcaaacagggacaatttgacttcctcttttcctaattgagtaccctttatttccttctccggcctaattgccctggccagaacttccaacactatgttgaataggagtggtgagagagggcatccctgtctcgtgccagttttcagagggaatgcttccagtttttgcccattcatatgatatttgctgtgggtttttcatagatagctcttattattttgagatacatcctatcaatacctaatttattgggagtttttggcatgaagggttgttgaattttgtcaaaggccttttctgcatctattgagataatgatgtggtttttgtctttggttctgtttatatgctggattacatttattgatttgcgtgtattgaaccagccttgcatcccagggatgaagcccacttgagcatgttggataagctttttgatatgctgctggattcggtttgccagtattttgttgaggatttttgcatcaatgctcatcaaggatattggtctaaaattctctttttttgttgtgtctctgcccggctttggtatcaggatgatgctggcctcataaaatgagttatggaggattccctctttttctattgattggaataatttcagaaggaatggtaccagttcctccttgtacctctggtagaattcggctgtgaatccatctggtcctggacttttttttgttggtaagctgttgattagtgccacaaattcagagactgttattggtctattcagagattcaacttcttcctggtttagtgttgggaaggtatatgtgtcaaggaatttatccatttttctagattttctagtttatttgcgtagaggtgtttgtagtattctctgatggtagtttgtatttctgggggatcagtggtgatatcccctttatcattttttattgcatctatttgattcttctctcttttcttctttaatagtcttgttagcggtctatcaattttgttgatcctttcaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttaggttgtcaattttggatctttcctgctttctcttgtggaaattttgtgctataaatttccctctacacactgctttgaatgcgtcccagagattctggtatgttgtgtctttgttctcgttggtttcaaagaacatctttatttctgccttcatttctttatgtacccagtagtcattcagaagcaggttgttcagtttccatgtacttgagcggttttgagtgagtttcttaatcctgagttctggtttgattgcactgtggtctgacagacagtttgttataatttctgatcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttaactttctgtctcattgatctgtctaatattgacagtggggtgttaaagtctcccattattattgtgtgggagtctatgtctctttgtaggtcactcaggacttgctttatgaatctgggtgctcctgtattgggtgcatatatatttaggatagttagctcttcctgttgaattgatccctttaccattaagtaatggccttctttgtctcttttgatctttgttggtttaaagtctgttttatctgagactaggattgcaacccctgcttttttttgtttttcatttgcttggtagatcttcctccatccctttattttgagcttatgtgtgtctctgcacatgagatggttttcccgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcattatttgatgcagtttcttcctagtctcgatggtctttacattttggcatgattttgcagcggctggtacccgttgttcctttccatgtgtagtgcttccttcaggagctcctttagggcaggcctggtggtgacaaaatctctcagcatttgcttgtctgtaaagtattttatttctcctttgcttatgaagcttattttggctggatatgaaattctgggttgaaaattcttttcttcaagaatgttgaatattggcccccactctcttctggcttgtagagtttctgctgagtctcatgggcttccctttgagggtaacccgacctttctctctggctgcccttaacatttttttcttcatttcaactttggtgaatctgacaattatgtgtcttggagttgctcttctcgaggagtatctttgtggcgttttctgtatttcctgaatgtgaatgttggcctgccttgctagatgggggaagttctcctgcataatatcctgcagagtgttttccaacttggttccattctccccgtcactttcaggtacaccaatcagacatagatttggtcttttcacatagtcccatatttcttggaggctttgttcatttctttttattcttttttctctaaacttcccttctcacttcatttcattcatttcattttccatcattgataccctttcttccagttgactgcatcggctcctgaggcttctgcattcttcaggtagttctcgagtcttggctttcagctccatcagctcctttaagtacttctctggattgattattctagttatccattcatgtaaatttttttcagagttttcaacttctttgcctttggtttgaatttcctcccatagcttggagtagtttgatcatctgaagacttcttctctcaactcgtcaaagtcattctccatccagctttgttccattgctgttaaggaactgtgttcctttagaggaggagaggtgttctgctttttagagtttccagtttttctgctctgttttttccccatgtttgtggttttatctccttttggtctttgatgatggtgatgtacagatgggtttttggtgtggatgtcctctctgtttgttagttttccttctaacagacaggaccctcagctgcaggtctgttggagtttgctagaggtccactccagaccctatttgtttgtgtatcagcagcggtggctgcagaacagcagatttttgtgaactgcgaatgctgctgtctgatagttcctctggaagttttgtctcagaggagtacccggccgtgtgaggtgtcagtctgcccctactggggggtgcctcccagttaggctgctcaggggtcggggtcagggacccacttgaggaggcagtctgcccgttgtcaaatctccagctgcatgctgggaggaccaatgctctcttcaaagctgtcagacaggtacatttaagtctgcagaggttactgctgtctttttgtttgtctgttccctgcccccagaggtggagcctacagaggcaggcaggcctccttgagctgtggtgggctccacgcagttcgagcttcctggctgctttgtttatgtaagcaagcctgggcaatggtgggtgcccttcccccagcctcactgccaccttgcagtttgatctcagactgctgtgctagcaatcagcgagactctgtgggtgtaggaccctccgagccaggtgggggagataatctcctggagcaccgttttttaagccccttggaaaagcgcagtattcgggtgggagtgacccgattttcttggtgtcgtctgtcacccctttctttgactaggaaaaggaactccttgaccccttttgcttcccaagtgaggcaatgcctcaccctgcttcggctcacacatgttgtgctgcacccactgtcctgcgcccagtgtctggcactctctagttagatgaacctggtaccgcagatggaaatgcagaaatcacccgtcttctgtgtcactcatgctgggagctgtagaccggcgctgttcctacttggccatcttggcctgggacccccttggtctttatttataagcatgaacaaaatgataatcagcttatataatccagaaatgttcacggggtcttttagttgtataatttttttattattatactttaagttctagggtacatgttcacaacatgcaggtttgttacatgggttatacatgtgccatgttggtttgctgcccacattaactcatcatttacattaggcatttctcctaaggctatccctccccctgggccccacactctgacaggccccagggtgtgatgttccccatggtgtgtccaaatgttctcattgttcaattcccacctgtgagtgagaacgtgcggtgtttggttttttgtccttgtgatagtttactgagaatgatggtttccagcttcatccatgtccctgcaaaggacatgaactcatcctttttcatggttgcatagtattccatggtgtacatgtgccacattttcttaattcagtctatcattgatggatatttggattggttccaagtctctgctattgtgagtagtgccccaataaacatatgtgtgcatgtgtctttatagcagcatgatttataatcctttggatatatacccagtaatgggatgactgagtcaaatggtatttctagttttagatccttgaggaatcaccacactgtcttcgacgtggttgaactagtttacactcccatccacagtataaaagtgttcctatttctccacatcctctccagcacctgttgttccctgacttttaaatgatcaccattctaactggtgtgagatggtatctcattgtggttttaatttgcatttctctgatgaccagtgatagcattttttcatgtgtctgttggctgcataaatgtcttcttttgagaagtgtctgttcatatccttcagccaattgttgatgtgattgttagtttttttcttgtaaatttgtttgagttctttgtagattcttgatattagccttttgtcagatgggtagattgcaaaaattttctcccattctgtaggttgcctgttcactctgatggtagtttcttttactgtgcagaagctcttcagtttaactagatcccatttttcaattttggcttttgttgccattgcttttggtgttttagtcatgaagttgttgcctatgcctacatcctgagtagtattgcctaggttttcttctacgatttttatagttttaggtctaacatttaagtctttaatcaattttgaattaatttttgtataaagtctaaggaagggatccagtttcagctttctacataagctagccagttttctcagcaccatttattaaatagggaatcctttccccgtttcttgtgtttttttttttttttttgagagggagtctcgatctatcacccaggctggagtgcagtggcgtgatctcggctcactgcaacctctgcctcctgggttcacatgactctcctgccttagcctcccaagtagctgggactacaggcgcttgccactacgcccggctaattttttgtattttttagtagagatggggtttcaccatgttagccaggatggtctcaatctcctgacctcgtgatctgcgcaacttggcctccgaaagtgctgggattacagacaagagccaccacacctggccccccatttcttgtttttgccaggtttgtcaaagatcagatagttgtagatgtgtggtattatttatgagggctctgttctgttccattggtctgtatctttgtttggtaccagtaccatgctgttttggttactgtagccttgtagtatagtttgaagttaggtagcatgatgcttccagctttgttcttttggctgaggattgacttggcaatgcaggctcttttttggttccatatgaactttaaagtagtttttccagttctgtgaagaaaatcattggtagcttggtggggatggcattgaatctataaattaccttgggcagtatggccattttcacgatattgattcttcctatccatgagcatggaatgttcttccatttgtttgtatcctcttttatttcattgagcagtggtttgtagttctcctcgaagagttcctttacgtcccttgtaagttggattcctaggtattttattctctttgaagcaattgtgaatgggagttcactcatgatttggttctccgtttgcctgttattggtgtataagaatgcttgtgatttttgcgcattgattttgtatcctgagactttgctgaagttgcttatcagcttaaggagattttgggctgagacgatggggttttctagacatacagtcatgtcatcttcaaacagggacaatttgactttctcttttcctaattgaatgccttttatttccttctcctgcctgattgccctggccagaacttccaacactacgttgaataggagtggtgagagagggcatccctgtcttgtgccagttttcaaagggaatgcttccagtttttgcccattcagtatgatattggctgtggatttgtcataaatagctcttattattttgaaatacatcctatcaatacctaatttattgagagtttttagcatgaagggctgttgaatgttgtcgaaggccctttctgcatctattgagttaatcatgtggtttttgtctttggttctgtttatatgctggattacatttattgatttgcatatgttgagccagccttgcatcccagggatgaagcccacttgagcatggtggataagctttttgatgtgttgctgcattcggtttgccagtattttattgaggattttgcatcgatgttcatcaaggatattggtctaaaattctctgtttttgttgtgtctgtggcaggctttggtatcaggatgatgctgacctcataaaatgagttagggaggattccctctttttctattgtttggaatagtttcagaaggaatggtgccagctccttcttgtacctctagtagaatttggctgtgaatctatctggtctttgactttttttggtttgaaagctattaattattgcctcaatttcagagcctattattggtctattcagagattcaacttcttcctggtttagacttgggagggtatatgtgtccaggaatttatcaatttcttctagattttctagtttacttgcatagagatgtttataatattctctgatggtagtttgtatttctgtgggatcggtggtgatatcccctttatcattttttattgcatctatttgattcttctctcttttcttctgtattattcttgcttgcagtctatcaattttgttgatcttttcaaaaaaccagctcctggattctttgattttttgaagggctttttatgtttctatctccttcagttctgctctgaccttagctatttcttgccttctgttagcttttgaatttgtttgctcttgcctctctagatcttttaattgtagtgttagggtgtcagttttagatctttcctgctttctcttgtgggtacttagtgctataaatttccctctatacactgctttaaatgtgtcccagatattttggtacatcatgtctttgttctcattggtttcaaagaatatctttatttcagccttcatttcattatttatccagtagttatttgggagcaggttgttcagtttccatgtagttaagtggttttgagtgagtttctttatcccgagtcctaatttgattgcactgtggtctgagagaccgtttgttgtgatttctgttcttttacatttgctgaggagtgctttacttacaactatgtggtcaattttggaaaaagtgcaatgtggtgctgagaatgtatattctgttgagttggggtggagagttctgtagatgtctattaggtctgcttggtgcagagctgagttcaagtcctagatatcctttttaaacttctgtcttgttgagctttctaatattgacagtggggtgttaaattctcccattattattgtgtgggattctaagtctctttgtaggcctttgaggacttggtttatgaatctgggtgctcctgtattgggtgtatatatatttaggatagttagctcttcttgttgaattgatccctttaccattaggtaatggccttctttgtctcttttgagctttgttgatttaaagtctgttttatcagagagtagaattgcaacctctgcttttttttcctttccatttgcttggtagatcttcctccatccctttattttgagcctatgtgtgtctctgaatgtgagatgggtctcctgaatagagcacactgatgggtcttgaatctttatccaatttgccagtctgtgtcttttaattggagcatttagcccattacatttaagattggtattgttttgtgtgaatttgattctgtcattatgatgttagctggttattttgcccgttagttgatgcagtttcttcctggcatctatgatctttacaatttggcatgtttttgcagtggctggtactggttgttactttccatgtttagtgcttcattcaggagctcttgtaaggcaggcctggtggtgacaaaatctctcagcatttgcttgcctgtaaagtgttttatttctccttcacttatgaagcttagtttggctggatatgaaattctgggttgaaaatttttttctttaagaatgttgataccttacatctacaaccatctgatctttgacaagcctggtaaaaacaagaaatggggaaaggattccctgtttaataagtggtgctggaaaaactggctatccatatgtagaaagctgaaactggatcccttctttacaccttatactaaaattacttcaagatggattaaagacttacatgttaaatctgaaactttaaaaaccccagaagaaaacctaggcaataccattcaggacataggcatggataaggacttcatgtttaaacaccaaaggcaatggcaacaaaaaccaaaattgacaaatgggatctaattaaactaaagagcttctgcacagcaaaagaaactaccatgagacttaacaggcaacctacagaatgggagaaaatttttgcaatccactcttttgacaaagggctaatattcagaatctacaaagaactcaaacaaatttacaagaaaaaaacaaccccatcaacaaatgggcaaaggatatgaacagacacttctcaaaagaagacatttatgcagcccacaaactcatgaaaaaatgctcatcatcactggccatcagagaaatgcaaatcaaaagcataatgtgataccacctcacaccagttagaatggtgatcattaaaaagtcaggaaacaacaggtgctggagaggatgtggagaaataggaacacttttacactgttgggagtgtaaactagttcaaccattgtgaaagacagtgtggcaattcctcaagggtctagaactagaaataccattggacccagccatcccattactgggtatatacccaaaggattataaatcatgctgctataaagacacatgcacacgtatgtttattgtagctctattcagaatagcaaagacttggaaccaacccaaatgtccatcaatgatagactggattaagaaaatgtggcacatatgcgccatggaatactatgcaaccattaaaaatgatgagttgatgtcctttgtagggacatggatgaagctggaaaccctcattctcagcaaactatcgcaaggacaaaaaaacagacaccgcatgttctcactcataggtgggaattgaacaatgagaacagttggacacaggaaggggaacatcatacactggggcgttttgtggagtggggggaggggggatagcattaggagatatacttaatgtaagtgatgagttaatgtgtgcagcacaccaacatggcacatgtatacatacataacaaacgtgcacgttgtgcacatgtgccctagaacttaaaaaaaatgttgaatattggcccccactctcttctggcttgtagagtctcccaagagatctgctgttagtctgatgggcttccctttgtgggtaacctgacctttctctctggttgcccttaacattttttccttcattttaaccttggtgaatttcacaattatgtgtcttggggttgctcttcttgaggagtagctttgtggtgttctctgtatttcccaaattttaatgttggcctgccttgctaggttggggaagttcccctggataatgtcctgaagagtattttcctagttggttccatccttccttgtcactttcaggtacaccaatcaaacgtagatttgttcttttcacatagtcccatatttcttggaggctttgttcatttctttttactcttttttctctaaacttgtcttcgttctttatttcattaatttgatcttcaatcactgataccctttcttccactttagcaaatcagctattgaagcttgtgctttcatcatgtagttctcatgccatggttttcagctccatcaggtcatttaaggtcttttctacattgtttattctagttagccattcatctaatcttttttcaaggttccttgcaatgggttcgaacatcttcttttagcttggaggtttgttattaccgaccttctgaagcctacttctgtcagctcatcaaagtcattctccagccagctttgttccgttgctggtgaagagctgcgatcctttggagggaagaggggctctggtttttagaattttcagattttctgctctggtttctccccatctttgtagttttatatacctttggcctttgatgtcggtggccagaaatggggttttggtgtggatgtccttttagttgatgttgatgttattcctttctgtttgttagttttccttctaacagtcaggtccctcagctgcaggtctgttggagtttgctggaggtccactccagagcttgtttgcctgcatatcaccagtggaggctcagttggaaatgcagaaatcacccatcttctgtgtcaatcatgctgggagctgcagatgggagctcttcctatttggccatcttggaacgtaatattttagttctataattttaagaatataataccttggtctggcatgtttaaatgccattttgtataatttttataacctttaaaatatacaattgttacttaaaatttgaaaactgcaccatttatataaaattataaactactatttcttatctatcactagtccatgactgtggaagaaaattacatcattcactgtcatgactcctaaatatgatgtccttaaaagaactgtctgcactcacaaactgaaattttctttccattcattcttgatcttatttcagtagtcttcaatttcagcactcctccaaagttgtttttctcaagattatcacaacttttattgtgtaataaatctaggcattttttcttacatctcattttatttaatttatcagcagtatttgacccagtggaggatatctccttcataacagcatcttcacttggttttcaagacctcactccctcaggctttttctcctgccttcgtagtccattcatcatggtctgtttttgttgctcctcctcatctttcaccttttgcacattgttgtttcccagggctcagtccctaatcttctttctcatgacttttttttttttttgaggtggagtctcactctgtcacccatgctagagtgcagtggtgaaacctcagctcattgcaacctgtcttgtgggttcaagcaattctgctgcttaaacctcctgagtagctggaattacaggcacctgccaccatgcctggctaatttttgtctttttagtagcagcatggtttctccatgttggccaggctgttctcaaactccggatctcagatgatctgcccacctcagcctcccaaagtgctgggattaaggtatgagccagcaccccagcccctcatgactttttctaatgtgtatatgctagtgatttccaaatgtatgtctctagctcagacctctcaccttaattccagatctctatatcaacctgcctacttgacatctctttttggttggctattgggcatcacacacttgccagatccaaaattgggctactggtgcccttcctgaaatcgacacctcatgcaatctttcctaatttggttagtggccactcttccagttgctctaccaaaaaccttggtgtcattcttgactcatctttctttctctcttatacctcacatccaatctatcagtaaatcttgtcaggtctactggaagaatatatccagaagccagtcatatcttttatatctgagccaccatcatctgtagtctagatgagtgtcatagactggtaatggatagtcctggtttttaaaaaatttcctttaaatctattcttaactcagtggcaaaacataagtcgaattgtgtcattcctctgccccaacccttctgattgccttccatttcactctgagtatgtgacaaaattcctcctaataactaaaaggcagtacaccatctagcatgttttctctcctgcttaaacttctattacttctctcctttgctctgcttcagccacactgaacttctcgctattccttatctatctctcttgctgaacgactccaggtacacctctatacttggcagttccttgtgttcttcagttctttacttaaaaatcccctttctcagcagggacctttctggccatcccaacttttccaccacccttcccctcaaacacataatcatttcattttcctgctttagtttttctcctctaacatactgtatattttgccttatctgtctattgttgtgtgtttatctcattctcatgaataggatttttattgttcactaccatatcctcagtgcctagaaaaaggcctagcatatcggatgtatctacctaacaaatactcgtgggtatattacatttgattgattctcacttaaaaaatgtttgacaaggttcactctaacaacttagcctggtaattatatgcataaattcttttggctctttataataagctacattcttaatattttttcatttagggagaaaatcccaatattgtggttattcaccatttattattttactggtaatcatgataattttaattatggtaaaatgcatcagaggaattgcaaactttactggtattttatctgaaaaatattagggtggtaaatttaatggacttacaaattctttccaacggattatgaaacttcagtatttgaaataaaaaaacagagttggaattttttgcttgctgtataagaggtgtactgatcaggcactgtctgctctgatggagcagctgctgctgcttggctgtctttcagaagcaagctgctcacattgatattggtgggcaagcaagggcagcggtcattgatcgattgactagatttagaacttgccctgggtggcttcttgttatcatggctacaggtcagttcttttctaagtttgtgctgtttaaaggttgccttccattaactattttcaaaatgaaactattttatattccagaattgcatacttaattttaaagttttttcaagatgaattggttaataatagctctcaggaagacctttttttttttttttttttgctacatagtcttgtcttaaccagaagagttctctgtataatttatttcttaaaaataatggttttgtttttgttttcagtgtttttagaagcttttgctcaagtcctaacataaactccaatgggagattttaatctctttgtcagttcatggatgtgtatgatagtgatattctctctttttaaattccttttcttgttcactttcttctttgtacaataatagtgatattcttgtgcatgtttacctcattaaaaagtaattacaattttctgctggcaaatccagctttttatattttgactaaataggaggctaaaagtgaagaacatttaccagattgttttattttcaaacaaaatcataactaatcaaaaattgctatttttgaaatataaataatgacatttagatattttaaaagtaaggatagcccccgatgtaggttggctttgtgtccccacccaaatctcatgtcaaattgtgattcccaggtgttgtgagaaagacctggtgggaggtgattagatcatagggttggtttcccccatgctgttctcatgatagtgaatgagttttcacaagagctgatggtttcttaaagggctctatccccttcacttctctctctcctgccaccttatgaagaaggtgtctgcttccccttcaccttaccatgattgtaagttttctgaggcctccccagccatgtgtaactgtgaatcaattaagcttctttcctttatgaattaccccatctcagatatttctttgtagcagtgtgaaaatggactaatacagagaattggtaccagggatagtggggtattgttaaaaagataatgtgaaaaggtggaagtgactttggaactgagtaacagaggttttaacagtttggagggctcaaaagaagacaggaagatgtgggaaagtttggaacttcctacagacttgttgaatagttttttttaccaaaatgctgatagtgatatggccaatgaagtccaggctgaggtgatcttaggtggagataaggaacttgttggggactggaacaaaggtgactcttgatatgctttagcaaagagactgacagcattttgcccctgcactagcaatctgtaaaactttgaacttgagagagatgatttaggctatctggtagaagaaatttctaagcagcaaggcattcaagaggtgacctggttgattctgaaagcattcagttttatgcattcacaaagagatggttttaagctggggcttatgtttaaaagggaagcagagcataaatttggaaaatttgtagcctgaccatttggtagaaaagagaaacaacacattttctatggacgaatgcaagttggctgcagaaatttgcataaataacgaggagcggaatgttaattgccatgaaatggagaaagtgtctttagggcatgacagagatcttcgtggcagccactcgcatcacaggcccagagtcctggaaggaaaaaatggtttcataggtttgggtccagggccctggtactgtgtgcagcctcaggacttgctgccctgcattcagccactacaggtccaactgtggctaaaagggaccaaggagaaacttagcctttatgaattacccagtcttcagtatttctttatagcagtgtgaaaatggactaatacaccctccctgaagacattttcctgatttcgtctttcatgttttatgtgccacagctacttttgaaattgtatttaaaggtaaacattattatattgaataatagaaacagaaatatagcccaaatctaattgtgattttcatgtttaacagtcatttctcatattcagtggactccagctttttaatatagcattcaagtgtagtgtagattcatctcctattcttagcttccaagtattttacacttttcctttcaagttcttagtaagcatctagacttcatgtgcttaatctttgtgctcacattctgttctctaactggaaggattttctctcactgtttttccctagtgggcccttcttatattttgcctcttctctaaagccttccttgtgctaaaatataactttttaatatatcaactcttacagaacacaatgtattataattgtatattaccttgtttttgaagcaggggatgcacatttccttttatgttgtttgtagttctaaacatttaaaaaattaatcagtgcaatgagatggaaaacagttggagttttacaaaaattgtggtttttttgttcattgtcaatagagttattaggaaacattggctttttatagagtttttaaagtagagcttttgccttgcatatgaagaaagaaacatgaaaataaaaaacggacctcaaaataatctgtgattacacccatatttgagaaggccaatttactaactcatggtctgcaacaagtaaatgatgatagcagtttaagtgaaatagatggtaaagaaggtaaaatttataagtcctttataagaaatatctgggaacaccccctcaaaaagtgggcaaaggatatgtgcagacacatctcaaaagaggacatttacgtggccaagaaacatgaagaaaagctcatcatcactgatcattagaaaaatgcacatcaaagccacaatgaggtaccatctcatgccagttagaatggtgatcattaaaaagtcaggaaacaacagatgctggtgagcctgtggagaaacaggaacacttttacactgttggtgggagtgtaaattggttcaaccattgtggaagacagtgtggtgattcctcaaggatctagaaccagaaataccatttgacccagcaatcccattagtgggtatatacccaaaggattataaatcatgctactataaagacacatgcacacgtaagtttattgcggtattatttacaatagcaaagacttgtaaccaacccaaatatccatcaatgatagactggataaaaaaagtgacaaatataatccatggaatactgttcagccataaaaaagaatgagttcatgtcctttgcagggacatggatgaagtgagaaactatcattctcagcaaactaacatgggaacagaaaaccaaacactgcatattctcactcacaagtgggagttggacaataagagcacatggacatagggaggggaacatcacacactggggcctgcctgggggtgagggagcaaggggagggagagcattaggacaaatacctagtgcatgcaggacttaaaacctagatgacaggttgataggtgaagcaaatgaccatggcacatgtatacctttgtaacaaacctgcacgttctgcacatgtatcccagaacttaaggttaaaaaaattttaaagtcaaaaaaaaaaaaaaaaagaaagaacaaaaaagaaagaaaagaaaataaatctctaggaaagaacgttaacaccaattacttttcctggaactagaataatatagtctcctcaaactggaaatactcaactgtatcagtgctgttgaaagattgattataataaggattagtgactttgactaggagaagtttcaacaaatgatagccatggaaatctgtagtggatgaatgtagacaactcttgagagaaaatttgctgggaaaggcaatatagaaatgggcaataattaaaaaagagtgtgggatttgagggagttttctctctttgtgtttcaaaacagaaatttttagagtttattttttactgttgggaatgatccataagagaagaacatggttatgaaaggtaattttgtttgcttggttgcatgtctaagcattagacagcttgattcattatcttttatggatttttagcaaactaattgcccttagaacttctattcatgtatagttttatgattagagttgttttttcagaattggttcagaagtgtaacatgttagtgtaactgtacatgccgatgatgacctaaaacttaaactgtcatacacagatttttaaaaagaattataataaacattcacacacttaggccatgctgaatagaatttaaatgttccttcataattgcacatcttgcactacctttgacagtagcatcatgaatagccatgatttgcttaggtacttactctaaaatatcaggtgtatcaactttatgattgtttagattctggggagtagggaaggattttgttcatgaagttgagaaaagcaaactattgacaatctattgcagattattacttcaggattataaactcctaaagcatcaaagccatattttcctgggccagcaatgttatcagcatatattgtatgctcaatgagtatttgttgaatgcatgaataaacagttgaagaaataaatgaatgacattgataaatttcttttaaaaactaatttttagttttttgaaagtagtaggtttccaaacttgcctctgtataaagtctttattttttaaaaaagtgcaggattcatgttctcactcataggtgggaattgaacaatgagaacacatggacacaggaaggggaatatcacataccagggactgttgtggggtggggggaggggggagggatagcattaggagatatacctaatgctaaatgatgagttaatgggtgcagcacaccaacatggcacatgtatacatatgtaacaaacctgcacgttatgcacatgtaccctaaacttaaagtatgtatatataaaaaaaagacactgcaattttcaaaaggtgaaaaaaaagtgcaggattcagaaattattagttatagccaaaaacagaatgataatcagaaatttttagttatagccaaaaacagaatgataatatggatttgtctgctatcatatctcttaaaaacacttgaatataaatattaccttcacagcatattgcaaaacacatgttttggagggagaattcttggatttcaatgctgtgtcaattactgaccagctctatgggctgggaaaatttatatggcctttctgggcctagtttctttctttatagaagccctaatattacctacctcaaagaattgttatgatgattaaaatgagcttgacacatgcacagtgcttagaatgatgcatagtgtctgcataataagtcctgaaaaagctaatattatcatttaaaaaagggttcccctcacataagaacataaataatgttttccaaataggtttcagtgccagtaaaagcttgtttttattgaaaaggacagcaatgagaagtcctggtatatgtctttctatcacataatatcagtaacatgtttttccttttgccttgactgtcagaaagcttgatctaaattcaattctttgtaatgatattattattatcatattttctttctcccttaatgttactctttctgtttatagtttaattccccatgtggaaaatagttatatttacattacctgttaaaaaatgacctgaacacttaatggatagaataaataacttataaatgccgagattttatataataaaataatagatttggacattatttgtattttatgtatttgtttgtctaagaagaattgtttcttttttcaggcctgaaaagaaatctaatgaaaagaacaaggtattgtaataagtaaattatctgaaacattattgttaaaaaaacacattataaaaggtaaagtgagaaccttttttaataaagacaattagttagaataaaagggcttaataacaagtacccattgataacggtacccttttaagaaaaatctgttgttttaagaagcacctgtggttttgctcatataaaaatatgaataaataccacttctgtacaactggtatattctatgaatattttgaggacatttgaggcagtattatttatcttacaggtcaaaagccaaatacattcagtggataaccttgatgacataacatggccatcagaaatagcgtcagaggattatgatttgcttttctctaattatgagacttttacattgctcattgaacaactcaaaatggattttaacggtaggaccattgcataagtagaaggccttttaatgtatcccacagtaatattcacacacattgcttagtattgcaccacagagcactgacgtgtgatagggatgatcatctcagaaacgtgtttgacattaaaatagactgagaaataatgtatattgtataccaaagagctatgataactccactgtacctttctcagtgtgaagggcagtctcagcctttttattgactctgcttctcccagatcgggttaccattctctcccactcagaatactgcagtaaccttagaactatttttcctgctaccccacttcctgagaccatggtctactctgaaactataattattaatttaaaaaaattcagatctgatgttgtctcttccttgtaactcagcataccacttgccattgctattaggttaagatctgaatattctagctctctcttgcatcatttaatacccttttttccctgccctagccattgtcttagatgtttattcctgcaatttatagctttagtgaggtataactgatatatgataggctgaatgtacgtaaaatatacgatttgataagttttggcatacgtatgcacatgtgaaaccatcaccataatcaagagcagtaacatgcccatcatccataaaaatctcttcctgtccgtttgtattctccttattaagaaactactaaatgtttaagtatttatactgtattccattcccatcagcagtatatgacaattctcattgtgcaatgtcatcatgagctcttagtattgctgtttattagtttttactgttagccattccaatgggtgcatattgtgcgtgtcactgtggtgtgaatatgcattgacctaaggactaagaatgttgaacatcttcccgtgtgctgatttgccacctgtatatcttctttagtgaactgtcttttccaatctggatagcttataaagatttaaaaattagatagtttttattcttatttgctgagttttaagagttttttaaaataaattctggatatcattccattattatgctttttcagaaagattttttcccagtttgtagcttgactttttgttttcttaataatatattttaaagagctgaagtttttcgttttgatgaaatgtgatatatctgttcgtttaattacagactttgctttttgtctcatgcctaaaaaaagtctttgtccagcacagggtcccagagatttttctcctctgctttcttgaagaatttttatagttttaggttttatatttagatctgtgatccacattgtgtacatttttgcatatgagtgaggtgtgatgtaagttcattgtatggatgtggatatctatctgttccagcagcatatgttgaaaatgctgtcttttctccatacattgctattgtccctttgtgaaaagtaagctggcatatgtgtgtgtgtctatttctggaccatttgttgtattccatcaatctgcgtattcttctagagttatactgatgaaccaatcataatttgaaaatcaatttaataccccaataaacccattgtacagttgaaaaattctaagtagaaccatcttaaactggagactatctctatctggctttcttcatgtaggtctagcatccctaatccaaaatccaaaatcagaaatgctgcaaaatccaaaactttttgagtgccaaaatgatgccacaagtagaaaatttcaaactagacatcaggtacacaaactttcatctgcaaatttactaaaagtgttccataaaattacctttaagccctgcatataaggtgcatgtaacataagtgtattttgtgtttagagttcgattccatttttgagatatctcattatatatgtgcaaatattccaaaacccaaaacacttttggtaccatgcacttgtagagatattccacccatatcacactgtttcattactgtaaatttatactaaatcttgacaccagcccttcagttttcttcttttttaagggttattttgattatgttggatcttttgcatttgcacttgagttttagaatcagattgttaatttttttttgtagttcaaatttaactttttaaaaaattttatcattattatactttaagttttagggtacatgtgcacaacgtgcacgtttgttacatatgtatacatgtgccatgttggtgtgctgcacccattaactcatcatttagcattaggtatatctcctaatgccatccctcccccctcccccaaccccacaacactccccggtgtgtgatgttccccaccctgtgaccaagtgttctcattgttcaattcccacctatgagtgagaacatgtggtgtttttttttttgtccttgcaatagtttgctgagaatgatggtttccagcttcatccatgtccctacaaaggacatgaactcatcctttttatggctgcatagtattccatggtgcatatgtgccacattttcttaatccagtctatcattgatggacatttcggttggttccaagtcattgatattgtgaatagtgctgcaataaacatacgtgtgcatgtgtcttcatagcagcatgatttataatcctttgggtatatacccagtaatgggatggctgggtcaaatggtatttccacttctagatctctaaggaatcgccacactgacttccacaatggttgaactagtttacaatcccatcaacagtgtaaaagtgttcctatttctccacatcctctccagcacctgttgtttcctgactttttaatgatcaccattctaactggtgtgagatggtatctcattgtggttttgatttgcgtttctctgatggccagtgatggtgagcatttcttcatgtgttttttggctgcatgaatgtcttcttttgagaagtgtctgttcatacccttcacccacattttgatggggttctttgtttttttcttgtaaatttgtttgagttcattgtagatagccctttgtcagatgagtaggttgcaaaaactctctcccattctgtatgttgcctgttaagtctgatggtagtttcttttgctgtgcagaagctctttagtttaattagatcccatttgtcaattttggcttttgttgccattgcttttggtgatttagacatgaagtccttgcccatgcctatgtcctgaatggtattgcctaggttttcttctagggtttttatggttttaggtctaacatgtaagtctctaatccatcttgaattaatttttgtataatgtgtaaggaagggatccagtttcagctttctacatatggctagccagttttcccagcaccatttattaaatagggactcctttccccattgcttgttttttgtcagatttgtcaaagatcagatagttgtagataatgcagtgttatttctgagggctctgttctgttccattgttctatatctgtgttttggtaccagtaccatgctgttttgtttactgtagccttgtagtatagtttgaagtcaggtagtgtgatgcctccagctttgttcttttggcttaggattgacttggcagtgtgggctcttttttggttccatatgaattttaaagtagtttttttccaattttgtgaagaaagtcattggtagcttgatggggatggcattgaatctatgaattgccttgggcagtatggccattttcacgatattaattcttcctacccatgggcatgaaatgttcttccatttctttgtatcctcttttatttcattgtgcagtggtttgtagttctccttgaagaggtacttcacgtcccttgtaagttgtattcctaggtattttattctctttgaagcaattgtgaatgggagttcactcatgatttggttctctgtttgtctgttattggtgtataagaatgcttgtgatttttgcacattgattttgtatcctgagagtttgctgaaattgcttatcagcttagggagattttgggctgagacgatggggttttctagatatacaatcatgtcatctgtaaagagggacagtttgacttcctctttccctaattgaatgccctttattaacttctcctgcctgattgccctggccagaacttccaacactgtgttgaataggagtggtgacagagggcatccctgtcttgtgccagttttcagagggaatgcttcctgtttttgcccattcagtatgatattggctgtgggtttgtcatagatagctcttattattttgagttatgtcccatcaatacctaatttattgagagtctttagcatgaagtgttattgaattttgtcaaaggccttttctgcatctattgagataatcatgtggtttttgtctttggttctgtttatatgctgtattacatttattgattttcatatgttgaactagccttgcatcccagggatgaagccgacttgatcatggtggataagctttttaatgtgttgctggattcagttggcggtattttattgaggatttttgcatcaatgtttatcaaggttattggtctaaaattctcttttttttgttgtgtctctgccaggctttggtatcaggatgatgctggcctcataaaatgagttagggaggattccctctttttctattgattggaatagtttcagaaggaatggtaccagctcctccttgtacctctggtagaattcggctgtgaatccatctggtcctggactttttttagttggtaaactattaattattgcctcaatttcagagcctgttattggtctattcagagattcaactcttgctggtttagacttgggagggtgtatgtgttgaggaatttatccgtttcttctagattttctagtttatttgcatggaggtgtttatagtattctctgatggtagtttgtatttctgtgggatcggtggtgacattccctttgtcattttttattgtgtctacttgattcttctctcttttcttctttattagtcttgctagtggtctatcaatttttttgatcttttcaaaaaaccagctcctggattcgttgattttttgaagggtttttttgtgtctctatttccttcatttctgctctgatcttagttatttcttgccttctgttagcttttgaatgtgtttgctcttgcttctctagttctcttttattgtgatgttggggtgtcaattttagatctttcctgctttctcttgtgggcatgtagtgctgtaaatttccctccacacactgctttgaatgtgtcccagagattcttgtacgttgtgcctttgttctctctggtttcaaagaacatctttatttctgccttcatttcgttatgtactcagtagtcattcaggagcaggttgttgagtttccatgtattttagcagttttgagtgagtttcttaatcctgagttctactttgattgccctgtcatctgagagacagtttgttataatttctgttcttttacatttgctgaggagtgctttacttccaactgtgtggtcaattttggaataggtgtggtgtggtgatgaaaaaaatgtatattctgttgatttggggtggagagttctgtagatgtctattaggtctgcttggtgcagagctgagttcaattcctggatatccttgttaactttctgtctcgttgatctgtctaatgttgacagtggggtgttaaagtctcccattattattgtgtgggagtctaagtctctttgtaggtcactaaggacctgcttcatgaatctgggtgctcttgtattggtggcatatatatttaagatagttggctcttcttgttgaattgatccctttaccattatgtaatggccttctttgtctcttttgatctttgttggtttaaagtctgttttatctgagactaggattgcaacccttgcctttttttgttttccatttgtttgttagatcttcctccatccctttattttgagcttatgtgtgtctctgcacgtgagatgggtttcctgaatacagcacactgatgggtcttgactctttatccaatttgccagtctgtgtcttttaattggaacatttagcccatttatatttaaggttaatattgttatgtgtgaatttgatcatgtcattatgatgttagctggttattttgctcattagttcatgctgtttctttctagccttgatagtctttacaatttggcatgtttttgcagtgtctggtactggttgttcctttccatgtttagtgcttccatcaggagctcttttagggctggcctggtggtgacaaaatctctcagcatttgcttgtctgtaaagtattttatttctcctttgcttatgaagcttagtttggctggatatgaaattctgggttgaaaattctttctttaagaatgttgaatattggcccccactgtcttgtggcttgtagagtttctgctgagagatcagctgttagtctaatgggcttccctttgttgttaatccgacctttctctctggctgctcttaacattttttccttcatttcagttttggtgaatctgacaattatgtgtcttggagtttctcttctccaggagtatctttgtggcattctctgtatttcctgaatttgaatgttggcctgccatgctagattggggaagttctcctggataatatcccgcagagtgttttccaacttggttccattcttcccatcactttcaggtacaccaatcagatgtagttttggtcttttcacatagtcccatatttcttgaaggctttgttcatttctttttattcttttttctctgaacttctcttctcactcatttcattcattttgtcttccattgctgataccctttctgccagttgatcgcatcagctactgaggcttgtgcatttgtcacatagttctcataccttgggtttcagctccgtcaggtcctttaaggacttctcttcactggttattctagttagccattcatctaattgtttttcaagatttttaacttctttgccattggttccaacttcctcctttagctcagaatagtttgatcttctgaagcgttcttctctcaactcatcaaagtcattctccgtccagctttgttccattagctagtgaggagctgtgttcctctggaagaggagaggacctctgatttttagagtttccagtttttctgctctgttttttccccatctttgtggttttatctacctttggtctttgatgatggtgacatacagatggggttttggtgtggatgtcctttctgtttgttagttttccttctaacagttaggacccccagctgcaggtctgttggagtttactggaggtccactccagaccctctttgcctgggtatcagcagcagtggctgcagaacagcggatattggtgaacagcaaatgctgctgcctgatcgttcctctggaagttttgtctcagaggagtacccagccatttgaggtgtcagtctgcccctactgttgggtgcctcccagttaggctactcagcagtcagggacccacttgaggaggcagtctgtccattctcagatctcaagctgtgtgctgggagaaccactattctcttcaaagctgtcagacacggacttttaagtctgcagaggttactgctgcctcttgttagtctgtgccctgcccccagaggtggagcctacagaggcaggcaggcctgcttgagctgtggtgggctcctccgagttagaacttcctggcagctttgtttacctactgaagcctgagcaattgtgggtgcccctcccccagcctcactgctgccttgcagtttgatctcagactgctgtgctagcaatgagtgaggctccgtgggcataggaccctctcagccaggtgtggggtataatctcctgatgtgccatttgttaagcccattggaaatgcaaagtattagggtgggagtgacctgattttccaggtgccatctgtcacccctttctttcactaggaaagggaattccctgaccccttgtgcttcctggtgaggtgatgcctcaccctgctttgcctcatgcatggtgtgctgcacccactgtccagcactcctctgtgggatgaacccagtacctcagttggaaatgcagaaatcacccatcttctgcatgtctcacgttgggagctgtatactggagctgttcctatttggccatcttggctccacccctctcccagatagttaattttttaaaaacctgctgtgctggaaattacactgagttagtgatgaatctatacattaattgggggaagatttacattttaatgagaatgcattttttgactcctgtgaaatggtttctatttatataggtcaaatttaattttctcagtaatattttatagattttaaaatatggctttcctttctttttgagacagtttcactccaggctggattgcggtgcctcgatcttggcctactgcaacctctgcctcctgggttcaaatgattctcctgcctcagcctcctaagtaactgggattataggcatgagccactgcacccagctaagttttgtatttttagtagagatggggtttcaccattttgtccagagtggtcttaaattcctgaactcaagtaatcctcccggcttggcttcccaaaatgctgggattacaggcatgagccactgtgcccagccttggtgtttccttattttatcagattcatctgtatctcattttttaatgaagttataaatgacatttaaaaaaatttcaagttgattgtttactgctaggatataggaatacagctgatttttgtatgttgatttttgtatcctccctccttgctaaacttagacttacttattagttctagtagcttttttggtagatttgatcagattttatacatacaacaaagattatcaaatcttttcattctcaaactactttcttactatggataggaagtcttttagacttgtggcaaagcagtctctgttgcagctagtcaactctgccattgtagtatgagagcagtcagggaagttacctacattaataaactcagctgtgttccaataaaactttatttacaaaagccagaagctggcccagaggctgtagtttatctgcccctattatgtgatcatggttgtgaataaagacagttttacttcttctttccaacctggataacttttatttatttttcttgtctgacagcactggctagaatcttcagcacaatgcttactaaagtgttgaaagcaggcattattgtgtcattcctgatacggggaaagcattcagtttgtcatcatgatacacattaactgtaggtttattatagatgctttgtatcatgctgatgaagttcatttgtattcttaggttgctgagtttttttttctttttaaatcaagaatgaagttgaattttatcaaatgtctttatttactgagataatcataaggttcttctcttttagtgttttaatggggtgaataactgatattttaatgttaaaccaacctttcattttagaataaaacttattttcttaggatgtaggcttttaaaaagtatatcattggggccggacacggtggctcatgcttgtaattttagtactttgggaggtcaaggcaggaggattgcttgaagctggagttcgagaccaacctgggcaaaaaaatgagaccctatatttatttgtattcagtttgccaaaattctgtttagaaaattttaaaagactatgtaaatgtagttttaggttcacagcaacattgaaagtatggtacagagattgtctgtgcttcctgtccacagacatgcatagcttcccccattatcagtatctctcactatagtggtacagttgatatgattgatgaaccaaaattgcatgtcataatcatccagatttcatagtttatattagtgtgcactcttggtgttgtacattctgtaggtttggaaaggactgatattcatcattatagtattgtacaaagtaattttactgctctaaaatttatttatgtttcacctatctgccctttcatgccctcctcaaccacaggtaaccactgatctttttactgtatccatagttttgccctttctacaatgtcatatagctgaaatcatacagtgcatagccttcagattggcatctttcacttagtaatatgcgtttatgtttccatcatgtcttctcatgacctgatagctcgtttctgtttagaactgaataatggttcattgtgtaactgtaccagaggttgttcactcacctattgcaaggtatcttggttgcttcagaaatttgtgaaatattttgtcaatgttcatgagggagttttcttttttgtaatatcattgtttggttcagggtaatgctagcattatagaatgagttgtgttgtatttctcctctttattatttgggagagaggttgtgtaaaattatattacatctgcctaaactgtttgatagaattcactagcatagctatctgggcctggagttttctcaactttattttctttcatagatatagggtgatttggattatctatttcttcttgattgagctttggtaatttttattttttaaggaacgtgcccacttaatctaagtggtaatggttagttacataaagcttgcactattatcttgctattcttttaatatctgtagaatgtataaaaatgttacattaattatctctgaagttagtaatttattctcttttttatgatcagcctggctaggtcaaggtttatcacttccactgatgacctcaaagtatttggttttattgattttccctattgttctcctgtttcatctttgatgtcatcatcggtttggcctgctctcacaaaataccatagacttggtagcttataaacaacagaaactgatttcatacattcctaaaggctgcaaagtccaagatcaaggtgccagaagattcagtgtctggtgagggacaaattcctgatttctatattcctttatttcccctgtgtgcttcatatggcagaaggggtgaatgagctttctggggtctcttatataagaagggcactaatcccattcattagggcttggattccatgagctatcacctccacaaagctgcagtatctaataacatcacctctgtgattaagtttcagcatatgagttttgggaggacaaaaatgttcacactatgttctgatgtttattattttctctgcttctgttgggtttaatttgctctctttttttgtagtttcttcttttttacttacttttcgtttgtttgcttgtttttgagacagagtctcattctgtcatctagcctggagtgcagtggtgtgatttcagctcactgcaacctctgcctctggattcaagcaattctcatgcctcagcctcctaagtagctaggactacaggtgtgcaccactgcacccagctaatttttgtatttttagtagagatggggtttcaccatattggccagggtggactcgaactcctgacttcatgacccatccacctaggccaccgaaagtgctgggattataggcatgagccactgtgtccagaccttttttactttcttaagatagaagtcaaggctattgatctgaatgtcttccagtatagacattccgtgctaacttttcatttaggaactgttgtagctatattccacaaagtctaacatgtagtattttcatttttattcagttcaaaatagtttccaatttctctttgtgtcaccactttgcctaggattatttagatatgtgttactttgtttccaaatttttgagtattttgatgagctattttgttactgatttctaattttattcttttgtggtcagggaccatactttgtatgacttaaatacttttgacttaatactttcatgaagatttattgtatggcctagaatgtggtctgttttgctaagtgttccaagggcacttgagaagcatagtgttcttcaagtctactcttgtcttgctgattttctgcctccttgttttatcatgtattcagtacgcaatattgaaatctcacactatacctgtgaatttgtcaatttcttctatcagtttttagctcatatttcgaagccgttatgttaccaggtacataaacatttaagattatgtgttcttgaataactaaatattttatcattctgaaatgatgttgtttataactagtaatattttttgttgtgaaatctactttagtattaatataatgattcctgattagatttcttttgtcatctgtttgcatgggatatatttttcttccttttaaccaatttgtgtctttatatttaaagtgtgtttcttataggtagcatggagtaggatcttgctttttatacagtttgacaatttgtcttttaatttaggttattagacccatttcatttataatgtgattattgatatattaatatttaagtttatctgtcatcgcgctgtttgattttcattagtcccagctattctttgttcccttctttttctaatttcctttcaattagttatgtaacttttatggtttagttttatctctcattttttggcttattggctctatttttttttttgctatcttaatggttgcattacaatttgtactgtatgattttaacttatcacagttcactttcagacaatattatatcatatcacatatggcataagaaaatcagaatagtatgctttcatttcctctctcccagccagattcttcctggatttgtggaattatggttttcattaagtttagaaagtttctgttcattttctctttatgttttgtcattgtctctccctccctctttggggacaggtatattattgcttaaagtttttgcataattctctgatgtcccaaatttatgaatcttctcttttgtggtatctagtctgtatttacttctaccagtgtcctttccgtcatgactttgtttttgtttgtttgtttgtttgttttttgaaacaaagtctgactccattgcccaggccggagagcaatggctcgatcacctctcactgcatcctctgcctcctgggttcaagccattctcctgcctcagcctcccgagtagctggggttacaggtgcctgccatgatgcccagctaatttctttgtacttttagtagagatgggatttcaccatgttggccaggctggtctcgaactcctgacctcaagtgatccacctgccttggcctcccaaaatgctgggattacaggcatgagccaccataactggcccagtcctgacattttaatttgaattcctactagtgtaattttctttcaagaaatatcttccatgtctctacttgagatttatttggggacacagttgacttataaacaacttgatctttctggtcttgttttttgatttggtctaattttccactcctgaatcaaggtgtttctgataactctattctttgccctgtgaagtcttgagttttttcagcatcattcagacgaatggacactcttcctggtacactgtgagcaacaggcactgtttcttacaattttttaaggattttttccccctggtctcaagtagtttcctaggacaaatatactgttcattattctgctaaataaatacccaatgagattctcagcttcattgttcgaactcagagaatctggggctctacctcagtttttggtagactctacctcagttttttttccttcaattgtcatggcctggaaactttgccaagtcagggggctggggtgtttgtaaggcttatttctcttgtttcctatcttacagggttcattgtcttcattacctgaaatccttgttcttgaaaatcgtggtattatgtattttgtcttttttggttttgttttaagtgagaaggtaaatcagtatctgctgctccatcgtggccagaagcagactgcagcagagcttcagtacatgacatagactagctagaatgcttttctaccccctttacttaacagcttccttctcacccttcatttctcagtgtagcccgctcttccccaggggaatcttcctgagcccagtatagatcaaatcctgtgtgatcatagaactgttttcttgcagcatctatctgaatttgtaatttcacttctttgtattttttcttcactacacctaaagctaaacaagagcagagttactgtttgttttatctgcagagctcagtagactgtgttcgccatggtaggaactcagtgcatatttgtttggtgtatggatgggtgaaggttaaaatgcacgggactttatatccaaaaactactcttatattttatttccaccttgtttccccccgatgcagattctgctagcctatcaaaaatccaggatgcagttatttcagaagaacacttactagaactcaaaaatagccactatgagcaacttacagtagaagttgaacaaatggaaaatatggttcatgtactacaaaaatagctatctgaggcaaaagaaacacaattacagttagctcctcagaaaggtgaatgtgagcaagaacgctacagttcgaggtatgacattctagttttagagaaatattttaactctttattctaaatatatatgtgagaattgtgattgctgactttctggggcttaatgggagaaaacgtcttggtcttatggagtctgaaaatcttggaaataatacaacaaattcttaactgtgcttcttttatttattgcatatgcttttaaattgtgattttaatggctatttagaagtttaccatatagaaatctcattatttaacaaacagaatttggggtttttgattcttttgtattagaattaatgctgcaagaaatactttttattattactattatcattattattatgattattattattagaattttgctctgtcactgaggctgcagtgcactggtgcaaacatagcttactacaactttgaacttttggggtcaagggatcctcttgcctcaaattcctaagcagctcagactgtaggcacatgctcccatgcctggctaacttttgaaatttttcattgagacaaggtctcactatcttgcccagtctgatctccaactcctgacctccaacagtcctcctgccttggcctcccaaagcattgggattacaggagtgagccatcacgcccagcccagaatatcttttatataaatcattttctgcatttctaattatttactttgtataaagtcttcaatatagaattttttggttaaaatatagaaactttttcaaaaaggccttggatcaatatttctaaattgtcctcaagaatatttgtattgaatgcatgctgagcttaatacctaggtgatgggttgataggtgcagcaaaccactgtggcacatgtttacctatgtaacaagcctgcacattctgcccatgtactctggaaattaaaattaaaattaaaaaaagaatatttgtattaatttacagttcaaccaacagagcatgaaatggccatttgtctcaaaccagaatactttttaaaaactttatacagttttattctttttttaactctctgtttaaattgatttatttttatttcaatagctttaggggtacaagtggtttttggttacatggatcaattttatagtggtgaagtctgggattttagtgtacccatcacccagtaggtagttttattgctcacttttcttctccccttccttcttctgagtctccaatgtcattataccactctacctgcctttacataacctagcatagctcccacttataaatgagaacatgtggtatttgtcgttccattcctgagttacttcacttagaataatggcctctagctccatccaatttgctggaaaaaacattatttcattcttctttatggctgagtagtattctgtggtgtgtgtgtgtgtgtgtgtgtatatatacgtatctatacatgtatgtatatgtagatgtatgtatataagtatatatatacacacatagatatatggactcacacacatatatgtgtatatatatcacattttctttatgccattcatcagtcaatggacactggttgattccatatattttcatgttgtaattgtgctgcagcaaacatatgtatgaaggtgtttttttgagagtacgatttcttttgtagatatccagaaatgagaatgctgggtacaatggtaggatctacttttagttctttgagagtctccacagattttgtactaacttgcattcccatcagcagtgtataactgttctcttttcaccacatccacaccaacgtctgttgtcttttgatttttaatagtggccattatggctgcagtgaggtgatatctcattgttgttttagtttacatttccctgatgattagtgatatttagtatgtttttatatgcttgttcagcatttgctcatcctcttttgagaaatgtctattcatgtcatgtgcacactttttaatggaatcatttgtatttttcctgctgatctgtttgagattcttgtaggttatggatattagtctttgacagattcataatttgcaaatatttttcccattctataggttgttggtttactcttatgattatcaatttgcggtgctgaagctgaagctttttagtttaattaggtcttatttatttattttcatttttgttgcatttgcttttagggtcttcatcataaattcttcacctaggtcaatgttttcaggtcttagttttaggcctttaatccatcttgaattaatttttgtatatgataagagatagagatccagtttcattcttctacatgtggctatctttttttcctagcgccatttattgaataatgtgtactttctccagtgtatgtttttgtatcctttctcagagatcatttggttgtaagtggctttatttctgaattgtctattctgtttcattgatctatgtatctacttttataccagtatggtgctgtttttgttactgtggctttagagcataatatgaagtcagataatgcgacgccaacatgtttgttccttttgcttggtacatctgttgttattcaggctcttttatggttctacataaatgtcaactttttttataattctgtgaagaatgacattggtactttcataggaattgtatcaaatctgtagactgctttgggtactatggtcatttttcacaatatcagttctttcagtccatgaacataggatgtattttcatttgtctgtgtcatctattattttcttcggtagtgttttccagttatccttatatagatcactcacctccttcattaagtatattcctaggtattttacacttttgcagccattgtaaaagagattgggttcttgatatgactctcagcttggttgtatttggtgtatagttgtgccactgattggtattcatttattttgtaacctctgagactttactgaatttatttatcaaatctaggagtgttttgtaagagtctttggggttttctaggtataagatcatatcattggtgaagagatagcttgacttcctcttttaaatttggatgccctttatttctcttgcccaattgctctgcctgggacttcccagttttattcttaatatgcatgaaataaaagtaaaatggaaaatgattcacgattagtttatttcacatctctgtctcataaacagataaaattaattcaccttgaattaattttgttatatgttaaatacatatattatatgtataataaaaacatgtaatatattatatgtataataaaaacatatatgttaaaaacaaaatattagaccctgtcttgttcaaaagaatgtctaagttgcttataaaatacataggaattaagaatataagttaaaaatgtttccaaaaaataaacatgaaaattatgggttaacacaggggttcccaatccccaggccaaggaccagtaccagtccctggtctgttagaaactgggccacacagcaggaggttagtggcaggtgagcaagtgaagcttcatctgtttgcagtccctctccatcactcacattaccgcctgagctcctcctcctgtcagatcagtggtggcactagattgtcataggagtgtgacctgaaccctgttgtaagttgctcatgcaggggatctaggttgttcactccttatgagaatctaatgccttatgatctgtcaccatctcctgtcacccccagatgagaccatacagtagcaggaaaacaagctcagggcccccagtgattcttctacattatggtgagttatagaattatttcattattaataatagtagaaataaagtgcagaataaatgtaatgtgcttgaataatcctggaagcatccccccacctcaggtctgtggaaaaattaccttccacaaaaccagtccctggtgccaacatggttggggacagctggcttaacagatgtgagacccctttgccttttcttggattaatctgcaagatatacattgtgtgaatgatatctgatgatgacaccttggcctgtaaatcattttagggataccttcagtatctcatgaaaattaaaatttcttctagtgaagaacaaaatgatacccggaagcaactttccaaggaacagaatgctagaatattacaagatgagattctgactactaaacagaagcagatagaagtggccgaaaaaaaaatgaattttgaggtattttctttagtcattttcaaatgcttttatataaaatgtatgtatttaaaaaaacaactatatatttcagaaagtataaaggatttttaaatcacatatatatgtatatatgtatatatcatttatcatgtgtctatatatgtacatataggataaagccatgttcttaattcaactccatttgcctgcaacagttgagtagtgacattcacaatggcctaaatccaaagaagcatttgatattttccataagaattgatgatctttccaatatcaaaaataagttttgctaacaacagattttccagtttttggacattagttcatcttttaaaaatattaatagagaagtcagtttattattttcactgctaagaaagtaggaaatgtatagttgggtcagaggccatattgtggatatcattatccttacttttgaggacagtaacagtttgctccaagtagtttctcatttcaatgcaaagagctttgaaaacaatgacatgcatgatatacattgagtgataatttattgataagtattttgttcccagagaaagagttcagtatattttcctctatttcacacttattactgtttcaaacattataaagaagaaataagttattgcaatggcaaataatctcatgatttctaagaaaagctctataagttgtatgctaccattcatattttgaaataaaaggcttcttttgtatttatatatttacaccacagaagtaactgtgattttgtggaggatcactagaagtagcatcagaagacctggagaaaatcctgcatcttgtgtatatacatatgtgtatatttgaatatatatgtatatattcaaaaatatgtatatatttttgagatggagtctcgcactgttgcctgggctggagtgcaatggcacgatcttgactcactgcaacctttgcctccctggttcactcgattctcctgcctcagactcccaagtagcttggattacaggtgcacaacaccatacctggctaattttttgtatttttagtagagacagggtttcactatgttggccaggctggtctcaaactcctgaccttgtgatctgcctgccttggcctcccaaagtgctggtattataggtgttagccactgcaatcagctgcatatatatttttttaacttcttttaagaattgtgatcttaaatgagttcagtgtcgtacatagaggtgcaatgtttagatgcagatgtgtacaatgtagaagggtacaatgtttagatttaacagttatgaataagtgtaattctcataactgactataacatattagaaaagtagaatattgataaaacattcttgagaaaaagtaacttaaagaattttgagaaattgcttctgccctaacatatgtatagctaaggctcctacaatgttatggtttataggtgagatatcagagtgtaaacccaatttaaaaaatatagtcaaatgtattaatcttatattttatgcctctgggttttttgtaattcagagaaatgcatttacaattctgagtttcttaaaaatcctccagtgatttaattttcataatctttaaataaatatttagatttgtggagtttacactctattaggtttgaagttttgtccaacttgtttttaggtaaatatccactatgggaattctttcattatacaaacatacaggttactttttaatttcagaagaaattatgatatgtccctctattgagtgctaactaaaatttccctttgtttactcagatttctcttagccataaggaagaaaaagaactcttgcatgaaaatagcatgatgcaggaagaaattgccatgctaagaatagaactagacacaataaaacatcagaaccagctaagggaaaagaaatatctggagtacattaaaagtgtgaaagaaaagaatgataatcttctaaaggctatacaattgaatgaggaagcactaacaaaagcagtagttcagtacagtggacagcttagcattttgacaactgagaataaaatgctcagttttgaactgcagaatgtaagacacaacaatgaaacactggaaatggaaattcaatcatgtcattttagactggctactgctctacatgattgtgactgaagtcagatagcagaaagagacttctttccagagaacaagacatgaacaggtttatttacaggagacaatgaattctcatatatctaacctaaaaggtaacagtgagattctttctgagcaactctaatgctaacagtaaaattaacagcctgaaaattaaggtccatcacacaagataaactctgagagaaaagacggggcaggccaccatttttcctttttgggcaacttagtcattccagcctgcaggctttggagagtacaaaccgaccaggggaagaagacatcctgcagcacagcacagctgctttatcaaatcatggccagactgcttctgtaagcaggcccctgatcctgtttctcctcactggaaaggacctcccagctgaggcctccagctacccccaccagtgttccctggccaacagagatttaaatcccccctgggacagagcacccagagagaggggtgggtcaccacctttgctgtttgggcgactagccattcaggcctgcagactttggagagcccaagctgaccaggggtggaagtggtacctcagcacagcacagctgccctatgaaaatgtgaccagactcttttttaagtcagtccctgaccacatttgttatcactgagtggagtctttcaaccagggtctctggctaccttcagtgctgttctctggctgacagaggtttcaggccttcctgagtcagagctcccagggggaggaccagattgtcatctttgctgtttgggcaactcagccatttcagccttagggcttcagagtgtctgaggtgatgaggagctgaagtgaacccccagcatagcacagctgctttaccaaaaagtggccagacctacattttaagcaagtccctgttcttgttcctcctgattaggcaagagttttttccacttgcctccagccacctcctacaggtgtgttcagattggcaacaagtttgtacctcagtggtacagtactcccagaggaaggggcaggctatcatctttgccttttcacagccttcattggtgataccttcaggccctggaaaatatgaggcagttagggactggagtgcacccccagcataccacagcccccctacggaaaagtggccagactgttacgtgggtgccagtttccatatcttcttgatgggcaggtcttcccatcctgggtctctagccagcaccccactggagctaccaagccagtagcaactcagcaattccctggacagagcttccaggagcaactgaaatcctctatgccactgcctctgcagtggaactgtccttgctacccttggaatatcaagggagcaaagactttaagtgctgtattgacatgtccaacaagttgcagttgacccagtgagcaagccagtccatctcccatgggtcccacacactctccactgttcatcacccgacagggaacgctggcttgggcccacagcacagacactccatcctgggctgatcgcactaagtgattgctaactcacatctctctggggtggagcccctaggagaaaagccaagtggtagagcagcaagccagctgatgcggagcccaaagggcagggacagctatctctctaggcaccatttgctcttatgagacactttatcccagcactttaggagtgctgaggtcagaccagccacatcttatgtgcaagattgcccagcagagatcaggtctgagagttcccctcttaaaaaaaggggacttgcttaaaaaagaagtctggccacatttttgtagagcagctgtgctgtgttggggctttagttttgagagagttctcctctgagacctgatctttgctgggaagtcttgcatatgagatggggctggtctgacctcagcactccttagtctgtttgcctctcccagggccccagcctggccacacctgcttacagggcactctcaggtgctcacaccatagcttctgtgccagtggaccatgtctgaccaatggagggttgcagcaaggtggcccctacagccatggaccagcctgcatattgcctctacatactgcagctctttatatgcaaacttcctacatccctttgctggtgtgtgtttacatgggtgggttttgctgtacttgccctaccagcacacgggagtgcatcacacaccccaacccacaccaactgccattgaagatggagccctggcaggcacagagccaaaaatcccccacccccaccagcacctcacccttgacctaatgctgcagagaggaaaagggaccctcttatatcctgagggaccactgttgcttggggagcacagagaaggcacctagacccgtgctggccagcacctcaccccaaaccaacactatctccagtgcaacagcacacacagtcagcaggggccccctggtccccaccctagctgtcttgcctccaccactgggtgaatgcccacagggaggcaggcacttttgcatccgctagcactctgctgcagttgccgcactttggtcccctcagtgcagtggaccccaaacctcgaggagccagagaacaaagttggggcccagtacaatttcctcagagttaaagcacacagtccaggaattgggagctgaacactggctccctaaaatcctccagaaacaaagccagttggctgaatccacctgacaccacaatcaaaccctcaaggtcatcaaatgtgataaaagaaaagtactctgtccaaaggtcagcaaccgcaatggttgaaggtggataagcctataaagatgagaaagaatctgtgcaagaacactgaaaactcaaaaagtcagcgtgtcttctttcctccaaatgactgcatcaactctccagcaagtgtttggaactgggctgaggctaagatgtctgaaatgatacaagtagaattcagaatatgagtaggaacaaagttcactgagtgagagaagtatgttgtaatccaatgcaaggaagctaaaaatcactgcaaaacattgcaggagctaacagacaaaatagccattataggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcaagactctgtctcaaaaaaaaaaaaaaaaaaaaaaagccattataaagaagaacataaccgacctgatagagctgaaaagcacactagaagaattttcataatgaaatcacatggtgattatgtgtgattgcattatgaaaattcttgtagtgtgtgtgggcacctgagagtgccctgtaagcaggtgtggccaggctggggccctgggagaggcaagctgactaaggagtgctgaggttagaccagccccatctcatgtgcaagaccacctagcagaatagaccaagcagaggaaagaatctcagagcttgaaaactggatttctgaaataaaacagggagacaagaacgggggaaaaagaatgaaaaagaattaacaaaacctctgagaaatatgggattatgtaaagtgaccaaatctatgactgattagtgtacctgaaagagatgaggaaaatggaaccaacttggaaaacatatttcagaatgtcattcatgagaatgtccccaacctagccagacaggccaacattcaaattaaggaaatccagagaacctcagttagatatgccacgagaaagacatccaaggtcaaaatgaaagaaaaaatgttaaaggcagctaggaaaaaaggtgaggtcacctacaaagggaatcccatcagacaaatagtggacctctcagctgaaaccttacaagccagaagagatattcaacttcttaaagaaaagaaattccaatccagaatttcatgtccagctaaactaagtgtcataagtgagggagaaataagattcttttcagacaagcaaatgctgagggagttaattaccaccaaatctgccttacaagagctcctgaaggaagcactaaatatggaaagaaaagaccattaccagccactacaaaagcccactgaagtgcacagaccagtgatgctaaaaagcaaccacatacacaaatctgcaaaataaccagctaacagcatgatgacaggatcaaatccacatatattattactaaacttaaatgtaaatgggctaaatgctacaactgaaagacacagcggggcaaggtggataaagaaccaagacccgtttgagtatgctgtcttcaagagacccatctcacctgcagtgccacacacaggctcaaaataaaggaatgcagaaaaatctttcaaacaaatggaaaacagaaaaaagcaggtgttgcaatctagtttctgacaaaacagactttataccaataaagatttatcaagacagagaaggacattacaaaggtggccctgacctttgataaatctcattattggttgataccaacctgggctgtctttttttgttgttgttttttgtttttacttttgagaaggagtctcactctgttgcccaggctggagtgtggtggcatgatctctgctcactgcaacctccacctcccaggctcaagcaattctccttcatcagcctcccatgtagctgggattataggtgcatgccaccacactcggctaatttttatagttttaatagagaccgggtttcaccatgttgggcagactggtcttgaactcctgacctcaagtgaaccgcccaccttgtccatccaaagtgctgggattacaggcacgggccactgtgcctggtcaatctgagctatatttattgctgaaaccaataggataatttgctgaggttgagaagtttctcccctccagagagtccctgatcttccaaaattaggttgagatctaaggttgattttactgtacaactccttttctgaagttctacttatttccaacaaggaatgcaagttttcctgcttccatgatgatggagagcaggcacctcctttcttaagtttcagcttgcagggaaggtgagtgtgaattttttcctgcttctaagatgatagagagtgatcatcagcctgagactttttccaggtaagtagctgaagtagagatttgtcttaaaaattttccttaatgactaaaagttaagattaccaaccaactggttttaatttctccttgcctttagaacagccagtaatcatatgaattgtgcatttgtttgttttgcttaacggtttttgtttgtatatgtttggggtttattgttgttgttttacttttctcccatcaagtatgatcatctcttcctgacttggtcaaatccaaaggaatgttccaaattgtgaggaacaaggcatcagaataggccaaaactcctgtagctgcaaaaaaaaaaaaaaaaaatccagttagaaataatttttataaaacttagaaaaaattaaaaaaaatttttttttcttaagaggtttcatgtacataaccaggccatcttttgccagccaagagcaaattgaagaagcagtggtggccacccagtgctaagattctgcccaaacaatgtttactacagcaacctgagtttgtttcctaagtctagttctttctggtttggtatttgtgttacttttaaaatgccagcagtttgtcctagctatgaggctgtagtaagagattcaaatgattttttttaagagctccatgataaaaagcttcattaaaaacaggtattatatatatgtaaaaatatatttaaatataattacatatatgtcaaaaatatataaatatatgacatatttatatataaacatataaatacacatatttatgttagaaatatgtttataatttgttatatatattttttgtatttgtgtgaatctaaaaggcctttctctttttggatttttttttttgagaaacatttgattttgttctcagtcaactgaattctatctctccattttacgtatgtctgtcctttctttttcttgctacccttaatgcccacataaaagacgtaaagtaatttctgataactggggattgcttaaaacagaaagggcaccagacttctttttgcaaggaatcactgtttttgtttctaaaatcccaatagttgtaaacagacaagtttttttgcagctcttaaactgctcactttttaaattgcattattggatcttaatggcttttttcttttttttttttttgagacggagtctcgctctttcactcaggcagactgcagtggcctatcttggctcactgcaagctccacctcccgggtttatgccattctcctgccttagcctcccgagtagctgagactacaggtgcccaccaccgtgcccggctaattttttgtatttttagtagaggcggggtttcgccgtgttagccaggatggtctcgatctcctgaccttgtgatctgcccgcctcgggctcccaaagtgctgggattacaggtgtgagccactgcacccggcccttaatggcttttgagggtttcaagaatcactttgcacagtgagaaagtttttgaccttggagtgtgtaatagctaagtaggagatatatttttagggctggttattatgggatatattttttcttccttttaactaatttgtgtctttacatttaaagtgtgtttcttataggtagcatggagtaggatcttgctttctacatagtttgacaatctgtgttttaatttaggttgttaggcccgtttcatttataatgtgattattgatatattaatagataagtttatctgtcatcatgctgtttgattttcattagtcccagctattctttgttcccttctctttctggtttcctttcaattagttatgtaacttttatggtttagtttcatctctcattttttggcttattggctctaattttttttttttgctatcttcgtggttgcattacagtttgtactgtatgattttaacttatcacagttcactttcagacaatattatatcatatcacatatggcataagaaaatcagaatttctattcattactactttcatttcctctctcccagccagattcttcctggatttgtggaattatagttttcattaagtttagaaagtttctgttcattttctctttatgttttgtcattgtctcttcctccctctttggggacacgtatattattgcttaaagttttcgcataattctctgatgtctcgaatttatgaatcttctctttcttggtatctagtcagtatttgcttccacccagtgtcgttttcagtcatgactttgtttttgtttgtttgtttgttttttgaaacaaagtctgactccattgcccaggctggagtgcaatgactcgatcacctctcactgcaacctctgcctcccaggttcaagccattccttctcctgccttggcctcccgagtagctggggttacaggtgcctgccatgatgcccagctaatttctttgtatttttagtagagatggggtttcactgtgttggccaggctggtcttaaactcctgacctcaagtgattcacctgcctcagcctcccaaaatgctgggattacgggcatgagccaccatatctggcccagtcctgacattttaatttgaattcctactagtgtaattttctttcaaaaaatatcttccatgcctctacttgagatttatttggggacacagttgacttataaacaacttgatctttctggtcttgctttatgatttggtctaattttccactcctgaatcaaggtgtttctgataactctattctttgccctgtgaagtcttgagttttttcagtatcattcagaggaatggacactcttcctggtaggttgtgagcaacaggcactgtttcttacaatttttttttttttttttgtgtttaactcatctgcatgtattttcttttttgcattttttttttaatgttttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgcttggttttttgttcttgcgatagtttactgagaatgatggtttccaatttcatccatggattttttccccctggtctcaagtagtttcttaggacaaatgtactgttcattattctgctaaataaatacccaagagggtgtttttgcagatctccagtgttctttccctttactgctgtctcctttcaagtattctgtgatttctgtctgccttggttttttgagactctcggcttcattgttcaaactcagggaatctggtgggctctacctcagtttttggtagactctaactcagttttttttttctttcattgtcatggcctggaaactttgtcaagtcagggagctagggtgtttgtaaggcttatttcacttgtttcctatcttacaaggatcattgtcttcactacctgaaatccttgttcttgaaaatcgtggtattatgtattttgtcttttttgtttttgtttcaggtgagaaggtaagtcagtatctgctgctccatcatggccagaagcagactgcagcagagcttcagcacatgacataaactagctagaatgtttttctaccccctttacttaacagcttccttctcacccttcatttctcagtgtagccatctcttccccagggaaatcttcctgagcccagtatagatcaaatcctgtgtgatcatagaactgttttcttgcagcatctatctgaagttgtaatttcacttctttgtatttgttcttcactacacttacagctaaacaagagcagagttactgtttgttttatctgcagagctcagtagactgtgttccccgtggtaggaactcaatgcatatttgttttgtgtatgtgtggatgaaaatagccactatgagcaacttacagtagaaattgaacaaatggacaatatggtttgtgtactacaaaaggagctgtctgaggcaaaaggaacacaattacagttagagactgggtttcaccatgttggccaggctggtcttctcacctcaaatcaaccacccgccttggccttccaaagtgctgggattacaggcatgagtcaccgcgcctagccaacctgagctatttgtattgctggaaacaataggataatttgctgaggttggggagtttctcccctccagagagtccttaatcttccaaaatttggttgagatccaaggttgattttgctctacgactttttttctgaagttttactcatttccaataagaaggcatgttttcctgcttccatgatgatggagaacaggcacatcctttcttgagtttcagcgtgcttctgacagggagggtgagtgtgagatttttccttcttgtaagatggtagagagccatcatcagcctgagccatatttccaagtaagtagctgaattagaattttgtcttaaaaattttccttaatgactaaaagttaagattaccaatcagctggtttttatttctccttaccgttagaacagtcactaatcatatggattgtgcatttgtttgttttgcttaaatgttcttgtttacatttggtgttttattgttgttgttttacttttctctcatcaagtatggtcgtctcttcctgacttggtcaaatccaaaggaaagttccaaattgtggggaacaaggcatctgaattggccaaatcttttgtagctgcaaaaaaaaaaaaaaaaaaaaaaaaagttccagttagcaaaaatgatgttgtaaaacatttttttttttttaacctaagagttttcgtctacataacaaggccatcttttgttagccatgggcaaactgaaggagcagtggtggctacccaatgctaagattctaccgtattcactacagcaacttgagttttgttcctgtctagtgctttctggtttggtatttgtgttactttaaaaataacagcagtttgtctgagttatggtgtgttagtaagagattcaaaagttttttctaagagctccatgattaaaagcttaattaaaagcaactttgatatatatgtaaatttatatttataattacatatatgtcagaaatatataaatatatgacatatttatatataaacataaatgtacatatatatgttagaaatatgtttacacattatatttttaacctataattttttttgtgtttgtgtgtgtctaaaaggcctttctctcttcggatcttgttttttgaggaatatttgtttttgttctcagtcaactgaattctgtctctttattttacttatgcctgtcccttttttctcttgccacccttgatgcccacataaaagatgtaaaataatttctgataactggggattgcttaaaacagaaagggcatcagacttctttttctccaaatcactgaaatcacagattttgtttatcaaatcccaagagttgtaaacagacaagtttttttgcagctcttaaactgctcactttttaaattgcattactggatcttaatgacttttgagggtttcaaaaatcactttgcataatgagaaggtttttgaccttggtgtgtgtaatagctaggtaggagatatatttttagggctggctatcagaagagatatttgtatgcctttggctgcctggaaggtatggaaacatcccaatgctccactgaatagtgagactaccatgggatatgagctgattattgaatgggctaattggcttttcttggctaccaacctcaggggaaatgtagtgaaatgcatgttaaaaacatggcattgtctcatcccataatgttttcctcttttcagggcctgaggattttatgtaaaaatcaaatacttgatttttggatatctgttctgccttacagctgtgccttcatgttaggccctagaagctgcatgcttccttggccctgtttcttaaaaggctccagcctaaagccagtaagccaatttttaaaaatcttcaaggaaatcacatttaagtgtgtctgctttccttggccatcttaactgaacttttacaccatttttttttttggctttagtaaaatataaatcctccatcttgtttcacatgagtcatctctttaaaaatgcaaatttagaattgcctcactaataactgtttacagtagggaacaagtattcaaaagacgaatgtgctaaagtggagaggaaaaactggcaaatgaaaaatcttttgaatccctaagatctacttctgtgtgcctatatgtctaaatatttatatgaattatgcatgtaatgtttgaataccaaaaatatgtgaaaaggctctaattggctttttaaaaagttcttaaatattgtatcagaaattagaaattagaaacttattcccaaatactttttcaagttttggttaaaaagaaacttcaagatgtcttcacaatagttagcatacattattgtttagatgtattggtccagtggtttttttccttttttcttttttttattttctggtcaagtggttttattttatatcttctagctactataacatgtcaaaatttgccacaaagttacaaactataaacccagacccaaacaataatttttgttcatgtaatttttgataaatatttaatattgttgatttaatgaaaacagctcaatccagagttatcagtaaataaaactattaataataagttaggtaaatgtaatagaataaaagcttataaatgaacttgtcatataagttaaatcttaacattatattaaatcaaataatagatattagatgtctggatcattatcaatttttaaactatattattggaaacattttcaaaataattataagatagtcctcatctataaaatgctgatgtgacaataaagatttcttacttcttaggttttcaccaaaaatttattaccaaaaatcaaaattttagttaatatgtgattttacatataaagtgtgccaaaataagttttattctgatgaaaaaagaaaaattgtgagaaataaaaatgaaataaagaaatgataagaaacagaatgaaaataattgttgtccaattcaaagattattgaaggattccttatgaaacaatgtaaagggaaccagtaagtgacagagagatttaaagaaagttataaagagattataaagagatacattcagtaagaaataccacaaagatgctgggcacggtggcttatgcctgttatcacagcactttgggaggccaaggtgggcagacaagatcaggagtttgagaccagtctgtccaacatagtgaaatctcgtctctactaaaaatacaaaaattagctgggtgtggtggtgtgcacctgtaatcccagcaacatgggaggctgaggcaggagaatcacatgaacccagaaggtggaggtttcagtgagccgagattgcaccattgcactccagctcaggtgacagtgtaagactctatctgaaaaaaaaaaaaaaaaaaaaaaggaattattacaaggaaaataattttgtataaaaaattgtatggtagatttttatcctaaaacaaaatggctggttatttaagaaagaggatatttaggacaaaacagaaagtctaagcatgttataattggtctgtgtaataatacgcttcattaaaaagaaaattcttttaagaattttgtgtgtgattcagttggctagaatggaaggaaaattattcataatagcctttctgaaaaattaagctttgatttttaaaatacactagaagaaaacaaaaaaattgattagaaccacaagatgcttttaagcattaatttaataaaattgtaagattttttaatgtttaattctataatctgtttctaaaaggtttctcagatgaatatctcaaaagtttaatttttgctgaaccccattgcttccagcttactcagcttattctccctttgagaaacctgggatagtaactctcttcttcaacttttcttgactccagtagcattttttttcttcctccaattctaaatctgttgttatggcctgatgatgaaatgttttatcttgaaaagtatttttttttaaaggcaatgttttcctccagtataagttaattctacactgttgccttttcttaatatgtttatgggccttgagccctctgaaggttagcttaaaaatcaactcagaaaagaccaatcgattaaagagaggacaggcagatttgtttctgaatatatacatgaaagttttcaaaatagaggcccaatatataggagaaattgtctatttttcattgtttagtttcaacaaattatggaaagccttgtaaacaatatgcttgaaaaaactttataatgtagttctggtggactttgagggaatatccaagaaggcctgtctctctagattcttctaaacctttctgagttagcatttcttctttttagctatggggcacctataacctatagtacaacaaggaaggtcagataagttctttatggccagttcttagacagaaatttgaagaaaaaattagattaatactttaaaagttttatggctggctctgaacaaaaagttacagattctagggcccacctggaaaatgaagattctagtttctgtggccaggcttgagggaaactggaactgaggaacacaaggacaggagaaagccaaataaaaagttttatttctgagggtgcttctgaaggtttcattttggggtattgtttttttcagtccaacatatgtccaaagtgttcaatataattaggcaacttcccatgctgtggctaagagtcacatattctgctcaagacttctatgatatagtgtttgcatgttacactgggcatactctttctgtatctgactagttcacgttttcttttcatcaggtttgactgtcaggttgtccaaataggcttcccataaaggagaaacagtcactgaagaaggttacttttttcttttattgttaactaatcaacaaacactttaagataattcctgtgttgttttaattagtttttaaaaattattacaaaactaaactttaacagggttaagggccttacatccatgtaacttcctatattgctgttaagatcttttcatttcactctggttaaatgaagaactattattttataatggcccgtgattctgttgtaatcaaacattttgagttttctaatatcttttgacaaacagcctcaaatatcaaatactgaataaagtctctgacttagacttgtagctggtggcttatcaaaactataaaaattaaccactgcaaggtcataaaatcttcttacagcttccagttaagtcatgaactccagtatcaccctctccaggctgatgattgggcatcagctgagagactcctccagcgccattgaaaagggtttttatcaaatagtgtaaattaaactttttgctgttaagttgcagggctttgactcctgagtacttctatctcatctaaaaggtagcactggctcctgctgaaacttaaacatcaatgctgatatctggcaccaaattctagttaatgaaagccccaccttcaaacctgggagaagatgagagtcaaaacaacttgctaatgctatactttcatgggtcatttctatagtttgttattagagaagtttctctgaatgtgttgagcaccagaaaccacgaggagatgcagcattctctcctgaacgggaagccagcttttggcattgctttgatgcaactaccatttgccattgatggcaatgcatcgcttcctctaggagtgtaagagggagtggatgcagtcagagtggttttttaaattaaaaaaatttaaaaaaaaatccaggctgggcatggtggttcacacctttaatcccagcactttgggagaccaaggcaagcggatcacttgagctcaggagttcaagatcagcctgtgggcaacatggcaaaaccccgtctctacaaaaaatttaaagtagctgggtgtgttggaatatacgtgtagtcccagctacttgggaggccaaggtggtaggattgctttagcccaggaggttgaggctgcagtgagtggagatggtgccactgcactccagcttgggtgacaaagtgagaccctgtctctctctctctctctctctctctctctctctctctctctctatatatatatatatatatatatatatatatatatatatatatatatactttcttgtgatactgtgctaggcctctatacaaagacataaatactaaatcattttcctctattttaatataatttgttctatgccttaaaactagataatttaaatgtttagctacctgtgggttttttttttctgttattgtcagagctaggcagggcttatgtcctttgtgtttaaacatttttaattctgggccaggtgcggtggctcacatttgtaatcccagcactttgggaggccaaggcaggtggactaattgaggccaggtgttcgaaaccagcctgtccaatgtggtaaaaccctgtctctactaaaaatacaaaaattagctaggcgcagtggcacacgcgtgtaactccagatacttggggggcatagagaggaggatcacttgaacctgagaggcagaagttgcagacagctgagatcctgccactgcattccagcctgggtggcagagcaagactgtacaaaaaaatgccaattctatatgtagcttataaaattgggtaaaacaacaaaacttacctttctctttctatgtggtatttccaaaatttaaaactattttaaatctcactgggcccaatctatttttattgctaatgtaccactgctaaaacgatataaacaccttttcttacaggtgcaggcactcatgtagaaaaattgagcatgtggaactgtaagggccagttttgagagataaaattagtttagccccttcaaataaaggacaggcacacatgcctaaacagctgacaaaataagaaactttgcctcctgggttctttccattcatcctaatataaagaattacctactctccataaaattaaaaaagaattacttacaggatattaagatacttaagtgacaaagcctcctgggtagagtgctccaagttatgaaatttttacagatacatatagaaagctgttttaaatcagcgatcttagtacaaattactaaaaagactacacaccaaaaaactttgtggaataacagaagtgtctaaattccttaacttaaatggttttaataaaatgtttgtgtttcacataactaattactatagtttgtaactaaaaccaaaattatgctagcttaacacacagaagttgttataagaaaaacttcagccaaattaaacttcaaagaatattgagcaataaataatttgcaaattggtctgcctcctgagccagagtagactcagagactcagtgaagctgtgtggtggaagaaggtttatggacagaaaaaggaaagtgatatacaaaaaattgaaatgaggtacagaaacacctggattggttacagttcaatgtttgctttatttgaacatggtttctacatttgattagccaaatctcagtgattggcacaaatgtaggctacagtctgtttacaagtttacttgttatagttcaaggacagggaaatctttggcctaaacatttaggccaaacttaacatttgtagggaggcagctttaggttaaacttaacaatttccctctttggtcatcttctcaattttgagagactgacaaaaatttagtcattgatgtcactattagtatgtacttacttggtcttgaaacccactgggaagtgggttttgtaaggtgggagcagttggttttgtaaggtgggaacaaggacttgggattattttattttatttttatttttgtaagggttatagtagagggtacctccttatgctggaacatctttttatatgagaaaaaaacaaaacctgatccattctaggatctgtgtgtttccttaaagtcttagtttatgtcatgagtgactcagtttggtttggtctggtctgttgaggcctgatgcatgagctgagtccaaaaaaatggcctctcataactttgtttaaaaattctccccttttggtcaggttctcacttaggtgatttagactgtgaccaaaacttagggtctgagtgccactcttagttgccatcactttggatttctggtctcagcatgccatttataggttacagtgtcctcatggtcacacatattttgtttcagctcttgtcattccagttgaagagagatcatttgacattccagagatggctgcatggaaacattcaaaattttaaagagaatacagtgtaccaggaagactattattactatcagaaagataataacaagattttggagtagttccttacttagtgtcctcataaaccaaaccactgaaaatcaaaagaatgagctaaagagtctgcttgattaactaagcagtctcttcattaaaactctacaaatccatataatacctggtgtgatgtatttctctgtaggccacacatgccagcagctgcacagataatttctctgtttagccagtaagtaatctagagcaattctatcattgagcataactttcccaagataaagtctgttgtgtaactttagcctttacagtagaatctgctataacacctatcattagggatacatttgtaatcattccctcttgtacttcaaaccatggagaaaatagggcttaacaaatgatgcccttctagaagagtgaaggcctcctctcaatgctctcttaaacccatgatgtaggttaagaggagtgaacaaatattctgtttctgactgattatgaggcaacatacgtaccattaaaatttctcacatttggcctctatcttccatcaaagaataaggttatccagatgtgagggtaatctggctgtgacatctgtcactcagttgatctccagggttgatttggctgatctggctggccaggcacactttcccttcctccctcaccactccatgtgcatccctcctgaagctgcatgctcagtccaagaggatgaccatctctgttagaggaggaccattctttggtcaagggtatacgagtagctgcactcccctggtagaacttccaaacaagctttcaagttataaagttgtatatgtataagactagctacaaaatctatcacaaaagtatatcccatgagtgtgcacaacagaccccccctttcacatctattgttcataaaggcataagcaagggaaaaaaatattcagaatctaatgttagcagagcagtctttatccgttgttcacatcaagtttgccatcttctggggagaaacttttctggttagctttaccttaagggttatagtgggtgtacagtttcaagactgtggagggacccttcttagttgtaagattatgaacccagagttcaaggttccaaagcttttctgtagtgtggatgtcaagggcagtctttctctgatgttctcagaagatccaatctataggctctagattatgaagaggtgttgatctcagtgaatcataaaaaagctttttttacctggtgaaaatacactgtggcataataatctgttataacatcagctctcttgcatgggaaagctttaatacaaccagaaaacacgcactgaaaatgataattcaatgaaatccctttataaatgtttaaatggcccatcaggtagtggattgtatctgaagctttcattgtccttccaggaatatgagtttgacaaaccaaacattggtcataagctattttagcaatttagaattcaccacaccaatatatatttaacttggatcattttatcttttctatgataagtcatggaatgcagaacttttaataatgaaagctttaaggatggactcaggaaggataaggcagctgtcctggttctccatgagtccatgcttaacattgaacttatgtagtcttgaattccagttgtttctccaatttaggtttatagcagtaacaactgaagggttgtcataggtaatttgacttagaccaaggcgttcattcaaactgtgtatttaaacaatttcagtattggttaatttagcgtgaaagtctgacaatgtgttttcttggtattcagttaattttcgttctacttttaaaaacaagtaagtcttttcgttaaagttccaggtactctgacacagtccaaatgatatgattctaaaatttccagaaatctgtattcaagagctcttttcagggtctttccatcctttcaggaatctcccaaaagacaccatattctgggacattttgggcttgtgaagttttcagaaactgcatcagtattaagcaattaactgtggaaatgatgttaaatagtcatagttacccaattaacaggaaaatttggttatttctgtggtctacaatttatcatgataaccataattataattcatagcatatgtttatacatattagaattttagaaattccatataattttggaacatatattaacattcattagaatataacctgaataaggttaaacatttcttattttgacagtgtttcccatgtaacttaatgtgtcaaataatcctgtttacccctgttttgaattcttcagggccctctgtagcatcccaaagttagaagtcaaaaagacttaattttgaaactgaaatttgattttgggaagcccataaaatatattaaaggtttaaaacacttgatattataaagtggaattccagatcacaatgtcattcatttagccaaaatgataactcaaaaaatgtttaaaggcaaaaacccttactcattgatagatgacttagcttttcaagcaatctgtctttcccctctttttcctgtagtttatttggaggggaaaaagacatcttttattatcctttagtattacatgaaaatcttattcaaaagagaaagccaaatttcatccttgcattagtgtactattaaagtcaactccaatttttagtaaaaccttatagacaaatttatccagtctttatcagtttgaccataaggtgagattctcaaaaacttctgataatgttttacaaatttgcattaaagagcagatgagtgctctaagaaaaccctgttttgatttcattccaatgttcaatttatggaaaagctgaataatactcctttaaatttaaccaatatgttcacacacagtatttctcttacaagattatttttttcacaaaccttccacaacttgctcaaacttttagctttattttatctaaattaaaacaatcctttaactctctaaattaggcaaaaatttacattttaatgccttcttataatcttttactgaaagcacatttcactttcctcacacagcttccatagataacttttttcagtagtctgaattacatgttacaatgttaacccttagcaatttttatttttggtgaaaaatctggcaagtaagtgactttaattatgtactaggtgtggagcctaggacaccagacagaagtgcagataaagtctgaccctttcaagcatagccaggggcatggctaactccacatgtccccaggcattacctagaatctaatggctccagagcaggtaaactgaacagattttaaaactcaaggaagcagtttattactttaaagcattttacagacctaatatctgacctgcctaatttagaccaaatgtctttattttaccaataaactttaaagctatctttattttcaaagcttactaaagtcatgtgaactaaaaggcattacagtttttatttctctgaaaaaaatttgatttaagcactcattgtttttaagccaattagagcttttttatttataaacatcacacacaacacatacacagaagtagacccagtagttgtaagacttttcatttgccagtttttaagtttcttagttggattactagcttcagggtggagtcccctgaggaagaaggctaggaaaatatgcagtttctaggacctaataaacaggcacaactgaaaggcaaaacagatccccaaaaatttagggtcccattttatactggatccccaaagagaaatgctatggagcaggacagttcaatgatccttaccatgcattttgttgcagagcaatagaaagccaattagttcattttgtgatcagcccatccctatgggagccttatttctcagtggtgggggaacattgtcatactttctaggtaatcgagaatgtgcttctctgattgagatgtgcaaagagctgaatatccccccataactgccatttgccatcccccaaaaatatatttagccttagactttgtgaggaatctatctgctttcaattcctgggatttcatgaggaaaacaggtttttcccaaaatggggtctgtggtgcctcctctgtttttcccaaggagtcccaggctgttagaaattaatcttatgtcctctcatgcatgcatcaagtttggcaagccaaaatggagaaaaacaattgagttgactgaagagaaaaaagagatccaagaagagaaaaaatcatgaaggacttttaaatacacctatatctttgatatcctattttaattaagctgacttttaactatagtgctctttaaaaaaatcgttttaaatctcttattacctgactttacctaggccaaacagccaatatttctggcttttgaacttttacaaaattaatctcccaggtgaaaccaataagtcataactaaggttatgacttaaccacgagtgatgaggtattttcaaagaggtagtaagcaatttttacaaaatctaaaatctccaaaaatagcttagagaaagaaaaattcaagatggatgtcagaagttgtttatggagagaaagagaatcaataaatggcaaaggtcacacagatatcaaaccagaaaggactgattccctgagccaagaattgaaaccaggttgccgttgtaaaaaggcaaaaccttagccactaagccacagtattgggtagtttccattgttcttcccagaaggagcctagagcagctgattttgaacttgcagaggcttttaactgctcaagataatttttagaactatgacatgaactctaaaattcctgccctccagatggtggagaccaaggaaagtactaccatgtggtaacaaggtcaagctcccaaggacataaaactagatgagagggaaacctcatctttatttatatatttatttatttatctttttttttaatgtttcaggaagctgcagcaaagtttgtaaatgaccagtttgctgggctggcttgaacttcgagcttttgggggtcctaggcctgcattctatccaatggtacccccacagaccaattggtagcacaaagtacaccaggtttgccatagtttaagactagtcacacatatccttgttttcattatttaaaactttgcagaggagactgatttttaccatttctacaactagttcacacacacacacacacacacacagaggccagaagtctgaggatacccttttggaggcatgtcaggcttctgggcttcctttcccttagtgttcctagcaaccctgctcactgcaccatagcctggggggcctaactttttctattttataaaaccataggtataggtgaatttaaaatgttctggttgagaattggtggagtttgtctaaagacctgggattcatagaaagggaatattcaggttaagataaaggttgtggagaccaaatttcttttgaagtcttatagtggctgccctgcccttagagacaatagatgacaaatgttttctattcagatttagttaatctctttacatttgggggggtctggaagaaaatgatccagctatattaatagagattctttacagatgtaaattctcccctacaaataacaggtttgcagggccatttcaagatatggcaaagaaatatgttttgggataaaatattttgattttcttccttgtctcataatgttatgccagagtcaggttggaaaataagtcatgacatacaagtttaaataaaacccttctgatgggaatttacgttttgtaggacatgactacccagaccctttagataggaatttggacaagataaaattagagtttagccctcaaacatttaaactggctataagccttttggctttaagtctgttggtcatagcagccccaccaaggaacagaatgattccagggcagggagctgcaccaccctgacaacagggacaaaattaaactttgacttttttgtttgtttgtttttctgggacagagtcttgctctgttgcttaggctggagtgcagtggcatgatcttaactccctacaacctctgcttcccgggttccaacatttctcctgcgtcagcctcccaagtagctgtgattacagatgcccaccaccacacctgactaattcttgtgttttttgtagagacagggttttgccatgttggccaggctggtcttgaactactggtctcaagagatccacctgcctcagcctcccaaagtgttgggattacaggtgtgagccactaagcccagccaaagtttgactattgatgttgccttgcaaatatttgccagaaagagcaggatgtaaaccacaaataaaattctaagttccccaactgactaagtggacctctcagccaaggaggaccaaacaaacctgaaacactagctcaggccatgatgggaagtgaggatagacatgcctcattgtacccttctatccttggacttgaggcccgagtaaacagtattaacattacaattataactgacataacagactctgtaacaataagaccagctccaacctgactgtggtataacttcacatgacaaataacaggccctaaaagaaaaagtattgtaagccaaaatatattactttgacatattttgaaatggccctgcatgtctgtctcttggggaaatttgcattctctaaagaatctccctccctcactaggtctctccagagagtctgacacctctgataagagatattcatatctattctctctgaaacctgctatctagaggcttcatctacaagagaagaaccttggattctgcaaccttccccccttaactgaagctgattccaactaggtgatactaatttacattgcaaacaatactgtttatgcattcacttttttctggatcctcaccaacattttttttttctttttaaattttaaaaatagccattcaaactggtgttaagatgatatcttactgcagcttaaatttgcatttctctgaagattagtgatgagcatcttttcataagcttgctgcccacttgtatgtcatcttttgataaatatctgattatgtcctttgcctactttttaatgttttttgttgttgttgttaagttccctatagatattagatattacttctttgtcaaatgcataatttgcaagtatttcctcccattgttcaggtagtctgtttgctgtggtaattatttcttttgctgtgcagaagctctttgtttaatataatcccatttgtgtattttttactgttgtttcattgacttagttataaattctttgcataggccaatgtcctgaagaggttttttaggttttcttttagaatttttatagtttccagtcttaaatttaagtctttaatccattttctgttaatttttgtatatggtgggtatagggattcagttttattcttctacacgtggctgtttaatttattttaggacaagttatatagattgttttttctatacatatgtacatatgagggccctggtctgttccattatcctatgggtataattctgtaccatcatcatgctgttttggttactacagtcttgtagtgtaatttgaaatcaggtaatagggtgccttcatctatgttatttttgcttaggctttttttttcattccatgtgaatcttaaattattttactaattctttgaaaaatgatggtaatagtttgaccagaatgcattgaatttgtatattgccttggacagtatggtcgttttaatgacattgattctttcaaatccatggttataggatattttttacatgtttgtttcatctatgatttctttcatcagtgttttgtctttgcctggagtgtagttctcctaacacagatcttccacctccttgactaaaatgaacttctaggtatttcatgtttgtgtggctattgtaaataagattgagtccttgatttggttttcagcttgaacattaatgatgtatagaaatgatacttctttttgcacatttattttgtatcctgaaacattactgaagtcatttatcaagtctaggagtttcttgtaggagtctttagggtttaccaggtataagatcaataagcaaacagagataatctgactttctcttttccaatttggatgccttttatttctttcccttgcttacttgcttagtctaggacttccagtagtatcttgaataggagtggtaaaatttggtatccatatcatgttccagttcttagggagaatgcttttaacttttgcccataaatatgatgtagggtgtgggttcagcatatgtgacatttttttgagaaatgttccttcaatggcttgttttttgagaatttttatcatgaagggatattggattttatccaatactttttctgcatctattgggatgatcttatggtttttcttcttagttctctgtgtggtgaatcacatttattgatttgcatatgttgaaccatccttgcatcccttttttttttaatttctgtgttaattttttttttgtttacccaaagatcattcagaaatggtgtttagtttccatatatttgtgtagttttgaggtttcctcttggtattgatttctaattttattcaaaattagaataagattactgtagtctgagaagatatctgatatgattttggtctttttaaatttggtttaaagttcattttaagtgaagactttccttgtggatttttatcctcgatgatttgtctactgctgtcaatgggtgttgaagtgccctgctattactgtattgctgtctatgtctttccttcagtctatttgtatgtggttaatgaacctaggtttccagtttggggtgtatatattttaagaatagttatatctttttgttgaattgttgaattgaatcctttatcattatgtaataaccacctttttttcccactgttcttaatttaacatctgtattatctgataaaagtacaactgcttctgctcattttcattttctgtttgcatggtacacctttatccaccccttgactttcagtctaagtgtgtttattcactaggtgattctcttcttggcagcaaatggatgaatcttgttgtcttacattcaatttgccattctctatcttttaagtggagcacttaggccatgtacattcaaggttttcattgatacttgagattttgttcctgtcatagtgttgttacctagtttcttcagagtctcaattgtgtcatcatattgttacctagtttctttggagtctcaaccacttcataggatttgtgaggtttgtactgatatgttttttaaaattttaacaattatttatttatatatttgtgtgagacattgtctcactctgtcacccaggctggagtgcagtggcatgatcttggctcactgcaacctccacctcctgggttcaagcgattctcctgcctcagtctcttgagtagctaagattacagacatgtgccaccacacctggctaatttttttttgtatttttagtagagatgtggtttcatcatgttggccagactgggctcaaacccctgacctcaaatgatccacccaccccagcctcccaaagcactgggattacaggccactgctcctggctaacaatgatttttgatgcagaggtacatgtgcttgatcattgcaagggtatattgcacccagttagtcagaatagtactcagtaggtagtttatcaatccatattcctctttcttcctcctcactctagtagtatatatattttattcccatgtttatgtctcagtgtggtgaatgtttagctttcactcataagtgagaacatgtggcattttattttctgtttctgtgttaatttgcttaagattatagcctccagttttatccatgttgctgataagaacatgattttattccttttatggttgtgtagtattccatggtgtatatggaccacaatttctttttttttgtttaattatactttaagttttagggtacatgtgcacattgtgcaggttagttacatatgtatacatgtgccatgctggtgcgctgcacccactaacttgtcatctagcattaggtacatctcccgatgctttccctcctccctccccacaccccacaacagtccacagagtgtgatattccccttcctgtgtccatgtgatctcattgttcaattcccacctatgagtgagaatatgccgtgtttggttttttgttcttgcaatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgtcgtaataaacatacgtgtgcatgtgtctttatagcagcatgatttatagtcctttgggtatatacccaggaatgggatggctgggtcaaatggtatttccagttctagatccctgaggaatcgccacactgacttccacaatggttgaactagtttacagtcccaccaacagtgtaaaagtgttcctattactccacatcctctccagcacctgttgtgtcctgactttttaatgattgccattctaactggtgtgagatgatatctcattgtggttttgatttgcatttctctgaaggccagtgatggtgagcattttttcatgtgttttttggctgcataactgtcttcttttgagaagtgtctgttcatgtccttcgcccactttctgatggggttgtttgtttttttcttgtaaatttgttggagttcattgtagattctggatattagccttttttcagataagtaggttgtgacaattttctcccattttgtaggttgcctgttcactctgacggtagtttcttttgctgtgcagaagctctttagtttaattagatcccatttgtcaattttggcttttgttgccattgcttttggtgttttagacatgaagtccttgcctatgcctatgtcctgaatggtaatgcctaggttttcttcaagggtttttatggttttaggtctaacctttaagtctttaatccatcttgaattgattttcatataaggtgtaaggaagggatccagtttctgctttctacatatggctagccagttttcccagaaccatttattaaatagggactcctttccccattgcttgtttttgtcaggtttgtcaaagatcagatagttgtagatatgcggcattatttctgagggctctgttatgctccactgatctatatctctgttttggtaccagtaccatgctgttttggttactgtagccttgtagtatagtttgaagtcaggtagtgtgatgcctccagctttgttcttttggcttaggattgacttggcgatgtgggctcttttttggttccatatgaactttaaagcagttttttccaattctgtgaagaaagtcattggtaacttgatgggggtggcattgaatctgtaaattaccttgggcagtatggccattttcacgatattgattcttcctacccatgagcatgaaatgttcttccatttgtttgtatcctcttttatttccttgagcagtggtttgtagttctccttgaagaggtccttcacataccttgtaagttggattcctaggtattttattctctttgaagcaattgtgaatgggagttcaccatgatttggctctctatctgtgtgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgaataccctttatttccttctcctgcctaattgccctggccagaacttccaacactatgttgaataggagtggtgagagagggcatccctgtcttgtgccagttttcaaagggaaagcttccagtttttgcccattcagtatgatatcggctgtgggtttgtcatagatagctcttattattttgaaatacatcccatcaatacctaatttattgagagtttttagcatgaagggttgttgaattttgtcaaaggctttttctgcatctattgagataatcatgtggtttttgtctttggctctgtttatatgctggattacatttattgatttgcatatattgaaccagccttgcatcccagggatgaagcctacttgatcatggtggataagctttttgatgtgctgctgaattcgttttgccagtattttattgataatttttgcatcgatgttcatcaaggatattggtctaacattctcttttttggttgtgtctctgcccggctttggtatcagaatgatgctggcctcataaaatgagttagggaggattccctctttttctattgattggaatagtttcagaaggaatggtaccaattcctccttgtacctctggtagaattcggctgtgaatccatctggtcctggactctttttggttggtaagctattgattattgccacaatttcagctcctgttattggtctattcagagattctacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgcgtctatttgattcttctctgtttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaatcgtgatgttagggtgtcaattttggatctttcctgctttctcttgtgggcatttagtgctataaatttccctctacacactgctttggatgcatcccagagattctggtatgttgtgtctttgttctcgttggtttcaaagaacatctttatttctgccttcatttcgttatgtacccagcagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttcccagtacgtggtcaattttggaataggtgtggtgtggtgccgaagaaaatgtatattctgttgatttggggtggagagtcctgtagatgtctattaggtctgcttggtgcagagctgagttcaattcctgggtatccttgttgactttctgtctcattgatcggtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttattttccatttgcttggtagatcttcctccatccttttattttgagcctatgtgtgtctccgcacatgagatgggtttcctgaatacagaacactgatgggtcttgactctttatccaattttccagtctgtgtcttttaattggagcatttagtctatttacatttaaagttaatattgttatgtgtgaatttgatcctgtcattatgatgttagctggttattttgctcattatttgatgcagtttcttcctagtctcgatggtctttacattttggcatgattttgcagcggctggtacccgttgttcctttccatgtttagcgcttccttcaggagctcttttagggcaggcctggtggtgacaaaatctctcagcatttgcttgtctgtaaagtattttatttctccttcacttatgaagcttagtttggctagatatgaaattctgggttgaaaattcttttcttgaataatgttgaatattggcccttactctcttctggcttgtagagtgtctgctgagagatccgctgttagtctgatgggcttccctttgagggtaatccgacctttctctctggctgcccttaacattttttccttcatttcaactttggtgaatctgacaattatgtgtcttggagttgctcttctcgaggagtatctttgtggtgatctctgtatttcctgaatgtgaatgttggcctgccttgctagattggggaagttctcctggataatatcctgcagagtgttttccaacttggttccattctccccgtcactttcaggtacaccaatcagacgtagatttggtcttttcacatagtcccatatttcttggaggctttgctcatttctttttattcttttttctctaaacttcccttctcacttcatttcattcatttcatcttccatcgctgataccctttcttccagttgattgcatcagctcctgaggcttctgcattcttcacatagttctcgagcttaggttttcggctccatcacctcctttaagcacttctctgtattggttattctagttatacattcttctaaaaatttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagaggtgctctgctttttagagtttccagtttttctgttctgttttttccccgtctttgtggttttatctacttttggtctttgatgatggtgatgtacagatgggtttttggtgtggatgtcctttctgtttgttagttttccttctaacagagaggaccctcagctgcaggtctgttggagtaccctaccatgtgaggtgtcagtgtgccctgctggggggtggctctcagttaggctgctcgggggtcaggggtcagggacccacttgaggaggcagtctgcctgttctcacatctccagctgcatgctgggagaaccactgctctcttcaaagctgtcagacggggacatttaagtctgcagaggttactgctgtctttttgtctgtctgtgccctgcccccagagatggagcctacagaggcaggcaggcctccttgagctgtggtgggctccacccagttcgagcttcctggctgctttgtttacctacgcaagcctgggcaatggtgggtgcccttcccccagcctcactgccaccttgcagtttgatctcagactgctgtgctagcaatcagcgagactctgtgggcgtaggaccctctgagccaggtgcgggatataatctcgtggtgcgccgttttttaagtccatgggaaaagcacagtattcgggtgggagtgacctgattttccaggtgccatccatcacccctttctttgactcagaaagggaactccctgaccccttgtgcttcccaagtgaggccatgcctcaccctgcttcggctcgtgcatggtgtgtgcacccactgacctgtgcccactgtctggcactccctagtgagatgaacccggtatctcagatggaaatgcagaaattacccgttttctgcgtcgctcatgctgggagctgtagaccggaggtgttcctatttggccatcttggctccttggatccacattttgtttatccaatctactgttgatgggtacttggtttgattttccatggctttgctattgtgaatagcacagtaataaacatatgagcacaagtaggttttggtataataacttattttcttttgggtatattcccagtaatgggattcctgggtctaatggtctctctgttttaaattatttgagatgtctcaaaactgcctttcccaccaacagtgcataaacattcccttttctccacagccccaccagcatctgttgttttttgagtttttggtaatagccatactgactggtgtgtgatggtatttattgtggttttgatttggatttgtcttatgattactgatgctgagcagttttttatatatttttggccacttgtatgtgctttatgatgttatgattcttttgtttccatgtttagaattcttttgagcatttcttgtagggttggtgtagtggtgacacattcacttaacatttgcctgactttgaaatactttatctctccttcatttggcaggatataaaatttggggctggcatttttgctttaagaaggcttaaataggtctttaatttactggtctgtagactgtctgctgagaaatctgctgttagtccaatgggatttactttatagatgatttgatgcttttctctacgtgctcttaagatttttttcatgttgactttggataggcagatgactgcatgccttggtgatgttcaccttgtaaagtatcttctagttattctctgagcatcttgcatttgcatgcctacatctttatcaagaccatgaaaactttcctaaagtgtctcctcaaatacgttttccaagcctttaacattttctccctcaggcatgcttataactggtgggtttggtcactttacgtaatcccatattttccaaaggctttgttcatttttgaaaattcttctcttatttttatgtgagtaggtgaatttgaaagaccactctttatgttctaaaattgtttcttgtgcttgatcctaggacagtgtgaaaacctttgactgtatttaacttttcattttcagaatttctgctttttcaaatttgtctttccttttacattttaaactgtttttggtgttttgattttttttaaaattttaacttttattttaaattcaggggtacatgtgcaggatgtgcaggtttgttatatagataaacatataccatgttggtttgctgcacagatcatcccaccactcaggtattaagcccagaatccattagctatttttcctaatcctctccctttttccaccccctgccctcctacaggttccagtgtgtccccctgcccaatgtgtttccatgtgttctcataatctatctcccacttagaagtgagaacatgcagtatttggttttctgttcccacattagattgctaaggacactcacctccagttccatccatgtctctgcaaaggacatgatctctttccttttatggctgcatagtatgccatggtgcatacttaacatattttcttcatttaatctgtcattgatgggcgtatatgtttcttccacacctttgctattgtgaatagtgcttcaatgaacgtgtgcgtgcatgtgtttttataatagaacaatttatattcctttgggtatatacccagtaatgggattgctggtttgaatggtatttttgcctctagacctttgaggaatccccacactgtcttttaaaatggttgaactaattcatactcccactatcagtggaaaatcatgcctttttcttcacaacctcaccagcatctgttgtttttttgacttttaaatcatagccattctgactggtgtgagattgtatctcactgtggttttgatttgcatttctctaataattagtgattttttttcatatgtttgttggccacatgtatgttttctttttttttttttttttttttttgagacggagtcttgctctgtcgcccaggctggagtgcagtgacgcaatctcggctcactgcaagctccgcctcccaggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgtatgttttcttttgagaagtgtctttgcccacttttgaatggggttgtatggtttttttctgataaatttgtttaagtttcttatagatcctggatattagacctttgtcagatgggtagattgcaaaattttttttcccattctgtaggtttcctgtttactctgttgatagtttcttttgttgtgcagaagctctttagtttaattagatcctatttttcaattttgcttttgttgcaattgcttttttgtcttcatcctgaagtctttgctcatgcctatttcctgaatgatattgcctaggttttcttctggagtttttacagtgtttggtttttcatttaagtctttaatattgagttgaatttgtatatggtggaaggaaatattacagtttcaattatctgcatatggctagccagttctcctagcactatttgttaaatagggaattctttccccattgcgcattcttgttaagtttgtcaaagatcagatggtggtaggtgtgtggtcttatttctgggttctttattctgttcttttggtctatgtgtctgttcttgtactagtaccatgctattttggttactgtagctctgtagtacagtttgcattcaggtagtttgatgcctcgagctcttttttttttttttctttttacttgggattgccttggttattcaggctcttttttggtttcatattaattttaaaatagttttttctaattctgtgaagaatgtcagtagtagtttaatgggaatagcattgaatctgtaaattgctttgggcagcatattagtctgtttacacactgccatatagaactacctgagacatagtaatttataaaaaaagaggtttaattgattcacagttatgcatggctggggaggccttaggagacttatgattatggcagaagctgaaggggaagcgaggcacatcttatctagtggcaggaggtagatagcaagggggagactggccatacacttttaaaccattagaccttgttagaactcactatcatgagaacagcatgggaaaaaccactctcatgatccagttacttcctactaggtccctttcttggcatgtgggaattacaactggacatgagatttgggtggggacatagagccaaaccttattatttaactcctggattctcctaaatctcatgtccttctcatgttttgaaaccaatcacaccttccaaacagtcccccagcctcttaatttattccaacattaactcaaacgttcaagcccaaagtctcatgtgacactatgcaagttcctatcacctatgagcctgtaaaataaaaaaaatttagtgatttcttagatacaatgggagtacaagcattgggtaaatgctcccattccaaatgcaagaaattggccaaaacaaagaagttacaggccccatgcaatccagaacccagcagggcagtcattaaatcttaaaactccaaaataatctccttcaactccatgtctcacatgcaggccacactgacacaatgcatggccttctaaggccttgggcagatcctccccagtgattccacagggtagagcccctgtggctgctttcttgggctagcattgagtgcctgtggcttttccaggtgcatggtgcaagctctcagtggatctatcatcctaggttctggagcatggtggccctcttctcatggctccaccaggcagtgccccagtgggcactctgtgtggggccttcaaccccacatttcccctctgcactgccctagtagaggttctccatgacggctttgcccctgcagcagacttctgcctggacatccaggcgtttccatacatcctctgaaatctaggcataggctcccaaactgttgccttctgtgcacccacaggctcaacagcatgtagaagccaccaagacttgggacttgcatcctctgaaactactgtctgagctgtaccttggcctcttttagtcacagctggagctggagcagctgggacacagggcaccatatcccaaagctgcacagaccagcaaggtcctcggcccagcccacaaaagtatttttctctcctaagccttcaggcctttgatgggagtggctgccataaagatctttgaaatgccctggagacattttccccattttcttggttattaacattcaccttctctttacttatggaaatttctacaggcagcagcttgaatatttccccagaaaatccatttttgttttctaacacatggtcaggttgcaagttttccaaacttttatgctgttttcctttaaaacataagttccaatttcagaccatccctgtgaacacacatgactgtacacattcagaaacagccaggtaatgtcttgaatgatttgctgagctgcttagaaatttcttcttcaatgggcaccatggatcatgcctgtaatttcagcactttgggaggccaaggtggggatgacttgaggtcaggaatttgagaacagtctggtcaacatggtgaaaccccatctttacaaatcatacaaaaattagctgggtgtggtttcatgtgcctgtatttccagctactcaggaggctgagacatgagaattgcttgaatccaggaagcagaggttgcagtgggccatgatcacaccactgtactctagcctgggtgacagagcagaactctctcagaaaaaaaatttgttctgcaagataccctaaatcatctctctgaagttcaaagttccacagttctctagtttaggggcaaaatgctgccagtctctttgcttaagcatagcaagagtgacctttactttacatcccaataagctcctcacttccatctgagttcacctcagcctggacttcattgtccatatcactatcagtattttggtcaaatccattcaaaagtttgtaggaagtcccaaactttccccaatattcctgtcttcttttgagccttccaaactgctccaacctctgctcattacccagtttctatgttgcttccacatgttcaggtacctttatagcagtgccttactcccagtatcacttttttgtattagtctgctttcacacagctataaagaactacctgagcctgggtaattcataaagaaaagatgttttgttgactcgcagtgacacacatctggggaagcctcaagaaatgtacaatcgtggcagaaggtgaagagaagcaaggcacattttacacagtggcaagagagtgaggggggaactgccacacacgtttagtccatcagatctcatgagaactcagtatcatgcaaacagcatgcgggggtgcgggttgctcccatgataaaattaccttgcaccaagttccaatctccatgtagggattacaattcgatttgagatttgggcatgaacatagagccaaaccatatcaggtagtatggccattttgatgatattgattctttatccatgagcatgaaatgtttttccactcgtttgtgtcctctctggttttcttgagtagtgttttgtagttcctgaagaggttcttcacttttcttgttagctgtattcttaggtattttcttgtgtggcagttgtgaaggagaattcatttactatttggctcttggcttgcctcttggtgtataggaatgctggtgatttttgtacattgattttgagttctgagactctgctgaagtggcttttcagtttcttctgtgaagttattgggctgatatgatggggttctgttgaaataggaatagaatcatgtcatctgcaaacaaagatagtttgacttcttctctttttatttgaatatgcttaatttctttcttttgcttgattgccctggccagaacttccaatactgtgttgaataggagtggtgagagagggaaactttctcttatgccaattttcaagggaaatgcttcttctttttcttcttcttcttcttcttcttcttcttcttcttcttcttcttcttcttcttcttcttcttcttcttcttcttcttcttttttttgagacagagatttgttcttgttgcccaggctggagtacaatggtgctatctcagctcactgaaacctctgcctccagggttcaggagattctcctgcctcagcatcctggtgttttgggtagctgggattacaggcatgaggcaccatgcctggctaattttgtatttttagtacagatggggtttctccatgttggtcaggctggtctcaaactcttgacctcaggtgatccacccacctcggcctcccaaaatgctgggattacaggcccgagccactgcacctggccctcaaggcgtcaagatagaataagcttctatcttttgcttattcaacatgatatttgctgtgtgtttgtcatatatggcttttattattttgaggtttgttctttcaatacctgtttattgagagtttttaaaatgaaaggatgttgaattttgtcaatggcattttatgcccctattgagataatcatgtggttttgtctctagttctgtttatgtgatgaatcacatttgatttgcatgtgttgagccagccttgcatcctgggaataacttctgcctgattatgtgttgcgggaagtcagggaccccaaacagagagactggctgaagccatggcagaagaacataaattgtgaatatttcatggacattgattagttcctcaaattaatacttttataatttcttacacctgtctttactgcaatctctgaacataaattgtgaagatttcatggacatttatcccttccccaatccatactcttgtgatttcctatgcctgtctttactttaatctcttaatcctgacatctttgtaagctgagtatgaatgatgcctcaggatcctgtgatgattgcgttaactgcacaaattgtttgtagagcacgtgtatttgaatgatatgaaatctgtgcaccttaagaacaggataaccacgattttcagggaacaagggagatgaccttaaagtctggctgcctgtgggcaggaaggacagagccatatttctcttactaccaaaaatgggtaagataaatgtcactgaactctttccccagtaaggaatattaataattaacagccctgggaaaagaatgcattcacagaggaggcctctgaagtggccgctctgggggtgtctgctttatgcagatgtagatagggatgaaacatgccctcgtctcctgcagtgcccccaggcttgctaggattaggaaattccagcctggtgaattctagtcagaccagttctctgctcttgaagcctgacaatgcgtgcacagtgggacatagaagttcattagtgattctagtttcaccctgaccttctgccttgtgatcttttgttgcccttgaagcatgtgatctctgtgacccacaccctatttgtgcactccctcccctttgaaaattcctaataaaaacttgctggttttacagctcaggggcatcatggaacctaccgacatgtgatgtctccctgggcccccagctttaaaatttctccttttgtactctgtccctttatttctcagactggctgacaattagggaaaatagaatagaacctacatgaaatattgggggtgaattttgcccaataattatggtggataggctttttgctgtggtggataagctttttgctgtgctgatggattcagtttgccagtattttgttggggatttttgcattgatgttcatcaagaatattggactgaagttttcttttcttgctatatctctgccagggtttggtatgttggcctcatagaatgagttatggaggagtccctcctttttaatgttttggaatagtttcagtaggaatggtaccagctcttctttgtacctctggtagtattaagctgtgaattcgtctgttcctgggctttgtttttggtttgtagagtattttttactgtctcaagttcataactcattattggtctattcaggattcagtttctccgtgcttcagtcttcagagcatgtatgtgtccagcattttatccatttcttctcaattttctagtttatgtgcatagaggtttttgtagtattctctgatatttgtatttctttggggtcagtggtgatacacttcttattatttctggttttgtctacttgaatttttctctcttttcttcattagtctagctagtagtctctattttaataatttttttcaaaaagccaacttctggatatgctgatttttgttaagggtttttcgtgtctctatctctttctgttctgccctgatcttgactacttcttgccttctgctagctgaggggtttgtttgctcttggttctctagttattttagttgttatttatgttattaacttgagatctttctagctgtttgatatgggcattttagtgctacaactttccctcttaacactgctttagctgcatcaaggagattcccagatgtgttgtatattctcattagtttgaaagaacttcttgatttctgccttaagtttattatttactcattcagaagcaggtggttcaacttccatgtagttatatggttttgcatgtatttcttaatcttgagttctaatttgattgtgctgttctctgagagactgtttattattatttcagttcttttgcatttgctgaggagtgttttactttcaattatatggtcaattttatactaagtgccaagtggtgatgagaaggatgtatattctgttgtttgggtgtggtgagttctgtacctatcaggttcacttgattcagagctgagttcaggccctgaatatgtttcttaattttctgtcttgatgatctgtctaatattgtcagtggggtgttaaagtctctcactattattgcctgggagtctaagtctgtttgtaggtctctaagaacttgttttatgaatctgggtgctcttgtactgggttcatagatattccagatagttagctcttcttgttgaattgagccctttaccattatgtgatgcccttctctgccttttggatctttgtttgtttaaagtctgttttttcagaaactaggattgcaacacctgctttttgtttggtaaattttcctccatccctttattttgagcttatgtgtgtctttgcacatgggatgggtctctggaaggcagcataccatttgttcttggttttttatacagcttgctattctgtgtcttttaattggggcatttagcccatttacatttaaggttagaattattatttgtggatttgatcctgtcatcatgatcctgcctggttattttgtagacctgtttatgtggtctacagtgtcacttcatagtgacactggtctgtgtacttcagtgtgtttttatagtggctggtaatggtttttcctttccatattcagtgctttcttcaggagctcttgtaagtcaggtctgctggtaacgaattacctcagcattagtttgtttgaaaaggatcttatatcttctttgcttataaagcttagtttggccagatatgaaattctgggttggaaattcttttaagagtgctgaatagtggccttcaatctattctggcctttaaggtttctgctgagaggtccactatttgtctgctgggcttccctctgtaggcgatgtggcctttctctctggctgccctgagcattttttccttcatgtggaccttggagaatctgctgattatgtgtcttgaggacgatttttttttgtggattatcttactggggttctctgcatttttgaaatttgaatgttggcctgtctaggtagatcagggaagttctcctcgatggtatcccgaaatgttttccaaattggttttactctcctcatctctttcatgtacctcagtcagttgtagattcagtctctacataaccccatatttctgtgaagttttgttcattcctttgttctttgtttttattcttgcctgcctgtcttatttcagaaggtcagtcttcaagctctgagattcttccctttgtatggtgtattctgctactagtacttgtgattgcattatggagtttgttagtgtgtttttccgctctatcaggtcagttatgtttctctctatgctggctatcagctcttgcattattttatcaagattcctagcttccttacaaggggttgcaagtggcttttttagctcagtgcagttcatttttacccacattggaagcctacttgtgtcatttcagctatttctagcctcagtccagttctgaatccttgctggagaggtggtgttgtggccatttggagaaaagggggcactctgggtttttgaatttttattatttttgcactgattctttctcatctttgtggacttatctacctttgatctttgaggttcctgatcttaggttttttttttttttttttggatgtttatttgcttgggtgcttttctttcagcagtctggccactgtttcataggggtgctgcagtttgttggggttccattctagacccttgttgcctcagtttttccagtacctggaagtatcaccagagaaggctgtgaaacagcaaagatggcatcctgctccttcctctggtagcttcattccagggggcctgaatgcacctataggagttggctggagacctgggttggaatacctcacccagtcagagggaaagggatcggagacaaacttgaagacgcagtctggctgaattttgtagagcagctgtgctgtattggggatcccttcagcctcccagttggtttggatcctttaaggttcacaggttggaccagctcagatgcccaaataggaaaggtggtggcctgcttcacccatcaggcactccatcccagggataaattagaactttgtttgcaatagaacatgagcagtggtgaccagaggctttggctgggagagccagcaaggaggaatggatctgagtcctgttgaaagaagcagtctggccacttctcaacaaaacagctatatcatgctgtggaattgctttttgccttgtctgcttatactctccaaagcccacaggcttgaagggctgagtcatccaaacagcaaagatgatgacccacccctccccacaagcactttttggcagaaagatatcagaacgctgtccatagtatacaggtgagggtggccagaggccttggctaggaggactgaccttgtgagaaggagtagatcagggacccatttaaagaagcagtctggccatgcctcaacaaaacagtcatgacaggctgtggaaccacctttgccctgttggtgttggactctccctaggcctaaggctggaatggctgagttgtccaaacaaccaaggtggcagcccatcccaaggagagatcagaactctgtctatagaatatgagtgggagggggtggctggagacccaagttgggaggtctcacccagtgaggaagaatggattgaggtttcacttaagcagtctggccacgttctggcaaagcagctgtgctgcactgtgaggaccttttctcatttgtaccatctggactctccaaatcctgctggctggaacagctgggttgaccaaacagcaaagatgatagtgtgccccttgtcttgggggttccatcccatctcaggcaggctccaccctgtttttagtggctggctggaattccaagccaatgggtcttatcttgtgacatgccatggaagtggggcccgcagactgctgctgctcagctccttcaattctgcccccttcctatgggtatgtacggacctttgaccttgcctgagttgcagtcacctttgtcagggatcctgggctcagagtctataaagctcctgggtttctgtgcatgcctgagcagttgctctgccaagactccacacagctgtgtgttggacccaaggcccctgtagtgtgggctcacaaggtaatctgctgattggagggttgcaaagatctgggggagaagtgtggtttccctggggttgcacattgactcactgcttttcttggctgggggtgaggggctccctttccaaattgttaatctgatttctttgtggtggttttcaactctcttgtatctcattgggctttcttacaagccatagtttgccatttgtggaattggtggaatttgtcctttcagaatttttattttgtttaggacccatgtctagaccgctagtgtgatccttatgggtgctgcaacactctgttttttgtgatgccacagttcttattctgattttttttgaatttacttctgttcagatggggattttaccccccgagggtttatttcatatgttgagtagcattttttttggctttgcttctttatgctattagggggcaaagctttgtttgaattccttggtagtagatagcctttgtgtagtggtgttctcaaatgccggttgtttgtagcatgtagtagtggtgtactatgcatgtgagtaggcttgctgtcttctgcagagatgggtaggaggctcatcattttttacagcagtgtgaacttctgtcagcaggaattattttaaattctgccgtccatcctatagaccagtaggtggcacttgtaagagctagctgaatgctgcacagatgtgtcagcataagctgtaatcatttttgcagactggcatcaaagtcagtaggttgtacttgcaagaaagaggcagcttcagtggtggcagtgagatttttacttggccatttaaaaccaggagaagtgccagggtatctcagtgatgggcagggctgtggagctcctggggatccctgtccggttctttgctaccaaggtgactagagtgggcaatgctggtcatggctgggttggtatgtcagtgagcaggctcttgaaggcaggcataagtaccaacgtttgcagcagtctaggcacagctcccaggctgctggagcaactcttaagggaggaatagaggtgtctgtccaccacagagcctactgaggtgaagaagggcatggcccagagtgttcagcatagtaggtggctgtgggatccacctaattcccacacccctgacctgaaagttctccctccaggcgctagctgctgccagaatgccagaatgcttagactggtcccaaagagtctacattcagattgttgaacagttccagaaactgtagctatgaggccacaccctctcaggactagtcttgtgatgaaaggcgggcccagctcctatgccacagcatacattcacacaacagtcttctctgtgttctgtcagtgggaattcctcccctgttggaggtcacataacaaatctcatcttcatgcacctgagtgattgtgttgagtcctggggaactgggataaggtcagtaggtttttcccctggccactcaggctgtagcacctgctgtgatcagaaggggtaaacagcttccaggccaccaaaagaacactcaggtgtggcaacagcaactgtgccacatatctcaacttcctgtgagaatgggaaggcaggcagtcttgggatgaactggcaggcatgggatgtgtggcttgaatgtacttcattcccaacacaatggtggtggaacctgtttagggagcaagagagtgccttgggccccactcattccctggcctgacaggcaacagcagcatcacctcaaaataggatgcaaagccttcagggatgggcaccaaaattgtgctttgctacagcagcccagcacatggaagtccttcatgttttgtttaaatgcatacatttgtttgagggatggagaaggtgtacttatatacctcagcatgtttcatttttctttttatcatgcaaggagttgatttggttcaggcaaatattcattgaagtttaaaatgtacatacctcaccatgcagtaaacacctgtttaatgtctgacctgctcagatttcatttacttgtactgataatgcttttttgttttatttattcataacattttacatatttatcaggtacttgtgattgttacatgcatagaatgtattatcaagccaggagtatttgaggtatccatcaacttgagtgtttgtcatttttgtgttggtaccatttcaagtcttctagctactttgaaatatactctgctatctgaagtcacccaactctgctatcaaacattagaatttatttcttctaactgtatgtttgtatccattaaccagcctctcttcatcctcccttctaccctcacatcttcccagcctcaggtagttatcattctctgtcttcatgagatcaacttttttagctcctccaaatgagtgagaacatacaagatttgtctttctctgcctggcatgtttcacttagcatggtaacctccaggtacatccatgtcattgtaaatgacatcttatttcttcaattactgaataataatccataatgcatatataccacattttctttatctgttttattgatacttctgttgatttcatagctttgctgttgtgaagagtgctataaacaattgagtgctggtatctcttggatatactgttttcttctcttatggataaataccccatagtgggattgctagattgtatgatagttctacttatagcttttaaataaatgtttacgctgtttttcatagtagttgtactaatttacattcccacaaactgtgtaataagcattccctttatccgcatccttgccagtatctgtttttgtttgttgttgtttttgcttgttttgtctttctaatcattttagctggggtaagatgatgtctcattgtggtttcaatttgcatttccctgatgattagtgatgttgagcgttttctatgtaactattggtcattagtatgttttcttttgataattatttatttatttatttattacttttgattatgaatcctcctggaacttgattctttaaaaatttattattattatactttaagttttagggtacatgtacacaatgtgcaggttagttacatatgcatacatgtgtcatgctggtgcactgcacccactaactcgtcatctagcattaggtatatctcccaatgcttcccctccccactccccccaccccacaacagtccccagagtgtgatgttccccttcctgtgtccatgtgttctcattgttcaattcccacctatgagtgagaatatgtggtgtttggttttttgttcttgcgatagtttactgagaatgatgttttccaatttcatccatgtccctacaaaggacatgaattcatccttttttatggctgcatagtattccatggtgtattgtgccacattttcctaatccagtctatcattgttggacatttgggttgcttccaagtctttgctattgtgaataatgccgcaataaacatacgtgtgcatgtgtctttatagcagcatgatttatagtcctttgggtacatacccagtaatgggatggctgggtcaaatggtatttctagttctagatacctaaggaatcaccacactggcttccataagggttgaactagtttacagtcccaccaacggtgtaaaagtgttcctatttctccacatcctctccagcacctgttgtttcctgactttttaatgattgccattctaactggtgtgagatggtatctcattgtggttttgatttgcatttctctgaaggccagtgatggtgagcattttttcatgtgttttttggctgcataaatgtcttcttttgagaagtgtctgttcatgtccttcacccactttttgatggggttgtttgttttttttcttgtaaacttgtttgagttcattgtagattctggatattagccctttgtcagatgagtaggttgtgacaattttctcccattttgtaagttgcctgttcactctgatggtagtttcttttgctgtgcagaagctctttagtttaattagatcccatttgtcaattttggcttttgttgccattgcttttggtgttttagacatgaagtccttgcctatgcctatgtcctgaatggtaatgtctaggttttcttctagggtttttatggttttaggtctaacgtttaagtctttaatccatcttgaattgatttttgtataaggtgtaaggaagggatccagtttcagctttctacatatgactagccagttttcccagcaccatttattaaatagggaatcctttccctattgcttgtttttgtcaggtttgtcaaagatcagatagttgtagatatgcagtgttatttctgagggctctgttctgttccattgatctatatctctgttttactaccagtaccatgctgttttggttactgtagccttgtagtatagtttgaagtcaggtagtgtgatgcctccagctttgttcttttggcttaggattgacttggagatgtgggcttttttttggtttcatatgaactttaaagtagtttttttccaattctgtgaagaaagtcattggtagcttgatggggatggcattgaatctgtaaattaccttgggcagtatggccattttcatgatattgattcttcctacccatgagcatggaatgttcttccatttgtttgtatcctcttttacttccttgagcagtggtttgtagatctccctgaagaggtccttcacatcccttgtaagttggattcctaggtattttattctctttgaagcaattgtgaatgggagttcactcatgatttggctgtcggtctgtctgttgttggtgtataagaatgcttgtgatttctgtacattgattttgtatcctgagactttgctgaagttgcttatcagcttaaggagattttgagctgagacaatggggttttctagatatacaatcatgtcgtctgcaaacagggacaatttgacttcctcttttcctaattgaataccctttatttccttttcctgcctaattgccctggccagaacttccaacactatgttgaataggagtagtgagagagggcattcgtgtcttctaccagttttcaaagggaatgcttccagtttttgcacattcagtatgatatcggctgtgggtttgtcatagacagctcttattattttgagatacgtcctatcaatacctaatttattgagagtttttagcatgaagtgttgttgaattttgtcaaaggccttttctgcatctattgagataatcatgtggtttttgtctttggttctctttatatgctggattacatttactcatttgcgtgtattgaaccagtcttgcatcccagggatgaagcccacttgatcatggtggataagcttttggatgtgctgctggatttggtttgccagtattttagtgaggttttttacatcaatattcatcaaggatattggtctaaaattctcttttttggttgtgtctccacctggctttggtatcaggatgatgctggcctcatgaaatgagttagggagggttccctctttttctattgattggaatagtttcagaaggaatggtaccagttcctccgtgtacctctggtagaatttggctgtgaatccatctggtcctggactctttttggttggtaagctattgattattgccataatttcagctcctgttattggtctattcagagattcgacttcttcctggtttagtcttgggagagtgtatgtgtcgaggaatttatccatttcttctagattttctagtttatttgcgtagaggtgtttgtagtattctctgatggtagtttgtatttctgtgggatcggtgttgatatcccctttatcattttttattgcgtctatttgattcttctctgttttcttctttattagtcttgctagaggtctatcaattttgttgatcctttcaaaaaaccagctcctggattcattaatttttggaagggttttttgtgcctctatttccttcagttctgctctgattttagttatttcttgccttctgctagcttttgaaagtgtttgctcttgcttttctagttcttttaattgtgatgttagggtgtcaattttggatctttcctgctttctcttgtgggcatttagtgctttaaatttccctctatacactgctttgaatgggtcccggagattctggtatgttgtgtctttgttctcgttggtttcaaagaacatctttatttctgcctttatttcgttatgtacccagcagtcattcaggagcaggttgttcagtttccatgtagttgagtggttttgagtgagattcttaatcctgagttctagtttgactgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggggagttctgtagatgtctattaggtccgcttggtgcagagctgagttcaattcctgggtatccttgttgactttctgtctcattgatctgtctaatgttgacagtggggtgttaaagtctcccattattaatgtgtgggagtctaagtgtctttctatgtcactcaggacttgcttttcgaatctgggtgctccagtattgggtgcatatatatttagcatagttagctcttcttgttgaatggatccctttaccattatgtaatggccttctttgtctcttttgatctttgttggtttaaagtctgttttatctgagactaggattgccacccctgcctttttttgttttccgtttgcttggtagatctacctccatccttttattttgagcctatgtgtgtctccgcacgtgagatgggtttcctgaatacagcacactgatggttcttgactccttatccaattttccagtctgtgtcttttagttggagcatttagtccatttacatttaaaattaatattgttatgtgtgaatttgatcctgtcattatgatgttagctggttattttgctcgttatttggtgcagtttcttcctagtctcgatggtctttacattttggcatgattttgcagtggcatgtaccggttgttcctttccatgttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcctccactctcttctggcttgtagagtttctgccgagagatccgctgttagtctgatgggcttccctttgtgggtaacccgacctttctctttggctgcccttaacattttttccttcatttcaactttggtgaatctgacaattatgtgtcttggagttgctcttctcgaggagtatctttgtggtgatctctgtatttcctgaatgtgaatgttggccttccttgctagattggggaagttctcctggataatatccttcagagtgttttccaacttggttccattctccctgtcactttcaggtacaccaatcagacgtagatttggtcttttcacatagtcccatatttcttgaaggctttgctcgtttctttttattcttttttctctaaacttcccttctcgcttcatttcattcatttcatcttccattactgatatcctttcttccagttgatcacatcggctcctgaggcttctgcattcttcacgtagttctcaagccttggttttcagctccatcagctcctttaaggccttctctgtattggttattctagttatacattcttctaaacttttttcaaagttttcaacttctttgcctttggtttgaatttcctcccgtagctcagagtaatttgatcatctgaagccttcttctctcagctcgtcaaagtcattctgcttccagctttgttccgttgctggtgaggaactgcgttcctttggaggaggagaggcgctctgctttttagagtttccagtttttctgctctattttttctccatctttgtggttttatctacttttggtctttgatgatggtgatgtacagatgggtttttggtgtggatgtcctttctgtttgttagttttcctctaacagagaggaccctcagctgcaggtctgttgaagtatccggccatgtgaggtgtcagtctgcccctgctggggggtgcctcccagttaggctgctcggggttctggggtcagggacccacttgaggaggcagtctgcccattctcagatctccagctgcatgctgcgaggaccactgctctcttcaaagctgtcagatagggacatttaattctgcagaggttactgctgtcttttcgtttgtctgtgccctgcccccagaggtcgataattatttattaatgtccttagcccacttttagataggattttttaaaattgttgagttccttgtatattctggatattagtgccttatttgatgaatagttttaaaatattttcttccattcaacaggctgtctcttccatctattgattgtttcttttgctgtgctgtgattgtttcttttcggtttctttgtatcatctataatttctttcatcaatgttttacagtgttttcttgtagagatctttcacgtccttcattaaatatagtcctcggtattttatgttttgtttctattgtaaagaggattgagttattgacttggttttcagtttgaccattattggtgtatagaaatggtactgattttttgtatttttgtatgttaattttgctgtatcttgtaactttactgaatttgctctcagctcttagagggttctttttggtgaagttctttggtttttctaaatataagtttatgtcatctgcaaagagggatgagaaaggtttaattgaaaaagcttatccccatcttggaaatttatggagccattaacggtgggctttttgcagctgtgacatgttagctacaactctcattggaaaatgggaaaggcttttctgacccataagggctgtctgatacatgaagataaaaacctaatgtttggccactttgttgttgtttcttgttctgttgttaattttagggaatttatttatttatttatttatttagtgtgtgttatagcagtgatttattttattattattattattattattaatattattattttttatttttttattgatcattcttgggtgtctctcccagagggggatttggcagggtcataggacaatagtggagggaaggtcagcagataaacaagtgaacaaaggtctctggttttcctaggcagtggaccctgtggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacgggatcccaaggcagaagaatttttcttagtacagaacaaaatgaaaagtctcccatgtctacttctttctacacagacacggcaaccatccgatttctcaatcttttccccacctttcccccctttccactccacaaaaccgccattgtcatcatggcccattctcaatgagctgttgggtacacctcccagacggggtggtggccaggcagaggggctcctcacttcccaggagggacggccgggcagaggtgcccctcacctcccagacggggcggctggccgggtggggggctgacccccccacctccctcccggacggggcagctggccgggcggggggctgacccccccacctccctcccggacggggtggctggccgggcagaggggctcctcacttcccagtagggacggccaggcagaggcgaccctcgcctcccggatggggcagctggccgggtgggggctgacccccccacctccctcccggatggggcggctggctgggtgggggggctgaccccccacctccctcccggacggggtggctggccgagcgtggggctgaccccccccacctccctcccggacagggcggctggctgggcggggggctgacccccccacctcactcccagattgggcggctgccgggcagggtgctgacccccccacctccctcccggacggggcggctggccgggtggggggctgacccccacctccctcccggacggggtggctgcagggtggagatgctcctcacttcccagaaggggtggctgccgggcggaggggctcctcacttcttagatggggcagttgccaggcagtgggtctcctcacttctcagacggggcagctgggcagagatgctcctcacctcccagatggggtcacggccgggcagaggcgctcctcacatcccagatggggcggcggggcagaggcgctccccacatctcagacgatgggcggccggacagagatgctcctcacttcctagatgggatggcggccaagcagagacgctcctcacttcccagactgggcagccaggcagaggggctcctcacatcccagacgatgggcagccaggcagagacactcctcacttcccggacggggtggcggccgggcagaggctggactctcagcactttgggaggccaaggcaggctgctgggaggtggaggttgtagcgagctgagaccacgccactgcactccagcctgagcaccattgagcactgagtgaaccagactccgtctgcaatccctgcacctcgggaggccgaggctggcggatcactcgtggttaggagatggcgaccagcccggccaacacagcgaatccccgtctccaccaaaaaaatacgaaaaccagtcaggcgtggtggtgggcgcctgcaattgcaggcacttggcaggctgaggcaggagaatcaggcaaggaggttgcagtgagctgagatggcagcagtacagtccagcttcagctcggcatcagagggagaccgtggaaagagagggagagggagactgtggggagagggagagggagagggagagggagagcaattttagggaatttattaagcttcataaatttatgggataaatggaggcccctaggttaggggtgatgccactgtgagattcagagtcacttcagtgtaaggaggctgcagcagtgtttagaaagtgtgtcataattatagccatattttgacttctggaggcaagggcaggaagtgtggcttttccctgacatacagttgccaggtaggcagttatttggttgcataaataattgtaattttatggaaaaattttggagattgaaaatagaaattaaaattactccaccattcaaaagcaattgttattaccatgtttgtataatttactttagagtttaaaattttcatgtatatatatttttaacttacaatgtagattaaataaatagagatgaggttttgccacattgcccaggctggtcttgaactcctgggctgaagctatcctcccacctcagcctcccaaattgctaggattaaagacatgatttattgtgcctggcctcatgtatattatggaaactgttaagattattttacatgagagctttatatttgcttaaggtttgaaaggcttcagagtttatgtaggaagttacagacaatgtttctgttcatgtatcaaaagaaaaataatattcagagactgaagtttttctagggcagtgccacaagggttcatgtccttagaagttagcagtggcctatctaggacagtgtaattgtggtgattgttttttgttttgttttccctattatctcttatccctggaaaacatctttcagcattaggcaatgtgctatttgacattgatcagtcccttaatttatggccacttttcctgcaggtttttatgcagccagtgttaaacagctgctggtcttaagctaaaggtgggaaggtcatggcacgcagtgtgggctggatttagaatatgaattgctacagttttattttgaagaacatagagcatcagtagatgatgggcatttagggcctccataaagactgcagctgaggaaaagattcacttataagtacaggagcatcatgttgggaggggtcaagttaattattgaccacagcttttacaatctgctttatcaaccagggctgcaggctgggaacttagtacagctaaattttatgtataaagaactagtgtgtaagtgggatttatgttatgtgtgcagaggtaggctggcactcactttttgcactatttttggctgaattaagggcctaaagatgggctaattcatggatatacatggcttccacataggcttttaaaagccactccccactctgtagtttcaagttggccatggatttgttaatcaaagtcaactgtgatcttagtactagaccattctgagacatacaatgcacccttgtccacagaagggtggtagaattttattaacaatcttgcaaaaagacatgagacttattattaaaaatggtccctttttgggttgaagtagaaaaacacctcagtgaagccattaccacaccaaagtctagaaagccggtgcctggaggactacatctcaagaatcagctttgctgaggaagccagagatgagtttgaagagtatgcttcaacccttctataagaacaagtgcaacagaatattgagaataacagaataagacatttaggaatatttaactgaaggaagcaaaggatttccttatgagaaaggttgaggttttattggttaaaatcaacagatgtgaaggggaagcaagaactgtaaggacagacaaatgtagatggtctacctgttctcagaaggttttagaaaatgcgttgtgctttcattgttgctatatcagaaagaaagaccggagcctgacaaaatttagagaggaagcaaggcaggatctcataaagtagagtgatccctgagagggtgtgcccaaatgctgcagactctctcataagtgttaggagaaaccaattctccaagcatatattgggacaacagtatgacttgatccagaatgttaggacaaatttgagggggaaaggtggggcagaacagagaaaaactcaaaacataggaggtgacttaactattatgtactgtattaaaagtattatatgctgttccttgaagaaacatccccaagcaatttttggttaggactcaaggtaaagcacagaaaagatgagttatattggagggatgtagacagaagaactataatatgtactgagcccattatagatgttgagtgatggaagggtatcttctgggatggataatcttcctaggagcctggatgtacacaaaatatgtttaaacagcagatatttttggcagacccagaacctgatgttttcatgtatctcaccatggaaaactctataaccacaatctaacagaatacactagtaaaatgtccgggcctgagagcaatgccaaagtaaaaagaaagaactcggatcttacaaacattgtgatcctacttggcagaagaaaagaaacctctgaggtaggttaatcagctaagtcttcttgaaactattagaggggaaaatgaaaacacttgaggcatatagcataaaagacatagcatacagaaatattcagagctggtagcatcctaaaccagaggaaatgtcatttcttggggagtaatcatgagggaaattttttccgtgagggtgctaggggtgcaattcaccagaaacagctttatttaaggaagttgctgaaggtgattctctagctggaacacttctagggactgagggacaggaggatcttcactgggaggcaggtttcacaggtccaaacaattctgtagtgagtgacagcagccactgtggctcaggaccaaaactaccagttcctgggatacagtgttagctacctggccagatggagtccactcttagtatagcattagaagggtactcagtggggagattgagactaaaaggctgagaaaatactgaatgggaagaacttctcagtagtacctgatgcccagtgagtggggtggggggtgatttcattgcaaattttagagattaaaaagccaggagtatctcagatgacaataattgggaaagaagataagcgaataagcctttaacccactctggtgccatagttatgataaatcccatatggtcaaatttaatctcttatgacaggtttctctcaatgtaagggttttttttttaatgtgatataatctatataacgtaaaattcactgtttaaaagtgtagaattcagtgatttccagcatattaactatgtagtgcaaccatcactattgtctcactctagagtatttctgccacccccccaaaaaaaaccctgtaccaattagcagtgagtcccaatttttcccttctctcatctcctaatgaccagaaatctgctttttgcatctacaaatttacatagtctggatagttcatgtcaattgaatcacgttatatgtagccttttgtgactggcttctttccattagcacagtgttttcaagattcatctatattgtatcacatagcaatattcatttctttttatagctgaatatgttttggatatataccacattttattcatttatgcatcagttgatgggcattacattgtttcagttttttagcaattatgcataatgctgctgtgaacttttctgtacaactctaatggatttttagggtaatgctcatataccccagacaagcatctcctgtagagatcttttacctccttgggcagatgtattcctaggtttttatttgttttattgtttgttttggctataagtgggattgcattcttgatttggttctcagcttgaatgttgatggtgtatggaaataatactgatttttatatgtagattttgtatcctgaaacttcaccacatcatttgtcaagcctaggagtcttttggagaaatcctttgggttttctatgtacagaattatatgttcagtgaagagagatagtttgacttctttttctatttggatgccttttatttctttctcttggctgattgctgtggttaggatttccagtactacattgaataggagtggtgtaagtggacattcttgtttattccagttctaagagggaatgtttctaaatttgtcttttcattatgatgtcagctgcaggtctgtcacagatggctcttaatattttgaggtatgatgcttagttcattgagggtttttattataaaggggtgagttgatcagctatttagtaaagttgaaactaatatttctttttcagatacttttgagtttctataatgacctttacaacagtatatactaggttctagaacataattatgtttgcgataacattactagcaaatgggattgctttattttctaaaacgtgtgggtgcggaaaacatgatgttcagttttgtatgttctagtaatgcatttgatccttaaaaatgaggcttctgagttgacttaggagtgaacaaacacaatttctgaggtcctgaagaaactgcagccactcctgagaaagagtcaggctgtagctgctgaaagaatgcagatatggagaaaattcatctaactgaaactgaagagaatgagaagttggagagaataagtttagaatttaagttgggatttgagacattaatttctttggattcatactgcacaacaaagacagcaggaatttttcagactttagcttttatggattttaaggttaagaatttgaattttttaaagcttttaatatttgaatttaattataattcctgggaaactattaatgagagggaaattatatttaattttggagtatcaatatgtggtgacatacgattattggactatcttacggtcattatttaatatcattgcagaagctttgaaaggatatattaggtaatatggctggatacaatttaagataggaaatagaacagaagtgaagttccagctttactgatctctcagcagaaactctacaagccagaagagagtgggggccaatattcttaaagaaaagaattttcaacccagaatttcatatccagccaaactaagcttcataagtgaaggagaaataaaatactttacagacaagcaaatggtgagagattttgtcaccaccaggcctgcccaaaagagctcctgaaggaagcaccaaacatggaatagaacaacctgtaccagccactgcaaaaacatgccaaattgtaaagaccatcaaaggctaggaagaaactgcatcaactaatgaccaaaataaacagctaacataatgacaggatcaaattcacacataacaatactaaccttaaacataaatgggctaaatgctccaattaaaagacacagactggcaaattggataaagagtcaagacccatcagtgtgctgtattcaggaaacccatctcacgtgcagagacacacataggctcaaaacaaagggatggaggaagatctaccaagcaaatggaaaacaaaaagaggcaggagttgcaatcctagtctcagataaaacagactttaaccaacaaagatcaaaagagacaaggccattacataatggtaaagggatcaattcaacaagaagagctaactatcctaaatatatatatgcacccaatacaggagcacccagattcaaaaagcaagtccttagtgacctacaaagagacttagactcccacacaataataatgggagactttaacaccctattgtcaacattagacagatcaacaagacagaaagttaacaaggatgtccaggaattgaattcagctctgcacctagcagacctaatagacatctacagaactctccaccccaaatcaacagaatatacattcttttcagcatcacactgcacctattccaaaattgaccacatagctggaagtaaagcactcctcagcaaatgtaaaagaacagaaattataacaaactgtctctcagatgacagtgcaatcaaactacaactcaggattaagaaactcactcaaaaccgctcaactacatggaaactcaacaacctactcctgaatgactactgggtacataacaaaatgaaggcagaaataaagatgttctttgaaaccaacgagaacaaagacacaacataccagaatctctgggacacatttaaagcagtgtgtagagggaaatttatagcactaaatgcccaaaagagaaagcaggaaagatctaaaattgacaccctaacatcatcattgaacgaactagagaagcaagagcaaacatattcaaaagctagcagaaggcaagaaataactaagatcagagcagaagtgaaggagttagaaacacaaaaatcccttcaaaaaatcaaggaatccaggagctggttttttgaaaagatcaaaaaaattgatagacctctagcaagactaataaagaagaaaagagagaagaatcaaatagatgcaataaaaaatgataaaggggatatcaccaccgatcccacagaaatacaaactaccatcagagaatactataaccacctgtacataaataaactagaaaatctagaagaaatggataaattcctcgatacatacaccctcccaagtctaaaccaggaagaagttgaatctctaaataggccaataacaggctatgaaattgaagcaatcattaatagcttagcaaccaaaaaaagtccaggaccagatggaatcacagccaaattccaccacagatacaagggggagctgataccattccttctgaaactattccaatcaatagaaaaagagggaatcctccctaacacattttatgaggccagcatcatcctcataccaaagcctggtagagacaaccaaaaaagagaattttagaccaatgtccctgatgaacatcaatgcaaaaatcttcaataaaattttggcaaactgaatccagcaacatatcaaaaagcttatccaccatgatcaagtgggcttcatccctgggatgcaaggctggttcagtatatgcaaatgaataaatgtaatccagcatataaacagaaccaaagacgaaaaccacgtgattatctcaatagatgcagaaaaggcctttgacaaaattcacagtgcctcatgctaaaaacctctcaataaattaggtattgatgggacataactcaaaataataagagctatttatgacaaacccatagccgatatcatactgaatgggcaaaaacttgaagcattccctttgaaaacggtcacaagacagggatgcccctctcaccactcctattcaacatagtgttggaagttctggccagggcaatcaggcagaagaaagaaataaagggtattcaattaggaaaagaggaagtcaagttttccctgtttgcagatgacatgattatatatctagaaaacgccatcatctcagcccaaaatctccttaatctgaaaagcaacttcagcaaagtctcaggatacaaaatcaatgtgcaaaaatgacaagcattcttatacaccaataacagacagacagagagccaaatcatgagtgaagtcccattcacatttgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatgaagctaccaatgactttcttcacagaattggaaaaaactactttaaagttcatatggaaccaaaaaagagcccacatcaccaagtcaatcctaagccaaaagaacaaagctggaggcatcacactacctgacttcaaactatactacaaggctacagtaaccaaaacagcatggtactggtagtaaaacagagatatagatcaatggaacagaacagagctctcagaaataacaccgcatatctacaaatatctgatctttgacaaacctgagaaaaacaagcaatggggaaaggagtccctatttaataaagggtgctgggaaaactggctagccatatgtagaaagctgaaactggatcccttccttataccttatacaaaaattaattcaggatggattgaagacttacatgttagacctaaaaccataaaaaccctagaagaaaacctaggcattaccattcaggacacaggcatgggcaaggacttcatgtctaaaacaacaaaagcaatggcaatgaaagtcaaaattgacaaatgagatctaattaaactaagagcttttgcacagcaaaagaaactaccatcagagtgaacaggcaacctacagaatgggagaaaagttttgcaatctactcatctgacaaagggctaatatccagaatctacaatgaactccaataaatttacaagaaaaaaacaaagaaccccatcaaaaagtgggtaaaggacatgaacagacacttctcaaaagaagacatttatgcagccaacagacatatgaaaaaatgctcatcgttactggccgtcagagaaatgcaaatcaaaaccacaatgtgatatcatctcacaccagttagaatggcaatcattaaaaagtcaggaaataacaggtgctggagaggatgtggagaaataggaacacttttacactgttggtgggactataaactagttaaaccattgtggaagacaatgtggcgattcctcagggatctagaactagaaataccatttgacccagccaccacattacttggtataaacccaaaggaatataaatcatgctgctataaagacacatgcacccatatgtttattgcagcactattcacaatagcaaagacttggaaccaacccaaatgtccaacaatgatagactggattaagaaaatgtggcacacatacaccgtggaatactatgcagccataaaaaaggatgtgttaatgtcctttgtagggacatggatgaagctggaaaccatcattctcagcaaactctcacaaggacaaaaagccaaacactgcatgttcttactcttaggtggtaaatgaacaatgagaacacatggacacaggaaggggaacatcacacactggtgcctgttttggggtgggggaatgggggagggatagcattagcagatatacctaatttaaatgaggagttaatgggtacagcacaccaatgtggcacatgtatacatatgtagcaaacctgcacgttgtgctcatgtaccctagaacttaaagtataataaaaagaaaaaaaagtatgtgtatgtatctatacatatttataaaagaaggcaacatagtgacagcctgttagagacccaatttgcataataaaagatcagggtggggtggccagcctcttcacgtactatataaagggcacacctggtttaaccaatcctctgtgccctatataaggcagacatgacttcctcaagctcatctataaaccaactgcatcttgctatgaacctggaaaccatttgggatctcttcctctgcaccagaaagctctcttctttgtttcacttattaaacttctgctcttaaacccactccttttgtctgtgtctgtgtccttgatttcctcggtgtgaggcaatgaaccttgtgtattaccccagacaaatgaggcagcttcattgtgggggcttgtccaggattatcaaaagggtgagtataggagtggacctcaactctgtccttttatttcagggctctcagcctccattttaattatttaattattttatttttttgagacagagtctcactgtatcactcaggctggagtgcagtggcattatcttggttcactgcaaccaccacctcccaggtttaggtgattctcatttctcagcctcctaagtagctggaattatgacacatgccaccacacctggctaatttttgtatttttagtagagatggggttttgccatattgggcaggctggcaccaaagttctgggatgaggtgtgagccaccacacctggcccttaacctccattttaaagtcaaatcaaaccatatactgtgtgtctgatggccacctagatacctctagtgtgagccatgcttctcaaggctcagatgacaggcttgttgggctgtcatgatagtgaatccactagtgccctcaggttgctgggcttattggttatgtttcaaaccaattttccttcatggaggaactagccatctcatggggcttgaagaagtcctagggcaactgacaatttctggccagggctaaaccttgatgtaattcaaaagctttgggactgaactcagcctccagctgctcaattggatcagcaacagaatctccagcttttctattgcagaatgttctcctttcctatccaccaccatcatgtctcctctctctgtatgcaatatcatgggaatttttacagttcagagaaatagtcctgttaggaaagatcaaaaaatgctatagtaactacaaatatagctcaagggaatgccacttttgtaactttctagaagcagaggtctcccccagcgagtgtttctacccttcctctggcaagcatatggtatttctaggtcagcagcgtcaactagtggagtatccttaccatgagtctcagtgttggtcctttgctgagacactccagcttcccaattctccctttttgtgcccctctaccagattccagggtttatggctttctgtaaatgggaaaaactatgccatgaaagatcaggaggaaaatgtcctctgaaactgttttagtctgaacactgtcccatcagcaggaaaaccaccatttgatccctatgttcttttaacacaccaatcctgcttgcagttaagacaatacttaaatagtaagggaattttaagtccagaagttaaccactaccattctctaggggtaaatcctttagcacgacccacaatagcaggatatagagttcaatcttgtacaccccctccattaaaggggccatgcccaaattcaactattacatagtctttcctgagatccatttttcagggagccatgaagatcatacaagtctaggaagtcagggtaatcaaaaacagagaactagggctgcatgggtacacatgactaaactcatcacttaattcctctggttccatggctggggaatcatgcctgcaaccatgggtagcatgtttaacaaggtgccaggagcccaggaaccaaagagagaaaacagtagggggaatgcccccactgtcttcccctccaccctgggccatcccaaggaaaggatccttttattctcagttctctttctagatgggtaacagaccatctttggcctgtactcctctcaagtgtattctaaagcactgggactcatttaaccccaaaactttgaagaaaaaagcagctcatttttctttgcacaaggggatggcattctttctagacctttgcaagcattgcaaaatcaacccagcttttttagcagtcatatcaggcaggtctgtagagaatgatttcccacagtaagagaagcaacttttgagggaaccatctgagaattccccttatctgaggcccctttaagttcccttctcattacagaaccttaggcagattaagggggtcttaggccatgctgctcctaagccaaaccctcactgctactcaaaaacaggcagctctgtaggcagtagaacattttggagatgaacaatatatctcctataataggccaaaaaggaaaaaaggagatagggaaggtgatatggtttggttctgtgttcccacccaaatctcatcttgaattatactcccataattttcatgtgttgtgggagggacccagtgggagataatttgaatcatgggggtggttttccctatactgttctcataatagtgaaggagtcttatgagatctgattgtgctatcaggggtttctgctttagcatcttcctcattttttctagccactaccatgtaagaagtatctttcacctcctgtcataattctgaggcctccccagccatgtgaaactgtaagtccaattaaacctctttttcttcccagtcttaggtatgtctttatcagcaggatgaaaacatggtacatcctacatcagcaagatgtaaattggtaccagtagagttggcgttgctgaaaagatacccaaaaatgtggaagtgactttggaattgggtaacagtttgcagggctcagaagaagacaggaaaatgtgggaaagtctggaaattttgcaaagacttgctaaatggctgtgaccaaaagcctgatagcaatatggacaataaggtccaggctgaggttgtctgagatggaggtgagaaacttgggaactggagcaaaggtgactctcattatgttttagcaaagagactggtggcatttggcccctgccttagagatttgtggagctttgaacttgagagagatgatctagggtatctggcagaagaaatttctaagcagcaaagcattcaagaggtgacttgggtgctgataaaggcattcagttttataaggaaaacagagcataaaagtttggaaaatttgcagcctgacaatgtgatagaaaagaaaaacccactttctcaggagaaattcaagccagctgcagaaatttgcataagtaatgaggagccaaatgttaatccccaagccaatggggaaaatgtctccaggtcatgtcagaggtcttcctggcagccgctcccatcacaggcccagaggcctaggagaaaatggttttgtggcctggggcccaggcctagggacttggtgccctgcatcccagccactccagctgtggctgaaaggggccaacatagagcttcagccatggattcagagggtgcaagccccaagccttggcagcttccacgtggtgttgagcctgtgagtgcacagaagtcaagaattggctgggcatggtggctcatgcctgtaatcccagcactttgggaggccgaggcaggcagatcatgaggtcaggagatcgagaccatcctggctaacacagtgaaaccccatctttactaaaaatacaaaaaaattagctgggcatggtggcggatgcctgtagtcccagctactcgggaggctgaggcaggagaatggcgtgaacctgggaggcagaggttgcagtgagcagagatcgtgccactgcactccagcctgggcgaccttcacctagatttcagaagatgtatggaaacacctggatgctcaggcagaagtttgctgcaggggcagggtgatcatggagaacctctgctagggcagtacagaagggaaatgtggggtcccatacagagtccctactggggcaccacctattggagctgtgagaagagggccaccatcctccagaccccagaatggtagatccactgacagcttgcactgtttgcctggaaaagccgcagacactcaatgccagcccattaaagcatctgggaggtaggctgtactctgcaatgccccaaggatagagctgcccatgaccatgggaacccacctcttgcatcagcatgacctggaagtgagacctggtgacaaaggagattattttggagctttaaaatttgactgcccctctagatttcagacttgcctgggccttgtaacccctttgttttggccaatttctcccatttggaatggctatatttactcaatacctgtaccccattgtatctaggaagtaactcacttacttttgattttacaggctcataggcagaagggacttgccttgtctcagatgacattttggactgtggactttcgggttaatgcagaaatgagttaagactttgggggactgttgttggaaaggcatgactggttttgaaatgtgaggacatgagatttggaggggccaggggcagaatgatatggtttggctctgtggctccacccaaatctcatcttgaattgtactccaataatttctgcgtgttgtgagagggactcagtgggagatcatttgaatcatgggtgcggtttcccccatgctgttctagtggtagtgaataagtctcatgagatctgatggttttattaggggtttctctttttgcatcttcctcattttctcttgtcgctgccatgtaagaagtgcctttcaccttccatcatgattcttaggcctccccagccatgtggaactataagtccattcaaacgtattttttcccccttgtctcaggtatgtcttaatcagcagtgtgaaaacacactaatacaaaacacaaagaaataatggaaacacctttcccaataggaagggaaacagtccctcctgacaatccctattgaaactctggtagctctgcaaaagaatggaaaaggcaacacttttttttttttttgagacggagtctccctctgttacccaggctggagtgcagtggtgcaatctcggctcactgcaagctccacctcccaggttcataccgttctcctgcctcagcctcccaagtagctgggattacaggcacccgccacgacgcccagctaattttttgtattaaaggcaacattttttaatgtacttatgagagggcttacaaagaactagggctaaacctgttaattactctaagctgtccttgatagaccaatagccagataagaattacacagcctttatggaaaggctgagagagctactaacaaaccacccctccttatcccttgattcagttgagggacagctcatcctaaaggacaagtttatcacacaggctgctcctgatattagaaggaaactgtgaaaggaggctataggaggatacaccaccttggaaaacctcctgagggtggccacttcagtcttttataatagatatcaggaggaggcccagcagcagaaagagaggaagcacaagaaaatgacagaggctgtagtatctacctgctttgcaggcttgcaaaattcaggatccccaaggtacatctgctagtggctatcaatgtggcaagtcagggcactttaagaaggagtgctcaggcagcaaggaaatgccacctcagtcttatccagcttgtggcaaagaccactagagatcagactgcccccagtgatggaggtcactgtgttcagaaccagtctcacagatggtccaacaggactgatgggttctggggctcaaacccgtggctccagtggctcaaactgccattacagcacagaaaccccaggtgattctggaaattgaagaaaggaaggaagacctcctcctggacactggagccagcctctctctctctctctctctctctctctctctctaatccaggccttcccacttcttgtagcaccaccataagggacatctcaggaaaaactctaatatttttctcgaccccttagttgcagctagagggacctattatttacaaatacctccaagccattgtcacagtgaccctactggtcctagatgccacaaattaacctcggaaatgacttaaatgtttacacctcacataatgtggaaggattactgtcctctagggggagcctttggctaatagtcggctccttaaatattaggctctgctcttagagggttccacaatccagttaaaaacttgttctcacctaaacctagccactttcctccccaaggaaagtggggaaaatgaacatgactgtgaacaagttataatacagacctatgcagccagggaagatctcagggaaaatcccctagaaaatccagactggatcctcttcaaagatgggagctcctttgtagagaaagtaatcagtacggcaggattatgcagtagtcactctaaatggcatcattgaaaatgtgtctctctctccaggcacaagtgctcaattagctgcactgacagatcttaaaagaccacttgaattaagcaattgaaagataggtaacatttacactaatttgaagtatgctttcttagttctccatgctcatgctgtcatttgtaaggaaagacactgtcttacagataatttatggcctataaaataccaccccaaaattaactggttattatcctcagttttccttccatgagaaatagcagtaatgcattataaagggacatcaaaagagagcagatgaagtagatgaagaaaataggtttactgatcaggtagctaagtcagtggcaaggaagccttagcacatcaatatacttcaagcccctctaatctggaaaggctccataagaaaaattaaacctcagtactcccctgcagaaatagaatgcatcacttctcaaaggtatactttccagccttcagggcggctacactcagaggatggcaaactcaacctgccagcctccagccaatggaaagtccttaaatccaccaagcatttcacttaggaaaggataaaatttatcagtgtgtccagaaattattttcaagagagaatttattaagaacagtgaaactggttgttaacacttgtgaaggtgggttttttcttctcaaacccaaaggatgggaagctttccaggggaggactggcagacttcacccacatgccagagatgaagtgtagtcaatacctcctggcatgtgtagaaactttcactaactgcatagaaatctttccatgccatacagaaaaggcctctgaggcaataaaattgttaacgaaataagtcctcactttggtctacttaagtacctccaaagaggcaatggccccccatttaaggcaggtgtcatgggcggggatgtggggtggatctcaaacacactaggcatacagtgtcatctctgttgtgcttggagaccccagtcctaaggaaaggtagagaagacaaatgatactatcaaaagacacctcagaaaactgtcccaagaaactcattttccttgcactactcttcttcccatggtcttactgtgggcaagaaataccccttcaaagttaggtctgagcccttttaagatgctgtatggatgcccttttcttaccaattattttctgttagatcaggaaatatctgagttagttaagcatgtaacctctatggctcactttcaacaggaattaacacagttagccaaagcccaaccccaagaaataggaccacctttatttaaccctggagatttggtattggtgaaggctctcccttctctttctttctccctgagcccaagctgggaagggctctacactgttcttctttcaaccccctcagcggtaaaagttacaggtatcaactcctggatacatcacactggagtcgaagcctggaaagctgtgggagcaacccctgacagccctgaggaacatcctgaatatcaatgtgaataaataggagatctgaagctacaaaccataaaaggtaagtgagggctacccatcttactcagtcccacctttatctcatgaaatactttcagtcatttctacttttctgtttagatttgccaccagatattagaacttctttttaatgcatatttgcagaaagattttaattatccttgggattacatgtacaacttcatagacccccagacagaaattctatgtcttggcaagtaaaaattttcaatggaaattatctactacaccacctttgcaggactgtatactcactctatttgcagtaggactatatactgtagaatgcccagagtggaatgctggataaagagtctcaactactgtaatattttgctgaattattatccttatagcaggcataatagttacctgacaggaagtaaacataaaagttttactatcactaagtctgctaggatgttttattgggtttgtcaatatgtcacactctagttattcaaagaaggttataaagaaaggtgattttatataagaaaggatcttctatggtaaattattgtcctaaaaggaaataactggtagttcaaagagggatgtttagcacaaatcagaaagtttaagcatgtcataggtagtctgtggaggttgtgaaagtattaatagttgctggaaaatttagccaaagttaacactaaagttactctagccacccaaatccaatgccacttatcctaaaaagaatgttcctttttttttttttttttttttttgagacagagttttgctctgttgcccagcctggagttcaatggcatgatcttggctcactgcaacctccacctcccaggttcaagagattctcctgcctcagcctcccaattagctgggattacaggcacctgccatcatgcccagctaatttttgtattattgtagagacagggtttcaccatgttggccaggctgatcttgaacttctaacctcaggtgattggcctgcctaagcctcccaaagtgctgagattgcaggtgtgagccactgcacctggccaaagaatgttacttttatattaacgtttctgctaaggtacagccacatttggtggaggcaaactagtattacaatccattagaatagctaacagatatcaaactctactgccatgcttatcacctatagtacctccactaataatggtaatctcaatacttatattcaaaccctatattctaaatcttcttgtaaaatttatctcttttcatctagaagtaatcaaactccaaatggtgctgcagacagaaccatccatggacacgcctttcttctgaggacccttagattgaccccaggaggagccctaactgctgttccctacacaacactccttttcagcagtaagtaccagaaagactcatcatccaacaccccctaacagcagttagggataccactcctgagggggaaatgatacagcagctaaacataaattatttaggcagattgtgaggacaaaagagtcctcagtaaggtttccttttaacaaatagcagccccaaaattatttctaacaaaaagcagcctgaaaaatcaagctgcaagcatacataagcaagctggaagcttgcgctggcagctctgccaatagaaaagggatagctggaagccggctatagtcagcatggaggttccttttcccctttttcaccacatgtgcagtaaaaagcagacaacatggtaccagtccagtagagaccccatttgcataataaaagattacagtggggtggccagtctctttatctgctatgtaaatagcacacttgatccaatgaatcctctgtgccctacataaatcagacaacacttcctcaagctcatatataaaaccaacccagaaacctgtttgggacccccttctctgaatgaagaagctctcttctttctttcaactattgaacttctgctctttaacccactccttgcatgtctgcatccttgattttcttggcatgaggcaacgaacctcagttattaccctaaacaatgctgtgtcaactcctctcgtaatgctagtttgcacagctcatggctccaaaagagaccccttccttttgaggaaaggaagagagaagagcacggagaagtttgtcttacatcttggatatcagcttagccacagcaggacaggaactggtcagtcataagaccccaattccaggccctagcttccagatgacatttctagacacaccctgagccagaaggtaacccaatgccttgaaagaaagaatcaagttttggcagcattcatcacctggtaactgaggagctcttgggccatgaataatcagcagtaatacccaggtactctgttgaggacatttggtgattctctgagacttactggcttcaggtgagatccagcacattgccaactgtgttgactacgaggcaaaactcctgcttgagaaaagcagtagaaaaaataaaagagattttggctcgcaccttaggtactagcatggccacagggttgtagagcaccaagaaggctcatggggaccctattccatgacttcacttttgaattacatttctggatctgccctgggccagaggggagcccactgtcctgaagggtgagtcccagaccaggcaacatttaccacaagctgactgaagagcccatgggccttgagggaacactggtggtagtctgtcagtactccgcgtggcctggtgtggtggtggcaatgaggtgaaacttttcttcctttggaaaggggaagggagagtgagaagaactgcatcttgtgctttgagtgccacctcagctgcagtataatagaacaccaggcagacctctaaggttttttactttagtctctgacacccacatggcaactctggacccacatggggcctgggggagctggctgtcctgaagggaagaacactggcctggctggcttgccataagctgattatagagccctagggccttgagtgagcataagtagtagccagaaagtggtcacagcagaccttaggtgagacccagtgctctgtgggcttcagttctgacccaggacagtcacactaacagcagggagagtcatagtgttggtggccataggggtgcttgtgtcactccaccttcagcattaggtggctcagaacagagagagattgtttgattagcagaaagtaagaaaagctaacaaaagcctctgcctggtaatctaaagaattcccacagattttgtttaagaccatcaaggtggtacctctctgagtctacaagaaccatagtgttactgtgcttggggtgtcccctaaagcagatacagcttagatcacaacacccaagttctttctaatatctggaaggccttccaaagtaaaatggctacaaataagcccagacagtgaagactacaatagatacctaactcttcaatgcccagacacaaactaatatctacttgcatcagtatcatttaggaaaacattacctcatcaaacgaactaaatagggcaccagggaccaatttgccttagtatctgttttcttttggttactctttagtgccttcaggaaggtttattttggttggtttgtccagagtttatagttgttacctgtgtgtatgtgttgagaacaggggacagagaggtcagtcacttttagaagtggaaccttaaagagctttttttgtgtcatatcatgtgcaaacctgttagaattcatgttaaaattagacatgaatgataccaaaaacatttcagcactatggtataaaaccataccttactgttgacctttcttttgcctattttgttcatacttactatttatttacttaaatccctcctcagttttaattcttgttttctaatgagttactgagtacttaccagatggaaagcactatgatagattctccatctgttgaaatattgctcattcaaaatccaaatcaaatgcaaacaccctccaaggatcactcccttgcctcctcctaagcagacgtgatttacttttatctgaatgcctttggtactttgtttttaccttatgacattagatttattaatacacttgctttctccccaccacaatcagttctttgtccctattagatcatacacttcatcagtaagggcaagtctcactcatatttccatccatccatgctgccttaaacatgctttctaaagtcaggaactaaaaaataaaaagaaagaatatctttgcagctgctcagaaagaaaagaaaataggacattagtttcctgtctgtgttctcaatagtaggatcggacatcagttaacaatgcattctttatttttagcgaacatctagacagagaaaactgtcttttcccttctcctcgttatttttcctctttcttcttcctcctcttccttcttcctttttcttcctccttttttcatcttgtcctcttcctcctacttacccttccccctttatcttcctttgtccctcctctcttctcactttctttttctcactaattatagtctcatttaaactttttttgtatgcttagtctcatctttaaaatggggaaacatatatgtgtcattatgaaatgttttttgctttaaattgttaaagatcagtaagggagtcttttttcttcacctttgaaattgtagtgccaaaactcagacaaaccagtgatgttccaaaagttgatgggagaagaacccaaacatttgattcttccttcattgatttttctttcattggtaagatattttagtgaaatattatatgttgaattgtcaataacaaaagccatctacaagcattctttttcctcttttagccatagcaacaaacatgccataaaatggaagttatagaaataaggttaagtgaattaaactaggttttgtaataagctcacttcttccttagactcaggtcagaagacatttaaaagaagaggatctatcataaactggggctgttgctggggttctagcacttgcctggacaatgtgtctgcaccatcaacatcacctatgcctggacagctctttggagtttctctgccaaatatgtgtgagaatgacaatctgctcaaacctgtcctggtaaggctcacttgacctgttagctaatgggaaagggggtttgggaaaggagagctctgagaggtaaatatgtcaccaaatggaaaaattatagacgccactgtctttggctaaaaatctgatttaactactgtagaatcataaggaagacatatagggagagatcatatagtttcctgatttcaggaaagacccacataaacctactcagataaattagaattttctctttagacagagaattcacattctctcacacaaatcctttcttcaactccacattgttatgaaagtcctcttttatcagtgtagcagcagagactactcaatgttatgcttaagttttaaaaacttttattatttatatgtcaagtacttaagcataaaggtacgttccctggcattcatttatcttttgtctgtagaatgggtcagatgaaaaccactgagttatttccagttgacatattaaagaatcactactaagcagcatttattgagtattcattatccttcaggtgttatactagatgtgtggcatttaatgctatattgttcatctataagtgccagacactcatctagccaccttattatttatccttcacagcaaacgtaggaggtggttcttactatgtcaccatctctacttcatggtctgtgttttcaaaagcctcagtactttactcaaggatacatagtagctaagtggcctaactaggttttaaatcctacagattgcttgtctccaaaacccattctcttcctgcactgtaagcagaggacatactgatacaaagaaagcaaaattagagaacacttaaaatccactctcttagccatttttagaaatgcagtaccttgttattgagtatagtaatcatgttatttaatagagcacctgaccttacttctgctatctaactgaacttttgtatcctttgaccaatatctccccaacctcaccaccaccccagcccctggtaaccaccattgcgctccccaaaaaaattgacttgaatctttctagctgttcttttagtcccaatcttttagtacttttaccctagcacaaccccatagcctctggtagccaaagggggtaagtatgtgccaaaaaggataagtattcccttgtctgtatgtgtgaaatgccattttgcttatttcctttgtttccctattggatgtacttttctttcttaatcaaaaaggacccctcaccaaaggtgtcttcaggaaagcagccagtttaaaatcctgcagaaaatgagaaattaaattctggaggtgaagtaaacctagattgtgaatctatttttgagatagcctctgtattgaaggtaagaaaaattttcttttaatctacctgatggtatagctctggagcaagaaaaaggtgtttttattttttttatgaacattatttatatttgcaaagacccataatcaatttataactttaacactaaaagagtgttacaaacacttttataaagtcaacattggactttaaaaactaccaccagtgatatgacatatcaaatatgtttaaaaattttttttcccacactaacctcatctttacttctgcaaccccatgtaaaaaataaaactttgttaaaataataaaaagacacacacatttaccaaaacaaacatcatgcctattagtattttctgtcttggccaggcatggtggctcacacctgtaatcccagcgctttagggggctgaggaggggcagatcagttgaggtcaggagtttgagaacagcctggccaataatggtgaaaccccatctctgctaaatatacaaaaatttgcatggtatggtggctcacgccagtaatcccagctacttgggagtctgaggcctgggaatcgcttgattcttggagaggaaggtaacaatgagccgaggtcacaccactgtactccagcctgggtgacagagcaagactctgtctcaaaaaaaaaaaaaaaaaaaaaaaattctgtctcactaccttcataataaaggcagttttcaaaactaaacttttgttgcatgtttgaaaatagttacagaggtttgccataataaacatttgcctcacaactgaaacaaaaaaaattgctgagatcactgaaatttttgtttacataaccattacgcccaaaaatactcttttccttgttccctaatgccttttactctaaaagtggagtgggaacaatctcagcatctgagttccttttacctttaccacatttgatattctttgtggttcttaccctttagccatggctacaaaagtcacatatatagttacagagatagagttctaattttttttctgccccacattcttgcaaatgccctacctttttggaaaacctcaagtcaaaactagcttaaagcagagattttgaccctacagtatcttctgcagacctgcctcaggctcccaccttccaaagggctgaaatgcaccagagcccggagtagagacaaggccccagcccatatctcagggcctgcagcataaaaacaaaattaaggaaaatatggtgaagaagactcttgcatacccctacttcagcggagtggctagatgccgataaaatcttatgtcatgacttcatgtacaatcagacattttttgataaacgagccatgtcttttcttaaacccagccgtagacttttgcaattaaatattaggccagagaactgaagggcttgagctaaggtcatttaacctgtttgcagagggtttgtgattactcttcaatcctgcaaaacaataaagacctttttttttttttttttttgagacggagtctgtctctgtcgcccaggctggagtgccttggcgcgatctctgctcactgcaagctccgcctcccgcgttcacgccattctcctgcctcagcctccgcagcatctgggactacaggctcccgccaccacgcccggctattttttttttttttttgtatttttagtagagaccgggtttcaccgtgttagccagggtggtctcgatctcctgacctcgtgatccacccacctcggcctcccaaagtgctgggattacaggcgtgagccaccacgcccggccaataaagacatgtttgatttatttagccccagatatatatgccaaggatttttatgcataatgaatttttcttttttctttccatataattaggttttcttctacttcttagtttacaaaggtaaagcctgtgtttcatggaataattttttgaaaaccaaaaatgtctgcaaaaatttatcttactatgctatttttcatagcaccatacttcttaaaattttgtgctattgatgctgttgtaaagaagcatgattcttgaaggttaaatgtgttacaaattggagaaatatttgtccaaaaataatgaaaagacaaaaaatgatccacatgattgaagagtctgtttaaatgggttccaagtaaatgacattttatcatataagtaggttttactcacttttcttccaagtggttgcaggaagggacataatttttgccaaagtttttgagtttttgttttgtttcttgttttaaagtctattttgaagtggcacttaagttttcttgtaatttttcacttatgcactggttatgcttagatataagtttagtttaagcctcaccttgacttttcaaactataattggacaaaaatgcttgagatactatagcttggatccatcagattttgagaaaaagttcatatttactcctgcactatctcaactcatgagtttgggaattctgccgatgatctgggctctggttttggaggagaggagacttttagttacatgctgtgagttggtgattgcaattcagaaccagctttcacatccttctcagctgtgatggtggctgaatttcaaaacttgttatttcacctgtgggagagttcattgagatgttatgagttattttctttcaagtgtaggtttaagatttagtggtgtttttctttaagacagatcataagtatatttttcactgagatttaaaaggaaagctattgtcactatcccgttttgaaataacagattttgctgcttctaaactggacttctaatgtgcatacagcagctaaaattagtttggaattatgaaaatttaatagctgtatccccaaagaggtaacttttgtaattatatccctgaatcacaaatattcaggtacatttctactactggaagatataatagaacaaaggaagagtttgaatcaatcagtcttctttctttctaaaaaaggtatagcaataaattgataccactacaaagaggttcttcaaattgttttagaatctcagttccagttgattggttttttctcggctctcattaatatttggccatatgacatatgacagcacttcactaatgacctccactgtggctgggactgtgcttgacattgacatgtaaaaagaaggttaagagtctgctcctaccctggaggagctcataagcaagtgggaaagatgcctacacaatcagccaactgtaacaataagttatcacagcttccatattagtgttagaaacatgatatctaagtaaaacatggtgtgttgcctttcataagacatatagagaaagttattgatttggttttccagcaagagttaaaattgcccaattgaagacttttacctgtccccatgttgtaatcaggaaattgcaagaaggtaaacaaccatgggtacagtgcttaaatatgatattgagttcactctgcctaaagtttactgaggtggagaacagactgcaagcttgatcttggtaatgtcatgccaacagcaacagagagagttggcctaaaatcaactctctaggatcaggacaagaattgaatttagttatttttaagctttttgtaaacaaaagccaaacaacaaatgccattggtcatatccttttgtgtcatagtgtggtttcatcacactcagccctgccagtggtctcagcataatagaatctctaagaaaagaatatactgtggacatgttatttagtgtacatcaagtgtgagaatgctgcccccatgcttccaaatacagccatcacgtggaatgctttctctctccaaatgtaagagaacttttctatggggaatatagggaaaaagcttacatacctcatgatgcaatcatggaatactgctggatataaagttctaagataatagggactgtgttttatctactactctatccctagtgactcaaatagtggttggcacacaagaataaatgcacatagaatgattgactgaatgaccaccaaattattaacctcatagataccttagtgcatttccatgaactagccatctaaggaaagagaaaaaaaatgatttagtatagtttactgccagaccctgtcagatttgactagtttgctaaaatgtatgcaaacaggaggtttcagccaaattggttgttctttgcctttcccatcataatgcagacttcaattatttctataattttttttagaaaaaaacaaaaaatacttctgtttccacaagtcagtggagagttggcacagaggtctgtgtagttccctgaagagagtacttaagtgaacttttcaagaaaatactttctgatttatctaacacatacttggcatgagaataataatttaaaatacctgtttttccatcaatgtaaagattttctgcaaagtattccaggaagtgttttttgtcagatctctgtgatcactgggtctgggtaatggatgagggaaatgatgaaaagaaaataaattctgttcaaatgtaattagtctaatttggtcgtgtctcaaaaatactattaaaaagattttataagcttgtttattaaaataatgacaaatatcaaagtcatatccatggggaccagattacaatatatttatgctggcttatcattgttattgtttttctcctttagcttattaacatgaaatatttaagcattgtataccttctgtatatccgaatctgataggagttgatattcattagtctgctagctaatactgtaggcccaatctacagtttatgattgtaattttggtaaatatttaaccagacaactcatcatatatttcattcaccaggtgaagtcatagagattatgacttattctctcttctcagggaactcacactctggtaaagtagatagatgaccaagaattacaattacgatgcagtataatcagtgctgtaagagatatttggagagtgctgtggaagcatggtagagaggcagttagctacttaaaaagtgtcaaggaaaagggggattgctactctctctactcatgcaaaaaaacaaaaatgctggtagaactcaggaccccatgcctaaatatttcctgcattataaaagaataggaaagaaatatccattaacaaaaagcaatacttctagttctatgaaaactcaatatttttcacttgcatgttcttatttagtactgtgtgttttttttcttgagcaattttcaaatatgaattatctacatctttcaccaataggagaacatagtacagctgctgaggacaccagaaaccaagggcatttatcaaaacactatcttcacttacattatagtttggcgtaagtcattcagatagtgagcatcaaattctatactttatttctaattgtctaaaaccttatatatcctataagctgttaaaggattttttaaagtaaaattatgactctcatacaaatgtaaaataaacacatgaaagattttatttaagtcatttatgagggaaccagtaagatgttacaaccagttcaaaggagacttcaaagttgaaatattatatatatagttgaatcagaagtgctaaaatgtggggccaggcacggtggctcacgcctgtaatcccagcactttgggaggctgaggtgggcggatcacctgaggtcaggagttcaagactagcctggcctacatggtgaaaccctatctctacaaaaaatacaaaaattagctgggcatggcggtgcctgcctgtaatctcagctacttgggaagctgaggttagagaattgcttggacccgggaggctgcagtgagtcaacatcatgccactgcactccagcctgggtgatagagtgaaattccatctcaaaaaaaaaaaaaacaaaaaaaaacaaactccccaaacaaacaaacaaacaaacaaaaaatgctaaagtaaatttacaaattgatacaaacaaaactggccttttctaccagggcaggggtacatgcggctaaatcacttgtctctccaccagacatacttttcacatcattagaccagtgttagatgggctgctgtcagttatttataacttgtaaagttacaaaataactcttcttgtgaagaagcttggggccccgtagaagcagataacccagacgcttatgctagatgtcttattttccattgaatacacccagtaatttttttgttctatttaaaagtctttcataatttatccttacaaaaactatattcattgttagtccattgtattgcaaaagacctgcctgctatttgtggagcattattcagactaccttgtttgccctagcttgcaggtttttattgaaaaaaagaacagtcatcaatatcagcatgcacacacacacacatacacacacaagcatatatatatatatatatacacacacacacaagcacatatacatatatatgtttaaatagtagtaatcatttttggtgagtgaccatttcaaaatctcttatcaactacaaaatgagaactgtagaaaatataatactataagcaactcatatgtgaaaatggtacaatgagacagatttaggacaaaattgaccttaaggttttgattctttccaagacagcatttctgggttactgcttggaaataaaggtatactttaaatttcattgctgtctaatttgatcagaaagctttttgtgggttttagttgttaatattctgaaatgttaaagggttgacctaagtttaaatgcattgtactagtttcagggaaatatttcaggcatcatttttatgaggcattttctgcattattttacatttttgagttgtgaagacagtgtacaaaaacaaaaaaattcccagtgcttattttttctttctgtccagacagtcctcacttgtgtggtatcatgttaactgaaacttctgcatatatgaaccatgttgttgatttgcactcttccccatgcaaagtgaaaattgcatgcctttgcaagtttttaaatacaatgtcttgcttaaagagtgcatttttctttctttacgctatgagaccagcttctgagtgccaatgttgttagcctaaggtatctctttggtatattacacaatattgagcaacaatcctcaatcaatcacatgaatgcatataatttagtggtatgtgtcacttcaagcattatttggtctcctacctcctccatccaagaactaaaagatgaatttaaaagaaaggtaataaagtttttcacttttatgccttgggggactgagcccccattttgaaactgaaatccagagtatcaattctgaaagatgatttcttacataacttaagtacacatacttcttataaatttgattttactgataaactataggaaagtgatttgttaagtagaaaagtgatcacaatcaggttgcttctttcttccctttaaggagtctaaacactaagagtaaattaatcataaagtgataaaacagttgatatgagttttcagattcaaaaaacaagagaactttggagttaggccagcccagattcaattctcagtcccacttcttgccaggcgtacaatcttgggcatcattcgttacattgacctaaagtgttatctgaaaaaaaaatggggttggtgataatagagtagttacttgaaatcacagttttgcagtgcctgacagttaataaggggcttggagatatcagttgcctttgctctcaacgtttctcctgccccttggccccagtcctggagcacagaaactacagaaaggttccagtgcatctcagtggaggcacacaatgtccctagtaatctctgacctctcccccaggtgccactagttagggagtctagtgaaatgctacacaggggtagaccagtcagtccaatgcatgcatgggtagagactagacagggaaaatacaagtttttttcctagctgtctttctttttcacgatgcacccacagatgagccctcctcccaagtttatgacaacctgccctttatataaggaatacttttcataagcctttgtctaatgatgctttataaacattaataacacagtgtatttgtttaccccaaacatcctatggagaacacttatatccaaattttaaagacagagtcactggtataaaattgtagcattaagccaaggccagaagtaaaaactttagtccactaattaaatttgtatgcgcaaactacctttgagagtatcatagatttttttggggaaagtgtttcatgtacttttaaacagatataatttcttttgagtacatttgctttttttgctgttaaaattaggattcataaatgaaaagggatttataaacctaatgtgaaaagtaatacttcatttgttctttttttgtacagtattgctgattatacaatttccgattgaaaattgttgtataatatttggagaaaaaatcacttttctcttgggagaggtttcagtgagatgtgacactggggagaatgcctcaggtattgtgaataattggattggtttttgtgaataattaggttggttttcaagagaaacagacacatgtctgtgaagatgctggggcaagagtgttcctgaagcccagagcagctaaagtaaaagtagcctctgacctgggtcactggggcccagggcttctgatcctttcttagaaaatctgctaataggtcaatgtatatgaacaatatagtggcaataagaaatgtataagactgggttccagctttaaagttgttagtggcagcatgctatagtactaaggtttgatgctttttttgaacaaaacaaacattacgagtaaccctaatacatataataatagaaatgctgtggttgaaactcaagtagaaaacccagagctagaggggcaggtatgtttttttctttctctacttccttgtactggtccctgagacacatcagaattctagtgtgtatgaaacagtttgacaactactggcatcatttggttggtgggggtagacagaaatttcagatatacaaccttccagaaaatgacttcttgtatcagccattcctaaatgtgttatctttggccaggaacatcactgttttcaaccctaaaatatgagtaaaaataatgtcgaatttttatggttgttgtaaagattaaattaattaaataaaaaattattaaagaactttttagaagagatattgatagagtagtaaataattttttttaacaacagttaatattagtgtgtaaccacaagcaattgatgttggaaggcagaggcttacttagaatctgggtatacttggccttaattctttcatattttacactatttcttggttatacaacatgttcattgctttaagaaattcttacttatggaaagcccattgatcagaaactgagataaatctcttgtatcctaacagttttatttttattctgcactaacaattggggaaattataaaatattttctcttttttttttttttactatgctttaagttttagggtacatgtgcacaatgtgcaggttagttacatatgtatacatgtgccatgctggtgtgctgcaccaattaacttgttatttaacattaggtatatttcctaatgctatcactcccccctccccccaccccacaacatgccccagtgtgtgatgttcctcttcctgtgtccatgtgttctcattgttcaattcccacctatgagtgagcacatgcggtgcttggttttttgtccttgcgatagtttgctgagaatgatggtttccagcttcatccatgtccctacaaaggacatgtactcatccttttttatggctgcatagtattccttggtgcatatgtgccacattttcttaatccagtctatcattgttggacatttgggttggctccaagtctttgctattgtgaatagtgttgcaataaacatacgtgtgcatgtgtctttatagcagcattttttataatcctttgggtatatacccagtaatgggatggctgggtcaaagggtatttctagttctagatccttgaggaatcaccacactgtctcccaaaatggttgaactagtttacagtaccaccaacagtgtaaaagtgttcctatttctccacatcctctccagcacctgttgtttccggactttttgatgatcaccattctaactggtgtgagatggtatctcattgtggttttgatttgcatttctctgatggccagtgatgatgagcattttttcatgtgtcttttggctgcataaatgtcttcatttggaagtgtctgttcatatccttcgcccactttttgatggggttctttgtttttttcttataaatttgtttgagttcattgtagattctggatattagccctttgtcagatgagtagattgcaaaacttttctcccattttgtaggttgcctgttcactctgatggtagtttcttttgctgtgcagaagctctttagtttaattagatcccatttgtcaattttggcttttgttgccattgcttttgttgttttagtcatgaagtccttgcccatgcctctatcctgaatggtattgcctaggttttcttctaggatttttatggttttaggtctaacatttaagtcttcaatccatcttgaattaattttcgtataaggtgtaaggaagggatccagtttcagccttctacatatggctatccagttttcccagcaccatttattaaatagggaatcctttccccatttcttgtttttgtcaggtttgtcaaatatcagatggttgtagatacgtggtattatttctgagagctctgttctgttccattggtctatatctctgttttggtaccagtaccatgctgttttggtaccagtaccatgctgttttggttactatagccttgtagtatagtttgaagtcaggaagcatgatgcctccagctttgttcttttggcttaggattgtcttggcaatgcgggcccttttttgtttccatatgagctttaaagtagttttttccaattctgtgaagaaagtcattggtagcttgatgggggtggcatttaatctatgaattgccttgggcagtatggccattttcatgatattgattcttcctaaccatgagcgaggaatattcttccatttgtttgtgtcctcttttattttgttgagcagtggtttgtagttcttcttgaagaggtccttcacatcccttgtaagttgtattcctaggtattttattctctttgaagcaatagtgaatgggagttcactcatgatttggctctgtttgtctgttattggtgtataagaatgcttgtgatttttgcacattgattttgtatcctgagcctttcctgaagttgcttatcagcttaaggagattttgggttgagacgatggggttttctaaatatgcaatcatgtcatctgcaaatagggacaatttgacttcctcttttcctaattgaataccttttatttctttctcctgcctgatttccctggccagaacttccaacactatgttgaataggagtggtgagagagggcatccctgtcttgtgccagttttcaagggaatgcttccagtttttgcccattcagtatgatattggctgtgggtttgtcataaatagctcttagtattttgagacacgtcccatgaatacctaatttattgagagtttttagtatgaatggctgtagaatattgtcaaaggccttttctgcatctattgatataatcatgtgatttttttctttgtttctgtttatatgctggattacgtttattgatttgcatatgttgaaccagccttgtatcctaaggatgaagcccacttgatcatggtggataagctttttaatgtgctgctggattcggtttgccagtattgtattgaggatattctcatcaatgttcatcagggatattggtctaaaattctctttttttgttgtgtctctgtcaggctttggtatcaggatgatgctggcctcataaaatgagttagggaggattccctctttttctattgattggagtagtttcagaaggaatggtaccagctccttcttgtacctctggtagaatttggctttgaatctgtctggttctggactttttttggttggtaagctattaattatagcctcactttcagagcctgttagtggtctattcagggattcaacttcttcctcgtttaatcttgggagggtgtatgtgtccaggaatttatccttttcttctagattttctagttcatttgtgtagaggtgtttatagtattctctgatggtagtttgtatttctgtgggattggtggtgatatcctctttatcatttttttattacatctatttgattcttctctcttttcttattagtcttgctagtggtttatcaattttgttgatcttttcaaaaaaccagctccgggattccctgattttttgaagggttttttgtgtctctatctccttcttttctgctgtgatctagttatttcttgccttctgccagctttttctcctgtttctcctgcttctctagttctctatgtttgctcctgcttctctagttcttttaatggtgatgttagggtgtcaattttagatctttcctgctttctcttgtgggcatgtagtgctataaatttccctctatacactgctttaaatgcatcccagagattctggtatgttgtgtctttgttctcgttggtttcaaagaacatctttatttctgccttcatttcgttatgtacccagtagtcattcaggagcaggttgttgagtttccatgtagttgagcggttttgagtgagtttcttaatcctgagttctagtttgactgcactgtggtctgagagacagtttgttttaatttctgttcttttacatttgctgaggagtgctttacttccaactatgtggttagttttggaataagagtgatgtggtgctcagaagaatgtgtattctgttgatttggggtggagagctctgcagatgtctattaggtccacttggtgcagagctgagttcaattactggatatccttgttaactttctgtctcgttgatctgtctaatgttgacagtgggttgttaaagtctcccattattattgtatgggagtctgtctcttgcaggtctctaaggacttgttttatgaatctgggtgcttctgtattgggtacatatatgtctaggatagttagttcctcttgttgaattgatccctttaccattatgtaatggccttctttgtcccttttgatctttgttggcttatagtctgttttatcagagactagcattgcaacccctgcctttttttgttttccatttgcttggtagatcttcctccatccttttattttgagcctatgtgtgtctctgcatgtgagatgggtttcctgaatacagcacactgatgggtcttgactctttatccaattttccagtctgtgtcttttaattggagcatttagcccatttacatttttaatattgttttgtgtgaatttgatcctgtcattatgatgttagctggttattttgctcattaattcatgcagtttcttcctagcatcgatggtctttacattttggcatgattttgcagcggctggtacccgttgttcctttccatgtttagcgcttccttcaggagctcttttagggcaggcctggtggtgacaaaatctctcagcatttgcttgtctgttaagaattttatttctccttcacttatgaagcttagtttggctggatatgaaattctggattgaaaattcttttctttaagaatgttgaatattggcccccactctcttctgggttgtagaatttctgctgagagatccactgttagtctgatggtcttccctttgtgggtaacccgacctttctctctggctgcccttaacattttttccttcatttcaactttggtgaatctgacaattatgtgtcttggagttgctcttctcaaggagtatctttgtggcattctctgtatttcctgaatttgaatattggccttccttgctagattggggaagttctcctggataacatcctgcagagtgttttccaacttggttccattcttcccgtcactttcaggtacaccaatcagatgtagatttggtcttttcacatagtcccatatttcttggaggctttgttcatttctttttattcttttttctctaaacttctcttcttgcttcatttcattcatttgatcttccatcactgataccctttcttccagttgattgaatcaactactgaggcttgtgctttcatcacgtagttctcttgccttggttttcacctccatcaggtccttcaaggagttctctgcattggttactctagttagccatttgtctatttttttcaaggtttttaacttctttgccatgggttcaaacttcctcctttagctcagattagtttgatcatctgaagccttcttctctcaactcatcaaagtcattctccatccagctttgttccattgctggcgaggagctgcattcctttggaggaggagaggcactctgatttttaatttccaatttttctgctctgttttttccccatctttgtggttttatctacctttggtctttgatgatggtgacatacagatggggttttggtgtggatgtcctttctgtttgttagttttccttctaacagtcaggaccctcagctgcaggtctcttggagtttgctggaggtccactccagaccctgtttgcacggaggctgcagaacagtggatattggtgaacagcaaatgttgctgcctgatctttcctctggaagttttgtctcagaggagtacctggccgtgtgaggtgtcagtctgctcctactggggggttcttcccagttaggctactcgggggtcagggacccacttgaggaggcagtctgtccattctcagatctgcagctgcatgttgggagaaccactactctcttcaaagctgtcagagagggacatttatatctgcagaggtttctgctgccttttgtttggcaatgccctgtccccagaggtggaatctacagaggcaggcaggcctcctggagctgctgtgggctccacccagttcgagcttcccagccactttgttaacctactcaagcctcggcaatggcgggcacccctcccccagcctcactgccaccttgcagtttgatctcagactgctgtgcttgcagtgagccaggctctgtgggcataggaccctccgagccaggcatgggatataatctcctggtgtgtcgcttgccaggactgttggaaaagcgcagtattcgggtgggagtgaccggattttccaggtgctgtccatcaccacttcccttggctaggaaagggaattccctgaccccttgtgcttcctggatgaggtgatgcctcaccctgcttcgcctcatgctcagtgggctgcacccactgtcctgctgtctgacaagcccgagtgagatgtacccggtacctcagttggaaatgcagaaatcactcatcttctgcgtcgctcatgctgggatctgtagattggagctgttccgattcggccatcttggaacacagagccccaggaaatttttttattttctggattcaggtgaataatgacaagaccccacaatttgaaaagacgtttactgttgttccttgcaccaacttttttcacccatgaattattcttgacctcagtgctgaaagagtaagtatgcaataagactaaaagggcataatgcattcaataagaatgctttttaatgaatgccaggtgcccagcactatgatggacatcatggcacacaccaaaaaagtgcaaaagaaaatcttatttattctgaaattaaaagtatataggaatggaggacatacatgtgtgaaataatttgataaggcatgtctgtgattctcaaccatgttatttactctacataaaaatacatatttctgcacctcccattttacctctccactttatccttatttaactttaaactagattttcaactttaggcttgaaacatcatttttttctggaagaccttatctagttcctcagggtagatgttacaacagtatgttaaaatacctctctgaatttttatattttttatttttgcaattttttcaatgtccatcttctggtataagtgtattctacacagcgacagggactgtattgaccattggaatacaccagtgaatagcacttgtcattagtgagtacatgaaggtttaagagatcatttatgccattccccttatttaagggagtcaacaaaagttaaatgatgtgttgcacagacaggtgtaacagacccaccactacaatcacagctacagaccttctccagctgtcctttccactccaacatgatgcttcccctgcattatacaagaggatataagacagaatgagcaaaggaggatgttttccaggggagaaaagagtgaataggcaggacttatttgggaattatgggagatctttgctcttttttaaagcactcaacatttacaccaacagatgagcaaagtacattaagtatagtatgaaatgtaccagtcatttcccactaacatcttcaatcagagtgtccacaatcttcctttaatacttaagtcagactccatttttcatgggaacacaatcttgtttcccatttataaacaatttttttctctagaccttgtgttaaaatgatccaaaaatttctccattacatatttttaagctcatttaatacttacattttattctacttaagaataaagaaacatatatttggtcagatttttctggaaaaaatcaagttcttttttagaaaacagacttaatatatgtgaaaatttggatcatttaaaagttggaaataactagaaattaataaagagaaaaatatgtgttaaaatgttgcaacttcaaagcaaacagaaattttagtttttcttctcggcagatctgaatattgcaaaaatatttcaagtttgtagaaataattaaaacattcaaaaagaagtaacacaaatattaatatcagttaatgaagagaatttcaaagaacttcaaggaaaaatttcaagagcatacaatttatgtaaatcattgtcttctaaatacagaaacagtatgtgaatatcctaaaacattgtgaaaagaagttatctaaaaagcaatttggaggaaagagactattccaatgaacattttgcaaactgggaagatgcaaccttctgtgtaaaataaaggtgtgttccagaggacaaatgaagggtttggcttttatagagaaagttcccactcagattccaaattaggtccttttaagcaaataaagggtccagatttacttaattctggttgttcagcacagttgggttctgattggaggatgcacgccacagcctatctgttggtttaggtgatgtaaacaggaatagtcaggtataaaattctcaaagttaggcaagtgtgtggattttctggtaactcagagtaatgtgtgacctctatttagcaaatggccattggcttctttttaaagttatgcccagttagccacccaggctttctcatgaaggatgggttctttccagttctctgctttcagggactctccatatcttgcataacttttctttttgcttgttttctttcttctcttctcaaaaacctttcattaatggcaatgcttcatcccttaggaagaatgtcatatcaccgagcacagaaatttcaggcaggaagaggtttagaattttaaataatcaacaaggaaatttacataacaggagaaggaagaaatttaagagtctagtactaaaaagcttctccttctaaacccataaaacgttcacacctatttgctattttgacccagaagggctaaaagaaactaaataaaactactctacttatggagttaatctaacaaagtaatacgtatctattctgaattttgaagataaccttttaggtgatttgattttctgttggataaataaaacaagcatgctccaatgtcacacaacacacaaaagtgaataaaagggaaagttaacataggctggagatgagtactggtgagcgctcttgacaagagaagctcttgatgaattttaatgtatggatggcacattttattattttatgatgtcacttagacaaaaaattaaagcagaatggagagctgaatttgtgcttgttatgatggaaatcagagagatatgttggggtgtaactgtatatcatgagaagattgcaattatagatgatgcaatgaaagatgaagccgaagcatggttgctacatctaacctgaagtgcatgatgacaatgctaattttgtggcctcaaacataataaaaaccagtgcatccctcacctgcatgtttactcagaaagcatttagtgaaggcttaccatactcaaagcactataaaaatcttcctaggagaaacagatatggcaccaagggacagtgactgatttcaggttcatgatatattagctgcaccctggttagcattattcactctccacaaccaggaaatgtagtttgacagtggcctttctgttcagtttatttatactttctcatgttcaatttttattttaatcagtacaattttttaaagaagcctaaccaaaactaagaaagaagggtatggctttttagaaagcaaagacaaatagcaggttaggaattaaaatgtccacgtagaatttactgatatataaatcattgtattagccaagattcttttcattgcaaatgacaaacctttgaatacatttactttagaccaaatggaaagtttacttgtctgtagagcccacaggaatggttaaataatatgagcagggaaaccatgataaaaagaaattttgtggccaggcgtggtggctcatgcctgtaatcccagcactttgggaggccaagatgggcagatcacaaagtcaggagatcgagatcatcctggcaatcatggtgaaaccccatctctaccaaaaatacaaactacaaaaaaaattagccacgcgtggtggtgggtgcctgtagtcccaggtacttgggaggctgaggaaggagaatggcatgaacccaagaggcagagcttgcagtgagctgagatcgtgccattgcattctagcctgggcgattgagcgagactccaactccaaaaaaaaaaaaaaagaaagaaagaaattttgtaaggatttgaactgtggactcaaatgccaacaatgctgtctgtatctctctttgattggtttctgtcagaataccagctcaatttttatcacactcagtatatttatattgtggaaaatataaacatttattgttcacaattttatagtctatgacttgaacaaccaaatagatttcttcattggcctcatggatactacacttgctaaaataatcccctctagtaaatgtcatgggccacttagtgtatcgcaaaaattctccaataataaaatacataaataaaagtaatattttggttgtcatcttagtccatttgcactgccataccaaaataccacggactaggtgacttataaacaagtttaaaaactcacaataagtgaccagatttttttctcttagaccaatgacttgcaaccaagtaagaatgcagtgtctttcactggagcctcttggttggagctgagggagaagcactttcttaaagaaggggttggaggtgtgaaaaataaaaacaacctactagattatgtgtttgcagaacaatattcatcatgttattcagttcctctcataaaaagattcaaatgataaatgctcataatttaaaactgaaaaaggacttttttccccaaagctatttttattgggcaataaaatgacagagcccattatttttcctatttttgctgttgctaccagaagcttcagaattaaatcataatataacatcaataaccaacttgcatcaggtttatggaaaccatttccactattttctataaggtttttaaatttttctaatttttaaattatttctgtgcctttaaaatgcttttggattactttcagaaacagatgaagaaaaataagtaagtaattgacaaagaactcacaacattggcctcatgggtactacacttgctaaaataatcccctctagtaaatgtcatgggccacttagtgtacggcaaaaattctccaataataaaataaaatgcataaataaaaagaatattttggttgtcatcttagtccatttggacttccataccaaaataccatggactaggtgacttataaacaacataaatttacttctcacagttcatgatttaaaatacaaatgtcattaggtcataaacacagtagaataccttcaaccactcaagcttaattggtatgttccatctcacagacaacatgcttaaatacattatttaatattaattattacagactggtttaaaatataaaatcttcaagaaatactttaatttcccttggtgatggaaagtctatccctctgaaatataacaccttccaatttcctgtctctctacacaatgcagctgtggggatttttgagaaagtgacaagaaatgtcttcttgtccttgttgacagggttttatggtgattgaataatattttcagtttaaatatgtaaaacacatattacttcagtaaaatgcttagtacttgaaacctaccagaaaaaatgaaggtaatataaatcagtgcatagcagtttgagttgaattgtgatttaaattctcctgctctctcatagaggaaaaactgtgtagacagtagttttacatggacctcatcccagtttcaccatgtctgataacaaaactaatgcaaagatgcttctagtcataggcctgtgtcctctaaaaataagaaaaattaattgtgactgttcatctttccaagacaccccattcctatgcttctgatatgggtaaatatttgtaagagtattagcaacaaaacatgaataagccccacctccactctcaaaggtctaaagctggaaaggagtagtgaaattgaaaagagactaaaatctattaaacatttactataaacaaaacactgtgttaagtgtttggattatatataattcctgagtttatagagactgattcttgtaaagaacatcattatttaaatttaaaaataagtataataaatgtataaataagaaataaatattattataagtttttctatctggggtcagtgaactaaagctcatagacaatctcatctacaaaccattttcatgtagaccacaaactaagaacggtttattaaatttttaagaattgcattaaatggttatatgggtacctgcataatatatttgattttgcctaatggctcacaaagcctaaaatacgttctatctggccctttacaaaaatagtttatagatcctattctatagagatttgacctagtcagaatagtaaatagtatagatgaatgacaaattaagaatataaataaaacattttattaatatatttttatcagtaatttcatagaaaaatatacactcagaattaatgtgaaaatagattacttagttatttggcatatgcaactaagtggaaggccatatagtatgctggattcttgtcgtgtgtgacgtggggtcttggatattaggctttttgacatatatctattgcagaagcaatttttatggaaataaagtatattagtctgtgctcacactgttataaagaaatacctgagactgggtaattgatcaagaaaataggtttaattagttcacagttctgcaggctatacaggaagcatggcagcatcttcagggcggtgggactctgggcctggcccacaaaaccattctttcctcctaggcctctgggcctatgatggaaggggctgccaaaaggtctctgaaatgcctttgaaacttttcccccattgtcttggctactataattgggttcctctttacttatgccaatttctgcagcctgcttgaattccttcttgaaaaatcggcttttatttgctaccatatggctaggttgcaaatttttcaaacttttatgttctgcttctcttttaaatataagttccagtttcagatcatttctttacttctgcatatgatcataggctgttaaaggcagctaaggcaaatcttgattgctctgtaaattagaaatatcttctgccaggtatcctaaattattaatctcaagttgtaagtttcacagatctctagagcagggtacattacttccaagattttgctaaagaataacaaaagtgttttctccagtttccagtaagttcttcatctccatctgagaccccctcagcctggacttcattgttcatatcactatcagtatttttgtcataacaattgaacaagtcctaggaattcccaagctttctctcatcttcctgcctttttctgagcccttcacacactatcaacctctgcccaataaccagttccaaagtcactttcacatttttacatatctttataattatgacccactcctgatactaatgttctgtattaatctgtataaaaaatacctgaaatggggtaatttaaataaaagaggtttaattggtgcatggttccacaggttatacaggaagcatggcagcatctgtttctagggaggcttcagggagtttttacttatggcagaaggcaaagctaaagcaggcatttacacatggctggagcaggagaaagagagagtggggaggggccgcatacttaaaaaaaaaaagatcttgtgagaactgactcactatagagtaccaagggggaatggtgctaaaccattcaggaaaactgctcccatgatccaatcatctaccactaggccccacctccagcattgggattccaactcaacatgagatttgggcaggaagacatatccaaaccatatcatagagtttttcatagaaggcatccctgtagcatgggatgaagttcaatttaaaaaaaaggttgaaattattgtagaaagcaaggtaacttacttactgtcttactagagaatcagcaaagctcacaatgtccttggaggttggaataggagactgagtttttggataggcctgctgaaacatgacagcaggagtggtggaggaagaacagaggtctctagggttgcaatgaaagagatgttttgctttctctatatatcttctgatataaaataaaaattttgtcagtgtaaaaagaatcatattattaagactatcaatcactaaaataacaaagaacaaaatcaactattgtgatatcactgatgatatttgggaaagttcgtgtttctctttcacttttgaagaataacttcatgagtatggaattgtaggttgatgtttgcttttacctctcagtaaattcatttactttgaatattttccttctctctagtcttactcacatgatttctgagcagaagtcaaatgcagttattatatttacatcactatagttaagatgtgttttattcctctgtgtcctttcagaattgtcctaaatctctgatttttccttaatttgaaaatgatatgctgaggtgaacttttttagcattaatcctggttggtgttctttgagcttcttagatctgtagtttggtgtctgacattaatttaggaaaattctgtcatcattatttcaaattttttttctgcttttttttctctcatctctgtctggaattcccattatgcatatttacactttctgtagttgtcccactgattttggataatatattctgttttttttcaacctttgttccctttgcttttcagttttggaggtttctattgacaaatcttcaactcagagagtctttccccaactgtgtccagtctagtaataagcccatcagggacattcacagtgtttgtatctctagcatttctctttggttctttcttgggatttcaatctctctgcttatatttcccatctgttcttgcatactatctgctttatccatcatatcccttaatatattaaacatagttcttttagatttcctatctgataactctaaaatccaggccatctagttctggtgttagctctttctctttaaagtgttttgtgtctgggagtatgccttataatttttcctgagagctggacatgaagtagtgtattaagtaaaccacagtaaatagttctttagtattgtgacagtaaggttttaggagatgaaacattttctgtagttctacagttagatctcagtcttatagtgagcctgtgcttctggactgtaagccttacaactctttttccatttttttttctcccatcttaggtgaggcaagatggttagagtgggctgaagtttggtatttccattctccctcatgacaaggtagagcaggctggagttgagtattttattcccccagtttagttagcctttgctcaaactgcagtaggttagtatctggttaactaatttatcctgacaagagattaaaacaacaacaacaacaacaacagagtgttctagtatatttcaaagtggtctcttttttttcttcccctgctggaagcatgaggaaatttttctcctatatttactgtggctaagctcctggaggtaaaacttagaaaagggcggtgtctgttctgactaggtcaccctggatgtattaacagagacatgttcacacctagtctccagcgagttatcaatcatagttcagggtttcctaccttgacactggttcccattaaggcctctgttttaatatgtggtgattctctgtatttgcctgcttgtgtcttctattctgggcacagtggtttgctctgtggatctaagaagagttgttatttacttatttttttgtttgttcagtattttactttgtttttacaacagagtggtggcttccaagctttttcaatgtagaattggacagcagaagtcccatattattttcaagtgcccatgtaatagatacccaattgagccatattcttatcatagcacaaactttaatacatttaaggaattgaaatcttgcagaataatgtatatcgtaacaacagtggaatctaactagaaatgaataatagaagattacagaaaaatctgaagcacttggaagcagaacagcacatcctaaataatccatgggtttaaaaggaagcttccaaggaaatctaaaatcacactgaactgaatgaaaatgaaaatacaaattataaattgtgagatagagctaaaacagtgttgagagagaaatttatagcattgagtacatctttaatgaaagagaaaatgtattcaatcaattatccaagctcccatctcaagatcctagggaaaaataaaccacatgacacagaacaaaaataaaaaagttaagagagaaaattaagaaaacataaatactaaaacaataaagaaacatgatgaaaaaatctgatacaaatatcactaaaacttccaaacctctagaaaaacataataaaaaagagagaagacacaatatcagaaattaaagagaggatatcactactggctctataggcatcaaaagaataatactaaggatagtaatgaacacataaatacaaaaacttagtcaaaatagatacctacattacacctatatgatgtagattatttcaacagggctatgattattaagaaaattgaatttataattttcaatttttaaagaagtatccaggccaaattggatttgctggaaaattctatcaaacatttaaagaattaacaatgttacacaatttctactagaaaatagaagactaaacactccacaattttaggaatttaatattactctgataccaacatcagacaaagacagtacaaagatagaaaacacatatcaatatgccttataagaatggactcaacagtctctcacaaaatattagtaaatggaattagtaatatataaaaagacattcaccatgaacaagcagggatttttccatgaatgtaagcttagttccatatttgaaaatcaatcaatataatccatagtataaaccaaaaaagagaaattacattaccgtaagaaataacgtagaaaaaattgacaaatttaacacaaatttgtgataactctcagaaaatagaaattgaggggagctaccttaacacgatgaacagtatctacagaaagcctggagcttatgttatgcttgatgatataacactgtttttcccctaagatatggaatgtagcaaggatgtctactgtgaaattcttattcataatagtgttggacaatcaatacaaaagataaggaaataaaagtcctacagatgggaaaaaaagaaacaaaactgttctcaatttcagatggcatgcgtttctaggaagaaaatctcaaggaatatacaaatataaattatagaactaatatcttatctcctgcaaccttcagtaaagtcaccagatataagataaacatttagacatcatatttaaatatattagcaataaatacatgacatcagtatttaaaatgtgatattacttacaatcactaaacaaaatttgaaataactctaaatctaacaaaccatgtacagggcttgtatgcagataaatacaaaatactgatgaagcaagcaaggaagaactacataaatggaaagatatgtgtgtttagagattgaaggaatcaacatattgaagatgtaaattctccctcaagttaacatactgatttagcacagttctcatcaaaatcccagcaatactttttgacatataggtaatattattgtaaaatatatctgtataagacaaaatattagaacagctgaaacaattttggtgtgtaaaaataaagtgggaggaatcagtctatctggttttaagactgattagatagttgtagtatccaaggctgcatgaaatttttgaagagagagacacacagatcaagagaaaggatagaaaaccagaaatagacttatgcaaattctgctcaagtgatttttttttttttgcaaaagtgaaaaggaattcaaaggaaaaaagataacattttaaacaaatagtgtaggggtgactggacatccatgatgaaataaataaaagaattaatttttagaaattttgcctcacattttatacagaattaaaacaaaatgtatcatagacttaaatgtaaaatgtaacactataacattttagataaaaattcatcttcatgatatgagatcaggtgatgagttttttaatttgacaacaaaaacaggattcataaaggaaaactgattataatttgaccttatcaaaattaaacaaatttaatgtgaaaaatcctggcaagaggatgaaaatacaagccagagatgcgtagaaatacttaaaaaacacatatctaacaaatgggctagtttatagcatgtgtaaataactctcaaactccctagcataaaaagaaacaattcctgcagagtgcagtggttcacgcctgtaatcccaacactctgagagtctgaagcaggccgatcacttgaggtgaggagtttaagagcagcctagccaacatggcaaaaacccttctctactaaaaatacaaaaattagccaggcatggtggcacatgcctgtaatcccagctattcaggatgctgagggaggagaatcatttgaacccgggaggcgggggtcgcagtgagtcgagatcgtgtcacaacactccagcctgggcaacagaataagtagctggtggaattaaattgtcaatcttctcctagtaagaaagtgattgaaggtggtaacagaagaaataatcttgggagataaactgaaaatattaactgctttatgttcttagtcaaaaattcagaatttacgcagcatgctaatccctatagattttctgtttgaacaaaagtgacaatgatctaatctttaacaatactcaaaaatgttacaaaactccttttattcaaaaatctactttgcaattgtttctaaatgatttccaaaaatcctgtcagtcgttaacaagagtaaatcttaaatacacataactttatactatctccttgcattatgttctttcgatttgacattctgagtgtcagaatgatttaacttaacataaattacatcaggaatatttttatattgtacttggttgtttacatattaatgacattgacacaaaaaaatacttgttttaattcaatctttgtgaaaagacattactccaaaaggatattgaccttccacttgctatctagggtgacgtctgcagtaaagatttggggaatggccatttccttaaatgctggctggccttaatgcaccctcagatattctatgtcccataataatagccaaggtatgggaatgggatttctaatatgtagggtaagaaaggatgacaggtctgctttactagtaggagaatctcattttgggtagtggaggatataaaaggaaaattaatccagacattagaaacttggaagatttcattattgtaatgaagccaacataggaaatgtgctacattaatcctgctgaggttaaatatttctgagaaaatgtgtgtatttcaggaaaaaatcttcactgaaaatactttagagtcatttcttaattgtgcctcttctcatccattagatgggagtgaatatttaattcatttaatggattaaagtaccaataccagtaaaataccaataatctatattagggattttaaaaagtggatagtaaagttcatatgtaaaaacagataagaagagctcagaaaacactgtaagagaaatctgtgaagggggatttgccctaaaaggtaaaaacaaaccaatacaaaatctgtataataaagccagtgtggtatcagagcagaaataaacagaccagtggaatagaataggaagtctgtaaataggcttatgtgcatatgtcactttttttataagggataagtggcatttcaaatcactaacataaagatgagcatttaataaagggtgctggagcaactgggtagccatttagaaaatgataaggttagatgtacatctaacatcatagacaacaataagctccaaatggatgaggaataaaatgtaaattaaaatcataaaagtgtgaggaaaaaaagatgggtggatttgtctctgaacttggtatagggaaaatgttcctaaggataactcaaaatcagaagcaatcaaataaaagattaatgtattttactacataaaactatttaaaatgcatgccccaaagaccgcaagaacagtcaaaagataactgaaaaacagaaagtatatgtaacatacaccatggttgaagggctaacatcaccattatataaggaattcctaaatgttaagggacagagtagtaaaacttagaaaaatggaaaaccaaatattatcagacaaatgataaataaatattttaaaataaccttcaaaaaggtaaaaagtaaaaactaaatcatagtaaggaaaatgttatttaaaacaaactaagatactattttctatttattatataggtgaaaatttaaagtgtcctgttggtgagtctggagaaacaggtactctcacatattgctggtagaaatgatcatcagtctaaaagtgtaaaagggacatttgaatacacacacatacatgtatttctctcttctctctttctctcaatgatagatagatagagagatagatagatagacagatagatgaatgatagatctatattcttgctttctgaccaggaatcccacttctaggaatctaccttaaagacataccccagtaatacggaaatacataagcctaagatcatttgtgttttattcacaatcacaaaatattaaagacaacctaaatgaccatacttaggagagtggttgaataaattatggcacatctacacaaaagagtttttggcatgagggcaagctctacgcactgagccgggtccatgtataggatatgttattaagtgaaaaaagtaaaatgcaaaagaatgtttgcagtatgctacctctcatgtaaaaaaaaggagtttatatatttatatggttccatttatgtgaagtgttcaaattagtcacactgacagaataagtagatttgtagttacctagagctggagtggaggggatggggagtggatgttaaatggctacaaggccattttgggggaagatgaacatgttctaattagatcatagggatgcttagacaactctgctaatacaccaaaatccactgaattgtatagactttgcagaagtaaagttcatgacatgtagattatatagtactaataaatgttctaaaatttagaaaaaacagaggatttaagaaaacatatatgtatcagattttttgtgccaaaaaatatagggaggaaaaatcacactttaaagagattgattacctattgaggggatggaaatataggagaagagtgaaaacaaagggagaaataaatatagaatattaggaatgaaaagaaactatcacacttctgaatatacatgggatatgggatatagtttggatctttgtcttcatccaaatttcatgttgaattttcacccctaatgctggaggtaggacctggtgggaggtgtttggatcatggaggtggagccctcatggcgtgatgctgtcttcatgatagtgactgagttctcatgggatctagtggttcaaaagtgtgtggcactgccttccctaccacactctctctctctcttgctcttgctcctgctctttccatgtgacatgcctgttcccgctttgccttctgccatgattgtaagccccctgaggcctcccagaagcagaagccgctatgcatccagtggggcttgtagaaccatgagtcaatcaaacctcttttcttataatttactcagtctcaggcatttctttatagcaatacggtaatagactagtacaatatgtttgtatatttttgacttgtagaactatagtagttgttcacatacttgaaaaataaaagaataaataaaatcaaccacaatatgtgggaagtacaaaatcaaatacaaatattaaaaatgaaactagctgtattacaaacgaaaaacataagcacacaaaaatttgggaaaaagtgaactaacctaaataatttcaggaagcaatagtttttgactggatattctaatgctaaagatgaaaataattataaataaatattgagctctagttagtaaagttgtttctcagagggttatgtgtaggtgattctgaaaccatgtgtagactaggattaatcaaagaataaatgtattggaagtaattagagctaagtgtctcaatattgaagaaagaattaaaagaaagggaaggttagaaaaaacactattttggtggaatggcattatagttgtcagtatgaactcttggtttataatatacacatacataggtagatatagaaataaatatagctgtataacaatgtgtggattagtatttatatctctgtttctatctactgaatctatttctctatctctatatctatctttctatctatctacatataatctatctatttcctaggtctatatgctaaaagggcctaggaaaatgatgtcctggtagcaatgaggacaccaaacagagagctctttgtttctaagtatcattctccacttcaaaatgaagaaacaacaacaataaaccagagatttgtggagaagtggttgatctagacctagcactaggaaagtatgagatgagcctggaaattaattgttcataaagaataaggaaatgtcaaaacctgacagagatcccattggccaaaccaggcacaatctgagcaacaaaataagtactgacagtgttggattataactcataaaatagaggtccatgaattggtcataacttaactaaataatggaataaatgaataattcatcctacaaaagaattctaactaatacatatagaaggcacaagggagatacagaaatcatcattaagtaatcattaatgcaggcaagatccactgctgaatgctaatgtgagtaaacagaagtatgaggaaaagcaaaatatttgaatagtctcaaagtacctatctcaagatatgtattagttacacaaggggaaaaatagtaactttaggctgggcatggtggctcatgcctgtaatcccagcactttgggaggccaaggtggacagatcacctgaggccaggagtttgagaccagcctggcaaagatggtgaaaccccgtctctactaaaaaaatgaaaattagcagggcatggttgtgcaaacctgtaatcccaggtacttgagaggttgaggtaggcgaatcactcaaacccaggaggtgaaggctgcagtgagctgagatcatgccactgcaccccagcctgggtgacacagtgagactccatctcaaaaaacaaagtaactttatagtagagaaatacagcaaacaaaacttataagcaagtaatgatgcttaacatcaccagtaacaaaacatctatatttcacaaatcctaatatggtacactgaaaagggaacacctctgttgtattctcatatcatcatcccaaccacaagtaaataaataaaagcaagaagcataacctcaatataatcatgagaaaacatcagagaaacccaaactgagagacattttacaaaataactgaggagtacacataaaatgagtcaagtcataaaaagacaagaaaaaacctggagattgtgtcagaaattggataagactaaggagacactactaaacacaacatggggtattgatttatatcctgaaacatgagaagatcttagtggaaaaagtggtaaaattcaaataagacattgcagtgggataattaaggaatcagagagaccgaggggttgaggaggaattatttaattatttatgtgcaacaactcagttggattaacatccaaaggactgagccccaaacaaagagtccggttaccttttaagcattttggggtggtggtggtgggagatctgtgcagggggaagcatattacagaagtgagaaacaaagacagttattcaattaagacatgcattacatcatttcttacttttcaaggaatagcatgttttacgacttgagtttatctgcctagtgaccttgcagctgcacagctagagaaacaaggtcttcacaatgcctgggaaggggagagataaggctcactagccacagaaaagcaggcagttaattttaaaggactccagctctttctcttcttcagggggaattgggttttcttacatacaactgagtttttgcttacattctttaatttgttttaattcctgttccaacatgttacttggtcaatactgctgaaccaatttaattttcctaaatgtatctttgttatgtaagttgctaccatgaggagcagtgaggtgaggggtacacatgaattctccttattaactttgcaacttttctgtaaacataatattatttcaaaataataataataagaagaatgaggtgctttttacattttggagattcaaaagttgagcaaagaaaagggaatgcaaactgcccaagctgaaacagttgtccatccgtgatttaaaatccaaaagcctgaattcaaaagccattgtcctaaaacattcacacaatgtttagaatgatgaaggcactcaataactgaaggcatttataaattccaatacctcaaactacatagaaatttcatatgaaccggagagcagttttcactgggtgtcagtggaaatgcagtgagaggttttgtggtggtccaaaattacttgaagcattggcagtgggaaagggtcaagaatgtgaatagctcttcagagcatggaaagatgagcataacaacaataaacacatctaaagaccaattgtgaattgtgaatcaccaactggggaacactgaggaaccaagaaaggcattctaaatctgaaaaagttgagtttgtttattagatcaacacagacaaatatgtgtagtgtttccaaaggtagactagcaaggtgctgtcttcttgctgaactttaaagctaattgtcagatgctaaagtttggagtatataatttgtattcaatttagttacatgtttggagaaaagattgtcaattattatgattattccttagtatttaataaaataataggtgatacttttatttggcccatatttgtatattaaaattagacatctataattgaatcagacctcaaacctatattttgattatttaatctaaatgttttccaatcggaaaatgttactttttcttctcatcttatagcacatggaaaaagcaccacactaccctgacaaagacgagaaaaggaactcaaggtgcctcagtgatgcagaatgttatcttcatgcaatcaggttcccttcgcaggtgtgctgtttgtgggattcactgtcagctcccattaattgtatctcctatattccttgtagatggttccctcaatggtgacagcttgttttagcagtagtcctattaacagcgactctcacaagaaatatcctcttcaattgaaatggcttccattcagaacaactcttagttttggcattctgttctatccataatgaatatagctttccccaactagcactccaagcaacatgtgtcatatctccagtgtctctcacctccttacacatgcctaatttcttcacagttaactctcgctactccaaatggatactgtagagtcttttagaaatgcagaatctcaggctctatgctagatttgctaaatcagagactgcattttaacaagatccccacatgatttatttgaccatcagtttaagatgcactgacctaggtgaatcagtgtggcagttttagtaccatattcaaaggccagctcatattggggtccctgaaaagtttttcagcgacagcctgctgcaaaacttctacaaactatgcagaaagactctagactaaccagatattcaaaaaaatgttctaatcaaaattccttacatgtcatttaaaacttgatttttaggccattatgtaaatacctatgattttactttttgtaaaaaaattctgaaagatgccatcacaaaatgtgtttgcttgcactagacaataagctctttcaagaccagtgtacatgagttactgagatagctgaatataaaatactgatttggaaggaccttcaaagattttgttatatattgcttccactttctgaagatgttttaatacttagtgggcatttggaaaagaccttcaaatagtcacctcactcaattattaattatttaatgtacacaacagatttacttccagtcagccatgcttttattatctccttaaaaatattattctatattatccagaatatttgattcttctcatagacatattttaaatctttaagactgtgaattcaattgaagtctatccaattggaataataattaggatttctccttaagaaacttacgcatgagaggtggagccaagatggctgaataggaacaactctagtctataactcccagcatgagtgacacagaagacgggtgatttctgcatttccaattgaggtactaggttcatctcactggggagtgttggaaagtgggtgcaggatattgggtggagtgcactgagcatgagccaaaggcattgcctcagccaggaagtgcaaggggtcagggaattcccattcctattcaaagaaaggggtgacagatggcacctggaaaattgggtcactcccatcccaatattacacttttccagcagtcttatcaaatggcacaccaggagattatatcctgtgcctggctcagagggtcctacgcccatggagcctcattcattgagagcacagcagtctgagatcaaactacaaggtggcagcgacactgggggaggggtgcccacaattgctgaggcttgagtaggtaaacaaagggccaggaaactcgaattgggtggagcccatcacagctcaaggaggccagcctgcctctgtagcctccacctctgggggcagggcattgccaaacaaaaggcagcagaatcctctgcaacttaaatgtccctgtctgacagttttgaagagagtagtggttctctcagcatgcagctggaaatcagagaatggacagactgcctcctcaagtgggtccctgacccccaagtaacctaactgggaggcaccccccagtaggggcagactgacacttcacacagccggttactcctctgagacaaaacttccagaggaatgatcaggcagcaacatttgctgttcaccaatatccgctgttctgcagcctctgctactgatatccaggcaaacagagtctggagtggacgtccagcaaactccaagagacctgcagctgagggtcctgaatgttagaatgaaaactaacaaacagaaaagacatccacaccaaaaccccatctgtacatcaccatcatcaaagaccaaaggtagataaaagcacaaagatggggaaaaaacagaggagaaaaactggaaactctaaaaatcgagtgcctctcctcctccaaaggaacacagctcctcaccagcaatggaacaaagttggatggagaatgactttgacgaattgagagaagaaggcttcagatgatcaaactactttgagcaaaaggaggaagttcaaacccaccaggaagaagttaaaaaccttgaaaaaaaattagacaaatggctaactagaataaccaaggcagagacgtccttaaatgacctgatggagctgaaaaccaaggcaagagaactacgtgaagaatgcacaagcctcagtagccaattcgatcaactggaagaaagggtatcagtgatgaaagatcaaatgaatgaaatgaaacaagaagagaagtttagagaaaaaagaataaaaagaaatgaacaaagcctccaagaaatatgggactatgtcaaaagaccaaatctacatctgattggtgtacctgaaagtgacgggaagaatagaaccaagttggaaaacactctgcaggatattatccaggagaacttccccaatctagcaaggcaggccaacattcacattcaggaaatacagagaatgccacaaagatactcctcgagaaagacaactccaagacacataattgtcagattcaccaaagttgaaatgaaggaaaaaatgttaacggcagacagagagaaaggtcaggttacccacaaagggaagaccatcagactaacagctgatctctcagcagaaactctacaagccagaagatagtgggggccaatattcaacattcttaaagaaaagaattttcaacccagaatttcatatccagccaaactaagcttcataagtgaaggagaaataaaaccctttacagacaagcaaacgctgagagattttgtcaccaccaggcctgccctaaaagagctcgtgaaggaagcactaaacatgcaaatgaacaactggtagcagccactgcaaaaacatgccaaattgtaaagaccatcaaggccaggaagaaactgcatgaactaatgagcaaaataaccagctaacatcataatggttattttattggatcaaattcacacataacaatattaaccttaaatgtaaatgggctaaatgctccaatgaaaaggcacagactgacaaattggataaagagtcaagacccatcagtgtgctgtattcaggaaatgcaactcacatgcagagataacacataggctcaaaataaagggatggaagaagatctaccaagcaagtggaatacaaaaaatggcaggggttgcaatcctagtctctcataaaacagactttaaaccaacaaagatcaaaagagacaaagaaggccattacataatggtaaagggatcaattcaacaagaagacctaactatcctaaatatatatgcacccaatacaggagcactcagattcataaagcaagtccttagagacttagactcccacacaataataatgggagactttaacactcactgtcaacattagacagatcaatgagacagaaagttaacaatgatatccagtaattgaactcagctctccaccaagtggacctaatagacatctacagaactctgcaccccaaatcaacagaatatacattcatctcagcaccacctcacacttattccaaaattgaccacatagttggaagtaaagcacccctcagcaaatgtaaaagaacagaaattataaaaaactgtctctcagaccacagtgcaatcaaattagaactcaggattaagaaactcactcaaaaccactcaactacatggaaactgaacaacctgctcctgaatgactactgggtacataacgaaatgaaggcagaaataaagatgttctttgaaaccaacaagaacaaagacacaacataccagaatctctgggacacattcaaagcagtgtgtagagggaaatttatagcactaaatgtccaaaagagaaagcaggaaagatctaaaattgacaccctaacaacatcattaaacgaactagagaagcaagagcaaacacattcaaaagctagcagaaggcaagaaataactaagatcagagcagaactgaaagaaatagagatgcaaaaaacccttcaaaaaatcagggaatcccagagctggttttttgaaaagatcaaaaaaattgatagaccactagcaagactaataaagaaaaaaagagagaagaatcaaatagatgcattaaaaaatgataaaggggatatcaccaccaatcccacagaaatacaaactaccatcggagaataacataaacacctctatgcaaataaactagaaaatctagaagaaatggataaattcctcaacacatacaccctcccaagtctaaaccagcaagaagttgaatccctgaatagaccaataacaggctctcaaattgaggcaaaaattagtagcttaccaaccagaaaaagtccaggactagatggattcacagctgaattctaccagaggtacaacgaggagatggtagcattccttctgaaactattccaatcattagaaaaagagggtatcctccctaactcattttatgaggtcagcatcatcctgataccaaagcctgatagagacacaacaaaaaaagagaattttagaccaatatccctgatgaacatcgatgcaaaaatcctcaataaaatacaggaaaccgaatccagcagcacatcaaaaagcttatccaccatgatcaagtgggcttcatccctgcgatgcaaggctggttcaacatacagaaatcaataaacataatccagcatataaacagaaccaatgacaaaaaccatatgattatctcaatagatgcagaaaaggcatttgacaaaattcaataactcttcatgctaaaaactctcaataaattagtaggtattgatgggacatatctcaaaataataagagctatctatgacaaacccacagccaatatcatactgaatgggcaaaaactggaggcattccctttgaaaactggcacaagacagggatgccctctctcaccactcctattcaacatagtgttggaagttctggccggggcaatcaggcaggagaaggaaataaagggtattcaatttggaaagaggaagccaaattgtccctgtttgcagatgacatgattgtatatctagaaaaccccattgtctcagcccaaaatctccttaagctgataggcaacttcagcaatgtctcaggatacaaaatcaacgtgcaaaaatcacaagcattcttatacaccaacaacagacaaacagagagccaaatcatgagtgaactcccattcacaattgcttcaaagagaataaaattcttaggaatccaacttacaagggacatgaaggacctcttcaaggagaactacaaaccactgctcaatgaaatgaaagcggatacaaacaaatggaagaatattccatgctcatgggtaggaagaatcaaaatcctgaaaatggccatactgcccaaggtaatttatagattcaatgccatccccatcaagctaccaatgactttcttcacagaattggaaaaaactattttaaagttcatatggaaccaaaaaagagcgcacattgctaagtcaatccaaagccaaagaacaaagctggaggcatcacactacctgacttcaaactatactacaaggctacagtaaccaaaacagcatggtactggtaccaaaacagagatatagaacaatggaacagaacagagccctcagaaataatgctgcacatctacaactatctgatctttgacaaacctgagaaaaacaagcaatggggaaaggattccctatttaataaatggtgccgggaaaactggctagccatatgtagaaagctgaaactggatcccttccttaaaccttatacaaaaattaattcaagatggattaaagacttaagtgttagacctaaaaccataaaaaccctggaagaaaatgtagacaataccattcaggacataggcatgggcaagaactttatgtctaaaacaccaaaagcaatgacaacacaagccaaaattgatgaatgggatctaattaaactaaagagcttctgcacagcaaaagaaactaccatcagagtgaacaagcaacctacggaatgggagaaaatttttgccatctactcttctgacaaagggctaatatccaaaatctacaatgaactcaaacaaatttacaggaaaaaacaaccctatcaaaaagtgagcgaaggatattaacagccacctctcaaaagaagacatttatgcagccaacagactcatgaaaaaatgctcatcatcactggccatcagagaaatgcaaatcacaaccacaatgagataccatctcacaccagttagaatggtgatcatcaaaaagtcaggaaacaacaggtgctggagaggatgtggagaaataggaacacttttaccctgttggtgggactgtaaactagttcaaccattgtggaagtcagtgtggcaattcctcagggatctagaactagaaatgccatttgacccagccatcccattactgagcatatacccaaaggactataaatcatgctgctataacgacacatgcacacgtatgtttattgaggcactattctcaatagcaaagacttggaaccaacccaaatgtccaacaatgatagactggattaagaaactgtggcacgtatacaccatggaatactatgcagccataaaaaatggggagttcatgtccttttagggacacggatgaagctggaaaccatcatcctcagcaaactattgcaaggacgaaaaaccaaacaccgcatgttctcactcataagtgggaatcgaacaatgagaacacatgaacacaggaaggggaacatcacacaccggggcctgttgtggggtggggggagggggagggatagcattaggagatatacctaatgttaaatgacgaattactgggtgcagcacaccaacatggcacatgtatacatatgtaactaacctgcacgttatgcacatgtaccctaaaacttaaagtataataaaaaaaattatccaccaggcgtggtggctcatgcctgtaatcccagcactttgggaggctaaggcaggcggatcatgaggtcaggagtttgagaccagcctgtccaatatgatgaaaccccgtctcttctaaaaatacaaaaattagttgggcatcatggcaattgcctgtaattccagctattcaggagcctgagtcaggagaatcacttgaacccaggaggcagagattgtagtgaactgagattgtgccactgcactccagcctgggtgacagaatgacactctgtctcaaaaaaaaattgttaaattttcgtaacaacctattgaaataaggcagcaaaatcctcactttgtagaagaagacattgagcctatgagaagtaggttctccaagaacaaatagctgttcattatggagctaggccttatgcagagttgggacactttctattatgtcaagctaaggcaagttaatttactgagtcacagtgccctcgatttatgagtatttcacctttttttctctttaattagaagcttattgagaagcttgtggaatgtaggcgtaagtgtattggataattaaagttttgatattctgatattgttggaactacttgaagaatttaacatttggtaagtatttttcatatgagtattaaaatagtaattttacttattatatgtttatacatagaatttgtcaattactttctgactacaaagacaaacagatacaaaaaagccgttctctcaacagcaatccaagtaagacttctgacagtgaattactctaggtcagtggttcccactctttttggcaccagggaccggttttgtggacgacaatttttccatggactggaggaaggaggggatggtcttgggatgattccagcacattacatttattgtgctactttatattattatattgtaatatataatgaaataatgatacaactctccataatgtagagttagtgagatccctgaacttgttttcctgtcactggatgttctcatctggaggcaatgggagaaagtgacagatcatcaggcattggattctcataagaagcacacaacctagatccctagcatgtacagtttatagcagggttcatgctccaatgagtatctaattctacctctgatctgacaggaggtggagctcaagtgggaataggagaaatggggtgtggctgtatatacagataaagctttgctggcttacctgccactcacctcttgctgtgtggcctggttcctaacaggccatgggctggtaccagtttgttgcccaggagttgtggacccctgcgctaggtggtcctaccatagataagaaagtaaaagtaaggaagtttttatcacaaaaaaaaaacagtttgaaaaatcactgtgtataaattgcatgtatatattttacaattttttttgagagtaggttcgatttcagaattatttaaaaatttcattttaggtgatttataatttcaaatatctgaaaaatttaattatggtctctaaaatcttgtataatatttttatgtaaataagaaaaacacaagttagtacatggtatatcttttttacggtcacatgataacaaattggacttgttatacaattgaatcttctatttaattatttaaataaatggtttgctttgagcaaatgaatgttaattacagttgacccttgaacagtgtaggacttaggggtaccaatcctccatgcagccaaaaatctatgtataacttttgacttccctcataacttaactactaatagcctactgttgaccagaagccttattggtaacacagtcagttaagatgatatttggtgtgttataagtattgtatgttgtatttgtacaataaactggagaaaagaaactgtcgggaagaaaaaatataattaatatcaagtggaagtggatcatcataaatgtcttcatccttaatcttcaagttgaataggctgaagaggagaaagagggaggttgggcttgctgtctgaggtgacagaggtagaagaaaatctgcatatgagtagtagacccctacagttcaagcctgtgttggtcaaaggttagctatattacactgaggtttgtgtcactaaaaaagtaactatctttaaaagtggaaactcagcaatacctttctaataccataagcaaatgagaatgagaactgcaagacttagtcagtgtgcagcaacaccaatgagaaattattttttttaaagatacctacagaagtgtccctgtctgacagctttgaagagagcagtggttttcccagcatgcagctggagatctgagaatgggcagactgcctcctcaagtgggtacctgacccctgacccctgagcagcctaactgggaggcaccccccagcaggggcagactgacatctcacacatctggccaggtactccaacagacctgcagctgagggtcttgtgtgttagaaggaaaactaacgaacagaaaggacatccacaccaaaaacccatctgtacatcaccatcatcaaagaccaaaagtagataaaaccacaaagatggggaaaaaacagagcagaaaaactggaaactctaaaaagcagagtgcctctccacctccaaaggaacgcagttcctcaccagcaatggaacaaatctggacggagaatgactttgacgagctgagagaagaaagcttcagatgatcaaattactccaagctacgggaggacattcaaatcaaaggcaaagaagctgaaaactttgaaaaaaatttaggagaatgtataactagaataaccaatacagagaagtgcttaaaggagctgatggagctgaaaaccaaggctcgagaactacctgaagaatgcagaagcctcaggagccaatgcaatcaactggaagaaagggtatcagcgatggaagatgaaatgaatgaaatgaagtgagaagggaagtttagagaaaaaaacaataaaaagaaacgagcaaagcctccaagaaatatgggactatgtcaaaagaccaaatctacatctgattggtgtacctgaaagtgacggagagaatggaaccaagttggaaaacactctgaagaatattatccaggagaacttccccaatctagcaaggcaggccaacattcacattcaggaaatacggagaatgccgcaaagatactccttgagaagagcaactccaagacacataattgtcagattcaccaaagttgaaatgaaggaaaaaatgttaaaggcagccaaggagataggtcgggttacccacaaagggaagcccatcagactaacagcggatctctcagcagaaattctacaagccagaagagagtgggggccaatattcaacattcttaaagaaaagaattttcaatccagaatttcatatccagccaaactaatcttcataagtgaaggagaaataaaatactttacagacaagcaaatgctgagagatttcgtcaccaccaggcctgtcctaaaagtgctcttgaaggaagcactaaacatggaaaggaacaaccggtaccagccactgcaaaatcatgccaaaatgtaaagaccatcgatgctaggaagaaactgcatgaactaatgagcaaaataaccagctaacatcataatggcaggatcaaattcacacataacaatattaactttaaatgtaaatggactaaatgctccaattaaaagacacagactggcaaattggataaggagtcaagacccatcagtgtgctgtattcaggaaacccatctcacgtgcagagacacatataggctcaaaataaaaggatggaggaagatctatcaagcaaatggaaaacaaaaaaaggcaggggttgcaatcctagtctctgataaaacagacattaaaccaacaatgatcaaaagagacaaagaaggccattacataatggtaaagggatcaattcaacaagaagagctaactatcctaaatatatatgcacccaatactggagcaccccaattcataaagcaagttctgagtgacctacaaagagacttacactcccacacattaataatgggagactttaacaccccactgtcaacattagacagatcattgagacagaaagtcaataaggatacccaggaattgaactcagctctgcacccagtggacctaatagacatctacagaactctccaccccaaatcaacagagtatacattttttcagcaccacaccacacctattccaaaattgaccacatacttggaagtaaaactctcctcagcaaatgtaaaagaacagaaattataacaaactgtctctcagaccacagtgcaatcaaactagaactcaggattaagaatctcattcaaaaacgctcaactacatggaaactgaacaacctgctcctgaatgactactgggtacataacgaaataaaggcagaaataaagatgttctttgaaaccaacgagaacaaagacacaacataccagaatctctgggacgcactcaaagcagtgtgtagagggaaatttatagcactaaatgcccacaagggaaagcaggaaagattgaaaattgacaccctaacatcacaattaaaagaactagaaaagcaagagcaaacacattcaaaagctagcagaaggcaagaaataactaaaatcagagcagaactgaaggaaatagagacacaaaaaactcttcaaaaaattaatgaatccaggagctggttttttgaaaggatcaacaaaattgatagaccgctagcaagactaataagaaaagagagaagaatcaaatagatgcaataaaaaatgataaaggggatatcaccaccgatcccacagaaatacaaactaccatcagagaatactacaaacacctctacgcaaataaactagaaaatctagaagaaatggataaattcctcgacacagacactctcccaagactaaagcaggaagaagttgaatctctgaatagaccaataacaggatctgaaattgtggcaataatcaatagcttaccaaccaaaaagagtccaggaccagatggattcacagccaaattctaccagaggtacaaggaggaactggtaccattccttctgaaactattccaatcaatagaaaaagagggaatcctccctaactcattttatgaggccagcatcatcctgataccaaagccgggtggaggcacaaccaaaaaaagaattttagaccaatatccttgatgaacattgatgcaaaaatcctcaataaaatactggcaaaccaaatccagcagcacatcaaaaagcttatccaccatgatcaagtgggcttcatcctgggatgcaaggctggttcaatatacacaaatgaataaatgtaatccagcatataaacagaaccaaagacaaaaaccacatgattatctcaatagatgcagaaaaggccttagacaaaattcaacaaccttcatgataagaactgtcaataaattgggtattgatgggacgtatctcaaaataataagagctatctatgacaaacccacagccaatatcatactcaataaattaggtagtgatgggacgtatttcaaaataataagagctgtctatgacaaacccacagccgatatcatactgaatgggcaaaaactggaagcattccctttgaaaactggcacaagacagggatgccctctctcaccactcctattcaacatagtgttggaagttctggccagggcaattaggcaggagaaggaaataacgggtattcaattaggaaaagaggaagtcaaattgtccctgtttacagttgacatgattgtatatctagaaaaccccattgtctcagctcaaaatctccttaagctgataagcaacttcagcaaagtctcaggatacaaaatcaatgtacaaaaatcacaagcattcttatacaccaacaacagacagacagagagccaaatcatgagtgaactcccattcataattgcttcaaagaaaataaaatacctaggaatccaacttacaagggatgtgaaggacctcttcaaggagaactacaaaccactgctcaatgaaataaaagaggacacaaacaaatggaagaacattccatgctcatgggtaggaagaatcaatatcgtgaaaatggtcatactgcccaaggtaatttacagattcaatgccatccccatcaagctaccaatgactttcttcacagaattggaaaaaactactttaaagttcatatggaaccaaaaaagagcccacatcaccaagtcaatccaaagccaaaagaacaaagctggaggcatcacactacctgacttcaaactatactacaaggctacagtaaccaaaacagagatatagaccaatggaacagaacagagccctcagaaagaatgccgcatatctacaactatctgatctttgacaaacctgagaaaaacaagcaatggggaaatgattccctatttaataaatggtgctgggaaaactggctagccatatggagaaagctgaaactggatcccttccttacaccttatacaaaaatcaattcaagatggattaaagacttaaacgttagacctaaaaccataaataccctagaagaaagcctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtggacaggaaacctacaaaatgggagaaaattttcacaatctactcctctgacaaagggctaatatccagaatctacaatgaactccaacaaatttacaagaaagaaacaaagaaccccatcaaaaagtgggtaaaggatatgaacagacacttctcaaaagaagacatttatgcagccaacagacacatgaaaaaatgctcatcgttactgtccatcagagaaatacaaatcaaaaccacaatgtgatatcatctcacaccagttagaatggcaatcattaaaaagtcaggaaacaacaggtgctggagaggatgtggagaaataggaacacttttaccctgttggtgggactgtaaactagttcaacctttgtggaagacaatgtggcaattcctcagggatctagaactagaaataccatttgacccagccatcccattactgggtatatacccaaaggaatatgaatcatgctgctataaagacacatacactcatatgtttattgcagcactattcacaatagcaaagacctggaaccaacccaaatgtccaatgatagactggattaagaaaatgtggcacatatataccatggaatactatgcagccataaaaaatgatgagttcatgtcctttgtagggacatggatgaaattcgaaatcatcattctcagcaaactttctcaagaacaaaaaaccaaacaccgcatattctcactcataggtgggaattgaacaatgagaacacatggacacaggaaggggaacatcacactctggggactgttgtggggtgggggaaggggggagggatagcattgggagatatacctaatgctagatgatgagttaatgggtgcagcacaccagtatggcacatgtatacatatgtaactaacctgcacattgtgcacatgtaccctaaaacttaaagtataataataataaaaaaaaccagctaaaggaaaagaaatattttgagaacactgaaaatatgaaaaaaagaatgataatcttctaaaagctataaaattgaatgaggaaactttaacaaaagaggtatttcactacaatgaacagcttagcattttgacaactgagaataaaatgcttggttttaaactgggggatataaagcaccacaaggaaagactggaaacagaaattcaatcatataattgtagactggccactgctgtatatttttgtgaccaaagtgagaaagcaaaaagagacctctttccagagaataagacacaaataggttcatttacaggagaaaatgaagtttgatatgcctaccctaaaaggtaacagtgaggttctttctgaacaactctctaatgctgacagtaaaattaacagcctaaaaattaagctccatcacacaagataaacactcggagaaaagacttcagttttagaacatttccaaagagatctatgccaaacacagacagtgtcaaaagaaagaaattgaacaaatgtgtcaaaatgaacaaagcagagtaaataaatatactggagtgcagaaacctatgaagacagattttctcaactacaaagtgaaaataatttgctttggcagcaactggatgatgctgacaagaaagctgagagtcaagaaaagacaatcagtactatccaagagcaattccatgctgttgtcagaaatcttctagctgagagtataaagtcttctgctggaagaggaaaacgaggagataatcaatgtacgtaatcccttgaaagaaagaatatatcaatgtgaaaaagagacagtgggaaaaaagtaagtattaacaaagatatttttcaaacttcctgaaagaaaatttaaagtaatatttggttatggtaaatgttatatgtatttgaatataaaaatatgtagaccataaaatatatttgctgtacggcctagaaacataccagcaaaaaaaggtagacctgaaatttgccttattttgaacaacgaaattgtatcacctttgaaattttaagactttattttacaaatttactatatatagactaatagttctaatgtggacttctgctgaaataattttaatatctctctgtggactaattttaagaccatgatgagacagataaacagaaatgccttttacctgaaatgaattttttgaaattaagattcaatcatgtgggttactttgacagttatttccagatttcccaggtgaactgaaatatactgctgtatctcatagtacttttttaaggtagctttttatgtatttatgttggtgtagttttatttttatttttactgatttgacttaaatctgagactttaagtctcacattattgttatgacctctcaattatttgaaggcatttactttttataaaatcattatttggaacagatgtgaatttccagcaaaaccatatttgatttagtcgtacctctggtgtttataattttaatgttcttaaaagtaatttgctcatgatttttatcttatggctcaatgactgtcatttggctataaccttgtccagtacaaagataattgtgtttgtctgcagttgctttgtttagcattgggttttcattttaaagctaatgagggatggcagaattcacatacagttggaatggaatgagtaggggagagagttataggaactgaggtaagggagggaggtggaggccaggttacctagggcctccaaatgtcattggaattttacttttattctgaggtagaaatctattagaaggatctgagcaggcaattgaatatgtgaggagtggggaggtttatttgaggttctgataaaaaagaggaaagacattttacactccagcattttccaccactagtgccacccacataccgaatttttgggacttcagtaggttgttaagcattgtaaatgtatcaggggttaatgaatagtgggctgattctgtcatctagcagaatactcatttggaaggaatataacacctgtgtccttaactgaattcagtaataagaatgtatacacatgaggaaaagaaggtgaatccatgtatgtggtgctatttttcaaagtatatgttgaatgttatgatcatgttttaataataaggtgatatatgaaatcagtaacaaaaatatcttaacaggtaattatgagacaacttctacaagaaccggctgataccctgaaaaaaaacctgtcagagccttccctagaggctacaccacattgtcacattaatttagaagagacacaagattcaaagaaggaattaggtaaaatcagagtcaagtatgtatgaaatgtaacatgtcaacagttaatctgtaggtggtggaggaatatatagttttaggatgctaattgcagtggatagatttcttttgtattttcattacaattaattttattatctttatcatgcacttatttcttctgacttttcagtctgtcatgtttttctcataagtatgtacattttaaagataatatttacccttaagaaagctgggaattatacatcattcctcacagaagttgagagacttttttttgtgtgtgaaacagtatttttcagggatttctctgttgccatgttgaggcaagccagattacatcagaggataatgttcaatagaatgttccagaaaagcatcttattgcttatcttactttcttggatgggtgcagaatctttgtatatttattgcatgaattttaggataacttgtacagaaaggccattatacttttctccaaaatgcagatgttttaggttaatttacaaagtacttgaaatgttaagcattcccttcttttttctttcattttaagtatattgtaaaagcatggaaatgctcagtttgtgtagagtatatacatccaaattagaggattaagaaacgtatctagatcctaccattgggattttaaaagacaattgtagtgatgtataatttgaacaccatacagttcacatggtctcttagtatattcacagagttgtatagccatcaccatcaccaattttagaatattttcatgatcctaaaaagaaacagtgcatcattttgctattatccaccagtttgcccttcctcagctctagggaaccaccagcctactttgtctttatagagttgcctattctggacatttcatatcagttgaaccacacaatatgtggtggtcttttgtgattgggttctttcacataggataaggttttaaggctcatctgtgttgtaacatatatcagtactcaattccctcttattgctgagtaatattccactgtgtggatatatcagtcattttatttactcattcctcagttgtggacctttgaattgtttccattctttggctattaatcatgtctgcttttatgtacaagtttttgtgttttcatttctcttgggtgtatgcatacaagtggaattgctgggtcatattgtaactctatatgtaacattttgaggagctgccagtctgttttccagagtggctgtatcattttacattcctatcagaattgtgtaagggttccaacttctctatttctttgccaacatttttcacatttttgattaagaaaagatttcctcttagtggtgtgaaatgatacctcattctggttcgatttgcatttccataattccctatgatacctcattttggttcgatttgcatttccctaatgactaattactttaatcatctttttacgtgcttcggagtgacttgtgtatcttctttggagaaatgtctattaaaatgcagcctatttttaaaagtggttgcctttttgtttgtgaatccataagatccttaacagatatgattctcaagtattttctttcactcaataggcttttttaaaactttcttgatgatgtctgttcacgtgcagacatttcaaattttgatagtcattaatctttttttgcagtcacaaagatttatgtctatgctttcttctaaaaattttatagttttagctcttatatttagtgattctattttgagttaattttagatacagcatatgccaggagtctatttttattcttttgcatgtagatacctagttttcccagcaccatttgtggaaaagactattcttttaaataaattaatattcttttttaagtgttgttctttttggcacccttgttgaaaatcaattgaccataaatgtgagtttatttttggattctcaattctaatatgttgatttatgtctactgttatgccattaccaaagcaaattttagaattgttttccaatcgtgttacttattattaccaattgcctaaagtaagaatagaaattcaagtactaggtagcctttaacttcactgtttgcttcttgaaggaacatgtggtcagcttatattatggtaacttcatgcttaaccttttgaggagctgccagtttgttttccaaagtggctgcaccactttacatttccagcagcattgtataagggctttaatttctttacatttttgctaatatttatattttcctaatgactaattacattaagcatcgattaatgtgcttatatccatcttttcttctttgcaaaatttctattcaaaatctttgcccatttttaattgggtcatctttttatttatgaattgaaagggttctttatatatcctagatataagtcccttatcagatatatgctttccaaatattttcttctactcgttgacttgacttttcactttcttgactgttttctcacacacagaatttttcagttttgaagtccattgaatccatttttcctttggagtcagagctaagaaaacactgccaaatgtagttacaaagacttatgccaatgttttcttctgaaagttttagagttttagctgttacagttagctgttttattttgagttaattattaaatatggtatttagtgagagtccaactttattatgtttttgcatatggatacccagttgtcccagcaccatttgtctaaaagactattcttttcccatttcattgttttgttaaccctgtaaaaaatcaattgactgaatacgcaggtttattttttaatgatcagttctttgtttatgtctattcttatgccagggccaaattgaatttaataagtttttttcaatcatgttgcatattaccagttgtcttatgtcataataaatattaaatatagtggaacatctttaacttcaccttctgcatctccagagagtctgtggtcagcttatactttacttatcctaagacatgatgagaagtcaggcttacaagacacaattcatttctttttttttcctccattcaagcctttagtgtcttatccagtgcctccctctatagtttcattttcagtaaattttggtcgcaggatccgctgacatagcctactatttagtgcattatgtcttattaactcattataattcatagaatcatccatagatgcttaccatctagaaaggagaagtttaagtctgagctgccagctttcctcagtggaagtcaagtgaagttatcatctttcaattcgcagatcctttttccacctggtagctggttctcttgtgtagcactgtggctgatccttttcttggtgcagatcctgcattctcagaaaccacagttccctgtattgacctcgttttactgaaacagagatgcacagctgtgctttgtagcttagtagaagattcttggagtaaaaagtttaactcattgcaagaaaaatatttaggagtgcagcgcttaaaaatctggtaatgttcaggaaatttatcagtagtagattagtaatttgaattttaaaatttcagagtcaacttgtgtgctatagagaagcgttgtggtataacatagagatgggatggtcttaacttctccatacaaacaagcttgaagtaaggatgaaggagaaatcgcatttgatttcttaacactcaaggcacactacatttattttacttctgtgaagattaaaaataattccatcgtgttctccttgtttccccactgagtaaaggaaaatgaaaatggaatactagattgattaataaatactcaaagctgcttacttttagaatttttagttaattgaaatcaggtaaactgtctgattttggttatttaaccaagtagttctagttgtttttaaaaatcacgtcttcttgctttccagtcttatttcctaacttgaggggaaattctaaggagacacccttgccttgtcatcagagttcataattgaagggagttttaggaaaagttcatcctcaggaacttatgtctctctcccagttatctgctgcttctcaataatgcttgtcatcaataaattaatctcaacatttatttgattctactttaaaagagactcttttctgctgtgtaagttatgtttcctgttgtctcttttttaaaatcatttttttctaacaattacccagagtttagtggcgtaaaagagaaacatttaaggctgggcacggtggctcatgcttgtaatcccagcactttgtgaggcagaggtgggtggatcatgaggtcaggagttcaagaccagcctggccaagatggtgaaaccccgtctctaataaaaatactaaaaaaagaacaacatttattttgctcatgaatctgtggcttggaaaaagcttggccaggacagcttgtctctgcttccctcagcttccctaggaacagctgaatgactggggaaatggaatcatcagatgctttgttcaaccatgtgtttgatggttaatgctggccattggctggaaccttggtttgggcaggcagcatgaacactgacactggcactcccaggctctctttgtggcctgagctctctcttagtctgggggctgggtttgaagggaaagcagttggagatagagaagccacatggaatcccttattactgcattcttttcattagaaggaagtcagtaaggttggcccgtattctatttttttagtgggatgaatttatcttctcttttgtttttaattgacatgtatatacaaaattatgagttataaagttatattttgatacatgtatatagtgtgtattgatcaaggtattactagcatatttattacctcaatcatttttcaaaaagtcttccagctttttgaaaatatacaataaatcatagttaagcatattcaccctacaatgctacaggacgccagaactcattccttttttataactgtaattctgtatctattaaccagcctcccctcccttacttccttgagttttttgttgttgttaagagacagggtcttgctagtctagtctgggccctgggcaactgcagtcactcagactagagacaatgatttgatcatagctcactgcagcctcaaactcttgggctcatatgatcaccccaccttagcctcctgagcagccaggattacgggtgtgcaccactgcacctgtctgattttttactttgtagacatgaggtctcatgatgttgcccaggctggtctggaacttttggcctcaagcagttctcctgccttggtcttttaaagtgctaggaaattgcaggcatgagccatgttgtccagccttcaatttttctttagctcccacacatgagtgagaatgtgcagtatttttctttctgtgcctgcacttaacattctccagactcatccacgtggcaacaaataacaagatttcattcctctatatgtggaatactattccattttgtatgtatactacattttttgtccatttgttgatggacatataggttgattccatacattagctgttgtaaatagtgctacaataaatgtacgagtacagttatccttttgatcttttgttttcgattggctgaatactcagtagtgggtttgctggatccctcagcagttccaatactagttttttgagaaatcctcatgttgttttctgtagtggctgcactaatttaccttcctatcaccagcatataagagtttactgttctctgaaaccttacctgcatttgttattttttgtcttttcaatgatagtcatttatttgaactggagtgagattatacctcgttgtaggtttgatttgtgtttccctgatgattagtgatactgagcatttttaaatgtatttatttgccatgtgtatttctttttttgaaaaagaaatgtgtattcagatcttttgccttattttgaattcagattttttttaatgtcaagtgtttgcgttcttgtatattttggatattagtcctttattagatgaatagtttgaaagtattttctcccattctacaggttttctgtttactcagttgttttctgggcaaaagctctttagcttaatgtggtaccatttgtctatcatttgttttttgcctatgcttctgatgtcttatccataaaaatctttgtgcagactaatgtcctgaagcatttttcctatatttactgctagtagtttgataattttgggcctgacatttaagtcttcaattcattctgagtttattttggtattggtgttagataggaatctattatcattgttctccatatgtatattcagttttcccagtggcattcatttgaagagggtgtcctttccccaatgtatgttcttggcatcttagtccaaaatcagctggctgtaaatatgtggatttatttctgggtggcatgtgccatagactttaccccaagaatcattacttcttaaaatgcaattcaaattagcataaaacatttgcattttagggaaaggcttatgacattagaatccttatttacaggattcattattttgtctcttttttttgagatatggtctttgtctgttatccaggcagaagtgcagtggtgtggtcataattcactgcagccctgaactctgtgtccaagccacccttttgcctcattctcccaatgagctggatgtacaaggcatgaataattaaaaataatttttttttgtagagatgtggagtctcactgtgtttctgtggctgctctcaaattcctggcctcaagtgatctttctgccacagactcctaaactgctaggattacaggcatgagccaccatgcctagcatagagtgttatattattttcagtgtcttattctgagagccattttttgactttggcctaaatatcttaatatgatatctctgaaactttttttgacaaattatggggaatgatgatgagggaagaggtttataaactttctcctaagagataacttagagccatttaaggaggaacaaaaagaaacaatcagaataataaaagatcaagtgcaaaatttctgcatcaaagatgatgatagtaaagaatatatttttgtgactcatggtggtctaattttgttcttgaatttctgagtaatttaagggttaacatttgaggaatctgctacattacaggtaatattttattccaagtaaatgtatttcaaaaattttattggtttattattaaaccaaaatttttattggttttattattctcagctactgcattatcaagctgtattatttcattcatgcagtttgatgatctcacagcagaattggaagctgtatctttacaatgtgtctatttggctgaaaacaatcaagttactcaacaggagttatctatgaaaaaagtacaacaggaatgtgaaaaacttgaggaaaataaaaagatgttggaagaaggaatagtaaatcttatgacacatatggaaaaatatggtagaacttggtaaagtacaagaatataaattggagctagaagaaaaagcaatgccagcaatagaaaaaaaatagaagaaatccattaacacgttagtttttaaagtcaggtaagtttatctgtaatgtgctttcatttatttcactgcaaattacattttagatattatatgtattgtgtttactctgcctctcatagcaatttgtagagttctagaaacaggtggcatctgtgtttttcttttaaatatttaaatttccatcattattataacaaaattgatctttcagagtaatgattctcactatagactcacttgattgttaagacctgtaggcataagactattaggaaaagagaagattgtgatttagaaattaaatgatacttttgaattggtcttaagctacattgttcattgttcagtttttaaaattataaatggattctattactttttaaatgaccagattgcattaatactaacactactaaacatacactcatagaaaatggaataagcttattaatttgttttgaaagcataatctagtgagatgccttcaggagattagtagaaagtgaatgctaacttgacaatataattttggaaaataatgtcagtaaataatcttacctttaaaacgttagtcagggagaggttcggtgtctccttcctctctctctctctctctcttttgtatggcttttttttcctgaaaaaatctcatgtagttaacttgatctattagtttttttcactaagtatttttgaatcgttataattaataaagtgatcttgttataaaattacttgtcagaattaccctaagtagaaatattaatgagtttaatttactttttggtacatcacaacctaaacccaaagtgtcaagtactactgctgctctgggtatatcctggccctcaggcatggaactgtccttgattgtgatctttagtattatcactatagggcaccttaagaaagactattctgtgtaacattttcaaactacagaaaggcgttcttgtgaaatagggaataattattacaggaatgaaaggaagtgtgattcactaagtggtttcaaaataacaccttgttcagcctgaaggggtgtgtggaagacagaaagaaaaaaccccatctccagtgccttggtcacaatgttaggggctaattgtcttcagagatgctttagttctttttgatcaccaaccaagccatctacttctctactatgagttgttgctcagaattattcatcattgccaaatgcttaattgttcctagataatgggtgaaatgtacaagggtgaaacctgaaactggtttactaagcacaagtatttctagcggtttttttttttggttcattttagatttcttaaatgtatattatttaaggagtacaacaagccgttttgatataactatttatagtgaattggttcttatagtcaaacaacttaacatattcattttgtcacatagttaccctttaaatacaagtatttctaatagaatcttccaaatcttacaagtagagtcattttagaaagcagcaagtgttacctgttcagccccacattactgatagccatttctcttccctctctactttgtttgaattgcttattcagtagaaatcaccctagaaacacatgtacttcttttgaacgactttaaaattataattggttacaacagatatgctctcacacatcttcggtgagaaaacactttagtgggtaatttggtttactctctcagcaacttttaaaaaagtggaagtcattaagactcacttaaggaaaaatgaaatactaagcatttgtctttgctatcttcacagatcaaataagaaaacaagtgatcagcaccaagctccatatggagaaagagtggatgaaagcttttctcagtgctctttctatgaggccaggctcagagccaccttgtgttgaaaatcttaatagtataggactcaacagaaaatgtattcccaaaacacctgtaagaattcctacttcaagcccacagacttcaaattaccttttctattttgggttttatttcactaataatattcttgtttttaatttggtgaaatactgagttgttcagttgacctatgcatgttaagtaaagattatagttagccatattaacacagaaaggaaatgggaactttacttttttttaaattccccagagctctaattttcaagagacacccatttgctaactttattcagtaaatgtaaataaactgacacatttcaactttctttaaaggctgcacttaagttagattttagaaattgcatgttattgcctaataactgaaggtatattttgagatgctttggcttacgctctaattgattgtagtttggctgtggttcatgccacttttaaggtttctttgtaccatctcaactcttcccacccatactcacaaaggaatgattggcatccaaacacttaatcacacatgggtatttactatttaatagaatccaaaataagtgcattttatgaattaaataaacataaaatactaaaagattcatttccatttttattttaaaagccttgtgctcttcttacataagagtacatcctctgactataaaaatcctggaagtaaacctaggaaatattcttctggccatagtggttggcaatgaatatatggctaagtcctgaaaagcaattgcaaggataacaaaaattgacaagtgtgatcaaattaaactaaagagcttctacacagcaaaagaaactatcaagggattgaacagacagcctacagaatggaagaaaatattcacaaactatgcatacagcaaaggcctattatccagaatccataagggacctaaacaaatatacaaacaaaaaataactccattaaaaaatgagcaaaggacatgaacagacacttttcaaaagaacacatataagtagccaacaaacatattaacaattgcttatcactaatcatcagagaaatgcaaaacaaaacaacaagataccatctcacaccaatcagaatgaatattgttaaaaagtaaaaaaaaactggtgttgggaggattggagaaaagggaacaattacacactgttggtggcaataaaaaattagttcagctgctatggagagcagtttggaaattaagaactaagaatgatcattggatgcagcaaccccatttctatgctgggggtatacctaaaggaaaagaaatcatcgtaacaaaaagatgcatgcacatgtatgttccttgcagtactattcacaatagcaaagacatggagtcaaccaaggtgcatccaaggtagactgaaaatccaaagtagattggaaaatttcacatacaccatggattactatgcagccatagaaacaacaaaatcatgtccaacatggatacaactggaatccattatcctaagcaaactatcatagaaacagaaaaccaaatatctcatgttcttactcataatgtgggagataggcattgggttcacactgtcataaacatgggaatagtagacactgggaaataagaacggggagggacagagtaggccagggttgaaaaactacttattggatcctatgctcactacatgggtgacgggttcagttggaccccaaacctcagcattcctcaatatacctttggaagaaacctacacaggtaccaccttgatttagaatacaatctagaaaaaatttactataaaaaaggttactgtaagtggagaatagaaatttctttttaaggaaaagtttactgaagtaaaaaatggattgaacttttataaagggcagaattttgctaagagttttgaagcaatgtattcattgcaaaacatgactttaattgtttaacctttgtactaataaaacaccacctttttaaaattatttatatacaatagaccaatattaattttattgttatcagataaatctaaacagcattacacagatatatcctctattatctaaacttaaaataagtagaaattttattttatttatgtgattatttttctatttaaacaagtgttcaagttatgtgtagtcactaaatatactaaaggccacattttgtaagtgatatattattctcacgataatgtctcttgtttaacttaaacattattattatttttacttgagatggagttggactgtgtagaacaaataattagagaaacaaagaaaagtatgttgccaaaatttattaattaaatttagacttattttagaaataaactgtatatagcaaatggcattccttttcattgttgggttagtagatactatgttattcttttcttacatacatctaatgacagatgtgaaaacaaaaactttcacaatgaagagtatacttatgcaccattaattcatcatgttccatagcttaaaaaattcccaagaagtctatgcatcccttttttactggctctacactttattcacttttgtcattctcatggaactgtcagccagcacactcaaacaattctcagcaaacaaaggcatcatcaggttctcagggttccggtagagacttaagaccaacagacctcatgctcatttagaaatactcagctgagccataaccattcataagcagtcacttgacaggtgacattttaaattttctgtcatttactttgtcattggcttacttttgttctcaggaaaagttctaaatttttcaccatggaataaaaacacctacatcaatgtgattcttgtcaagttactcagccttgtctctagccacttaccacactctgccctttgctctagcaccaaactggatggagtggaactccacagggttcttcctcacctcaggctctttgccttcatctcttccctctatctggcaatcttttcctcgtccttcaggcatcaacctacctatcttctccaccagaaagcctatgatattgacacaaaactgggatagatgactcttctgtgtgttccagtagtaccctgctatatacctgtcatggcatctatgactctatgtggacattgcctgcctgtctgttttttcagattacagcatatgattgttgagaggtggaccatactatcttcatcttgtaattccagtgctggttctagtaccttagcacatggctgttgagtatgtgaatgaagaataaaaagctctcatatttaaccacaattgtaattaattccatgtgtaaatacgagcaaattctatttaatagtaattttgtattataattgtacatacatatttctcattcttattaaccctgataaagttctgaactctttatttatttatttatttattttgagatggagttttgctctttttgtctaggctagagtgcaatggtatgatctcagttcaccgcaacctcctcctcccaggttcaaatgattctcctgcctaagccctacgagtagctgggattacaggaatgtgccaccatgcctggctaattttgtatttttagtagagatggggtttctgcatgttggtcagactggtttcgaactcctaacctcaggtgatctgcccacctcagcctccccaagtgtggggattacaggtgtgagtgactgcacctggccaactctttagtttttaaacttacacatagttaactgaaatgttttaggtaaagaacataattctttatttttctttccagcttttgctgtgttggacattttctcccatctggtttcttctttagaatccactgatgagcaacaactaatgaagagaatatctaaaccataaaatcttaaggaaaaagtttatgatttaaaagacctaaaacatcttaaaactttattactgatctgtgtacatgacattttaattgtttctcataaaatatgtaacatcatgatcttcactaaagtagaatatgtttgtatcatatgtgtgatgaaaatgtatatggtattttaaatgattttttagcctctttaagttttaagttgatcttgtaaatgaaaaccagtattgttgagtttgacatactcaaattgcccagatttcagctgtttaaacagccaaacaatcaagtcatcattgatacttcagtagaggtcattgatggcttattggcattttatagcttttactactatatataataggagacttgaggagtaccagcctggtatgttcgtgctaatgttactatttcctttttttctttttttgagatgaagttttgctcttgtcacccaggctggagtgtaatggcgtgatctcggtcactgcaacctctgcctcctgagttcaagtgactctcctgccttagcctcccgagtagctgaggttacaagcacctgccaccacacccagctaattttttttttttatttttagtagagacggggtttcatcatattggccaggctggtgtcgaactgacttcatgtgatccacccacctcagcctcccagagtgttactatttcctttttgtagttcaacagtattttgtgtggagatattttgaggctctgtaaatatctggttgctcctcaaaacccactagatttagcatttcatggatgacttgtgtttgagcaattattaccgtaatgattgccaaatgattactttcttattctctcctttgttctacatggagaaataaaaccaatacataaccgagaagggaaagctcgtgattctggtcctcaaatgccccaagattaggccagtggtagacatttcaagctcccttcatctcttttttatttgtccccattagtctgtcagcacttttttactttctggcacaagatgctccaagcttatcttgtattttctctgccccagccctggaatgagtgattgttcttagaagcagaggtggagccaccgaggaagcacaggatgagcattccgcagcttgcacttactggtccccagtaggaagaaccactgctgcatccactgaggtaccaagaaagtagcaaagaaccttctgactgtctggggacagtcctcatgtggtccttggctcagcctgaaaggttctggattagtctccttgaagcccctgtgatttgtctctagacctgtgctctgcaggaagggccctgagagaccaagcagcacagggtgtctcatctgccaaatgtccctcccttcctcccactctgagactcaggaataggctagatgatgtgttcaggcagtgccaggccacctcactgtctcctttgagatgggcccagaggaccttggggggtgagtgagaagctgggcacatggagcctgaggctgactgtccctccctgtgtcttggaggaaaggccttgtcccaagaagacccacagggcctgatctgtgggcacacatgcagggagggatggtctgtgggctgactgggacattggaatgagactttgagcactgctgctcaggggcctggtcagtggcccatggtcagtgatgacctggtcatcaggacctggccagttggggcaggatcagggacctcgttagtggtggcctcctcagtgaaggcctcatcaatggggacctgaagacctagtcattggaagactggttagtggtgacctggtcagtggtggccttattagtggggcctggtcagttggaacataaacaaggaaaaagtagttggtgggatctgtatacttggggtctggtcagttggggccttaatgggctgggacctggtcagtgggagcctagtcaggggggcctagccagctagggactaattcatggagaattgtttagtgggattcgggtgagcagcaaccaggtaaattgtggtcttctcagtgggggcctggtcagaggaaaattggtcagtggagtctggtccatggggcctattaatgggggcctagttcgggagagatggccagtgggtacttggtcaatggggacctggtaaatggaagagtggacattaggaacctggctagtgggaacctggccagctggccgctgtgtgacctcaggcagggggtttgtctgaggaacctccttgcctccacctgtagggtaggtgagtcaggtcaccctggagggctactgggaagaggatctgagaagttgtattgaatccagcattgctgggcagacctagcactttacacacgacctagattccacctagggagggtgccagccctctgctgtacccagtgcccctcctctgcatccccatgaccaccctgggtggggaggacagagattggggagctcctgtggagacactaatgctggccccaggccctggtggtgacagtgatgaggacctgggtgcacctgtgagtggagcacctaggcctagccatagaagcaacacaaacacacacatgcacacaaaaacacacacacacatgcacaaacacgttgcacacacacatctcagttcaggggataagggatactgactctgtgccctgtttatccaagcaggctcccattgtgatgggttatgttgccccacgatgtcatcattgctgagcccccagtgcctctgtgttgtggagcagttagagacacatggcagtgtccttgagtggctctgagtgtgggaccattttctaggtgatcactcagcatagcttaccgatcagactcaagtgaatggaacctgccctcttcccttcctcctggctttggaacagttgctaccaggtgagtggtttttccctccagacagttactgagagtaatccctgagcactcactgggtgcctgttctgtgctgacagtcatctcattcatcctaacagcaattccattctgcatcttctctggacacccccaggaccatccaggacaaccctgcctgacaccaggcctagtgtggctccatgataacaaagacgcaggtccagagacaatccccctacatggtgcctgcatctgattccccttggtgggtagtgacgatcacaacatggaagaagccagggcagcttgcagccagctgctgtgcagccccagatggctcctggaccttgggaagtaattctcaaaggggaagctggtcactttgaggtccctggagggatgggtgaatgtggcatactggcaacgctgacagccagcagcatgccatacatctcacctaacatgtgggacagaggccccctccaagagcacgagtctcatacatgaagcatcctgtctcaggcctcatcctgagccctaggaggggaggggtaccgtgggccaccagcagcagccaggattaccacacacgggactcagtattctgtagccctggccagacttagaatttggcccaagacaggacaatatcactcggagcagcatgtcggtacttggggtctgtgcatgccaggcaagaccaacctggctcaaagagcaatcagccacctctataagggtgtcccaggagcaggtggaccagccaccaacctcacccactcaaggaagcagggatagccaggttcccacagcctgagtggccactacataacagctgatggagtagaggcctgaggaaagcagatggcactgggccctacctccagggtagaggaactgatatatctagattggcagcgtgtgaggttggtgactggtccacctgctcctggcacacctttgtggaggtggccgcttgctctttgagccagtttggccttgctggcatgcacaggcctcagtgcaacaactgtgctgcaaatggagccacatggaggaaatgagcagcaggctcaggagcaggctgtgtgctgcctttggggctccagtccatgtatcagttctcacacagcactgagggcttcttgggtgccaagaggcagaccacaggtcattttgaggaggactttatgtccagatgcagaaagggcccaatctggtggatgaaccacatgccagcttctgggtgcaggcacagtgccacatcttccatcacttcctgatatgtgccccaccagcactgaagagacagcctggaaacaggacaatataaaggctgagaagggtgagatggtgagtgccagcttccaaatgaccctgagtccacccccatggtagccttcaacctttaggaatcgaatgctacaccaagaagatggacaacagggcactcaactcaacttcacagccaatgagttgacatgcaagcagatgatggtggcaggctttaagaaggagcatcagaaggcaggcagtttttcttcagcctcagccaggccttggagctggaccaggccatccacttcaccagaggtgccagcaacaccatcagtgagctctctgccaatctgtcccaacaaggcctggaccccatgatgcacctgttattgttgtctcagggacaccagtccaacgtcctggacatcatccatgtacccaaggaagctcttgccaaagtcatggaaagcaggcaacatgtggcagaaaggaagcagaagtgcagaggctgatgacatcaggatcacggtaacaggatttatttggccactttggctgaaattcaccacttccatccaactaaattgagaaacttgaaatcacaaatgcagtatttcttgcaacaagagatactatttttccaaaaagtcacccaggaattgagagtgttgaatgactagatattcaactgcggactttttccagttcaaggataccttctacagcagaataataacactatcaaagagccagtgccagctattgtggtagtacaagtattgttttgtgttagactaaaacccagctgaatattgacttgtgcaggaagcagttaatatggtgatagaatagaaacagcaccaaactaaatcatactacaaatgcttacactacctttgtaacttttggaagaatgataataccatttacttcattgctttttgaagtatgaatattttagtgtatatgctgtagaccttatatttatgaaaagtctcaaagaagctggctggataaagcctgctgtagatggttttatactgaaagattgatgatatgattcaaatatgtgtccccaccaaatttcatgttgaattatgtttcctaatgttgaaggtggaagctggtatgaggtgattgaattatgaaaacaaatttctcatgaatggtttagcaccatcactttgctactctccttgtaatcatgagtgacttcttgtgagatctggtcattgaaaactctatgccacctccttactttccatgttttcctcttgccatgtgagaaaattcagtctttgtcttccacaatgattgaaagatttctgaggcctcccagaagcaaaagccactgtgcttcctgtacactgctgaatcaagggtcagttaaacctctgtttcaaaataaagcacacagaaaatggcaaatgaggattgaacgattgctatgaagatacctgaaagtgtggaagtagctttggaagtaagtaatgggcagaggttggaagatttgagatggctcaagtgaagacagatagatgggaaaatttctggaccatcttagagactgtttaaatggttgtgaccaaaatgctgacagaaacatggacagtgaaggccaggctgagaaaggtctcagattgaaataagaagacttcaagaaaatgtcttccttttggatacggaaatcttacacaatgcctgtaccactattgtaccttagaagcagtgaacttgctttctatttcagcacctcataggcaaaagagactgtagccttggctcagatggtactttgcactttctaactttgagttaatggtggaatgagttaagaatttgggagactgttggcaagggatgattgtttttgcaatatgagaaggacattaaattcgtgggagggacagaataatatggtttatctctacttccctaccagaactcatactccctaatgttagaggtggggcctaggtagaaaaagatttaatcataaaagggtgagggtggatccttcatgaatggtaaagcaacatgcccttaatgctgtcctcctgatagtgagttctcatgagatctggttgtttaaaagggggtggaacctcttttcttgctctgccttgctcccactcttgttgtaggagacatctcattgtccctaagctgtctggtgtgattgggaagctctctgactcttcccagaaacagaagacacaatgcttcctttacagcctgcagaacactcattaaattaaacctctattatttatgataatacagaaatttggtactgcagaggggagctgtgaaatgtcttcaaggccttttcccctttgacttggctatcagcactgggcttctttatgtgcaaatttctgaagacttcttgaatttttccccttaaatggggttttgtgttattgctacatagtcaagctgttacagagatacctgaaaatgtagaagcacgttcagaagtgggtaacaaagaatgggagagtttggagggcttagaggatgacagaaaaatgagggcctggtgagaatgatttgatcatgaacaggaggtgggtgagagtggaagaaaaaaggggtgggtaggatggggagaagtaggttggcagtagggtggtgggagtgtggagggtagtaggaagggggagtagcctgctgtagaggcagagcctcatggaaaacctctattagggcgttgcacctgtggttttgcagggtttagcctccatggctgctctcatggacggggttgctgttgagtgcctgtagcttttccagactgagggtgcaagctgttggtgggtatatgaatctggaatctagaggatgctgatcccctttgtggaagctcaaagcccactattttccttccgcactgccctagcagaggttttccaagaggctctgcttctgcaacaggcttctgcctagaaaccatggtgggtgagggtggaggatggatcctttactaatgggtaagcatcatcttcttgatgctgtcctcatgatatagagttctcatgagatctggttggattacagggtgtggcaccactttcctctctctgtcttgctccttttcctgccatgtgacacatctccttgccccttgaccttttggtatgattgggaggtttcctgattccctccagaagtagaagccactatgcatcctttacagcttgcagaaccatgagccaattaaacctcttttctttatgatcatacagaaaatatagtaccttgaagtggacctaggaaatgacttcaaggacttttctccattttcttggcaatcagcagtcagcttgttttcatgcaaatatctgaagcctggttgaattttccccctgaaaatggatgtttcttcttttacgacattcccaggctgtgacaaagctggaatgtagaagcaggctcagaagtgggtaatgaacagaggttgggagaatttggagagtttagaagacaggaagatgaggaaaagtttggaccactgtagagcattttactagtcatgttcagaaggctgacagaagcgtggatagtgaaggccagactttgaaagtctcagatgaatatgaaaagcttactgggaacaggagccaaggtcacttttgttttgccttagcaaagaaggtgtctgctaggtgaacctgccctggagattggtgaaagtttgaacttgctggtgatcatttggggtgtaactagcagaatgaccttctaagcagcaaagctcaagaggtatcctgtctgcattgaacagcctgtgctcttaggtgtgatcaaagaaatgacttcaagttggaaattatacttaaataagaagcagagcttcaaagttagaaaaatctgcagcctccttaagtggtcaaaaacgaaagctgattttcagagggaaaatccaagaaggctgtagaaatttacgtaaaatggagtccagtgctaatagccaaggcaatggggaaatggccttgaaggcatttcagagacctttgtagcagcccttgctgtcactggccctgaggactgtgaaagaataatggtttcctgaaacagccacatggcctcactgctgtgtgcagcctcaggacactgctgcctgcatccctgcagtgccagctccagctctagcaatggctgaaagatgcacatgtacagcttgggtcacagctttggggcctgcaagctataagctttggtggcttccacatagtgttcagccagcgggtgtgtagagcatgagacaagaggctttggagcctttgtatagattttggaagatgtatggaaatgcctgggtgtccaggcagaagactgccaaaggaggagagcctcatggaaaacctctactagggcagtgcagaaggaaaatatggggttggagcctccacactggaggccaccactctcaaaacctcagattcatacacccccaacagcttgtacccttagaggggaaaagctacaggcactcaacaccagcctagcccatgagagcagccatggtcactaaacagtgcaaagacacaggtgcaggtctgcccaaggccttgggagcccagccctcacacccctgtgctctggatttgggacagtgaagcaaaaaggatgattttggagctgtaggattgaaagacttgactgctgtgttctggaatttcatgaggcctgtaagtctcatctgcttttgttctttctggcaaaattcttccttttggctgggaatgcttacccattgcctgtgcaaccattgtaccttggaagtagataacttgctttatatttcagaggctcatgggcagaagggagtgtagcctgtgtcagatgagattttaagctataaacaattatgtaaatgctggaaagggttaagatttggaggactgtagggaaggcaacattgtattgtgcaatgtgaggaggacacgagatattgggggccagggcaaaataatatgattttgctctgtgtccctaccaaaactcatatggaattgtcatcgggaatgttaaaagtggggcctggtggaaggtgatgtaatcatggatgagagtgggggttggaagttgggaggtggttgggagaatggcagggattatggtggtgggggagggaaaggtcggggtggtgtgaatccttcacaaatggttaaacaccatctccttcatgctgtcctcatgatagtgattctcatgatgattttggagctgtaagattgaatgaatagtggctggctggattttgggcttgcattgggcctgtggtcccatttgtgttattttcctgggaaatttcttccctttggattgagaaagcttacccaatacctgtaccatcattgtaccttggaagaaaagaactcctttttaaattcagggactcatttgcagccttatcttatatgagacaatgaactttttacatttgaattaatgctgaaatcagttaagatttttggaaacttttgaaaagaaatgattgtattttgctctgtgagaaggacatgagattcagaagggtcgaggtcagaataatacggttagggtatttgtccctaccacaactcatgtggaattgaaatctcaaatgcttgaggtagggcctggtgggaggtgatataataatggaagggaggggggtgggggtgcaaggaaaaaggggtgggtagggtggggaaaagtaggttttcagtagggtggtgggagggtgaagggtagtaggaagcagagtagcctgctgtagagacagagcctcatagaaaaactctactagggcagtgtgccgtggattcacagggtttagcccccgtggctgctctcatgggctgggctggtgttgaatgcctgtagctttttcacattgagggtgcaagctgttggtgggtctatgaatctggggtctggaggatggtggccccctgtgtgggggctccacgcccatattttccttctgcagtgcccgagtagcagttttccaagaggctcggcctctgcagcaggttctgcctgaaaacagtggtgggtgggtgtgggagaagatccctcacccatggttaaccaccgtcttcttgatgtgggcctcatgatagttctcatgagatctggttgtataaaagcatgtggcacctctttcctctttctgtctttctcctactcctgccatttgaaacatctcattgctcctcagccttctggtatgattgggaggcttcctgggtcctcccagaaacagaagccactctgcttcctttacatcctacagaaaccagagccaatttaacctcttttctttatgatcacacagaaaattagtactgcaaagtggagctatgaaatgccttcaaggccttttcttcattatcttgcctgttagcattggcctaccttttttatgcaaagatctgaagctttcttgaattttctccctgaaaatggggttttcttcttttaccacattgccaggtgtgactaaattagctgaaaatgtagaagcaggttcagaagtgggtaacagccaaaggtcagagagtttggagggctttgaagaagatagggacatgacagaaagttggacctattgtagaaatgttttaaataattatgattaaaaggttgacagatgtatagtgaaggccaggcttagaaggtctcagttgaaaatgaggaagttatactgggaataaaagcccaggtcacttttgtcttaccatagcaaagaacttagccgactggtgaccctgccctcaagatatgtgaatctttgatcctgagggtaaagatttagggtgtatctgggtggaatgaacttctatgcagcaaagctcaagaggtgtcctgtctgtgtcaaacagcctgtgctcttacgtgtgactgaggaaatgacctcaagttggaactcatatttaagtgagaagctgagcttaaaagtttggaaaatttgctgctggccaagtggtcaaaaagaaaagctgattttcaggagggaaaatttaagaagtcttcagaaatttgcataaaaaggagcccagcgctaatagccaagacaatgagaaaaaggccttgaaggcatttcagagacctttgcagcagcccttagtgtcacaggccctggggcctaagagagaagaatggtttcctgggccagacccatggccctgctgctgtgtgcagcctcaggacactgcaccttgcatccctacagctccagctccagcttcagccctggctcaaagatgcacaggtacaacttgagtcactgcttcagagggtgcaagctataagccttggtggcttctgcatagtattaacccattgggcacacagagcccacgactagagtcttgggatcctcctcaaagacttcagaagatgtatgggaatgcctgtgtgtccaggcagaagcctgcccaaaaggaggaacctcatgggaaacctctactatggaagtgcaggaggaaaatatgggttggatcccccacactggtttgtcattgggaatgttaaaggtggggactggtggaaaatgatttaatcatggatgagagtggggactggaaggtcgggggtgaggagaatgggacggatgatggtgggagtgggaggtgaaatttggaagtgtgggggggatccttcaaaaatggttaaacaccatctccttaatggtgtcctcatgatagtgatttctcataattattttggagccgttagatcgaatgattactgtcttgccgggttctggacttgcattgcgcctgtggttgctttcgtgttatttttgtgggaaatttcttccttttgattgagaaagcttacccaaagactgtaccatcattgcaccttgaaagaaaataactccttttgaattcagggactcatcaacagaagggactgtagccttgtctcagatgagactttgagcttttaacatttgagttcacgctggaatgaattaagacctaggaaacttttgaaaaggcatgactgcattttgctctgtgagaacaacatgggatttccaggggtcaaggtcagcataacacggtttgtctgtgtgtccctaccaaaccttatgtggaattgtaatctcaaaccccagaggtggggtctggtggacggtgatttgatcatggatgggagtggcgtgggggtggaatgaaaaagtggtaggtggggtgaggaagagtaggtttttcagtagggtggtgggagggtgggggtagtaggaagtgggagtagcctgctgcagaggcagagcctcatggaaaacctctactggggcaatgcacctgaggctttgcagaatttagctcctgcagctgccctcaagggctgaactggtgttgagtgcctgtagcttcctcacactgagggtgcaagccattggtgggtctgtgaatctggtgtctggaggattgtgtcctgtgcgggggctccaaacccatattttccttctgtattgcccaaatagaggttctccaagaggctctgtctcttccataggcttctgcctggaaacagtgttggttgagggtggggggtatatctttcacctatggttaagcaccaccttctagatgctaacttcatgatagtgagttctcatgatatctggttgtataacagcatgtgacacatttttcctctctctgtcttgctcctacttctaccacatgaaacttctcattgcctcttggccttctggtatgattggcaagcttcctgagtcctctcagaagcagaaaccactctgctgtttttacagcctgtagaaccctgagcaaattaaacctcttttcttggcctggcatggtggttcatgcctgtaatcacagcgcttttggaggctgaggtgggcagatcatgaggtcaagagatcaagaccatcctggcaaacagggtgaaaccttgtctctactaaaaaaaaaaaaaaaaaaaaaaaaccaaaaaacaaaaacctgggcctggtggtgcacacctgtattcccagatactcagcagactgaggcagcagaatcacttgaacctgggaggtggaggttgcagtgagccaagatcggaccactgcactccagcctggtgacagagggagattccatctcaaaaaataaataaataaaaataaaatactcttttctttatgatcataccaaaaattagtattgggaagtggagctataaaatgccttcatgaccttttccccattgtcttggctattagcactgggctgcttttatatgcaaatatatgaacccttgaattttccccctgaaagtgaacttttcttcttttaccacattgccaggttgtgacaaagatcactgaaaatgtagaagctggttcagaatattggtaataaagctcaaaatcctgaggaaattgaacactcaaataaaggattcttagcaaagcaattttacttctgcacagaggggtgcttctccttggccagtcaccatgagagcacatctgaacaaaggggcatgagagcctttattcctgatgcaattcctgcccctgtacccttttcccattggccagggtcaggtcacacaatctgaactaatcctggttggctaaacatttgaactttctttagataaagtgggcacataagggagagaggggaaaaggggaaggggtgtctgcaatgacctagagaggtagtcttttttccaaataaggaaaggaatgtgaacttgtactgataagcctggtactgtggtgtgtctgggcatgtaacaaaggcagaaaggaaaaaagacaaaaaggaaaagggggtgagcatgggtaatatgaatgaataaaggattgatcaggctatttgaagagaaacctcatcatatcacacaagaagtgagtaatggccagaggtcagagagtttggagggcttggaagaagacaggaacatgagggaaagtttgactcattgtagagacttgttaaataattttaattaaaaggctgacagaaggacatacagtgaagccaggcttagaaggtctcagatgaaaatgaggaacttactgggaacagagccaaggtcacttttgttttgccgcagcaaagaatgtggctccacagtgaccctgcccttgagatctgtcactctttgaacttgagagtgatgatatagggtgtatctggtgaaatgaacttctaggcagcaaagttcaagaggtgtcctgtctgtgtcaaacagcctgtactcttatacgtgactgaagaaatgacctcaagttgggactcatatttaaatgagaagctgaacttaaaactttggaaaatttgtagcctggccaagtagtcaaaaacaaaagctgattttcaggagggaaaattcaagaaggcttcagaaatttgcataaaaaggagcccagtgctaacagccagggcaatgaggaaaaggccttgaaagcaattcagagctctttgcagccacccttactgtcacaggccctggggtctatgagagaagaatggtttcccgggccagacctatggctccactgctgtgtgcagcctcagttccagctccagccatgggtcaaagaggcgcaggtacaacttgtgttactgcttcagaggatgtattctataagccttattgtcttttacatagtgttaagccagcgggcacacaatgcatgagtctacaggcttgggagcctctgtctagatttcagaaaatgtacagaaaagcctggatatccaggcagaagactttccaagaggcagagcctcatgggaaacctctgctagagcagtgcagatggaaaatatggggttggagccacccctagaaccttgggtctggaagcaggccaccatcttccagaccccagattcatagacccaccaacagcttgcaccctaagtgtgggaaagctacaggcactcaacaccagccccagtctgagagcagccacagaagctaaaccctacaaagccacaggtacaaagctacccaaggccctaggagtcccactctcagtcctgtgtgccctgggtgtgggatataggttcaaagaagatgattttggagctgtagtgtagcaggagaagcctcagacaaaacccctcagataccaagttaaagaaggaagggatttatttggccgggagcttcagcaagattcatgtctccaacaaccgagctccctgagtgagcaattcctgtcccttttaagggctcacaactctaagggggtccacatgagaaggtcgtgattgattgagcaagcagagggtacgtgactgggggctgcttacaccagtgattagaatggaacagaacaagactgggatcttcacagaacttttttaacgcaagtaactgattaggtcggggtcgatctttaactaccagacccaggatgtggcgccaggctgtctgcttgtggatttcattcctgccttttagtttttacttcttttttctttggaggcagaaattgggcataagaaaatactaggggtggtctcctcccttagtaggattgaatgactggcctgctgggttttggacttggaaggggcctgtaaatctcagctgtattttgttctactttctccaaaattcttccttttgaatttgaaacgctttcccaatccctgcagtcattgtgtcttggcagtagttaactcgctttatatttcagagactcatgggcagaaagaactgtaacactgtctcagatgagactttgggctttggacatttgagtaaatgctggaatgagttaagatttgggggactgcatagaaggcatcattatatttgacaacataactagaacacgagatttgggggccagtggcagaataatatggttttgctgtgggtcccttccaaatctcgtgtggaattgtcatcctggatgttggaggtgggacctagtggaaggtgatttaatgatgttctggagtgtggggtggaaagtggggaaggagtgaggagcattgtgaggagtatggtgggtggtggggagtgaaatgtggggatgggatccagatctttcatgggtgctaaacaccatttccttaatgctgtcctcacatgagtgagttcttgtgatgattttggagctgtaagattgaatgaatactgtcctgctgagttttggacttgcattggttctgtggtctcatttgtgttatttttctggcaaatgttttctttttggattgggaatgcttatgcaatgcctatatcatcattgtatcttgaaggaagagaactttgtttttaattcagaggttccttggcagaagggattgtagccttgtctgagatgagagtttgtactctatacatttgagttaatgctgaaatgagttaagaatttggaaaacatttgaaaatgcatgattttgttttccattgtgaggaggacatgagattttgggggccaaggacagaataatgtggtttggctgtgtgatcctaccaaaactcatgtggaattgtaatctcaaatgttggcagtggggcctggttgggggtgatttaatcatggacaggaggatggtggacctggaaggaaacaagagtggataaagcagagaggagtaggttggtagtagggtggtgagaaggtaggggttagtagaaagagggactagcctgctgcagaggcagaggctcatggaaaacctctactagggcaatgcatctgtggcttttcagagtttaacccccatggctgctctcatgggctgggctgatgttgagtgcctgtaagtttttcacactgagggtgcaagctggtggtgggtctatgaatctggggtctagaggatggtggtctcccacgtgggggctccaagtccatatttttttctgcattgccttagtagaggtttttcaagaggctctgtgtctgcagccagcctccgcctggaaagagcagggggtgggatgggggttgcattcttcaccaatggttgagcaccatcttcttgatgctgacctcgtgagagtgagttctcatgagatttgcttatataataggatgtgacaccactttcatctctctgtcctgctcctccttttgccatatgaaatatctctttgcccttggccttctgttatgattgggaggcttcctgagccctcccagaagcagaagtcactgtgctttctttacagcctgcagaaccccgagccagttaaacctctttttaaaataacatggcagaaaactagtactgtagagtgaagctatgaaattccctcacggccttttcctccttcttttgcatcagcacttgcctcctttcttattcaaatatctgaaaccttgttgaattttccccctgaaaatggatgtttcttcttttaccacattgccaggctgcagcaaagataccttgcaggttcagaagtgggtaaaggacagacaatggagagtttgaagggcttaagagaatacagcgaaatgggggaaactttgaaccactgtagacttgttaaatagttgtgatcaaaaggctgaccgaagaatagacagtaaagaccaggattagaaggtcttagatgaaaatgagagagttactgggaacagaggccaaggttagtttgttttgtcatagcaaagaatgttgctgcatggtgcccctgtccaggagacgtgtgaaattttgaacttgagggtgatgacttaggtagtatgtggtgaaatgaacttctaaggagcaaagctcaagaggtgtcctgcctgcattgaactacctatgctcttatgtgtgaccaaacaaatgacctcaagttgaaatttgtgtttaaatgaaaagctgagcttaaaagtttggaaaatttgcagcctggccaagtggcaaaaaaaaaaaaaaaaaaaaaaaaaaaaaaaaagctgattttcaggggggaaattaaagaaggcttcagaaatttgcataaaaaggagcccagtgctaacagccaagacaatgggggaaaaggcttgaaggcatttcagagacctttgcagcagcccttggtatcactgaccctgggacctatgagagaagaatggtttcctctaccagacccctggccttgcttctgtgtgtagcctgaggacaccactgcctgcatcctgcagctccagctccagctgcaactccagctccagtcatggttcaaagatgtacaggtacagcttgggttactgcttcacagggtataatttgagggggaccaggggcagaatcatataatttggctgcattttcctactaaaactgacatcatatcataatatttcatgttggtggttgggtctggatgccaaggtgaggagaggtgaaaagtggggatggtgttcagagtttgcaggactagagtggtgggctcggagcttatttggagagaggggtattgtacattttcagggcatgggggtggggcgcagattctttaccaatggttaagcaccatctccttgatgctgtcctcatgatattgagttctcatgagatttgcggggttttttgtttgtttttttttatagtgtgtggcaccactttcctctctctcttgctcttactttggccatatgggacatctctttgctccttggccttctgggataattgggaagcttcctgagtcctgccagatgtagaacccactttgccttctttacagtctgcagaaccatgaggcaattaaacctcttttctttatgatcatagagaaaattggtactgtggagtggagctatgaaatgccttcaaggccctttttccattgtcttggctattagcactcaggttttgttttatgcatatatctaagccttcttgaattttacttctgaaaatggacttttcttcttttacctcattacctggctttgacaaatatacctgaaaatgtagaagacagcttagaagtgggtaacagacagaggcagagagtttggaggtcttagaagaacagaataagataaaagaaagtttggaccattgtagagacttgttaaatagttgtgattaaaaggtcaacagaagaatggacaatgaaggccagagtgaggaggtctgaggtggaaatcaggaacttactgggaacagaagcaaaagttacttttgtttggcattaacaaagaaagtgactgcatggtggccccgccctggagatctgtgaaactctgaacttgagggtgatgatttagggtatattcggtggaatgaacttctaactagcacagctgtagatatgtcccacctgtgtcaaacagcctgttctcttatgtgtggaccaaaaaatgacttcaagtcagaacttacctttaaatgagaagtggagcttaaaagtttggtaaatttgcaggcttttttctcaagttatgcatttttagaatgacatgaggtttggagggacggggcagggtaatatggtttggcttcatgtccctgccaaaactgatgtcaaattttagtttttaatgatgaagtttggacagtaggtgttgatggactcatgtgggtgggttattaatgaatggtatagcaccatccccttgatgctgttttcatgatagtgagtgagtttttatgagatctggttgtttataagtgggttgtacctctttttctgttttgcttctgtgcttattatatgagatgtctcagtcttttttttgccctcctttctgacttgaagtttcatgaggcctctcagaagtggaaactactatgctttttatacaagctgcataactatgaggcagttaaaacttattttcacatgataacactgaaaataggtgctgaggagtgaaacacttgactaaagatacctgacaatatgggaagaggtttgggtctgggtagtgggcagaggttagagtttggcatgctcagtaggagatggggatttaaggggaattttggaacatctttgagattgtttaaatgattatgatcaaaatgttgacagaaatgctgacagtgaaggccaggttaggtggtctcatagggaaatgaggaatttagtgggaattggaacaaaggtcacttttgtcttgccttagccaaaaatgtggctgctttgtgcccattttatagggatgtttaaaactttgaacttaagtgtgataatttagaatatctagcataataaatttataagcagtgaagcattcaagaggttgtgtgtctgcttctaattgcctgtcttcatatgagtgagcatagaaatgacctaaagtgtgaatttatatttaaagagaaagcagagattaaaagtttggaatatatgtagtctggacatgtggtagaacagaaagcccatttttaggggagtaattttggatgacttcagaaattggcatatgtaaaaaggagccaagtggtaatagccaagacaatgggggaaaggcttccaaggcatttgagagagctttgcagcatctgctttcatcacaggttctgaggcctaggaggaaagaatggtttcatgggccaggcccagggccttacatccccgcacagcctcaagagaccgcttcttgcatttcatctgctttctctccagctcaagacatatgtcaaaggggcccaggtatgactcattttacttcatcagatgtttaaagccagaagccttggtgacgtctatggtttttttttttttttttttttgagacggagtcttgctctgttgcccaggctggagtgtggtggcatgatcttggctcactgcaagctctgcctcctgagtttatgccattctcctgcctcagcctcctgagtagctgggactacaggtgcccatgaccacacccagctaaatttttgtattttttagtagagatggggtttcaccatgttagctgggatggtctcgatctcctgacctcgtgatccactcaccttggcctcccaaagtgcagggattacaggcatgggccactgcacctggccctctatgtggttttaagtctgcaggtgcacagagtctgcaggtgcacagaggcttggagcctccactcggaacccccacctagattttagaggatgtatgcaaaagactgagtgtccaggtaagagctgactctagggatgtggctgttatcaagaatctcttctagggcagtgcagagggaacatgttgggttgagcccccaacacagagtttccaccggggcactgcctaatgatgctgtgagaaaggagctaccatcctccacatcccagaatggtagttgcaccagcaacctgcaccctgagtgtggaaaagccactggcacttaatgcctgctcagcttgttactgcagacatgggggtggaaccctgcaaagcaacaggagtagagtggcccaagcccttgggagtccaccccttacaccagtgtgtcctcaaagtgggacatggagtcaagattattttggaacttcaacattttatgacagccctgctaggatttagacttgcatggggcctgtagtcctgtggggtttttttaagcaaattttttccttttggattaggaatgttttgccactgcctgtacccttattatatcatggaagtaactaactcatttttttattttacagtctcataagagaatggaagtctagccttgtctcagatgagactttgaactttggacctctgagttaatgttggaatgagttaagaatttgggagagtattgggaaggcatgattgtatttttcaacgtgagaaggacatgagattgacaggtcaggggcaggataatatgatttggctctgtgcctctcccaaaacttgtgtcaaactcatgtaatccctaatgttggaggtggggcctggtggcaggtgactgaatcataggggtggatgctttattaatggtctaccatctttgtttctgtcttgatcctgctcccaccatatgaaacatcttagttctcctttgccttctgccatgtttggaaggttcctgaggtttccccagaagtagaagctgctgtaattcctctacagcatgagccaattaaacctcttttctttatatgttacctagtctcaggtatttctttatagcaatgtgagaacatactatacaattgaaattacctaaattcagtctgttctctatttaggtcctagagcagcattgctactctgtgcttttaaatttatctgcacaccttttttttcttagtgaaaggctgaaaggtgagtacacataaaacagagtgatgatcatacattggcagtggaggttgtgggatcgaggatcagctgccaacaaattggacagctagtattatgatctgataaaatgctgggacatgcagaggtgtgagattcagtgcacatcttttacatgaagtctgttagaaaagaaataatgcactgtgttcccttagaggcagctgtagcatcatctcgtcatgcaagtgtcctgaaacttagtttgataatttcagcaaatgtgtcttctggcatgagaaggaggattctcttctgtcagagaattaaagtgtagaagcagtgatgacacgcacttggtttcagttcttaggagagtttcgtttttgatgttttagcttgaagattttccttcagtagtgtttttaaaatgaatctatactggtaactgataaagactctactatgcaattcactcattgaattaaaaaatttccaaggttgtctgtaaatctcagggttctatgtcatgaaaactggtatcggttgatgtaaggaggaaccagaaataatttatttccagtactgaagaaaaaataattgatttatagtttgatttttaaaaagtattgataagtccccagaacatttaatcttgaaaatattttaaattttaaaaggattataatgcaaataaaaatagctgataaatatgaagattcaaaaggagcttaatttaaaaagcacaaagagattgtcttgcattgctgaaatctcaatatttttatagttcctgggctaaataatttgatgttgagtttacagatttaaaaactgtggctgaaaggttaaagtctctactatttatatgaagtccaacttatgctgccccaaatccctgggtactgaaattgtaacaagtcaaattgaaacactgatgaataacaatgatgaaataaaatgatccgtttgcagatagtcataaaaagaagagattactaaaatcatcatgcagcagcacattgactctcagaagtaatttcttatgggttgaattttaagatcagattctcataattttgatatttgctcaaaacttcgtcccttaggttacttagagccagatttaacatcaggtggtgttgtctgtactacacacatgtagactgtaaccagaaatattgttctctaaaaacaagatcgaacaactaccaaaaactaattcagctcctaggactgaagaaaactgggcaagtgaggttcaggaggccaggtgcctacctctgccatccttggcagttgcattttatggtaagaaaacatcaagatggcaccactcactgaaaggaggctccaagttgggaaccagaggtaccagcttagattccttaatccctaagaaggcctccctctcaaagacaaagaccccttccttggcctcaagtcctcattcttgttggttaaacacaattaattcttcatcattatcacctgcctgttttttgacttgcccagagctctgaaggaaaccctggacactctgcggcaagcgcgaagagagggctgtgcagcccaggcccctgatcagcttctcccagcctttccctcccaaaggctatagcagggctgagtgccaacatggacctgcagaggcctgggaggggagcaaatggctggggttcttgtggcatttgggatgttcatgacagttagtgcaaagcatccatggcaggatctgttgtcacctctctccaccatccctggattgccaggctccagtggcctttctttcctctcttcttctctgccctccctccctccatttcctccctccctctctcttcctctctctccttctgtcttttcttccctcctgttttccctttttcttccttcacatctatgcctcctcccagtatctggcagccccatgtcctcagcctgtgctgggtgagtctgatgaactcagacaggatgtataggaggggctttcatcagttcatcctgggcagctgttctagaagtgactacgatggggcaaatgcatgggtacgtgtgtgtgagtatgcacaagtgcgtgtgtgtgcctgtgcatgcctgttgaccacatgtcttctctaagtttgtgtccataactccagaggaccccaggtgtgctctcgatgtcatgttcagggatcaagcacagctcctgctggtgggaattgcactgtgtgacactttcctcagggacctgggggtgtcagatcccagtagtctcccagtaggctttcagataggtcagaaagatgttctattgttgttttattttctttttttcatccatggttttactaccttcttcttcttagtgatttttcatgaagggacatctgggttggggaaaggtagctaataagaaatgatgtcaccataaaatagcaaagagtctcctggctctgtggggacagtcttcatatggtccctggcccagcctcgagggccctggtccagtcaccttatggcctctgtgctgtgtccctagatctgggctctgtgggaaagaccctgggagacccagcagaatggagtaccttgtgtgccaaatgtcccccctttactctggctctatgactctttctccctgtgtcctggaggagaggacctgtctggagaagaccctcagggcctggccctgtcgattaagataggagggaagggtctgtggcctgaggcagggcattggaagggaattttgagcactgctgctcaggtgcctggtcactgggacccagtgtttcccttgtcagcaggggcctggtcagtgggactgtggtcaggggactattgatcagtgtggcctattctgtgaggacatggttagggggaacctggtcagtgggaacatttttagggggatcagtcagtggggaccaggtcagtgaggacctggtgagcggaggcctggtcagtgggacctgggcatcggggcctgttcagtggggacctgctcagtggagatgttttcactgtggtccccctcagtgggacctagacagtgggggcctgatcagcgagacctggtcagtggcaacctgatctgtgggaacgtggtcactggggacctggttaatagaaacctggtcagtgatggcctaatgagtgaggtcttgatgagtggggaaccttgtcagtgaaggcctactcagtggggttagtcacttttgacctgacagtgagcacctggccactttggccttgccagtgggggcttggtaagaggggcctgatcagtgtgggcctgcttagtggacctagtcagttgggacattgtcagtgaggtctatttagtggggtcctggtcaccatgggctgggtccctgatgaccaggtcatggggctctattcagtggaggcctggtcacatgggacctagtcagcagggcctggtgggcatgtcctcatcagtgaagcccttgtcagtgggtccatggttagggcatcctggtcaatggatcataatcagcaagggcctggtcagaagagaattggtcagaggggacttggtcagtggtggcttttgtagcactggtctaatcagtggtgacctggtcagcggggatctgagcagtgagtgcctgttcagtggggcctactcactagggttctagtcatggacatctggccacctcaggcctggccagtaggggcctcatctgtgggaccaggcaatggggtcatgattggtggaacctggtgactgaggccttgtcagtaaggacctggtcagtggagtcctggtcagttaggccttgtcagtaaggtcctgggcagtgggtcctggtcagtgggttctggtcattgtgggcctggcagtgggggcctggtaagtgtggcctggtgagtggggtataatcagtgagggtgtggctagggaggaccagctgtgcagggtctggtcagcagggacctggtcagtgggggctgctgagcattgctgggagatgtcaggtgtaacatgtgttattgatggtcctgtagacacctgggatggcccagtggtgcccaacagcccagttaaaagtggacaaggcaggtgtttggatggacttgggaggtcttgctcagagattccgacagaataaaggtaaagaagggccagagtggctggagagatggtcacagtctgtgggctacacaggatggaggaagtcagggtgttcccaggcaaggtgggtagctgggatgcagggagaggcaggtggatgctgagaggtcagatcctgcgagggctctgggggcatcaggtaggatgggctcttgtagggtccatccccacagggtctgtgggtctctccccgtgtgcagagatgagagagtgtagaaataaagatacaagacaaagagataaaagaaaaggcagctgagcccgggggaccactgccaccaagtcactgagaccggtagtggccccaaatgccaggctgcactgatatttattggatacaatacaaaggggcaggataaggagagtgagccatctccaatcataggtaaggccacgtgggtcatgtgtccactggacagggggcccttcccttcctggcagctgaggcagagagagagaggagacaaagagaaagacagcttatgccattatttctgcatatcagagacttttagtactttcactaatttactactgctacctagcaggcagagccaggtgtacaggatggaacatgaaggtggactaggagcgtgaccactgaagcacagcatcacagggagatggttaggcctctggataactgctggtgagcctgactaatgtcaggccctccacaagaggtggaggagtagtcttctctaaactcccccggggaaagggagactccctttcccggtctgctaagtagtgggtgttttcccttgacacttacgctaccgctagaccacggtccacctggcaatgggcatcttcccagaagctggcattaccgctagaccaaggagtgctctggtggccctgtctgggcataacagaaggctcgcactcttgtcttctggtcactcctcactatgtcccctcagctcctatctctgtatggcctggtttttcctaggttatgattatagagagagaattattttaatattggaataaataattgctacaaactaatgattaatgatattaatatataatcatatctaagatctatatctagtataactattcttgttttatattttattatactggaacagctcgtgtcctcggtctcttgcctcggcacctgggtggcttgccgcccacaggctctgtgcaccatcagtgcactgggcaggtctcagcccaggctccctggaccctggccaggtgatgtggtcactccatgggggactgctgtcatgccctggccacccaccctgggcagcacagtcttatctcatgattggcctttctctgatcctgcagagggcacagctcgcagcccaggaggggcagtcccagggtgcagcttgagttctccacgggcctgaagcatcccctgccagccctgtactttctcttctcccaggtctcgcttttccagtgtcacccagcaggaaggccccatcctcccttccttgtgtgtctcctaggctgagacctgtggtggatggggacagggagagtacttcctcaggtccacttggggaggagacttgctcccagcctggtgaaggtagtcagctttaccttggttgccttagaatgagatggatctgcccccttttagtgccctcaaggtgaaggtgagagacggtccctgctgtgcaggaggttggtttagggatggaggacttggcaggtcctcccagactgtcaggcttgggcagcactatccaatttcaggactcagaaagtccagccctgagacgggactgtgctgcccagggtgggtggccagggcctgacagcagtaccccagggagtgaccacatcacccggctggggtccagggagcctgggctgagacctgcccagtgtgctgagggtgcacctggagcccaccccacctgacactcccacatcctcacaggttcttctctcctagcatgcacttgcctttccctgctcctcagcagcccactctgcctcttccctgacttcctccatggtgtccagcaggatgggctggacaggggggcagcctgtgtgcacattttgtggaagtgggactaacacacactccctgggaggcaccatggttcctgccaaatccaaccccagaactctgtccctgaggtggttttactaaaccctaaactcagaactgtggctgtggctcaggggtcagcacctgctagtgccaagacactactgggagtgtgggaccttagcaaaccccatggtgtctggcctgaggacagggtgtcttggggctgagacaaacactggggctgagaccgtctgacccaactggccaccaatggccattgggtcagatgatctcagccccagtgtttgtccttccctggctccttctggttcagtcccatcaaggccctggagcccaaatcccatcatcaaacatcccctccaggaatcctggccactcaattcactttatcgtgtttcatcgtagagcaaaaatgacagaacagatgcatagaaaaatggcttcagttgcttaatgactagaagaaatctgggagaagcaagaaggtaatgtggagagggagagacctccatgatcactctctgcagagccaggggcacaggcacccagtgcagaggcctgatgccacctgcctctcagagggtgtgtggcacactgtcattacccggaagacatcaggtctggtcaccagcttttctgcctgtcctgtaagcatcaagttttggaagagaatctcatgccagggcctggaacacacctggctcaggggttaggggttgccccttggtaatctaaatgaaaaaaataggtccagatcagagttcctaatgcggagcactcatccactctttgaattgtaaaaggggaggcctggtcctaggtatacctaagatctttgaggaactgaagatcccaagattctggaaaattccagagtcctcaggccctaatcctccctgtcctcctgtggcctgtcccatcagcacactcttctatctgtagatgttttggctgctctgtaagggagtccccctgcaggtttggggctgggcatggtcacccctgctgcatgtcgagaaggtgaaagccaagaacacagggtacagtgtttccacgctcatccagagcaggacaaacaggccaggttgtgtcaggagcccaagtatccagttggtgcaaatgtcaaacctgctgtggaaggaggggtccattgcccatcctaggtacagatggtaatgtagcgcaggtaagctgggcttggtagccctccctagctttggaaataagccaaacaaggagctttctggagaatgaaatctcttttccttccagaagcactcctgaatttttggtgattgccatttgtggcagtgagtttttgtctgttctggggctgggctggtttctctgattggccctgccctacagagcataaaggaaaagtgcaagaggtccccagcaaaaatgtgcagatagccctggacataagccacattctgagaaacatgtcatgttctgagaaggctaaggcatcaagtaaatcatatgggactggaggatcccagggtaggtggggcagttcagagcagtgcgggcttccctgggaattgggagaggcaggggttccagaggagggaatcacagggccaccaagggctctcttggccctgggagaagtcaacataatggattgaacacctgctgggcttcaagccctgggccaggctggggcatgtggagctaggaggcagctcaaattgggaggcagagagagaagtgtgctgagacggcgccgtttctgggtgtaatatggtcctgagattctgtatgggaagtgcttccagggtttcatatgttatggggttgcttcctctccccagcctcaccctgcaggaatcccagtgactatatcgccaccatcttggagctcagtgccctcataatgtaacggcaacagcagatcttcctgcacagggactttctgtactacgtcactgctgaggggtggtgcttctgcagggcctgtgttgtggtgcacaacttcagacaccatcatcctggagcagcactgcaccctcactagccagggagttaataacttcctgaaggtcacagccacattcaagactttggacttcattgatgtgcttgtgctggacaaggtgggcttctctgggatcttaattcaggaggtaggatagagcttgacataaaattcagataaaagaacttgaccttcatctggagggctctggggagccatggaagttgctggaagaaaggtgggaaaactcagataagcttcagtgatgcctgtagaaggctgtctggaaggaataaacaagaggcaggaaaccagggagggagcttgtggggcagatcttgagatagcaagggagggttcctgcttggatgatagttcttcaggggctgtctctgtcttcaggtgtcttcagagctagtgtgttcattggtcttgtctccaggtgaaattgggaagttgtcagataagcacataaaagtggaagctgacatcttcatgagtgctggtgggggtcctggtgtgggactactgtgggaacagggatctctcaatcccagggatgtggtggatgggccctggattactccatcctctatgcttcctttcccctcctcccattctcccgacggcctcagtgcaaaggcactgttcatcctctggtgctgaagcagcctagagtctcaagcctgctggcggcctcgcaggatatgacagcacagccagtggcctcttctgggtcctgtacatcttcacaagacaagtagacatcaggagtgctgccagcacttggtgcaggagttctgagggaccacagtcctgaagacattgaatggtgggtgcagggccttatgtcctgtttcccaccccttctcattggttctgctccaggtggggaagggggaaaaagtttttgccaattctaccattattgccttgcagaaaaaggagcagaggccagaagcagggactggtacccacccgggctaataagggagaatttgtaggctttgtggaaagatctgggagtccatatctgttgtcccactaacttgctacgagacattagtaaaatcagttttttttatgaactacatttctgccatctgtaaattggggcgagatttttctaccccatggggttgcttggataattggtgatggtgtgtgtagagcaggtgccacctggcaggcattcggtgtccagccactgctcttcccccttgctcttctgcctaagtttgcattttcttctcaagaccttcactctccctaatttttctcttacctctgattcccaccttatagtctattccatggattcaccaggatctaagtaggtgacagtaatgtatgcatgtatgcgtatatagggatgtacaccctcacacaccacacctcaacatagtaggtgctcagtgaacatcacactgcagaagcagtgctggtagatctagagtttcacctcaacttgcagttgaaaaatctgagtatctgaaagggcaaatggaagggtgaagtcatggtggcccagtgcccttcctatttgacctggaacaggtgtctcaggatgtttggacaccacattttcaattttgggctggctgcttggtcgggaggaggtggacaagaattagaggctcttcccacaccctccaagccttccccagggtacaagaacagaccagggcaaagaagtcctggagcaggggagagacctttccatagcagaagccatttctgactcagtctctcccagccttttccattctgcctcttccccttgttgtccctgggtcttctatctgctctcagtccatttgcccatccctgagttcttcctgccctgccccagcaccttctcctctgcccctctccaccagccctgcagatccctgggtcctttcttgagcctcaggaactcaccttccatctcatcttccctgaagaatgtcactgctgagcctgtcctggctgggtctcaggtgagtggcagcatccccttgactgctcctgctggctcctggtctggacctacactttctatgacaactgctggtatctctagtgttttctgtagcctctgatttggaactggtttggaggtcacctgggcctggtgactgtagcagcaggctggctctaaggtctcagagtagatcgacttcctgaggggccaggagtggagctctgggagttggggtgagggcatgggctggcatctgggatggcagagaagtgaggaaggtggcttattcattcctctgctgtgccactcaacacctttgtcacctccttgttctctcatcctggcccatatcactcccttcctgcccatgttcctcacattcttgtacccctgaggggctccatggttctgcatagagcatggaacccctggcgtttctacattgatcactactggacttgaagcctcctgaggggcatggtccagtgccttggcccattttctgttatgggacacatgggctggaagagcagtgtgtgtgttctccaccctccctcccagagcatcaagctcttatcttgcctctgctcactaagatgtccccgtgtgtcctgttgcagaggctgaacgaaagctggccactctcttcccctttcagagccttctttggtcttccttccctcctcagacctctgagtcacatctgctctcccattttgggggtgtggcctcagcccatttgtaaatggtaggattgatgggcatgccagttgcagtgggagggtgcacagcacgcactagtgcagagcctggcatgcagaaactgctcccaggtgggagctgccatcctgagggacagttacaatcaacttgtctccactggaggctgctgagaagggaaggtccctggtgtatagaccctgctccctgaggaatcagagctcatggacacccacaaaaacatgaaaggatgtgggttcacatcctgaggccacactgcttaccacagtctcatatggctgtccctgggttgaaaccaaccccaggataagaaaatcttttcctgtagccaaggtgtgtctccctgttggaagagtcttctctccctgctcttggctgtacccttaggtattggaggtgtccctgagagaaaagaagtaggaggaagcagagattccctggatttctacacaatccagacctgctgttcattcggagtctggtccttccacagaggctgcagagggaacctgtgcattactcatggttttccttaatccagaatcaataggatatatttatatctactacctatctatcatttgtcaactatccatccatctctatacctatctacctatctatctgtatccatctatggagagacaaaaaaaaagaagagagaaaaaagaattgactgtggaaatgggctcatgtgatcatggaagtagagaagtcccacgatataccatctgtgggctgcaggaccggggatgttgggggtgtaattcagtctgaatccaggggcctgagaacctggacttttgatgtccaaaggcagaagatggatgcccgaaggcagaagatggatgccccagctccagaagagagtgagttctcccttccttcaactttttgttatattcagcttctcagtggattggatgatatgcgcccacattggggagggcaaatcttccttagtttactaatttaaatgtgaagcttttctgaaacaccatcctagacacacccaaagattgtgtttgaccagtgatgtgggtatccctcagcccaggcaagttgacacctgaaattaaccctcacagaatgtgactgtccctgctttgcatgcaggtcacccccacagagcaaggcttgaggattctgactcagctggtggccaccttcacatgaggctttatgaggtggacaggtctcatctttcctatcatcagtttgtgccccgacattggccatcaatgctacaggtgcccatgcagagcttgtggtggtgggcaccatggcacataagagggcttctagttctttcaatcccaagcttttatgaggcccctgcagtgccccacccctcctttcctctcctctctcagctttcttcctctttcctgtgtattcggcaacctccaactccatggctcccccatccactgctatcatcccctgccctcgtgttctgggtactgctgggtcctaagtggcctgaatccaaggccccatcctggaggaactcctaagtctgagaaggtgaagctggacaaagacatctccaatttcacgggggtcagaaatggagctaagggagatgggctctgagaaccagaggagaataaggtctctgtgggggcaggctggaaggctttttggaggaacggttgctggagcagggcctggaatgatgactaggaattgttaaatcagaaggcagggtgattccacgggcatcattagtgtcccaggccccctgccaggactaacattggcatttccagtccccacacccagaacagtagaaggacttgtggctgctggaggatctgggttgctgtttacatagcatccaggtctggtgggtcagtttcttctacccctacctgtgaaccttggtctcctgccacaggcaccaggaatctttaataggagaccccttcccagcctgctacacttccctgggagctagggactgtacagccacaccgggcccagcgcagggcctgttgggaaggcactggcctccagggtatgaccccggcctcctatttagcaacactgcttttttcctccggcctgcctcaatgtcccagtgaaagcctgcaagcctggcgtcctgtccctgtcacccggggaggcttcttgccactttggggtgctccccatgggcgagacacgcaccctggggtggcagccagggactccatggcccccccgggtctggcccaaggcctgctgggaaggcactggcccccgggggaggacagcagcctctgcttcgctttgctgcctttttaccttggcctccctcaatgtccccctgaaagcctgcaagactggcatcctgtttccgtcacatgggggaacttcttgtcgctttgggatgcccccacatcggagtgacatgcaccctggggtgaaagcaaaagactccacggcgccccgccctcaggtctggcgcatggcgtgcaaggaaggcagtggtgtccggggtaggaccccagcctcctatttggtctcgccgctctttttttccatgtcctgcctcaacgtcctcctgaaagcctgcaagcctgatgtcctgtccctgtcacccagggggaatccttgctctttgggatacccccatggcagagacacgcaccctggggtgggaaccaaggactccatggccaccccgggtccagcgcagggcctgccgggaaggcactggcctccgggggaagaccccagcctcttcgaactcgctgcttttttcccctggcctgcctttatgtccccctgcaagcctggcgtactgaccccatcacccggggggacttattgcctctttggggtgctctccacgcacccttgggtgggaactagagactccatggccttctctgatcccgcgcagggcgtgccaggaaggcactggcctctggaggatgaccccagcctcctcttcagcctcacccctttttttccctggcctgcctcaacgttcccctgaaagcctgcaagcctggcatcctgtccccatcacctgcggggaagcattggggtgttccccacctaccgtggggtgggagccagggacttcacagctcccccacccccctgtctggcgcagcacctgctgggaaggcaatggcctgcgggggaggaatccagcctcctattccgcctcgccgcttttttttcccagccggcctcaatgtccctctgaaagtctgcaaacttggcgtcctgtccccatcacccggggggactccttgctgctttggggtgcaccccacccaccctgatgtgggagacagggactccacggcccccctgggcccggcgcagggcctgccgggaaggcactggcctccgggagaggaccccagcctccttttcggccttgcaggttttttgccctggcctgcctcagtgtccaactgaaagactggcgtcctctccccgtcacacgaggggcttcttaccactttggggtgccccccacgcaccctggcatggaagccagggactccacgaccccccgggtccgacgcagggcttgcggggaaggccctggcctccggggatggactccagcctcctcctcagattcgcttctttttttccccgccctgcctcaacgtttccctgaaagcctgcaagcctggcgtcgtgcaatgtcacccgggaggacttcttgccactttcgggtaccacctgtgggaaaaacaggtaccctggggtggaagccagggcctctacacaccactctgccaagatctggcgcagggcctgacgggaaggcactggcctccgagggaccaccccagcctcctcttcggcctctccgccttttttccccagcctgcctcaatgtccttctgaaagcatgtaagcctggcatcctgtctccgtcacccggggcgacttcatgccgttttggggtgccccccacgcaccctggggtgggagccagggactccattgcttccagggtctgccaggaaggctctggcctttgggggaggaccccagcttcctcttcagcctcgtcgattttttcctcggcctgcctcaacgttcccctgaaagcctgcaagactggcgtcctgcccccatcactcggagaaatttcttgctgctttgggtgcccccccgtaggagagacacccaccctggtgtgggtgccagggagtccacggccccccacgggtccagcgcagaatctgatgggaaggcactggccttcaggagacgacctcagcctcctcttcggcctcgctactttttatccatggcttgcctcaacgtccccctgaaagcctgcaagcctggcgtcctgtccccgtcacccagggggatttcttgccgctttggggtgctcccgtgggagagatgtgcaccctaggatgggagccaggaacaccacaacccccgccccggtgaacagggcaggactagccgggacggcactggcctctgggggggacgatcccagcctcctcttcagcctcgccactttttttttctggcctgcctcaacgtccctctgcaagcctgcaagactgacctcctgttgctgtcacctggggggacttcttgtcattttggggtgcccctcacacaccctgagatgggagccagggattccacgtcccccttcccccacccggtccggcgcagggcctgttgaaaaggcactagcttccaggggaggaccccagcctcctctatggcctcgctgcttttttttctcggtcggcctcaatgtccccctgaaaacctgcaagcctggcatcctgtccccgtcacaccgggagactttttgccgctttggggtgcccacaacccaccctggcgtcggagccagggactccacattccccccacgagtctggcgcagggcctaccaggaaggcactggcatccaggggaggaccgcagcctcctctttggtggcgccactatttttccgcggcctgtgtcaacgttttcttgaaagcctgcgagcctggagtccagtccccctcacttgggggtaattcttgccgccaaggggtgccccgcttgggagagacacgcaccctggggtgggagccggaaactccaccgattcccgggtccgacgcagggcctgccaggaaggcactggcctccaagggatgatcccagcctcctcttcggcctgccttaacgtccccctgaaagcctgcaagcctggtgttctgtccctgtcacacgaggggacttcttgccgctctgcggtgccccccaggcaccctggggtggaagctaaggactccaatgtaccccaggatccggcgtagggcctaccaggaaggaagtggcctccgtggaaagaccctagcctcctcttcagattcgctgcttttttcccccggcctgcctcaacgtttccctgaaagcctgcaaggctgacatcctgccccatcactctgggggacttcttgctgctttggggtgcaacgtgtggcaaagacaggtaccctggtatgggagccaaggactccgcagcaaccccagatctagtgcagttcctgctgggaaggcactggcctccgggggcaccccagccacctcttcagcctcactgcttttctttcccggcctgcctcaacgtccccctgcaagcctgaaagcctggcgtcctgtccccattacctggggggatcttctttccactttggttgccccacacacaccctgggtgggagccagggactccacggctcccccgggtatggcacagcgcctgctgggaaggaagttacatccacgaccctagtctcgtcatccgtctcactgcttttttccccaggtctgcctcaacttccctctgaaagcctgcaagcttgatgtcctgtacccgtcacccggggagacttcttgcccattttgggtgccccccatgcagcctgaggtgggagtgagggactccacggctcctcagggtccacgcagggcctgctgggaaggcactggcctctaggggacggccccagcctcctctttggcctcaccactttctttctccggtctgcctcagtgtccctctgaaagcctgcaagtctggcctcttatccccgtcacccggtgacactttgtgccgcttttgggtgcccaccacggaccgcggggtcagagcgaggaactccaaggctccccagagaccggcgcagggccagctgggaaggcactggcttccggtgagcgacctcagcttccattttggcatcgccgcttttttccccaggcctgcctcaacgtccccctgaaagccggcaagcctggggtcccgtccccgtcattcgggaagacttcttgccactttggggtgcactttacgcaccctggggtgaaagccagaaactccacggccttcccaagtctggggcagggcctgctgggaaggcactggcctctagggaaagactccagcctcctcttcggcttctccactttttttctcctgcctgcctcaacgtttccttgaaatcatacaagcctagtgtcctgccccgtcaccgggggggacttcttgccgccttggggtaccacccgtgggaaagacacgtatgctggagtgggagccagggcccccatggcccccatgaatctgccgcagggcctgccacgaaggcactggcccctggaggacaaccccagcctcctctttggcctcgcagtttttcttccccggcctgcctcaacatccttctgaaagcctgtaagcttggtgtcctgtccccatcatccaggaagatttcttgccgcttttgggtgccccccacccacactggggtgggagcgagggactccacgactccccagggaatggcacggggcctgccaggaaagcactggcctccgggggacaatcccagcttcctcttctgcctcgtcgcttttttccctcggcttgcctcagcgtccccctggaagcctggcgtcctgtatttgtcaccctatgggacttctagctgctttggggtaccctcgtgggagagactagcactcaggagtgggagccaaggaatccacagccccccaccccccgttaaggtgcagggcgtgccgaaaaggcactggcctccgggggaggactccagcctcctctttggccttgccgctttaattccctagcctgcctcaacgtccccctgaaaggttgcaaggctggcgtcctgtcccggtcaggcggggggagttcttcccgcttttgggtgggccccacacaccctgaggtaaaagccagaaactctacagccccccagggtcccgcacagggcctggcaataaggcactggcctccgagggaggaccccaacctcctctttggccttgccccttgttttccctggcccgtctcaatgcttccctgaaagcttgcaagcctggagtcctgtccccatcacccagggggacttcttgccactttgggttgccttccacgcaccctggggtgggagccagggactccacgcacccccccgcccccagtccagcacaggtcctaccaggaaggcactggcatccaggggaggaccccagcctcctcttcagtctcgccactatttttccgaggcctgcctcaatgttttcctgcaagcctgcaagcctggcgtcctgtccccatcactcagggggaattcttgccgccgaggggtgccccacgcagcacagacacgcatcctggggtggaagccggaaacgccaccaattcccgggtgcggcgcagggcctgctgggaaggcactggcctacgggagatgaacccagcctcctctttggcctcgctactttgtttcccggcctgccttaacgtccccttgaaagcctgcaagcctggcatcctgtccccttcacccgggggtatttcttgcctctctggggtgccccccacgcactctgaggtggaagccagggactccacggtaccacagggactggcgcagggcctgccaggaaggaactggcctccagggaaagatcccagcctcctcttcggagtcactgcttttcccccccagcctgcctcaacctttccctgaaagcctgcaagtttgacgtcctgccccatcacccagagggacttcttgccgctttggggtgcaacctgtcggaaagacacgtaaccccggtgtaggagccaaggactccaagctccccgctcccttcggatccagtgcagttcctgccaggaaggcattggcctctggggaaggaccccagcctcctcttctgcctgcctgctttttttttcttggtctgcctcagcgatcccctgaaagcctgcaagcctggcgtcctgtccctgtctctcgaagggacttcttgccgccttgtggtgcccacgaggcgccctgggttgaaagccagcaactccacagcaccccgggttcaggcgcagggcctgctgggaaggcactggcttccgcgggacgaccccagccttctctttggcctcaccgctttttttccccaccctgccttgttgtgaccaagtgagttatagagaaacgccacattttgagacaaattaaagagtcctttaatagccggcgaccgagaggcagctaactttcaaaattctcttggccccgaggaaggtgctagttttgtttttataccgtggtctaaataggggatggggaattttagctgaagcaatttttacaggagaactggcaaaaagttaaaaaattaattggttacaaatgcagttacaaaaaataaacagttccaggtgcagaggcttaaactaccacaaagagataaatgcaggggttttgggtgccatccaccgagcgcatccccaggagctgctggtgcagcttgcctcaatatcttatcagtagatgcattcctggatgtgctttgagtcagttttacactagttatgccttaagggagggcggtgaaagggggttgcaaatgaagaaactgaaacggaatctgttcggctctctctctgctaggagagagtcactcagttaaaaaaaaggtagggtatcacattccccactcatgttttggggaatcaaatcattgattcttcagttataccaagggggttatactcggttctgagatacataagtttgacagaagctatgcactgttttacaaagttaaggaaccaatttaacatacaagtcctgaagattaaacttaacaagaggaggagaaggggtcctgccagtacagtaatcagaatagttagccatggattccagttgaacatgctttgataccagggggtgttactttctcgttcttgttggagtctatctatattttctcgaactctttggagggtatcttttatgactccagactgattggcatagaaaaagcaacactctcctagggctgcacataattctccttgggaaggaaatagtagatctaagccttggtggtttttgaagaactacttcagctagagactctacctgggtatgtaacatatttatggctgactagagattgcttaaatcagcatctacttgctgagacagggacattaatccagtttctccctgaactagggcagccatgccaatgcctgctgacccagctatgctaaggctagctaggaggggtactaagagtggggcagcttggcgaaacttggaaggcaattcagggggagcaataagaagttctccttctggcccactgtacacatagacctggcggagtacatgaactaacacacacagaagaggtccatgttcagtcccattgatgcagtgagtgaggcctgaagtacaagccaaccaggtgttgttaggtgcctggtaggaaactgaggtgtttaaggaagtaagtagcgattgattacaggtggcctgaaagggagaagcagataagttatacccattgctaattagacaggaggcattcccctacatgtctcctaatgtaagggcatggggtcgtgtatgacaaaagagagagttaaccttgaacatggcctctactcctaaaccaacattatatggggattttgctgtcaggcacaaccaacaatcttgggctagttttggctgggtgaggttaaggaggtgatgcactccatccagaatggacatcaggccgggttggagatgctgtcgttgtaattgggatttaggaaccaagagtggtgggacagttaaatcgaccctgtctgggtgtttttggaacatagggtcacctaaatcagttagaggtccgattggcttaggagggctccacgggaccaggacatttttctgaatggtgaacatagttccaacatcaaatcctgagatataaagtcttaatccccattacatgccataataccattgagctgaattagggttacggacagttataggaagagggttgcagttccttagagtgcacggtctaggacaggaagagcgagttatggagagggttgaggactgggttgatcctccagagtaagtggccagggttacacacaagcagttagggcagaaaaactgataggaatctcaacaactgggtcagggtgatttccagtacaggggtaaaaatcaacgctctggagtcctttttctgcacctttagagctccctcatccagtccggcttcctgtgtgtccgaatcctgcagccaggtcaatgtttcctgctcctatgaccagcagattgcattgcttttcatgggtatgggcaggctctgggaataagcacataaatcaactgcaaaagagacttttttggagcttcctgccttccaagtagtgtttgcaaatacacgtcctgtcatgaaagaagtaaggagaaaagagtaggatggagcagaaggcatgacaggcgggaacacacaaaagaggtaaataaaaggaattaatttgatggcttcaagtgacttaggtgcagttttaaggggcctggcccaggcttggggatccatgtttcttgctgggctttgctagcctttttgatgagagagtgatgaatccaggcaggaatgccatccacctttagagctgtcagcgtggtgaggatgacagtatgagtcctttccaggcaggaatgaatccttctttctggaactttttatcgtacaccaggtcacccggctggaaagagtggcagggtcccatctggtcaggaactggatttgggcgtgctccctggacaagtgcctggatgatgtctcgtacctgttggagagactgcatgtactgtaataagttagcttgagagatttctgctaaatgagtgtctctcaacctaggcaggataggtggagcccttccatacataatttcaaaaggtataaacccagctcagtaaggggtgcatgttactctaagaagggctaaacgaaggattctcacccaattctcacccatttctagaatcaattttgtaagagtattttttagggtgtggttcatgcgttctatctatccagagctctggggtcggtaggcacaatggagtttccatttgatgtttaatgccttgctgaccaactgatgtatggactaggtgaaggctggcccattatcagaccctatggcaacaggcaacccatgtcttgggatgatttcatttagtaaaaacttaactaccctagtggcagttttgtttctggtggcaaatgcctcagtccacccacaaaagatgtctactagcaccaggaggttcttataccctgcccagtgtggtttaatttctgtaaagtcaatttcccacctttctcctggtgagtctctgcagagatggtggcctgggctgggtttgggaccttgcttggcatttacctgagcacaagccatacactggagagctgcttggttagctaagtcctgagggtgggggatcttgaaacagctccttagaagctgggccaattttactcctcccaaatgggtggtagaatgtagacgattgactagagttttcccaagggcttggggtctgaagattctggaatcaggaataatccaccaaccttcctgatttttattagcctaaagatctgaagcctgtttgtcttcttctgtggagtattttgggtgatttggcaagtcaggctgcagaaaagacatggcgggcagtaggaccaagggcacgactgagagctgaacagcttctcggggctgcagagtctgctttggttaccacgggcaatggctgtgttttctctttgatgtcctttgcagtgaattacagccacctgctgaggaagccaaacagcttcaagaaaggctaaaatttcttctttgtttttaatagactttcctgctgaggtgagtagcccatgctcttgacagatggctccatgtacatgtacagtagcaaaagcatatctgctgtcagtgttaatgttaatacatttgtccttaccccatgggagagcctgagtgagggccatcagttcagccttctgggctgaagtatttgctggcaatgcctgggcccatagcacatccaactccatggtaatggccgcaccagccttctgtactccttgttcaaggacgctgctatcgtctgtaaataaggtgacctccactttctttaggggcacatcttggagatcaggtcggccagttttggtagtttctaacagttcctggcagtcatggacaggtgtagtgaactctggatcaggaagtaaagtagctggatttaaacaccttgtgggagagaagtcaaatgaggctgatctaacagtaaactctgatactgtaggatacgagcatttgacatccatttgctagaagcactttgtagcaaagtctctacagcatgtggagctgtaagggttaaattttggcctagagtcaatttgtcagcctcttggactaggcttgctgttgctgccatgactcacagacagcttggccatccagaggccatagggtccagtctctcagacaaataggctactgggcgtctccagggtcctaaagtctgagtgagcgcccccttagcaactccctggctttcatgaataaaaaggtgaaatggttttgagatatcagggagggctagagcgggggcctcagttagtgcctttttcaggtttttgaaagcctgttcttcagtgtcagtccaaactagtgggccattccttccagtagtggtgtacaggactttggcaatttctgcaaaccctaatatctacaggcgacagtatcccacagcccccaggaattcacgtacctgtcttttggtggtgggagtggggattcgcagaatggcttccttataagcactggtgagtgcccattttcctttatctcataccctaggtaggagactctgtgaagacaaagctgggcctttttggctgagactcgaaacccgagttcctgaaggaggtaaagtaagtctctagtatgttgcaggcagctgtcagaggtttcagtagctaataaaaggtcatctatgtactgaagaagggtacaattagggtgtctggctcaaaatggtacaagatcctgttggatggcttccccaaaaagggtgggggaatttttaaaaccttgaggtaaccgagtccatgtcaattgggtggtgtctccttagccaggatctgtccattcaaaggaaaatataggttggcttttgagggccagaggaatagcaaagaaatcatcttttaagtcaaggacagtgtacactgtgtgttctggtgggagcaggctgagtaaagtataagggttagggactgtagggtggacagtgactgtccatctgttaacttcctttaaatcctgtacaggctggtagtcatttgttccgggtttttggaccagcaacaatggagtgttccaggtggactgacatggtgtaagtatgccagcctgtaacagttgctgaatatgggggttgattccttccctagcccattgactcataggatatgctttacctggactggcaaggcagtggccaggagttctactaccactggcggatggtgcttagccagtcccaggaggtttgactcagcccagacctgaggaaagagagtctgtaagcccagtaagagaggattagttttattctccagtggttgtgaaggtgaaactaagagatattcttctgacagaggggtggttagcaggagctgagcagtgggaggtgttgtgtctcttagcatgaggtgagcttgttgggctgagatggaaatagatgcctgcagcttgtggagcatgtctcttcctaggaggggaaagggacactctgtgaccatgaggaatgagtgggttactcttttctgtcctaaactcacctcttgtgagtgggtgacaggatattcttgaatcactccagtagccccttgtacagcaactttcttattagagacactgcctagcggaatctgcaataccaagtgttccaccccagtgtcaattaggaagtgtacaggctggccccctactgtggcggtcaccatgggctcccaggggccaagtggaaaggagccctggccccgtcactcatgagattcctccacaaaagggagggtgaggacttttttctcttctggtttttcctctggtcttaacgggcattcctttttccagtgtcccatctgcttgcaataagcgcattggtttttctccaggggagcccggtcccctttctggcttttttggtggggacctggggttccctgaccatttttctgtgacaggggcttttctttcttgacttcatgaatggcagccactatgatttttgcctgtctttttgatgctttgtcagcaggcttttcagctgcctgagctgcctgtttctgcttttcaaactctcagttgtcaaaaaccttttgggctatctctaaaagctgactgatgttcattccagcaaatccctctagcttttgcaattttcttttaatgtcaggggctgcctgagccacaaatgccaaattaagagcacagctattttcgggagccattgggtcaaaaggggtgtaagtctgataggcctcctggaggctttcctaaaatgctcctggtgacttgtcaggcccctggacaacttcagttgtcttagacaaatttatgggtttttgagtggctcctttgacacccacaaggagataccggtgaaaatcgtctaaggctctccttccacctgaggaatttgggtcctaattaggctgggtagagggaaaagcctcttcaatttggtctcaggcttcctcttctggcccaccagctgatgtaaggtaatactttctggcctcccttcccatacactccctctcttcagaggtgaaaagggttaaaagtagttgctgacagtcctcccaggtgcggcagtgagtctggagcacggactccattagtgaggtcaaaacctgtggcttttcagaaaaagggggattatgaggcttccagttgtacaggtcagaggtagaaaaagggacaaactaagaagggagctgagtgctctctcccaaatattttgggtctctctcagtgggaggaggggggctacctcctcctgccttggccacaatcgggaagctatgggtggagagcccacaggagatgtagtcgaggaaacaagggaagaatccgggggagaaggagggttatagggtggcagaactgggagaggaaaactttcctcttcctcagaagaaggcagtacaggaggagccgaggggactcagggtcagggtaaaaatgtggaccggctcaaaaggaccctggaaatgggatcatgaatggcacatgagtggagccagggaggagggccccgtaccaaatccagccactgatcaatgtagggaaactgattggggtgaccgggacttccagtaatgacctgccacacatcctgaacacatgtggggttaaatgacccttctgtgggccatctggttccaaactgtggccattctacttcacagagtgtccagagtttgcctttcttcaggcagactccataatcttctgagaagtctacagagaaattctgcagtatacattggagaggactctactctttacagggccaggaagaggagtttcctattttggaggcagtttaacaaggttgaacagagatattaaacccagcatggacagagaaattcacaacctgggggactggcatattggaagaagggaaataacacaaccagaaagagcaggaaaaccactacagctaagacttcctgccatatgaagtaggttttcttaagcttcaagatttaggggggaagattagcaaccaacccgaggcctccttggctggcaggacctagatgacctccttccttcccttgacatatagcccaggtatttttggtgtctccatgattcaaagacaaaaagttcaaactcggccctttctttcaagggttttaggagggagagcagggctaaatcttggaggctctggacttgctgtgacacaggaaaatgagatgtgtggggaagggataaggatgagggggaaagggcccacttggatctctcctaaggtaggagagtagccaccggggaacagaataggagtccagatggagtaaagcagtatgagcgtaggcttctctgcacagtcttctattcaaaggcacgggaaacgttacaggatgacagaaaaggtgggcaaggaggcctgcagggtgactattttggatccaccactgatctaatcgggaggctgtccagtcactagagtgtgggatgtggcaatctaaattccagcagactttatggtgccagaaattccaaatgggcgagtgtttcccacacttcttcccgtaacaacacttgatttctttctgacagaaaaggcaggactgggacggccagcccaaatgactgatgaggtatttgacctcctgtggtagaaaatcagcactgaggaccttgaagaatttctttcctagttgccttggacagcactggcgacctgactatgaaacttagactgacactaaacaagacaatagacaccgagcaggacaataaacataaaacaaacaacagaccctagggtataagaacaattatggcagtttttattaaatagacaaggggagggggtccggtgatgggatcagtcagatgcccgcctggccactctccctgaggggacttgggctcctcttagcattggcaggctggtataaacccccggctcggatcgagctatgctcagtgctgccttaagccttatgaggtcaccatggaactacaggtgcgggcccactcgaactccatagcttttgccgtggagctacaaactggaagttcaagtgcaagcccttgacttccccatccactcaccattcacacaaagtttataatagtttttttttttttgccataaaacagaagtcttatggaaacctgaacgtgaaagggaggagagatagagaaagagagagcagagagagagacagagagagagagagagagactagtctttaatggagaggccagcctgccagaaaccaggactcagtcctccagcatcctggaatatggattgagtcaagggagggcccccgtcagggccgcttccctcccagagagacacagaggcacctaacagaaaatcaggactctgtcctccagtgtgctggaatgcgggcagagtcaaagagggagggccctgtcagagccatttccctcccagagaaacagagtcagatatgacttaccttcccgggaccagaggactcaggagttgaatttttctgggcacacaccagtggtcgatccattcccctccagaagacagggtcttatggggccctggaacgtcttcagggggcgcctcccctataagtccactgtctgtctgggggaacctggaatgagtccggctcttgcccagtggcgaatatctcactggggcctccaaatgttgtgaccaagcgagttatagagaaacgccacactttgagacaaattagagtcctttattagccagtgaccaagaggcagctaacgctcaaaattctcttggccctgaggaaggggctagttttgtttttatactgtggtctaaataggggaggggggattttagctgaagcaattttttacagaagcagaactggcaaaaagttaaaaaattaattggttacaaatgcaattacaaaaaataaacagttccaggtgcaggggcttaaactatcacaaagagataaatgcaggggtcttgggtgccatccacccgagcgcatccccaggagctgctggtgcagcttgcctcaatatcttatcagtagacacattcctggacacactttgagtcagttttacactagttatgccttaagggagggaggtgaaagggggttgcaagtgaagaaactaaaatggagtctgttcggctctctctctgctaggagagtgccactcagtttaaaacaaggtagggtatcacagcctcaacgtccccctgaaagcctgaaagcctggcatcctgccccatcactcggaggggggaacttcttgctgcatggagtgccccccaagcaccctggtgtgcgagccaggtactccacggccctccagggtctggtgcagggcttactgggaaggcactggcatcctgggaaggaccccaacctcctcttctgtctagctgctttttatccttggcctgcctcaatgttcccctgaaagcctgcaggcctatcgtcctgtaactatcaccttgtgggacttcgtgccgtggagtcccccccgtcacctccgggagagagacatgcaccctggggtgaaagccagggactccacagcctgcccatgtttagcgcagggcctgccgggaaggcactggcctcgggggggatgaacccagcctcctcttctgcctcgctgctttttttcccccagcctgccacaacgtccccttgagagcctgcaaggcttgcgtcttgtccccgtcaccaggggtgacttcttgtcactttggggtgcccgccacgcaccttggggtgggagctattcactacacggcacccctgggtccactgcagggcctgccagaaaggcactggtttccgacggaggacccaaccctcctcttcagattcgctgcgtttttttcccgacctgcctcaacatccccttgaaagcctgcaagcctggtgtcctgacccatcaatccggggaaatttcttgccgcttttgggtaccacccataggaaagacacataccctggcatggaagccagggactccatggccccccggatctggcccaggacctgccgggaaggcactggcctccaggagatgactccagcctcctttttgccctcgacgcttttttttctctggcctccctaacgttcccctgaaagcctacgagcctggcatcctgcccctgtcacccagggggacttcttgacgctttggggtgctcctcatgcacgccggtttgggagccagaaactccacggccaacccctgttccagtgcagggcctgctggagtcactggcctcatcgggacggcaccagcctcctttcctgccttgctgctttttttccctggcttgcctcaatgtccttatgaaagcctgcaagcctggcgtcctgtccttgtcacatgcagggaattattgccactttggggtgccccccacccaccctggggtaggatccagggactccacggccctcccgggtttggcgcagggtccaccgggaaggtgctggcctccagtggacaaccccaggctcctattcggccttgccactttttttcccctgcctgcctcaacgtccccctgaaagcctgcaagactcgcgtcctctccctgtcacccgggggaatttttgtctctttgggggtgcccataatgcaccctggggtcagagccaggaactccacggccccctcaggtccagcacagggcctgttgggaaggcactggcctcccttggtcgaccccagcctcctcttccgcctcgctgcttttattcccccgcctgcctcaccgtccccctgaaagtctgcaatctggcctcctgtccctgtaacagggggtgacttcttgcctctttgggttgcctcccacgcaccctggggtggaagccagggactccacggccttcctgagtctggtgcagggcctgctggaaaggcactggcctctgaggggggaccccagcctcctctttggcctcgcctcttttcttctctggcctgcctcaacgtccccctgaaagcgtgcaagcctggcttcctgtccgcatcactcgggtggacttcttgctgctttttgttgcccccactacgtatcttggggtgggagccagggaccccacgaatcccccaagtctggcacagcatgcccagaaggcaatgtcctccgggggaagagcccagcctcctcttcggcctcactgcttttttatccaggcctgtctcaacgtccctctgaaagcctgcaagcttggcgtcctgtccttgtcatccgttgaggcattttgccggttttgggtgcccctcacacaccctcaggaggaagccagggacttcccggcttcccagggaccaatgcagggcctccctggacggcactggcctcagggggaaaactccaacctcctcttcggggcctcgccgctttttatccctggactgcctcaatgtccgcctgaaagcctgcaagcctggcgtcttgtctgtcacccggggagacttcttgccgctttggggtgcccccggtgagggagacgcacactggggtgaaagccagggactccacggcccgccatgttctgtcgcacagactgccaagaaggcacacacctccgggggaaaaccccagcctccttttcagcctccgctttttctccccagcccgcctcaacgtcccccgaaagtctgcaagcttggggtcctgtccccatcacccagggggacttcttgctgctttgggttgcctcccacgcaccctgggttgggagccaaataatcaacagcactcgcgtgtctggtgcaaggcctgccaggaaggcactggcctcaggggagaaccccagcttcctcttcagccttgccgcttttttcctggcctgcctcaacgtccccctgaaagcctgtaaacctggcatcctgtcactgtcacctggggaaactttgccgctttggggtgcccaacgtgcacccgtggagccagggactccacggcccctccgcctctggcgcagggcctgttgggagggcactggcttccggggaccacatcctcctcttcggtctcaccacttttttcccctggcctgcctcaacgtcccccctgaaagcctgcaagcctggcgtcctgtctccttcatacagggggacttcttgctgctttgtaatgccccccacgcaccctggggtgggagccagggactccttgccaactttattctccggcctgaatcaacggcccacagaaagcctgcaagcccggcgtcctgtccctgttacccgggtggacttcttgctgctttgaggtgcaccctgtggaacagacacacaccttggggtaggaaccagggaattcacacaccccccaccccctccctgggtccggcacaggttgagttgaacagcctgcggaaaaggtactggcctctgggagaggacccccaacctcctctttggcatcaccactttttttccatggcctgcctcaatgtccctttgaaaggctgcaagcttggcgttctgtcatcacgcagggggacttcttgctgttttggggtgcccccatgcaccatggcgtgagaatcagggactccacggccaccccgggtctggggcaggacctgttgaaaaggcactggcctccagggaaggaccccagcctcctcttcagccttgccacttttttttccctggcctgcctcagcgtccccctgaaaccctgcaaggctagcatcctgtaccagtcacatagcgaaaattcttgccgctttgggatgttcccccaaaccctgaggtgggaggcagggactccacggtcctccctggtctggtgcagttcctaatgggaaggcactggcttccggaggatgactcctgcctcctcttgggccttgctgctttttctccccagcctgcctcaatattcccctgaaagttcgcaagcctggcttcctgtccctgtcacccacagggacttcttgccactttggggtgcccccaggggagagacatgcaccctggggtgggagccaggaactccatggccccctgggtccaaagcagggcctaccatacaggcactggcctccaggggaggaccccagcctcctctttgttctcaccacttttttccccatcctgcctcaatgtccctgtgttggggaaaggctgagtgttgggaaaaaaactgaggcagggcttgcatgtgtgacataatgtaaaagggtcttggaacatgtccggggtccagggtctaaaaccccttatggcctttggaacaccaagctctgtgccaaagggtggaaggctgccctgccacaccataatctaagccctgggcatgaaaccactcgtggcttgcatagaatccaggacttagggcataaaacccctcctggcttctagaatgtgtctagacttgctggctccttgcttctagcactgctattatctcaagcagcagaacttgttccatatgcttcaaagaaaatactaaatcatcacagctgtagatcatgtgcaacccccctacatcctcgccacctgtttctttgtttgatcaccaatgaatagggtgggatcccagagctaggggccttcacatcctccatgctagcattggccccctgatcccactttatgcctttacttgtcttttctcattcctttgatttggccggacctcattgcccccacagctgggtgttgggtttgatcacctcaacagccctgaaagcctgcaagcattgcaacctgttcttgtcatccagggagacatcctgccacttaggggtactgcccatgcaccctatgatgagagcaagaaactccacggcatccctgggtccagcacagtgcctgccaggaagacactggccactggagaggatcccagcctcttccgccttgtcactttttctccccagcctgcctcaacatccccctgaaaccctgcaagcctggcgtcctgtccccgtcacctggcaggacatcttgctgctttgtggtgcccccaatgcatgctggtgtgggagccggagactccaaatctcccctgaggcactggcctctggggcaggaccccatcctcctcttctgcctcaccactttttttcctctgcttgcctcaacatccccctgaaagcctgcaagcctggcgtcttgtccccgtcacctgggggcacttcttgctgctttgttgtgccccctgtgggaaagacatcaaccctggtgtgaaagccatgggctccatggccccccagttctggtgcagggcctgataggaaggcactaaccttagggggatgactccagcctcctcttcagcctcgccactttctttccctggcctgcttcaaccctggtgtgaaagcctaccggaaaagcactggcttcagggtggggggaccccagcctcctctttggcctcacctctttttttccccagactgcctcaatgacctcctgaaaacctaaaagcctggcgtcctgtccccatcacccggggggcacttcttgccgctttggggtgccccccactcaccctggggtgggagccagggactcctctgcccgccccccctgttcagatgcaaggcatgctgaaaaggcacttgcctttgggggaggaccctagtctcctctttggccttgccgcttttttcccttggcctgcctcaaagtccccctgaaagcctgcaagcctagcgtcctgtcccgtcacctgggggaaattattgcccctttggggtgccacacgcaccctggggtggaagccagggaccccgtgccccccccccgggtcggggcaggccctgccaaaagaaccccggactcagagggaggatcccagcctcctcttcagccttgctgcatttttttttccggcctgcctcaaggttcccctgaaagcctggccgcctgtccctatctcctggggtacttcttgcctccttgtgctgcccccgtggggagaggaacatgcccttgttgggagccagggtctccacaactcccacgggtagggcataggaactgccgggaaggcactgacctcctgcgagggacccctccctcctcgtcagcctcgccgatttcttcccatgcctgccgcaacctccccctgaaggcctggcctcctctccttccacgggggacttcttaccactttggggtactccaggaggaaagacacgcaccctgtgtgggagccaacaactccacgaagcccctgggttaggcacgaaggctgtcgggaaggctttgacctctgatgggggatcctgacatcctccttggcctcgctgcttttttcctgggccttcctcaacctccccataaatgcctggctgcctgtccctgtatcccgggggacttcttgctgctttggtgtgcccccgggggaagagacacgcaccctggttggcagccagggacttcacgacccccctcccccaggtccggtgcgggggctgccgggaaggcactgacctctggcgggggaccccggcctcctattcaacgtcgatgttttcttcccgggtctgcctcaacctccccctgaaggcctggacgcctgtccccatcccccggggtacttcttgccactttggggtgccacaggaggggagactcgcaccctgggtggtagcctgtggcttcacgaacctccctcatgttggtcgcgggggctgccgggaaggcaatgacctccagtgggaaaccacgacctcctttttggcctccctgctttcttcccaggtctgcctcaacctcccccgaaggcctggccacctgttccattgccctgggggacttcttgccgctttggggtccccatggggggacctctgcactgacccctggcaggggaccctggcctcctcttcggccttgccgctttctttccaggcctgcctctacatcctcctgaaggcctggctgactgtccccctccccctggggtcttcttgctgctttgggttgcccccagagagaaaacatgcaccttgggtgggagccagagactccatgaaccccttggttgggcacggagactgtcgggatgggactgaccccaggcaggggacacaggcctcctcttcgacctggctgcttttctcccaggcctgcgtcaacctaaccctgaacgtctggccgcctgtcctcgacactgggggacttcttggcgctttggggtgcccccggggaaagaaacatgcaccctggttgggatccagggactccacaaccacccctcatcaggctcagggactgccgggaaggcactgacccctggtgggggacccaggcctcctctttggccttgccactttcttcccaggcctgcctcaacctcctcctaaaggcctggctgcctgtccccatccactgggggacttcttgatgctttggggtgccccaggaggggagacacccaccctgggtgggagccagggactccatgaaccccctggttcgggctggagggctgccagcaaggcatggacccccagcgtgggaccccagcctcttcttcagccttgccacttttttccctttcctgcctcaacttccccctgattccatataaccccgggttcaggcacggggtctgttgggaaggcacttacctctggccggggttcccggcctcttctttggcctcaccacttctttcaggactcccatgggttgggcactggggctactggaaaggccctgacccctggcgggggatcccggcctcctctttggcctctccgctttcttcctgggcctgcctcaatctccccctgaaggccgggcctcctgtccctgtccctctgggaacttcttgctgccttggggtgtccccgtatgggagagacgcaccctgggtggaagctagggactccatgaatgccccccggtcaggtgcggggactactgggaaggtactgacccctggcggggggcttcggcctcctctttggcctcgtgacttccttccccggcctgcctcaagcttcccctgaacacgtggccgcctgtccccgtctaccaggggagtttttgccagtttggggtgcccccgaaggggagagacatgcaccctggtggggaggaagcaactccatgactcccccgggttgggcgtggggactgccgggaagtcactgactgccggcaggggacctcggcctcctttttggccacattgctttcttcctgggcctgcctcaacctcccccggaaggcctggccacctgtacccatccccccagggacttcttgctgctttggcgtgcccccatggagagagacacacatacttgttggaagccatggactctacgacccccccagtttgggctgggggatgctgagaaggcactcacctctggtgggggaccctagcctcctctttggcctcgctgctttttttctaggcctgcctcaaactttcactgaaaccttggccgcctgtccccgtgccctgggggacttcttgcctctttggggtgccccaggaggagagacacacaccctgggtgggagccagggactccactacccacctgagtcaggtgtgggtgctgccaggaaggcactgacctccaatgggggacaccagcctcctcttcggcctagccacttttttctcatgcctgcctcaacctccccctggaggcctggccacctgtccttatcccccggggtacttcttgccacattacggtgcccacggaggggagacacacaccctagatgggagccagggactccacgaccccacggatcaggcatgggggctgcctagaaggcactgacttctgacgggggaccccggcctcctcttcagcatcgctgcttttttcctgggacacactcaactttcccctgaacgcctgtctgcctgtccccgtcttctgaaaatctttttgtcactttggggttcccccaggtggagagatacctaccctggttgggagccaggaactccacaacccactcgagtcaggcgcaaagtctgctggaaaggcactgaccttcgatgggggaccccggcctcctcttcggcctcactgcttttatccccggcctgcctcaacctccccctgaatgcctggccacctttccccatccccagggggagttcttgccactttggggtgcccctgggtggagagacatgcaccctggttgacagccagaaactccacgatcccccaggttttggcttggggactgctgggaaggcactgactttaggtgagaaatcctggcctcctctttggccttgctgctttcttcccaggcctgcctcaacctcccctgaaggtctggcagcctgtgcccgtccccctggggacttttgccactttgggttgtccccggggggagagacacaaatcctggttggaagccagggactccacgacccctccaggttgggcgcgggggctgctgggaaggcattgacctgtggtgggggacctcggcctcctttttggcctgctgctttcttcccaggcctgcctcaacctccctgcgaaggcctcgccacctgtcctcatccccagggggacttattgccaatttgtggtgacccaggaggggagacacacaccctgggtgggagccagggtctctacaaaccccctgggttgggtgcagtgtttctgggaaggcattgacctgccatgtgggaccccggcctcctcttcggcttccctgcatttttcccgagccttcctcaacctccccctgaaagcctggctccttgtctccttcttccagggaacttcttgccactttggtgggcccatggtgggagagatatgcaccctggttgggagccagggactccacgatcctcccacgttgagcatggggactaccgggaaggtccagacctccggcgggggaaccaggcttcctctttggcctcgacgctttcttcctgggtctgccccaacctctccctgaaggcctggctgcctgtccccatcccctgggagacttcctgccacttttgggtaccccaggaggagagacacataccctggatgggagagaaggactccaagaaccccccatgttggccgcaggggctgccaggaaggcactgactcttagcaggggacctttgcctcctcttcggccttgctgctttcatcccaagcctgcctcaacctccccgtgaaggcctggttgcctgtccccttcccctggaagacttcttgcctctttgttatgcccccggagaggagacacgcacccagggtgggagccaggaactccacgacaccaccggtttgggcacaagggctgccgggcaggcactgaactctggcaggtgaccctggccttttctttggcttcactgcttttctcccaggactgcctcaacctcccccagaaagcctggccacctgtcaacgtctgttggggtacttcttgcactttgggatgacctcgtggggagagacatgcaccctggttgggagccaggaactcaacgaatcccatggattgggcacaggggctgccaagaagacccggacctctgggggtggaacccagccccttctttggcctctccactttcttcacagacctgcctcaatctaccctgaaggcctggcctcctgtccctgtcccccgggggacttcttgctaccttggggaaggcactgaccttcagcaggggatcccagccaccattttggctttgctgctttcttcatgcacctgcttcaccctctccctgaaggtctggccacctgtcccattcccccaggggacttcttgctgctttggggtgcccctgcagggcagacaagcaccctgggtgggaaccagggactccacgactcccctggtttgggaacaggtgctgcctggaagacactgatctctggcaggggaccccggcctcctctttggccttgccacctttttcccaggcctccctcaacctccccttgaactccagacaggctgtccccatcacactagggaattcttgcctcattggagtgcccccagtgggggagacatactccctggttggaagccagagactccacgacccccttgattctggcctgggggacacagggaaagcactgatctcagtggggggaccccggcctcattttcagcctcaccactattttcccaggtgttcttcaacctcccccttaaggcctggccacctgtccccgttccctgggggacttcttgcctctttgtgatgtgtgaattcatctcacacagttaaaactttctcttgattcagcaggttggaaaaactctttgtagaatctgagaaaagacatttgaaaaatcatcgatgcctatagtgaaaaaccaaatatccccagataaatactagaaagaagctatctgtgaaacagctttctgatgtgtttactcatttcacagagttaaacctttgttttgattcaggaggttgaaaacacttcttgtagaatttgtgaagggagagttgggagctcattgcggcctacagtgaaaaacagaatgtccccagatacaaactagatagaagctatctgtgaaactgctttgtgataggtggattcattgcacagagttaaaactgtcttttgattcagcaagttggaaactctctttttgtagaaactgcaaggaaacatttgggagcctattggggcctattgggaaataccaaatatccaccaataaaaactagaaagaagctatttgtgaaaccaccttgtgtgtgtggatttatctcacagagttcaacacttctgttgacagaaaagattggaaacactctttttgtagaatctgcgaagggacatttggaagctcattgaggcctatagttaaaaaaaaaaaaaaaggaatatccccagataaatattggaaagaagctatttgagaaacgtctttgtgatgtgtagaatcatctcacaaagttaaacctttctctttattcagcaggttggaaacactatttctgtatgcactatgaagggactcttgggagcccattgaggcctataatgaaaaactgaatatccccaatgtaaactagaaataagctatctgtgaaactgctttgtgatgtgtggattcatctcagagaactaaacctttcttttgattcagcaattgaaagtactcttttttagaaactgcagagggacatttggaagcctattgaggcctatagggaaaaactgaatttccctcaataaaaactagaaagaagctatttgtggaactgctttttgatgtctggattcatctcagagagttaaacctttcttttgattcagcatattggaaacaccttctctgtagaatctgctgtgggacatttgggagcccattgaggcctacagtgaaaaaagaatatacgcagatgaaaactagaaagaagctatctgtgaaactgcattgcgacgtgtggattcatctcacagaattaaacttttcttttgattcagaaggttggaaacattctttttgtagaaactgcaaaaagacatttgggagcccactcaggccttatagtgaataactgaatattcctcaataaaagctagaaagaagctatctgtgaaactgctttgtgatgtgtggattcatctcagagagttaaacatttcttttgattctgcaggttgggaacactctttttgaagaatctgtgaaggcacatttgggagtccattgaggcctatagtgaaaaactgaatatccacagataaaaacaagaaagaacctatctgtgaaatggttttgacatgtgtggatttatctcacagtgttaaacctttccattgattaaacagattggaaacactgtttttgtaagatctgtgaagttacatttgggagctcattgatgtttatagtaagaaaatttaacatctccaaataaaaattggaaacaaactacctgtgaaacgtctttgaaaggtgtggattcatctcacatagttaaactattcttttgattcagcaggttggaaacaatcttttttagaaactgcgaagggatatttgggggcccattaaggcctatagtgaatatcccctgataaaaattagaaagaagctatctgtgaaactgctttgtgatgtgtggattcatctaagacagtaaacctttcttttgattcagcagtttggaaacactctttttgtagaatcagcaaagggacattttggagctcattgaggcctatagtgaaaaactgaatatgcccagatagaaaccagatagtagctatctctggaactgctttgcaaaggatggatttatctcccagagttaaatttttcttttgattcagaagttggaaacactgtttttgtagaaactgcaaaggaacatttgggagcccattgaggtctagagtgaaaaactgaatatgtgcagataaaaactagaaagaagctacctttgaaaccaatttgtgatgcatggattcatctcacagagttaaaccttcttttgattcaacaggttggaaacactctttttgtagaatctgcaaagtgacatttgggagctctttgaggcctacagtgaaaaaccgaataatcccagatagaaagcagatagtagctatctctgaaactgctttgcaaagggtagatacatctaccagagttaaatctttctttttattcaggagttagaatcactctttttgtagaaactgtaaagggacatttgggagcccattgaggcctagattgaaaaactgaatatcctcgaataaaaactagaaagaagctacctttgaaagcaatttttgatgtacggattcatatcacagagataacctttctttcttttgtttcaggagtttgggaacattctttttgcagaaattacgaagggacatttgggagcccaatgaggcctagagtgaaaaactgaatatctacaaataaaaactacaaagaatgtatttgtgtaaccactttgcaatgtgtggattaatctcacagacctaaaattttcttttgattcaacaggtgaaaaactctctttttgtagaaaccgcgaagggacatttaagagcctattgaagcctatagtgaaaaactgaatatctgtggataaaaactggaaaaatgctatctgtgaatgcactttgtgatgtgtggattcatctgacagatttaaacttgtcttttgatttagcaggttggaaacactcttttagcagaatctgtgaatcgacacttggaatctgatagaggcctgtagtgaataactgaatatcccatgacaaaaattagaaagaagctatttgtgaaactgctttgtgatgtgtggattcatctcagagagttaaacctttcttttgattaaacaggttggaaagaaacactctttttgtagaatctgcaaagtgacatttgggagctcattgaggccaatagtgaaaaattgaataatctcagatacaaacctgaaaccaccttagaaaaagtggattcatctcctagatttaaatctttctttcgattcagaagttggaagcactctttttgtagaaaagtgcaaagggacttttgggagtccatggaggactatagtgaataactgattatccccagtaaaaaacaagtaagaagctatctgtgaagccaatttgcaatgtgtggattcacctcacagggtgaaaactttgttttgattcagcaggttggaaacactgtttttgtagaatccatgaaggaatatttgggagcccattgtggtctagagtgaaaaaccaaatatctgcaaataaaaaatagaaaaatcctgtctgtgaaactgctttgtgatgtgtggtttcatctcacagagttaaacctttctttgattcagtgggttttaaacagtttttttgtagaatctgcaaaggtatatttggaagcccattgaggcttatactgacaagctgaaaaaacccatgtaaaaactagaaagaaagtatctgtgaaactgctttgtgatgtgtggattcatctcacagagttaaacatttcttttgattcagcaggatgtaaacactatttgtagaaactatgaagggacatttgggagcccactgaggcttatagtgaaaaaccaaatatttgccaataaaaactagaaagaagctgtgtgacactgctttggtatgtgtgtagtcatctcacagacctaaaactttcttttgattccactggttaaaaccactctttttgtagaaactgcaaagagacatttaggagccctttgatttctataataaaaaacagaatattctctgataaaaacagaaagaagctattgtgaaactgctttgtgatctgtgtattaatctcagagtgtaaaaactttcttttgatttctcagtttggaaacacttttttttgtggaaactgcaaaaagacatttgggagatcattgaggcctgtagtgaaaaactgaatatccccagaaaatactagaaagaaactgtctttgaaactgctttgtgatatgtgtatttatctcagaaagttaaacctttcttttgattcctcaggttggaaacatcatttttgtagaatctgcaaagggatgtttgggagtccaatgagacctatagtgaaaaactaaatatccacagataaaaactagaaagaagctatcagtgaaagggctttgctatgtgtggattcatcttacagatttaagcctttcttttgattcaataggttggaaacactgtttttgtagaaactgtaaagggacatttgggaccccattgtggcttattgtgaaaacccatataccttccaataaaacctcaaaagaagctatctgtgaaactgctctgtgatatgtgtattcatctcatagagttaaatcttattttgattcagcaggttggaataactctttttttgtggaatctgcaaagggatatttgggggctcattgaggcctacagtgaaaaacaaaatatccaaggataaaaagtagaaagaaggtatctgtgaaaccgctttgtgatgtgtccatgcatcacacagacttaaaacttctctttgatttcacaagttggagacaccctctttgtagaatctgtgaaaggacagttggaagcccactgaggcctgtagtgaaaagctgaatgttcctagataaaaactataaagaagctatctgtgaaacatttttgtgatatgtggattcacctcccagacttaaatctttcttttgattcagcaggttggaaactctctatttgtagaaactgcgactagacatttggaaccccattgattcctatagtgaaaaacagaataatcatgaataaaaactagaaagaagcattctgttaaaccagtttatgatgtgtgtattcacctcacagagttacacttttctactcattcagcaggttgaaacactctttttgtagaatatgtgaagggacattggaagcccaatcatgcctatactaaaatactgaatattcctacataaaaactagaaataatctatctgtgaaaccgctttatgatgtgtggtgtcatctcacagagataaacctttttttttgactaagcaggttggaaacactctttttgtaaaacctgtgaggggttttacaaaccctttgggagaccactgaggcctaaagtaaaaaactgaatatccacaggtaaaaactagaatgaaactttcagtgaaaccactttgtgatgtgtggaatcatctcacaaaagtatattttttttaatgctccagattaaagactgtctttttgtagaatttgtaaagggacagttcagagcccattgaggcctatgggaaaaaagcagaatattcccagatcaaaactagaaagaagctatctgtgaaacttctttgtgatgcttggattcatctcacagagtttaacctttcttttgattcaacaccttagaaacgcttttttttgtagaatctatgaagggacatttgtagaatctatgaagggacatttgaaagttcccatagagaaaaatgggatatttccagataaaagctagaatgaagctatctgtgaaaccactttgtgatgtgtggatacatttcccagaggtaaatcattcttttgatacagcaagttggaaacatactttttttagaaactgcaaaagaaaatcctggcacccattgaggtccaccgtgaaaagactgagtatccccctcaaaaaaaaatagaaagaaggagtctgtgaaattgctttgtgatgtgtggatttatctcactgagttaaacctttcttttgatttcacaagttgaaaatacgttcgtgtagaatctacgaaaggacatttggaagtccactgaggcctgtactgaaaaactgaatattcccacacaaaaaaataaaaactggaaggaagctatctatgaaaccactttgcactgcatggaatcatctcacagacttaaagatttcttttgattcagcaggttggaaacactctttttgtagactctgtgaagtggcatttgagagcccattgaggcctatagtgaaaactgaatatccccagattaaacctagaaagaatctatctgtgaaatggcttttggatatgtgaattcatctcacagagttacatctttcttctgatttagaaggtaggaaacactctttttcaggaatctgtgaagggacatttgggagaccattgatgcttatagtgaaaaaccaaatatccccaaattaatactagaaagaatttatctgtgaaatggctttttgatgtgtagaatcttttgatttagaaggttggaaacactctttttaaggaatctgtgaagggatatttaggagcccttttaggcctatggttgagaaactaaatatcaacagataaaaaatagaaagactctatctgtgaaactgctttgtgaaatgtcaatttatctcacagagttaaatgtttcttttgattcagcacgttaaaaacactctttttgtaaaatctgtgaaggcaaatttggaagcccattgtggcctatgatgaaaaatcaaatatcctcagataaaaactagaaagaaactattggtgaaactgctttgtgatgggtggattcatctcacaaagttaaacctttctttcgattcagcaggttggaaccccttcttttgtagagactgtgaagggacactttgtagcccattgaggcctacagtgaaaaaccaaatatcccttgataaaaactagaaagaagctacctgtgaaatggatttatgatgtgtacaataatctcagagagttaaacctttattttgattcagcaggttggaatcactctttttttagatcctgagaagggacatttggcagctcattgaggcctgtagtgaaaaacagaatatccccagatgaaaagtagaaagaaactatctgtcaaccactttgtgatgtgtggattcatcttacagagacaagcctttgttatgtctcagcagattggaaacactctttttgtagaatctgtgaagagaccgtttgggagaccattgaggctaatagtgaaaaactgaatatccccagataaaaactggaaagatgctatttgtggagccacttcacaatgtgtggattcatctcacagagttcaacctttcttttgatttagcagcttagaaacactctctttgtagaatgcttgggacatttgggagctcattgatgcctatagtgaaaaactgaacaacctaagataaaaagtagaaagaagccatttgtcaaaccacttttcaatttgtggattcttttcacagggataaaactttcttttgatttagcaggttgtaaacactgtttttgcagaatctgtgaatggacattttggagcccattaaggcctgtagtgaaaaaccaaattttttacttaaaacctagataatagatatctgtgaatccactttgtgatgtgtggattcatctcacagagttaaaccattctttttattcagaaaattggacacactctttttgtagaatattcacagggacatttggaagcctattgaggtttaattgaaaaccaaaatatcccaatataaaaactagaaagaatctatgtatgaaacctctttgtgatgtgtcgattcatcttacagagttaaacctctcttttgattcaacagattggagacactctttttgtagaatctgcgaagggacatttgggagcccatttgggtctatagtgaaaaactgaacatccccagataaaaactagaaagaacctctctgtgaaaccttttgcaatgggtgcattcatctcacagaaataaagctttcccttgatgcagcaggttggaagcacactatttaaagaaattttgaagggacatttcaaagcccagtgtggcctataatgaaaactctagtgtccatgaataaaaaatggaaagaaacaatctgtgaaacaactttgtgataggtggattaatctcacagagttaaacctttcttgtgattcagcaggttggaaacattctttttgtagactctgtgaagggacattaaaagtccattgatgcctatactaaaaaactgaatattcctacataaaaacgagaaaaacctatctatctgtgaaagcactttgtgatgtgtcaattcatctcagagagttaaacctttcttttgattcaacagttttccatacttttttttgtggaaactgggaagagatattgaggagaccattgagttatatagtgataaaccaaatatccactgataaaaactagaaagaagctgtatgtgaaattgttcagtgatatgtggattcatatcagagagttaaactttcttttgattcagcagactggaaactctgtatttgtaaaaattgcaaagggacatgtgggagccaattggggcctagagagaaaaacagaatattcatggataaaaactagaagaaagctagctgtaaaatggctttctgatgtgtggattcatctcacagaaattaaactttttttttgattcagcaggttggaaacactctttttgaagaaactgcaaatggacattttggagccccttgagctctataataaaaaagtgaatatccccagataaaaactagaaagaagctatttgtgaaactgcttcatgatgtgtttattcatctcagagatttaaactttcttttgattcagcaggttgcaaacactcttttttgtggaatctgtgaagggacattttggagtccattgatgtcaagagtgaaaaactgaatatccatggatgaaaacaagagagacgctgtctgtgaagccattttgcaatgtgtggattcatctcacagagtgaaacctttcttttgattcagcacgtggaatcactctttttgtagaaacttgaaggagtatttgagagtccattgaggcctatggtgaaaaaccgtatatccctcaataaaaacgggaaagaagtgatctgtgaaactgctttgcaatgtgtggattcatctcacagggttaaacctttcttttgattcagcaaattggaaacactcctcttttagaatttgtgaagggacatttgagagcccattgaggcctatagtgaaaaaccaaatattccccaataaaaactaggaagaagctacctgtgaaaccactttgcaatgtgtggattcatctcacagagtaaaaactttcttttgattcaacaagtttgaaaccctctttttgaagaagctattaagggatatttggaaccctggaggcctatactgaggaactgaatatcaccatatagaagctaaaaagaagctatctgtggaaacgctttcctaagtgtggattcatctcacagagttaaatttctcttttggttcagcaggtgggaaacactgtttttgtagaaactgcgaagggacatttgggagcccattaagcctgtagtgaaaaactgaatagcccttgataaaaactagaaagaagctatctgtgaaactgctttttgatgtgtggattcatctcacagagttaaactttttttttgattcagcaggttgaaaagactctttttatagaaactgcaaaggcacaattgggatctcattgaggtctacagtgaagaacaaaatatctgcagataaaaactagaaaaaaactgtctgtataactgctttgtgatgtgtggattcatctcacagaattctttcttttgattcagaaggttggaaacaggctttagtagaatctatgaagggacatttggcagctcattgaggtgtatagtgaaaaattgaatatcccaaaatgaaaactcaaaagaagctatttttgaaacgtctttttgatgtaagaattcatctcacagagtaaaacctttgttttgatttagcaggatgggaacactattttgtagaatctgtgaagggacatttgggagaccattgaggcctatactgaaaaactgaatatccacatgtaaaaactacaaagaagctatctgtgaagccgctttgtgatgtgtggatttaactcacagagttaaaccttgcttttgactcagcaggttggaaactttctttttgtagaaactatgaagggacatttcaggcccattgaggcctatagagaaaaatcaaatatttcctgatacaaactggaagcaatctatctatgaaattgctttgtcatgtgtggatttgtctcacagcattaaaccttttattttgattcagcaggttggaagcactctttttgtacaatctgcaaagggaattttggagctcactgagggttttagtgaaaaacagcatatcagtgaataaaaaccagaaagaatctatctctgaaactgttttgcaaagtgtggattcatctcacatagttaaatcattcttttgatacagcaggttggaaacactctttttggagaatctgcgaaggaacatttgggagcccctttaggtccataataaaatacctaatatcccccaataaaaactggaaaaaagccatctgtgaatctgctctgtgacttgtgcaatcatctctgagagttaaacctttcctttgattcagcatgttgaaaacactattttgtaaatcctgtgaaggggcatttgggagcaaattgagtcctatagtgaaaaaagacatatccttggataaaaactagaagaacctatctgagaaaccgccttgtgaagtgtggattcattgcacagggttaaacctttcttttgattcagaaggaagaaactgtgaaggggcattttggagaacattcagacttatactgaaaaactaattattcacagataaaaaccagaaacaagctgtctgtgaaactactttctgatgtatggatgcttctcagagacttaaacctttcttttaattcagcaagatggaaacattctttttatagaatctgataagagacatttgggagcccattgaggcctagaatgaataactgaatatctgcagaaaaaaatagaaggaagctaacagtgaaaccactttgtgatgtgtggattcatctcatggagttaaaactttcttttgattcagcaggttggaaacactccttttgtagaaactgcaaagggacttttgggagcccactgaggcctatagtgacaaactgattatcccccagtaaatactggaaagaagctatctgtgaaactactttgtgatgtgttgatttatttcagagaggtaaacctttcttttgaatcctcaggttggaaatgcccttttttgtagaatctgggaatggacattttttacccattaagcctgtaatgaaaaatcaaatatccacagataaaagctaggataaatctatcagtgaaattgctttgcaatgtgtggattcttcccacagagttaaaactttcttttgattcaataaggtaggaaacactctttttgttgaagctgctaaggaacaaatagaagcccattgagggctttacaggaaaacagaatattaccatataaaaactagaaagaagctatctgtgaaaccactttgtgacatgtggattaatctcacagagttaaacctttctattgattcagcaggatgaaaatactctttttgtagaatttgcaaagggaaatctgggagcccattgaggcctatagtgaaaaagaaaatatccacaaaaaaaaaactagaaagaagctatctgtaaaaccactttgcaatatgtggactcatctcccagagttaagtctttcttttgactcagcagttcagaaacactttttttgtagaaaccatgaaaggacatttggaagcccattgaggcatagagagaaaaactgaatatctgtgaatgaaaactagaaagaagctacctgtgaaaccactttgtgatacgtggactcatctccgagaattaagtctttattttgattcagcagttcagaaacttttttttttttgtagaaaccatgaaggaacatttgggagcccattgaagcatagagagaaaaatcaaatatctgcacataaaatctaaaaagaagccatctgtgaaaccatattatgatgtgtggatatttctacagagttaaacctttcttttgattcagcaagttgggaacactttcctatagaatttgtgaagggacatttgtgagccccttgaggcctaaagtgaaaaactgaatatccgcagataaaaactagaaagaagacacctgtaaaattgctttgtgatgtgtgggtttatctctcagagttcaacctttcttttgattcaggaggttggaaacactctttttgtagaatctgtggagggatatttgggagctttttgatgcttatggttgaaaaacccaatatcaacagacaaagtctcgaatgaagctatatgtgaaactgctttgtgatgcctatattcatctaacagagttaagccttgtttcagcagattcagaacattctttttgtagaatcagtgaagagacatttgggagcatattgaggtctattgtgaaaaactgaatatccccagataaacactggaaagaactatctgtgaaactcctttgtgatccatctcacagagttaaacctttcttttaattcatcaggttggaaacacttctcttttgtagaatatgtgaggggacatttggaagcccactgaggcctacggtgaaaaactgaatatttccagggaaaaactagacagaatctacgtgtgaaactgctttgtgatgtgtggattcatcttacagagttaatttttacttgtgattcagaaggttggaaacactcttcttgtagaatctgcaaagggacatttcagagcctattggggccaatggtgaaaaatcaaatattccagataaaaatgagaaggtagctatctgtgaaactgttttgggttgtgtggattgatgtcatagagttaaacctttctttttattcagcaaatgggaaagactctttttgtagaatttgcaaagggacatttgggagcccattgaggcctacattgaaaaatggatatcactagataaaaactggaaagaagctatcaaagagtctgctttgtgatgtgtggattcatgtcacagagttaaatgtttctttagattctgcgggttggaatcattctttttgtagaatttgcgaagggtcatttggtagtccattggggcctatggtgaaaaactgagtatctccagataaaaactggaaaaaagccatctgtgaaactgctttgtgatgtgtcaattcatctcacagagtaaaattttcttgtaattcgtcatgttggtaacgctgtttttgtagaatctgtgatgggacgtttgggagacaatttaaacctacagtgaaaaacagaatatccccagattaaaaataaaaagaagctatctgtgaaactgctttgtgatgtgtgcattcagcaggttggaaactctccttttgcagaatctgcaaagggacatttgggagcccattgaggcctttggtgaaaaactgaatatccatacataaaaactaggaagaagttttgcgtgaaactgctttgtgttgtttggattcatctcgcagaattaaacgtgtcttttgattcagcaggttggaaaccctattttgtagaatctgcaaagggacattagatgggagcccattgaagcctagggtgaaaaactgaatctccccagataaaaactagaaagaagctatctgtgaaagtgctttgtgatgtgtggattcatctcacagaggtaaacctttcttttggttcagccagttggagactcttgttttgtggaagctgcaaagaaacattttggagcccattgaggactatggtgaaaaaaacgaatatccacagataaaaagtagaaagaagctatctgtgaaacttgtttataatgtgtggattcctctcacagaattaactttttttttttattcaataggttggagacactcatttggtagaatctgtgaagggacaatagggagcccattgaggcctacagtgaaaaaccaaatatcactagatgaaaatgagaaagaagctatctgtgaaacagctttgtgatgtttggattcatatcacagagttaaacgtttcttttgatttagcatgataggaaacattctttttgcagaatctgtgaagtgatatttggaaacatgttcaggcctatggtgaaataccaaatattccctgataaaaactagaaagaagttatctgttaaactgctttgtgatgtgtggattcaccaaacaacaaaaaaaactttcttttgagtcagcaggttgaaaacactctttctgtagaatctgtgaagggacgtttgggaccccattgaggcctataatgaaaacaaaaatatccccaaataaaaactagaaagaggctacctgaaaaactgctttggtttaaatggattcatctcacaaaattaaatctttctttagatttagcagttggaaacactctttttgtagactcagcaaaaagacatttgggggccctttgagggctatacttaaaaaaccaaatatcaaaagataaaaactagaatgaagccatctgtgaagttgtttgtgatgtgtggattcatctcacagagttaaacctttcttttatttcaggagattggaaatggtctttttgtagaatctgcaaagagacatgtgggagcctattggggcctatcatgaaaaatggaatatctttagataaaaactagaaacaagctatctgtgaaactgctttgtgaagtgtgtatttatctcacagagttaaatttttttttattcagcacgttgcaaaccctctttttgcagaatctgtgcaggtacatttgtaagcccattgaggcctatggtgaaaaacaaaatatttcctgaaaaaaaaaaaaactaggaaaaggctatctgtgaaactgccttgtgatgtgtggattcaccacacagagataaacctttcctgaaacattctatttgtagtatctgctaagggacatttgggagactacagtaaaaagctgaatatccccagagaaaaactaggaagaagctgtctgtgaaactactttgtgatgtgtggattcatcatacaagttaaaactttctttgattcatcatgttggtaacactcatcttgtagaatcagtgaagggacatttgggagctcgttaagggctaaggtgaaaaacagaatatccccagataaaaacaagaaagaagctatttgtgaaacagctttgtgttgtgtagattcaagtcacagaattaaatctttcttttgattcaaaaggttggaaacactctttttccagaatctgcaaaggggtatttgggatcccattgatgcctatggtgaaaaaccgagtacctttagataaaaactcgaacaaaacctatctgtaaaactgctttatgatgtgtggattcagctcactgagttaaaccatttttttgattcagcaaattggaacctatctttctgtagaacctacaaagggacatttttgagcctattgaggcctaaggtgaaaaactgaatatccccagattaaaactagaaataagctatctgtgaaactgctttgtgatgtgtggattcaccttacagagttaaacctttcttttgattcatcaggttggtaacactctccttgtagaatttgcaaagggacattttggagctcatttaggcctaaggtgaaaaatcgaatatttccaaataaaaactagaaaaaagctatctgtgaaactgctttgtgctgtgtgcattcatctgacagagttaaagctttcttttgattcggcaggttggaaaaagtctttttgtagattctgtgaagggactttggggtcccattgaagcctacattgagaaacagataatccccagatacaaagtaaaaagaagctatctgtgaaatttctttgtgatgtatggatttatctcacagagttaaaacaatcttttgattcagcaggttggaaacactttttttgtagagcctgcaaaaaaacatttgagagcccattgaggcctttggtgaaaaactgaatatccccagataaaaactagaaaaaagttatttgtgaaactgctttttgatgtgtggattcatctcacagatttaaaccattttttatttagtaagttgaaaacactctttttgtagaatctgtgaaaagacatttgagagtccattgaggcctacagtgaaaaaccgaatatccttagagaaaaactagaaagaacctattttgaaactgctttatgttgtgtggattcatctcccagagttaaatttttcttttcattcagcaggttggacatactctttttgtataatctatgaagagacatttgggagctcattgaggcctatggtgaagaaccgaatttccccaattaaaaactagaaagattctatttgtgaaaatgctttgtgatgtgttgattcatctcacagagttaaatctttctttttactcagcaggttgtaaacactctttttgcagtatctgtgaagggacacttgaaagcccattgaggcctctggtgcaaaaccaatttctttggataaaaactagatagaatttatcagtgaatgtgctttgttatgtgtggattcctctcacagagttaaaccttttttttttttttagttcagaacattgaaaacattctttttgtagaacttgtgaagggacatttgggagcccattttggcctatggggaaaaatggaatatccccagataaaaactagaaagaagttatttgtgaaactgctttgtgatgtgtggatttatatcacagagttaaaccttttttttcattcagcaggttgaaaacacttttttttttttttttagaatctgcaaaaggatatttgggagccctatgtggtttatggttaaaaaaactaatataaacagatgaaaactagaatggaactacctatgaaactgctttgtgatatgtggattcatctcacaaagttaaaacttttttttcagaaggttggaaacactgtttttgtagcatctgtgagggacatttgggagcccattgagggctattgtgaaaaacctaatttccctagataaagactagaaacaagctatgtgtgaaactggtgtgtgatgtgtggattcatctcacacagttaaaactttcttttgaatcagcactttggaaacactctgcaagtagaatttgtgaagagacatttgggagcccattgaggcctatggtgaaaaaccgaatatttccagataaaaactagaaagacactacttgtgaaactgctctgtgaggtgtgagattcatctcacaaagttgaaactttttttggattaaacacatcggaaacactctttttgtagaatctgtgaaggaacatttgggagccaattggggcctgcggtgaaaagccgaatattcccagaaaaaaactggaaagacgctatctgtgaaactgctttgtgatgtgtggattcatctcacacagttaaacttttcttttgattcagcctgttgggaaaactctttttgtacaagtggcaatgggacatttgggaatgttttgaggcctgtggtaaaaaactgaatatccccaggtaaaaactagaaagaaactctctgtgaacttgctttctgatgtgtggattcattacagagttaaacatttcttttgattcagaaggttggaaacactgtttttgtatactctgcgatgggacattttggagctcattaaggcctatgatgaaaaaccaaatatctcaagataaaaactagaaaaaagttatctgtgaaactgctttgtaatgtgtggattcatctaacagagttaaacctttcttttcattcagcagcttgaacgcactctttttgtagaatctgcaaagggacatttgggagcccattgaggcttatggtgaaaaactgaatatccccaggtaataactagaaaaaacttatctgtgaaactgctttgtgtggtgtggattcatctcccatagataaatctttcttttgattcagcacattggaaacactttttttgtacactctctgatgggacatttgggagctcattgaggcctatggtgaaaaactgaatctccccaggtaaaaacgagaaagaagctatttgtgaaactgctttgtgaagtgcggattgatctcacggagatcaacttttcctttcattcagcatgttggaaacactttttttgtagaatctgtgaagggacattgggacctctttgaggccaatggtgaaaaactgaatatctccaattaaaacctagacagaatctttctgtgaaactgtgttgtgatgtgtcaattcatgccacagagttaaacctttctttttattcagcaggttgtaaacactctttttgtagaatctgcaaagggacatttaggagcccattgatgcctatgttgaaaaattgaatatccccatgtaaaaactagaaataagctatcagtgaaactggtttgtgatttgtggatttatctcacagatttaaacgtttgtttttattccacaggttggaaacactctttttgtagaatttgcgatgaaacacttgagagccttttgaggcctatggtgaaaaacagaagagcccaagataaaaaactagaagaaatgtatatgtgaaactgctctgtgatacgtggattcaccacacggagtgaaacctttcttttgatgcagtaggtttaacacactctgtttgtacaatgtgcatagggacatttagaagcccattgaagcctatgctgaaaaaccaaatattcccagataaaaactagaaagaagttatctgtgaaactgatttgtgatgtgtaaatacaatgcaaagaattaaacctttcttttaattcagcatgttggaaacgctctttttgtagtatctgtgatgggatatttgagagcccattggggcctatattgaaaaatcgtatataaacctttcttttgattcagcaggttggaaacactctttttgtaggatctgtgaggggacatttgggaacccttggaggtatatggtgaaaaaatgaatgtccccagatagaaacgaaaatgaaactaactgtgaaaatgcctgtgacctgtggattcatctcacagagttgaaactttcttttgattcaacaggttgaaaacactgtatttgtagaatctgcaaagggacatttgggagcccattgatgcctatggtgaaaaactgatactcccagataaaaactgggaagaatgtatctgtgaaactgctttgtgatgtgtggattcaccttacaaagttaaaactttcttttgattcataaggttggtaacactctccttgtagactctgtgaatggacatttgagagcttattgagaactaaggtgaaaaactgaaaatccccagataaaaactagaaagaagctacctgtgaaagtgctttgtgatgggtggaatcatctcgcagagttaaacctctcttttgatacagcagagttggaaacactccttctgtaggatctgcaaagggaaatttcagatcccactgagaactatggtgaaaaaatgaacatctccactaaaaaaccggaaagaagctatgtgtgaaatggctttgtgatgtgccaatttatctcacagagttaaacctttctttaaatgcagcaggttggaaacactttttttgtagaatctgtgaagggacaattgtgagtccattggggcctatggagaaaaactgaatatccccagatgaaaactagaaagaagctatctgtgaaactgctttgtgatgtgtgaaatcacttcacagaattaaacctttcttttcattcaacagattggaaacactctttttgtagaatctgcaaagggatatttgagagcctatagtggcctaaaataaaaaattgattatctaaagttaaaaactagaaagaaactatctgtgaaactgctttgtgatgtgtgaattcatcttacagatttaaaactttgttatgattcagaaggttggaaacactcttattgtagaatctgctaaggggcatttggaagaccactgaagcctaggatgtaaaacagaatatccccagataaaaactagaaagaagatatgtgtgaaactgctttgtgatgtgtggattcacctcacagagttaaaagtttcttttaattcagcaggttggaaacactatttttgtagaatctgcgaagggacatttgcgagtccattgaggcctatggtgaaaaaccaaatatccccagataaatactagaaagaagctatctgtgatgggtggattcatctcacagtgttaaacctttcttttgattcagcaggttggaaacgctctttttgtagaatctgccaaggaacgtctgggggcccattgaagcctatgatgaaaaaccacatatctctaggtaaaaactagaaagaaactatctgggaaactgctttgtgatgtgtggattcatctcacagcgttaaatctgtcttttggttcagcaggatgaatacattcttttgtagcctcttcaaaaacacattttggagcacattgaggcccttggtgaaaactgaacatcacttggtaaaaactagaaagaagatatctgggaaactgctttgtgatgtgtggattcatctaagagatttaaacctttctttttatccagcagtgttttatcaacactctttttgttgaatctgcaaagagacatatgggaacccattgaggcataggataagaaacagaatatccccagataaaaatggaaagaagctatatgtgaagctgctctgtgatgtgtgaactcatcttacatagttaaaactttctgttgactcatctagctggaaactctctttttgtagaatctgcaaagaaacatttgggagcccattgaggtgtaagataagaaacagaatattcccacataaaaactagaaagaagctatatgtgaagcttctctatgatgcgttaattcatcttacagagttaaaactttcttttgattcatctagctggaaactctctttgtgtaggttctgcaaagacacgcttgggagcccattaagtcttatgttgaaaaacagaatatccccaaataaaaactagaaaaaagtttgatgtgaaactgctttgtgatgtgttgattcatctcacagagataaatctttcttttgattcaacaggttgcaaacactctttttgtaatatctgtgaagacacatttgggagcccattgagccctatagtgaaaaactgagcatccctagataaaaactataaagaagctgtctgttcaaccagtttgtgatatatggattcatctcacagatttaaacatttgttttgattcagcaagttgaaatccctctttttgtagaatctgcaaaggggaaactggaggccattgaggattctgctgaaaaacagaataccccagtttaaaaatagaaattatcaacctgtgaaacgtctttgtgatgtgtggattcatttcataaattaaacctttcttttgattcagaaggttggaaacactctttctgtagaaactgcaaattgacatttgggagcccattggggcctgtagtgaaaaactgaatatccccagataacagctagaaagaagctatctattgctttgtgatttgtggattcatctcacagagttaaaccagtctttatattcagtaagtaggaacactgtttttgtagaatctgtgaagggacattggggatcccattgaggtctataataaaaaacccaatatccccagataaaaactagaaagaaattatctgtgaaactgcttggtgatgtgtggattcatctcacagtgatgcacctttattttgattcaacaggttggaaacactctttttgtagtaactgtgaagggacatttgggagcttattttcttatgctgaaaaactgaatattctcagataaaaactgcagagaagcaatctgtgaaactggtttgtgatgtgtggattcatctcatatagtcaaatcttacttttgatcaccaggctggaaacacatttttttttgtagaatctatgaagggacatttgagatcttattgaggcctttggggaaaaactgaataatcccagacaaaatctagaaagaagctctctgtgaaactgcttcatgatgtgtggagtcatctcacagagttaaacctttcttttgattcaataagttggaaacactctttttgtggaatttgtgaagagacatttgggagcccattgaaccctactgggaaaaaccaaatatccccagataaaaactagaaagacattatctgtgaaactgctttttatgtttggattcatctcacacagttaataattttttttttgattcagcattttggaaacacttgtttgcagaacctgcaaagggacatttgggagcacattgaggcctgtggtgaaaaactgaatatctttagataaaaaagaagctagttttgaaactgctttgttaggtgtggattaatctcacaaagttaaatctttcttttgatttaacaagttggaaaaactctttttgtagaatcagtgaagggacatttgagagccatttgaggcctatggtgaaaaaccgaatatccccagagaaaaactagaaagaagatatctgtgaaactgctttgtggtattctcacagtgttttccctttcttttgattcagcaggttggaaacgttctttttgtagaatctgcaaagggacattgggaagcccattgaggtctacagtgaaaaattgagtatcttcagataaaaactagaaagaagctacttgtgaaacttatttgtgatgtgtggattcttctcccagtgttaaacttttcttttgattcaagaggttgaagacactttttacagaatctgcaaatggacatttaagaacccattgaggccaatgttgaaaaacataatatccccagataacaactggaaaaaagctattcgtgaaactcctttgtgatcggtggattcatctcacagagttaaacctttcttttgattcagcaggttggaaacactcttttgcagaattggcaaaaagacaattgggagcgcattgaggcctatggcaaaaaaccaaatatcctcagattaaaactacaaagaccttatctgtgaaactcctttgtgatacgtggattcttctcccagagttcaacctttctgtggattcagcaggttggaaacactctttttgtagaatctgcaaagggatatttggagcttattgaggcctatggtgaaaaactgaataaccccaaataaaatctagaaagtagctctctgtgaaactgctttgtgctgagtggattcgtcttacagaattaaacctttcttttgattcagcaagttggaaacactctttttgtggaatctgcaaaaagacatttgggaacccattgtatgctgtggtgaaaaatcgaatatccccatataaaagctaaaaagaaggtatcagttaaactgctttttgatgtttggattcatctcactcagtcaaatctttcttttgattcagcaaattggaaacactctttgtagaacctgaaaagggacatttgggagcccatggaggcctttggtgaaaaaccaaaaatccctagataaaaactagaaagaagctatctttgaaactgctttgctatgtgtggattcatctcacaaagctaaacctttcttttgattcaacaagtcagaaaaactctttttgtagaatcagtgaagggatattttagagccctttgagttctattgaaaaacagaatatgcccagagaaaaactaaaaagaagctatctgtgaaactgctttgtgatatgtggattcatctcatagagtttaacatctcttttgattcagcaggttggaaatacatttttgcagaaaatgtgaagggagatttggatcccattgagggctatgtggaaaagccaaatatcctcagttaaaagcttgaaattagcaatctgtggaaagtctttgtgatgtgtggtttcatctcagaaagttaaaactttctttagattcagcagattggaaacgtgctttctgtactatctgtgaagggaggcttgggagcacattgtagcttatagtgaaaaatcaagtaatccctgatacaaaccagaaagcagctatctgtgaaactgctttgtgatgtgtagattcatcacaaaaagtgaaatatttctattgattctgcaggttgaaaacacactttctggagaatctttgaagggacatttcaaagacctctgagatctgtggtgcaaaactgaatatccccagataaaaaccagaaggaagctatctgtgaaactgatttgtgatgtgtggattcatctgacaaagttaaaccttaatttagattcagtaggttggagacactatttttgtagaaactgcgaagggacactttggagcccattgaggcctatggtgaaaaaccaaatatccctagataaaaactggaaagaagctatctgtgaaactgctttgtgatgtgtggatttatctcacagagttaaacctttgttttgattcatcaagttgacaacactctttttgtagactctgcagaggaacattcgggatcccattgaagcctgtggtgaaaaaccaaatatccccagagaaaaaaaaatagaaagaaactatctgtgaaagtgctttgtggtgtgtatattcatctcagagagttaaaacattcttttgattaagcaagttggataaacactttttgtagaatcttcaagggacattttagagtccattgaggcctatggtaaaaatccgaatatctccatatgaaaaccaaaaagaagctatatgtgatactgctttgtgatgtgtgaattcatctcacagagttaaaactttcttttgattcaacaggttggaaacactctttttctggaatctgcaaaggagaatttggcagcccattgatgcctacagtgaaaaaccaaatctcccaagacaaaaactagaaagaagatatctgggaactggtttgtgatgtgtggatctatctgacagagttaaaggtttcttttgattcagcatgtgggaaacctcttttgtagaatctgcaaagggaaatttgtgagcccattgaggcctatcatgaaaacccaaatattcccagataaaaatgcaaaagaagctatgtgtgagtctgccttatgatgtgtggattcctctcacagagttaaatctttttttgattcagcaggttggaaaaactatttctgtagaatctgtggagaaacatttgggaatccattccggcctatggtggaaaatgcaataacctctcataaacactagaaagaagctatctgtgaaactgctttgtgatgcttagattcatctcacaaaggtaaaactttcttttgattcagcatttctgaaacactctttttttatcatctgcaaagggacatttgggagaccattgaggcctatggtgaaaaacagaatatcccctgataaaaactagaaagaatctagccgtgaaactgctttgtgacgttatcaacttatcttgcagagttaaatgttccttttgattcagcacgttaaaaatactctttttgtaaaatctgtgaaggcacatttggaagcccattgaggcctatgttgaaaaacagaatatcctttgatacagactagaaagaagctatctgtgaaattgctttgtgatttgtggattcaccacacagagttaaacctttcctttgattccacaaataggaaatactcttttgtagaatctgtgaaggaatatttaagagcctttggaggactatggtaaaaaactgaacatcactgcataaaatcttaaaaaatgttaacagtgaaaatgctttgtgatgtgtggattcatctcacaaagttaaaattttcttttgattcaacaggttggaaatgctctatttgtagaatctgtgaagagatatttgggatcccattgagacctatggtgaaaaattgaatatccccagaaaaaaaaattagaaaaaagcaatctgtacaagtgctttgtgctgtgtatattcaactcagagagttaaaactttcttttgattaagcaggttggaaaaactctttttgtaaaatctgtgagggatatttgggagtaaatttagtcctaaggtaaaaatcctaatatccccataaaaaaactttttttgtgatactgctttgtgatgtgtggatttatctcagagttaaaactttcttttgattcaacaggttcgaaacactctttttctagaatcttcaaaggaacatttgaaagcacattgatgcctatggtgaaaaactgaatatacccagagaaaaactagaaagaagctctctgggaactgctttgtgatgtgtggattcatctcacagagttaaatgtttcttttgattcagcattttggaaacagttttttgtagaatttgcaaagggacatttgggagcccattgagaccaatggtgaaaaagcaaatatccccagaaaaaaaagtagaaagaatttatctatgaaactgctttgtgatgtattgattcatctggcagaattaaacctttcttttgattcagcaggttgtaaacattccttttgtagaatctgcaaaggaacatttgggagtctattgtggcttatggcaaaaaactgaatattccaagataaaaatgcaaaagaagctatgtgtgagtctgccttatgatgtgtggattcctctcacagagtcaaacctttttttgattcagcaggttggaaacactctttctatagaatctgctaagagacatttcagagtccattgaggcccatggtgaaaaactaaataaaccctgataaacgctagaaagaagctatctgtgaaactgctttgcgatgtttggattcatctcacaaaggtaaacctttctttttatccagcaggtttgaatcactcattttttttttttagaatctacaaaggtaaatttttagaccactgtggcttgtgctgaaaaacagaatatcccccaataaaaacgagaaagaagatatttgtgaaactgctttgtgaagtgtgatttatctcagtgagataacttttctattgattcagcaggttggaaacactctttttgtaaaatctgtgaaggaacatttaaaggccactgaagccaatggtgaaaaaccaagtgtcctcagataaaagctaaaaagagaggttaccataaaactgctttagtttgaatggattcttctaaaagagataaacatttctttgcatttagcaggttggaaacactcttgtaaaatctgtgaatggacatatgggagccctttgaggtctattgttgaaaaactgaattatcaacagataaaaaatagaaagtatctatctgtgaaactgttttgtgaaagaggatttgtcttacaaagttaaacatttcttttgattcagcatgttgatagcactttttatagaatctgtgaaggcacatttggaagtccattgaggcctaaggtgaaaaagtaaataccctttgattaaaaactagaaagaagctatgtgtgaaactgctttgtgatgtgtggattcatcacacagagaaaagactttcctttgattcagcagattggaaacactcttttcatagaatctgcaaagggatatttaagagcccttggaggactgtggtaaaaaactgaacatccccagataaaatttaaaaagaagccaacagtgaaaatgctttgtgatgtgtggattcatctcacagagttaaatctttcttttgactcaactggttggaaacactccatttgtataatctgagaagggacatttgtaatcccattgaggccaatggtgaaaaactgaatatcttcaaataaaacctggaagaagctctctgtgaaactgctttgtgatgtgtggattcatcttacaaattaaccctttttttgattcatcaggttggtaaccttctccttgtagaatctgcaaagggatatttgggagctctttgaggcctaaggtgaaaaacaaaatatccccaattaaaaactataaagaatctatctgtaagactgctttgtgatgtgttcattcatctcacaaagttaaacctttctttttattcagcaggttgtacactctttttgtagaatctgcgaagggacatttgggagcccattgaggcctatgatgaaaaactgaatacccacagataaaaattataaagaagttatgtgtgaatctgctttgtgatgtgtggatccctttaacatatttaaaccttttttttttattcagcaggttggaaacactcattttgtagaatatgcaaagggacacttgggagctcattgaggcctatggtgcaaaactgatgtcttcagataaaaaccagataaaagctatgagtgaatctgctttgttatgtgtggatttctctcacagagtttaacctttcttttatttcagcaaattggaaacattctttttgtagaatctgtgaagggacatttggaagcccactgaggcctacagtgaaagatggaatatctccaggtaaaaactagaaagaaattatttgtgaaactgctttgtgatgtgtgtatttatctcaaagagttaaacctttcttttcattcagtagattgaaaacagtcttcttgtacaatctgcaaagggacatttgggagccctttgaggcttatgtttaaaaaactgaataacaacaaatgaaaactagaatgaagttatctgtgaaatgctttgtgaagtgtggattcatctcacagaattaattaacctttcttttgtttcagcaggttggaaacattgtttttgtagtatctgcgagggactcttgggagcctattgaaggctatcatgaaaaacctaatatccatagataaaaactagaaacaagccatcttgaaactgctttgtgatgtgtggattcatctcccacagttaaaactttttttgattcagcaagttggaaacactttttctagaatctgtgaagggacatttgggagcctctggagacttattttgaaagagggaataatcccagataaaaactagaaagaatctatttataaaactgctttgtgatgtgtggattcatctcacagagttaagactttcttttgattcagcaggtgggaaacactctgaatgtggaatttgcaaagggacttttgggagtccattgaagcctgtggtaaaaaaaaaaaaaaaaaaaaagaatatcctaagataaaaactagcaagaagttatctgtgaaactggtttgtgatgtgtggattcatctcacagagttaaaccttcctattgatttagcagtttggaaaaactctttttgtagactctgcaaagaaacatttgggagccctctgagtctgaaaatgaaaaacctactatctccagataaaaactagaaagaagctatctgtgaaacttctttgtgatgggtagattatctcacaaatttaaacctttcttttgattcagcggattggaaacactattttggagaatctatgaaaagacatttgggaggccatggaggcctataatgaaaaactgaacatcgccagataaaaactggaaagaagctatctgtgaaactgctttgtggtgtctgggatcatctcacagagataaaactttcttttgactcagcaggttggaagcactctttttgtagaatctgtgaagggacgttggaaacctcatggagacctatggtgaataacagaatagccccccaaaaatactagaaagaagctatctgtgaaactgttttatgatgtgtgggttcatctcacaggagttaaacctttcttttgatttagcaggctgaaaacactctttttgtaacctctgtgaagggacatttgggagtccattgagacctatggtgaaaaaccacctatccccagataaaaactagaaagaagctaggtgtgaaactgccttgtgatgtgtggactcatctcacagagttaaacatttcttttgattcagcaggttggaaacactctttttgtagaatcagtgaagggacactcaaaagcccattgaggcctatcatgaaaaaccaatatcccaagatgaaaaatagaaagaagctatccatgattctgctttgtgatgtgtggattcctctcacagagttaaatctttattttgattcagcaggttggaaatattccttttttcttgatggagtctcattctgccaccgaggctggagtgcactggcatgatctcggctcactgcaagctctgcctcccagattcatgccattctcctgcctcagcctcccaaacatctgtgactacaggcacccgccactaaacccagctaatttttttttggtgtttttgtagagatgcggtttcaccatgatagccaggatggtctccatcatctcctgaatttgtgatctgcccacctcagcctcccaaagtgctgggatcgcagacatgagccactgcaactgacagaaatattctttctgtagaatctgtgaaggtatatttgaaaccctgttgaggcctatggtgaaaaactgaatatccccagataaaaactggaaagaagctataggtgaaattgatttatgatgtgtcaattcatctcacagagtaaaagctttcttttgattcagcactttgggaacactctttttgtagaatctgcaaagggacatttttgagcccattgaggccatggtgataaactgaacatcttcagatagaactagaaagaagttatctgtgaaattgctttgtgatgtttggattcatctcaaacagataaatacttccttagattcaggaggttggaaacactttttttgtagaatctgcgagtggacatttggaagagcattgaggcctatggtgaaaaacccgatatccccagatggaaactagaaaggaggtatctgtgaagctgctttgtgatgtgtggattcatctaacaaagttcaacctttcttttgtttcagcaggtgcaaaacactcttttttttagaaactacaatgcaacatttgagagtgttaggggactctagtgaaaaatgaaatatctttagataaaagctagaaacaaactatctgtgaaatggctttgtgatatctagattcatttcacagaggtaaatttttcttttgattcagcaggttggaaacactctgtatgtggaattttcaaaggaatatttgagagaccattgaagcctatggtgaaaaaccaaatagctccagatgaaaactaaaaagacactatttgtgaatctgctttgtgatgtgtgaattcatctcacagagttaatccttccttttgatttagcaggttggaagcactgtttttgtagaatctgtgaagggacatttgggagcccattgaggctgatgttaaaaaatagattatccccagataaaaactcaaaagaagctatctgtgaaattttgtgatgtgtggattcatcacacagagttaaacctttcttttgattcagcaggttgaaaacactttttttgctgaatctgtgaagaaaatttcaggagcctattgaggcctatggtgaaaaactgaatatccccagatatacactagaaagaagctatctgtgaaagtgctttctgatgtgtggaatcatttcacagattagacctttctttttattcaaaaggttggaaacacttacttgtagaatctgcccattgatgcctagggtggataaccaaatttcccaagagaaaaactagaacaaagccatctgtaaaagtcctttgtgatgtgtggactcatctcacaaagatatacctttcttttgatttagcaggttggaaacactctttttgtagaatctgcaaagggacatttggaagcacattgaggccagtgtttaaaaactgagtgtcttcagatacgaatgagaaagaagctgtctgtgaatttttttttttgttgtgtgaattcatctcacatagttaaacgtttcttttgatttagcaagatggaaacactctttttgtagaacctgcaaagggacattttgaagcccattgaggccagtggttaaaaactgaatatcttcagataaaactagaaagaagctatctgtgaagctgctttgggatgtgtggattcatctcacagagttaaagctttcttttggttaagcaggttggaaacactcgttttgtagaatctgtgaagggacattcaagagcccattgaggcctatcatgaaaaactgactatcatcagataacaactagaatgaagatatctgtgattctgttttgtgatgtgtggattcctctcacagagttaaaccttcctttgattgagtgggttgtgtagaatctgtgaagggacatttgtgagcactttgtggccgagggtgaaaaacctaatatacccagagaacttgaaagaagctatctgtgaaactgctttgtgatttgtacatccatctcgcagagttaacacattctttaattcagcaggttggaaacactcgttgtgtagaatcagtgaaaggacattggaaaaaatagtgaagcctatggtgaaaaagtgaatatccccagataaaaaatatagggagttatttgtgaaactgctttgtgaagtatggattcatctcatagtgttaaaactgtcttttgttcagcaggttggaatactctttttgtagaatccacaaagaaacattttggagcccatcgagacctatgataaaaatcgaatatctccagattaaaaactagaaagaaggtatcagtgaaactgctttgtgatgtgtggctatatctcacacagttaaacctctcttttgattcagcgggttggaaacactctgtatgtagaatctgcacagggacatttgggagcccctttgaggcttatggtgaaaaaccaaatatcctcagataaaaactggcaagaaggtatctgtgagactgctttgtgatgtgtggattcatctcagagttaatccttttttctgattcaacatgttggaaacactgcttttgtagaatctgtgaagggacattttggagtccattgaggcctaatgtcaaaaactgatatcaaactgatattttgacctaatgtcaaaaacagacaaaaactagaaagaagctttctgtgaattttctttgtcatgtgtggattcctctgatagagttaaacctttcttttgattcagcaggttgtaaatattctttttgtagaatctgtgaagggtcatttgggagcccatttggggctattttgaataaccgaatatccccagaaaaaaactgaaaagaagttatctgtgaaactgctttgtgttgtatccattcatctcacagagtaaaagctttattttgattcagcaggttagaaacactttttttgtggaatatgtgaagggacatttgggggcccattgaggctgatggtgaaaaccagaatatccccagagaaaaactagaaagaagctatctgtgaaattattttgtgatgattggattcatctcacacagataaatttttccttagattcagcagttggaaagacttttttcatagaatctgtgaaaggacatttgtgagcccattgaggcctaccttgaaaaattgaatattcaaagataaaaactataaagaagctctctgtgaaacttctctgtgatgttggctccatctcacagaattaaatctttcttctcattcagcaggtgagagacactctttttgtagaatctgcgaagggacttttgagagcctaaggaggactatcgtgaaaaaccgaatatctttagacaaaaactgaaacaagctatctgtgaaatggctttgtgatgtgtggagtcatctcacagaggtaaacatttcctttgaatcagcaggttgggacactctgcatgtagaattttggaaaaaatatttgagagaccatcaaggcctatagtgaaaaactgaatattcccagataagaactaaaaagacgctatttgtgaaactgctttttgatgtgtgagttcaacttacagagttaaatctttcttttgatttagcaggttggaaacactctttttgtagaatctgagaagggacatttgggaactgattgaagcctatggtgaataacagaatatccacagataaaaactggaagaaagctatctgtgaaactgctttgtgatgtgtggattcatttcacagattagacgtttcttttgattcaaaatgttggaaacggttttttttgtaaattctgtgaagggacaactgggagcccactaatgcctagggtggaaaaccgaatatccccagagaaaaaccagaaaggagttctctgtgaaactgcattgtgatgtgtggactcatctcacagaatcaaaggtttcttttgacttagcaggttggaaaccctctttttgtagaatctgtgagaagacatttgaaagcctatcatggcctatggtgaagaactgaatatccccagataaaagctacaaagaagctatcagtgaaactgcattgtggtgtgtggaatcaactcacagacttaaactgttgttttgatttaacacgttgcaaacacccttttaaatattaaaaaattaaattaaataaattaaattaaattaataatttaaataaataatttaaaaattaaataaaataaattaaattaaatatttaacaattaaattaaataaatatttaaaagctgattgaggactttaatgatcccagatcaaaactagaaagaatctaactgtgaaactgctttgtgaagtgcacattcatttcacggagttaaacctttcttctgattcagcaggttggataaacccttattgtagtatctgcaaagggacatttgggtgcccattcaggcctatggtgaaaaatcgaatatcccaagataaaacagggaagaatttatttgagaaactactttgtgatttgtagactcatctcactgagttagacctttcttttgattcagcagattggaaacaatctttttgtagaatctgcgaagagatatttgggagcttattgatgccaatggttaaacactgaatatctccagatcaaaactagaaagtagctatctgtgaaactgctttgtgatgtgtggattcatctcacagtgttaaaactttctttttttaagcaggtgggaaaaactatttttgtaaaatctgtgaaaggacatttgagagcctatggaggaatatcatgaaaaactgaatatccctacataaaaactagaaacaagctctctgtgaaactgctttttgatgtgtggattcacctcacagagttaaacctttcttttgattaaccaggttagaaacactctgtatgtagaatttgtgaagggatatttgggaacccattgaggcctatggtgagaaagcaaatatccccagataaaaaactagaaagacactatttgtaaatctgttttgtaatttgtcaattcatctcacagagttaaacctttcttttgattcaggagattggaagcaatttttttgaagaatctgtaaaaaacgtttgggagcccaacaatgcctatggtgataaacagagtatcttcaggtaaaaactagaaagaagctatctgtgaaaccgctgtgtgatgtgcctatttatttcaaagattagaccttgcttttgattcaaaaaattggaaacaccctttttgtagattctacaatggaacaattgggacaccattgaagccttgagaggaaaactgaatatccccagagaaaaaacagaaataagctatctgtgaaagtgctttgtgatgtgtggattcatctcacagagataaacctttcttttgtttcagcacgtggaaaacccttttcttgtggaatctgtgaagggacatttttgagcacgttgaggcctatggtgaaaaatcgagtctccccagatacaaactagaaagaagctatctctgaaattgccctgtgatgtgtggatttatctcacagagttaaacctttcttttgattcagcaggttgaaaacactctgtatgtagaattagtgaggggacattttggaggccattgacgcctattgtgaaaaaccaaatatccccagataaaaactagaaagacaatatttgtgaatctgctttttgatgtgcactttcatctcacagagataaaccttccttttattcagcaggttggaaacactctttttgtagaatctgtgaaggtacattatggagtccatggggcctaaggtgagaaaactgaatatccccagataaaaactgtaaagcagctatatgtgatactgctttgtgatgtgtggattcatctcacagagttaatcctttcttttgattcttcagattggaaacacttctttcatagaatctgtgaaaggacatttgggagtccaaagaggcctatggtgaaataccaaatatccccagagaaaaactagaaagaagctatctgtgaaactgatttgtgatatgtagattcatcttacagagttaaacgtttcttttgattcaacagattggaaacacagttttgtataatctgcaaagagacattggggagcccgttgaggcctatggtgaaaaactgaatgtccccagtgaagaactaggaaggagctatctgttaatttgtaatccgtggattcctgtcacagagttaaacatttcttcagcaggttgaaaacagcctttttgtataatctgtgaaggaatatttgggagctcattgatgtctatggtgaaaaacaatatccctagggaaaaactagaaagaagctatctgtgaatctgctttgtggtgggtggagtcctctcacagagacaaacctttcttttgattcagcaggttggaaacactctttttgtaggctctatgaagggacttttgggagcccattgatgcctatggtgaaaaaccaaatatccccagagaaaaactagaaagaagttatctgtgaaagagctgtgtgagaagtagattagtctcacggagttaacactttctttgattcagcaggttggaaattctccttttgtagaatctgcaaatggacatttgaaatagtagtaaggcctacgaataaaaactgaataatatccccagataaaaactagaggaagctatttgtgaaactgctttgtgatatgtggatttatctcacaaagttaaacttttcttttgttcagcaggttgaaaacactctttttgtagaatctgcatagtgacatttggaacctctttgaggcctatggtgaaaacctgaatagcctcagataaaagctagaaagaagctacctgtaaaactgcttgggtttgactggattcatctgacagaatgaaacctattttttgattcagcaggctggaaacactctttttgtagaatctgctaagaaacatttgaaagccctttgaggcctatggttaaaaaactgaatattgacagataaaaactacagtgaagctatctgtgaaacaactttgtgatgtgtggattcatgtcacagagttaagccttatttttgtgttagcatatgggaaacactctttttgtagaatctgcaaagggacttttgagagcctatggaggcctattgtgaaaaacccaatattgctacataaaaactaaaaacaagctatcagtgaaactgctttggatatatggattcatctcacagagttcagcctttcttttgatttagcaggttgaaaacactctttttctagaatctgtgaggggacgtttgggagcccattgtggcctatggtgaaaaactgaatatctgcagataaaaactagaaagaaactatctgtgaaagtacttagagatgtgaatattcatctcaaaataaacctttcttttgagtcaaatgtttggaaacacctttttgcagaatctgcaaatggacaattgggagccaattgatgccttgggtgaaaaactgggtatccccataaagacactagaaagaagccatttgtgaaactgctttgtgatgtgttggttcgtatgacagagttaaacctttcttttgattcagcaggttggaaacactcttttcatagactctgtgaagggactttgggagcccattgaagactatggtgaaaaaaaaaatctccaaataaaaacgagaaagaagctgtctgtgaaattgctttgtaatgtgtggatacatctcacagagttaaacctttcttttgtttcaggagtttggaaacactctgtatgtagactctgcaaaggaacatttgggagttcattgattcttatggtgaaaaactacatattttcaaaataaaactagaaagaaactatctgtgaagctggtttgtgatgtgtggattcatatcactgagttaaacctttcttttgattcagcagtttgggtgcattatttttgtagactctgcaaagggacatttgagagcttattgaagtctgttgtgaaaaacagaatactctcggataaaaagcagaaaatatctatccgtgaaactgcttagtgatgtgtggattaatctcagggagtaaaagcttccttttgattaaggaggttgtaaacactctttttgtagcatctgtcaagggaaattttgttgcccattgaggcgtatggtgaaaaatggaatatccccatataaaaactagaaagaaacaatctctgaaactgctttttgacctgtggattcatgccactgagtgagttaaacctcttttgatttagcatgtttgaaacactctttttgtaaaatctctgaagggacttgggagccctttgaggccaatggttaaaaactgaatatttccagattaaaaattgaaagaaactatttgtgaaagtgctttgtgatgtgtggattcatctcacagattaatcttttttgatacaaaaggttgaaaacactctttttgtagcatctgtgagggacaattgggaccccattgatgcccagggtgagaaattaaatatcctcaaagaaaaactacaaataagctatctgtggaagggctttgtgatgtgtggatttgtctcacagagttaaacctttgttttgattcagcaggttggaaacacttattctgtagaatctgtgaagggacattttggagcacattgaggcctatagtaaaaaaagaaaaagaaattcccctgataaaaaaaaaaaaaaagctgttagtgaaactgctttgcattgtgtggactcatctgtcagagttgaacttttattttggttcagaaggttggaaacacttgttttgtagaatctgcaaagggatatttgggagctctttgaggccaatgtttaaaaacaaaatacctctaaataaaaactcgaaagaagctaacattgaaactgcttcattatgtatgaattcaccttacagagttaaactttttttttaattgagtaggttgtaaacaattgttttgtagagtctgttaatggacatttggaagcccattgaggcctatcatgaaaaaccgaatatattcagataaaaacttgaaagaagctttcagtgaatctgctttgtgatgcactgattcctctcacagagttaaaactttattttgatttgtcaggttggaaacactcttttcatagaatcttgtgaggaagatttgggggcccattgagacccatggtaaaaagccaaatatccccagataaacactataaagaaggtatctgtgaaacagctttgtgacgtttagattcatctcacagagttaaatctttcttttgattcagcaggttggaaacattctttttgtagtatctgtgaagagacgtttgggagcccagtgaggcctatggtgaaaaaccgattatacccagagaaaaactacaaagaagctgtctgtgaagctgctttgtgatgtatcaatcatctacagagttaaacctttcttttgattcagcaggttggaaacactctttttgtagaatctgtgaagggacatttgggagccctttgaggccaatggtgaaaaactgaatatccccagataacaactagaaagaagctgtctgtgaaagtggtttgagatgtgtggattcatctcagattaaaactttcttttgattcgaatgtttggaaacactctttttgtagaatctgtgaagggacaatgggggcccattaaagcttagggtgaaaaaaacaatatccccagaggaaaattagaaagaagccatctgtgaaactgctttgtgatgtgtggcttcatgtgacagagttaaacctttcttttgattcagcatgttagaaatactctttttgtagaatctgtgaagggatatttgggaacctaatgaggactgtggtgaaaaacaaaatatctccagataaaaatgagaaagaagctatcagttaaactgctttgcaacgtgtgcattcgtctcacatagttaaacctttcttttgtttcagtaggttgcaaacactctttttgtagaatctacagagggacaatttggtgcccattgaggcctatgttgaaaaacaaaatatcctcataaaaaactggtagaaaagtattggtgaaattgctttgtgatgtgtcgattcatctcacagagataaacttttatttaaattcagcaagttggaaaaactttttgtaaaatctgcaaagggacatttgatagcccattgagacctatggtgaaaaactgaatatccccagataacaactagaaagaagcagtatttgaaagtgctttgtgatgtgtgggtttctctcacagaattaaacctttcttttcattccacaagttggaaacactctttttttagaatctatgaatggacaactgggagccaaataatgcttatggtgaaaaattgaatatccccagagaaacagtagaaaaaacctacctgtgaaagtgctttgtgatgtgtgcgttcatctcacagagataaacctttcttttgattcagcaggttggaaactttttttgtagaatctgtgaagaatcgtttaggagcccactgaggcctttggtgaaacactgaataaccccacataaaaactacaaagaagctatctgtgaaactgctttgtgatgtatagattcatctcacagagttaaacctttcttttgattcaacaggttggaaacacactttttatagaatctgcaaaaagacattagggatcccattgaattctatgatgaaaaactgaatatgcccagatagaaactagaaagatgctatctgtgaaactgctttgtgatgtgtgaattcatctccttgagttaaatctttcttttgatttagcaggtttgaaacattcttttgtagaatctgcataggaacactggggagcccattgagaccaatggtgagtaacagaaaaaaaactagaaagaagctgtcagtgaaactgctttgtgatgtgtaaattcatatcaaagagttaaaccttgcttttaattcagaaggttggaaacactctttttatagtggtgatgtgtggattcaccacagaaaaataaacctttctttttattcagcaggttggacacaatctatttgtagaatatgcaaatttacatttaggagcccattgaggcctatggtgaaaaaccaaacatccccagataaaaactagtaagaagttatctgtgaaactgctttgtgatgtgtgcattcatctcacagagttaaacctttctgttgattcagcaggttggaaacactatttttgtagaatctgcaaattgacatttaagagcccactgaggcctatggtgaaaaaccgaatgttcccagaaaaaaactagaaagaatctgtgaaactgcattttgatttgcacattcatctcaccaagttaacatatgctttgattcagcaggttggaaacactgtttttgttgaatctgcgaagggacatttggaagcccattgaggtgtatggtgaaaaatcgaatattgccagataaaagcattctttttgtacaatttgtgaggggtcatttgggagcacattgaggcctgtaatgaaaaaccaaatatccccacataaaaaccagaaagaagctatttgtgaaactgtgctctaatgggtggattcatctcacagagttaaacatttctattgattcagtggcttggaaacacttttttcatagaatctacaaaggagcatttgaaagccctttgttgcatgttttttaaaaatggaatgtctctatttaaaaagtagaaacaagctatctgagaaactgctttgtgatgtgtggattcaactgacagagttaaacatttcttttgattcagcaggttggaagcactctgtagaaacatttgggagcacactgagacctgtggtgaaaatctgattatccccagataaaaattagaaagaagctatctgtggaaatgctttgtgatgtttggattcacctcacacagttaaacctctcttttaattcagtgggttggtaaaaatcttttggtacaatctgcaaattgacatttacaagcctattgaggcctatggtgaaaaaagaatatctcaaataaaaactagaaggaaggtatctgtgtcactgctttgtgatgtgtgggttcatctcacagagttaaacatttcctttgattcagcagttggaaacactctatttgtagaatctgtgaagggacatttgggaacccattgagacctatggtggaaaagtgaatatccccggataaaaactagaaggaatctatctgtgaaactgctttgtgatgtctggattcacctcacagatttaaacttttattttgattcagcaggttggaaacactttagatgtaggatgtgtgaagagatatttgggagcccatggaggcctatggtgaaaaatagaatattcccagaaaaatcctaaaaagaatctctttgtgatactgtttgtgatgtgtgcaatcatctcacttaggtaaactgttctcttgattcagcagattagaaacactctttgtagaatctgttaatggacatttgggagcccattgaggcttatggtgaaaactgaatatccccatataaaaactagaaagaagttatctgtgaacagttttgtgatgtgtggattcatctcacatagttatacctttcttttgattcagcaggttggaaacactctttttgtggaatctttggttggatatttgggagtcctttgaggcataggatgaaaaactgaatatctacagataaaaactaggaagaagctatctgtgaaagtgctttgggatgtgtggattcatctaacagaattaaacctttcttttgatttcacaagttggaaacacttttttggtagaatctgtgaagaaatatttgagacctgattgaggatgatagtgaaaaacagaacatccccacataaaaactagaaagaagtaatctgtacactttcattttggcgtgtggattcaactcacagagttaaaccattcttttgattaagcaggttggaaacactatttctgtagaatctaggaagtgaaatttgtgagcccattgatacttatgttgaaaaacgggatatccacagataagaataagaaagaatctatgtatgaatctgctttgtgttgtgtcaattcatctcacatagttacattttttcttttgtttcagcaggtcagaaacactgttttgtagaatctttgaagggacatttggagcccattgaggcctatggtgaaaaactgaatacccccagatgaaaactagaaaggagctatctgtgaaactgttttgtgatatttggaatcatctcacagagttaacatttcttttccctctgcaggttggaaacactctttttgttgaatatgtgaagggacattttggatcccattgaggactactgtgaaaaacaaaatatccccttataaaaacaagaaagaaggtatctgttcaactgctttgcaatgtgtggattcatctcacagagttaaacctttcttttgattcatctgtttggaaacactcttttagtataattggtgaagggacatttgggagctcattgagacctatgataataagctaaatatccccagataaaaggtagatagaagctctctgtaaaactgccttgtgagatgtggattcatctcacagtactaaacctttctttttattcagcaagttgaaaacactctttttgtaaaatctgcaaagaaacatttgaaagcccttgaggcctatgttgaaaaactgaatatcttcagatgaaaactgcaaagaagatatctgtgaaactgctttctgatgtgtgcattcatctcacagagttaaaccgttcttttgattcggcaggttaaaaacactctttttgtagattctgtgaagggaatttgggagcccattgaggtttatggtgaaaaggtgaatatccccacataaaaagtagaaggaaactctctgtgaaattgctttgtgatgtgtggattcaactcacaaacttcattctttcttttgattcaccaggttggaaacagtctttttgtagaatctgcaaagggacattttggggccctttgaggtctatggtgaaaaatcaaatatccccagataaaaactagaaagaagctatgtgtgaaatagctttgtgatgtgtggattcatctcacagagttaaacttttcttttgatttagcaggttggaagctctctttttgtagaatctgcaaagggacatttgggatcccattgagacctatggtgaaaaaccagacatttccagaaaaaactggaaagaagctatctatgaaacccctgtttgatgcgtgctgttatctcacagatataaacctttcttttcatttggatggttggtaacccactttttgtagaatctctgatggacatatcaggtcccattgaagcctatggaaaaaaatgaacttcttcagataaaaaccagaaataagctatgtgtgaaatggctttgtgatgtgtcaattcatctcacagagttaaacctttctttttattcagcatgttggaaacacttttattgtagactctgcaaagtgacattttggagcccattgaggcctatagtgaaaaacagaacacacccagataaaaattagaaagaagctatctgcgaaatgatttctgatgtgtggatttctcttacagagttaatttattttttgattcagcaggttgcaaatattcttttttaagaatctgtgaagggtaatttaaaagcattgaggctggccaggtgtggtggctcatgcttgtaatcccagcactttgggaggccaaggcaagtggatcacaaggtcaggagatcaagaccctcctggctaacacagtgaagccccatctctacaaaaaatacaaaaaacattagctgagtgtgatggcaggttcctgtagtcccagctacttgggaggctgaagcaggagaaaggcaaggaccaaggaggcagagcttgcagtgagccaagatcatgccacttcactccagcctaggcaacagagcgaggctccatctcaaaaaaaaaaaaagcattgaggcctatggtaaaaaacagaatatccctagataaaaactcaaaagaaactatcagtgaaactgctttgtgattggtggatgcatctcacagagttaaacctttcctttgattcatcatgttagaaacactctttttgtagaatctgtgaagggacattagggagccctcttaggcctatggtgaaaaacggaatctctcctgataaaaaaaaaaagaaagaagctatctgttaaactgctttgtgatgtgtggattcatctcacagagttaacctttatatttattcgacaagttggaaacactctttttgtagaatctgtgaaggaacattttgtagcccattaaggcccatactgaacaacaaaatattgctagataaaaacttgaaagagtctgtcttggaaagtgttttgtgatgtgtgaaataatctctcagatttaaacctttcttttgattcagtaggttggaaacactatttttgtagaatctgcaaaggaacatttgagagatcattgaggcgtatggtcaaaaataaaatatccctacataaaaactaaaaagaaactatctgtgagactgctttgtgatttgtagattcatctcacagagttaaatgtttcttttgattcagcagtttggaaacactctttttgtacacagataaacccttctgataaatctcacacaggtaagtccttctgaagattcagcaggttggaaacacttttctctgtagaatctgtgaagggacatttgggagcccattgaggcctatggtgaaaaagtaaatatcccccagaaagaaattagaaagaagctatctttgaaagtgctttgaggtatatggattcttctcacagattaaacctttattttgttcagtagcttgaaaccactctttttgtagaatctgcaaagggacatttaggagtctatttgggtttaccgtgaaaaacagaatatccctaaataaaacaagaaacaagctatctgtgaaactgttttgtgatgtttgggttcatccctcagagttaaaccattcttttaattcaacaggttggaaacactttgtatgtagaatctgcaataggacatatatgacacctttgtggcctatggtgaaaaatgggatatccccatataaaaactagaaagatgctatttgtgaatctgttttgtgatgtgtggattcatctcacaaagttaaaccttttttatgattcagcaggttggaaacagtctttttgtagaaactgtgaagtgacatttgggagcacaatggggcctatagtgaaaaagtgaataccccagataaaaactggaaataagctatctgtgaaactgctttgtgatgtgtggattcatctcacagagtgaaagctttcttttgatacttcaggtttgaaacacttgttttgtagaatctgcaagggatattatacagcccacagatgcctaaggtgaaaaactgaatattcccaaataaaaactagaaagaagctatgtgtgaaactgctttgtgatgtgtcaattcatctcacagagttaaaactttcttttcattcagcagattggaagcacactttttgaagaatctgtgaagggacatttgaaagcccattgaggactatggtgaaaaactgaatattctgagataaaaactagaaagaagttatctatgaaactgctttgtgatgtttgcattcatctcacataggtaaacccttcttttgattcagcaggttggaaacaatttttttagtatctgtgaagggaattttcaaagtctactgaagcctaacgtgaaaaaatcaaatatctccaaataaaatctcaaaagaagctatctgtgcagtgggtttgtcatatgtacattcacctcacagagttacccgtttcttttgattcaacaggtaggaaacactctttttgtataatctgcaaaaggacatatgggagcccattgatgcctatggtaagaaacagaatatccccagataaacactagaaagaaactgccagtgaaactgttctgtgatgtgtggatttagctcactgagttaaaacattttttgattcagaacgttgcaaagattcatgtatagaatctgcaaatggacatttcagagcctattgaggcctatggtgaaaaacatactatctccagttcaaaacttgaaaggacctatttgtgaaactggtttgtggtctgttgattcatatcacaaagataaaactttcttttgattcagcgggttggaaacactctttttgtagaacccgagaatagacatttgggagtccattgaggcctatgttgaaaaacagatatcccaagataaaaactagaaagaagctatctgtgaatctgctttttatgtataaatccctctcacagacttaaacctttcttttgtttcagcaggttggaaaaactctttttgtagaatatgcaaaaggacatttggcagcctattgaagcttatgatgaaaaaccaaatatcccagataaaaaggtagaaacaagctatctgtgaaactgctttgtgatttatggtttcatattccagagagaagcctttcttttcattgagcatattgttaacactctttatagaatctgcgaaggaacatttgtgagccaaatgaaagctaaggtggaaaaacaaatattgccatataaaaaacctatttgtgaaactagtttgtgatgcgtggattcatctgcaagagttaaatctctcttttgattctgcatatttaaacactctttttgtagaatctgcaaaggggcttttgggagcccattgtggcctctgattaaaagctgaatatccacagataaaaactacaaagaatctatctgtgaaactgctttgtgaagtgtggatttatctcatacagataaagttttaatttgattcagcaggttggaaacactctttttgtagaatatgtaaagggacttaggggagctcattgtgccctgtggtgaaaaaccgaatgtcttcagacaaaaactagaaagaagctatcagtgaaactgctttgtgatgtgtagattcatctcacagtgttaaacatttcttttgattcagcagattggaagcattctgtttttagaatctgaaaagggacattttaaagccaattgacacctataaaaaaatggaatatctccagatacaaactagaaagaagctatctgtgaaactattctgagatgggtggattcatctcactaagataaactttgttttgattcatcaggttggaaacactcttattgtagaatctgtgaactgacatttgaacgcccattcagacctgtggtgaaaaactgaatattcacaggaaaaaactagaagggaagtatctgttaaactgctttgtgatatgtggattctgctcacagtgttaaacttttcttttgactcagtagtttcaaaacagtctttttgtataatctgctaatggaaatttggaagcccactgaggcctatggtgaaagaccaaatatccctagatgaaaactggaaagaggctacctgtgaaactgctttgggatgtgtggattcatctctcagagttaaaccttcttgtgattcaacaggttggaaacacatttctgtagaatctgtgaaaagacaattaggagcccgttgtttcctatggttaaaaaccgaatatccccagaggaaaaaaaataagctatctgtgtaactactttgtgatgtgtggattcatctcacagaactaaacttttcttttgattgagaaggttggaaacacttgttttgtagaatctgcaagaagacatttccgtgcccattgaggccaatggtcaaaacccgaatatccccagttaaaaactagagggaagctacctgtgaaactgctttgtgatgtgttgattcatctcacagagttaaatctttcttttcatttggcaaattggacacactgtttttgtagcatctgcaaagaaacatttgaaagcccactgaggcatatggtgaaaaacaatatccccagataaaaactagaaagaagtggtacgtaaaagtgctttgtgatgtggtgatgtgttgattcttctgacagaatgaaatgtttcttttgattctgcaagatggaaacactatttttgtagaatctgtgaagggtcaatttggagccaattgatgcctttggtaaaaaaatgaatatccccacataaaaactagaatgaagctgtctgtaacagtgctttgtaatgtgtggattcatttcacagagataaccctttcttttgattcagtaggttggaaacactgttattgtacaatctgctaagagacatttggaagcccattgaggcttacagtgaaaaactgaatatccccagataaaaacaagaaagaagctatctatgaaactgctttgtgatgtgtggattcattttacaaagataaacttttcttttgttgcagcaggttggaaactctctttttgtagaatctgtgaagaaacatttgggagcccattgatgtctatggtgaaaacccaaatatccccagataaagactggaaagaacctctctgtgaaactgctctgtgatgtgtggattcacctcacaaagttaaacctttctcttgattcaacaggttggaacacacttttggtagaatctgtgaagggagatttggaggcccaatgagacatatggtgaaaaactgaatatccccaagtgaaaattggaaaaaagctatctgtgaaactgctttgtgatgtgtggattcgtctcacacacttacaccattcttttgattccacaggttggaaacactccttttgtagaatctgcaaagagacagtttggagcgaatttattcctaaggtgaaaaaccaaatatccccattaaaaaaactagaaaaatctatctgtgaatgtgctttgggatttgtgaatttattacacagggataaatttttttttgattcaacatgttgaaaagaatatttttgtaaaatctgtgaagggacatttgaaagcccaatgaggcatatggtgacaacttgaatatccgccgataaaaactagaaagaagctacctgtgaaactgctttgtgacgtgtgggttcatttcatagagttaaacctttcttttgattcaacaagttggaaacactctctttgcagaatctgcaaagggatatttgaaaaccctttgaggcctatggtgaaaaccagaatatccccagatataaactagaagaagctatttgtgaaacttctttgtgatgggtgaattcatgtcacagggttaaacctctctattggttaaggaggtttgcaaaactatttatttttgcaactatttattattgaaagcttgtggtgaaaatccaaatactcccagataaaaacgagaaagaagctatcagtgaaactgctttgtgatatgtggattcatctcgcagagttaaacctttcttttgaataagcaaattggaaactctatttttgtggaatatgtgaagagacatttaagagcccattgaggcctatgttgaaaaacaggttatccctagataaatactagaaagaagctatctgttaagctgttctgtgatgtggggattcatctctcagggttaaacctttctgatgattcagcaggttggaaacacttctcttttagaatctgtaaagagacatttgggaacccattgatacctatggtagaaaacagattttcccaagataaaaactagaaagaagatatctgtgaaactgctttttgatgtgtggattaaccacactaacataaacctttctttagattcagctggttggaaacacaatttttgtagaaactgtgaagggacatttgggagccctttgacacctgtggtgaaaaacagaatgccagcagataaaaactagaaagaagctatctgtgtaactgctctgtgatgtgtgaatttatctatcatagtgaaacctttcttttgattcagaaagttggaatctctgttttggaagaatctgtgaaaggacattttggaacttatggaggcataatgtgaagaactaaatattcccagataaaaactagaaagaagctatttgtgaaactcctttgtgatgtgtggattcatgtcacagagttaaatctttctactcatccagcaggttgttaacactctttctgtagtatctgtgaagggacagttgagggcccacacagacctgtggtgaaaaaaataatattcccagataaaaactaggaaaagctatctgtgaaactgttttgtgaagtgtggattcatctcaaagatttaaacctttcttttgattcagaagattggaaacattcttcttgtagaatctgcaaagggacattttggagccctttgaggccaatggtgaaaaaagaatatccccacataaaaactagaaaaaagacatctgtgaaactactttgtggttcttggactcatctcacaaagataaccgtttcttttgattcagcagattggaaatttttttttgcagaatctgcgaatggacatttggaagcccattgaggcctatggtaaaaaactgattatccccagataaaaactaaaaataagctatttaagaaactgttttgtaatgtgtggattcagcttaccgagataaaccttttttttggttcagcaggttggaaacactcttttgtagaatctgcaaaggaatatttggaagccctttgaggcctatgatgaaaaacagaatatccccagataaaaactaaagagaagctatctgtgaaactgctttgtgctgtgtagattcatctgacagagttaagtctttcttttgattcagtgatttacaagcactttttttgaagtatttgtgaaggtacctttgggagcccattaaggcctatggcattaaaccaaaaatcttcaaataaaagtgagaaagaagctctctgtgaaactgctttgtgatatgtggatttatctcacaaagttaaacctttcatttttttaaatgtgcagtttgaattttaatacatttgtacttatagaagatataaacaatttacaaaatgtagaagagatggaatttacccatcatttaaactaaatttttaataatttgttttttctaatttctttctttcatattccaggtaataaagaactatgctatacggaattccattggcattattatacaaaatcatagtagatacactgaaagataaaattcctacaatcaaatatgctactctctggctaaattttctcagtagcattttgcagaatgtttacatctttcatagaagcaaatttattaaaatttcaaatggcacagtgctttacaggaatcacatttattaacactcctttatttattaaaactaataaataattaaactattatatagaccctcctctgtattacaactacaaaggactataaatcatgctgctttaaagacacatgcacacatatgtttattgtggcactattcacaatagcaaagacttggaaccaacccagatgtccaacaatgatagactggattaagaaaatgtggcacatatacaccatggaatactatgcagccataaaaaataatgagttcatgtcttttgtagggacatggatgaaattggaaaacatcattctcagtaaagtatagcaagaacaaaaaagcaaacaccgcatagtctcactcataggtgagaattgaacaatgagaacacatggacacaggaaggggaacatcacactctggggactgttgtggggtggggagaggggggagggatagcattgggagatatacctaatgctagatgacgagttaatgggtgcagcataccagcatggcacatgtatacatatgtaactaacctgcacattgtgcacatgtaccctaaaacttaaagtataataataataaaaaaagaaaaaagatacctattttctaattgtcaccgctaattaccccaagggcagctgttcgttcatctaccaccagctctcctgtgttctgtactgtccatattttgcctctgataatgcataccactaaaaagaatcagggtacctgggaggaaaattgattccagtgttcaagcaggaaaaaaaatggattggtctggaatatccttttgttgtctgaaatgagctattgcttaaaaaatgtcaggagcagtgctaaaggacagaagagcaaacttaacaaggcttccattggctaagctgcaaagaccatcatcataattgtgataataatcatagtagttaaaacctttccttctattcagcaggttggaaacactgactttgtagagtgttggaagggatattttgatgcccatttagccctatgttaaaaaagtgaatattttcatataaaaccttgaaagaagatgtctgtgaaactgctttgtgatgtgtgcattcatttcacagagtaaacagcttctttttattcagcatgttggaaacactgtttttgtagaatcagcaaggagatatttgggagtccgttgaggccaatggtgaaaaaccaaacatctccagatataaactagaaagaagctatctgtgaaactgctttgcaatgtgtggatttatcttgcagagttaaaccttttttttttttgatccagcagtgttgaaacactctttttgtgaaaactacaaaggagtatttgggaatccattgaaacccatggtggaaaaaatgagtatttccacataaaaaacagaaacaagctttctgtgaaactgctttctgacatgtggatttatctcacagagttgaacctttctttcgattcagaatgttgtaaacactctttttgattcagaagtttggaaacaaatggacatttgggagctttctgaggtctatggttaaaaaaggaatttcccagataaaagttagaaagaagctatctgtgaaacttctttgtgatgtgtggattcacctcacagggttaaacgtttctttttattcagctgtttggaaacacacttcttgtagaatctgtgaagggacatttgagagacaattgaggcctatagtgaaaaatcaaatatccccagataaaatatagaaagaagctatttgtgaaactgctttgtaatgtgtggattcatgtcacagggttaaacctttccattgattcagcacgtttgaaaacttttttttttgtaaaattcaggagaagatatttgaaaacccattgagttctatggtgaaaaaccaaatattcccagaaaaaaccttgaaagaagctatctgtgaaactactgtgtgatgtgtggattcatctcacagagttaaacctttcttttgattcagaaggttgtaaacacacttttcatagaatctgtgaagggaaatttcaaagccattgaggcctatggtgagaaactgaatatctccacttaaaaactaaaaagaagctatctgtgaaactgctttgtcatgtgtggatttatctcacagagttaagccattctttttattcagaaggttggaaaaactcttcttataaaatctgcaaaaagacatttgggaattctttgaggcctatggtaaaaaatggattatctccagattaaaaagtagaaataagctatctgtgaaactgctttgtgacgtctggattcatctcacagtttaaagtttcttttggttcagcatgttggaaacaatctttttttagaatttgggagcctattgagtactatggtgaaaaacagaatatccccagataaaaactagaaagaagttatctgtgaaacctctttgtgatgtgtggattcacgtcacaaatttaaacctttctattgattcagcaggtttcaaacacttttttttaaagaatctttgaaaagacagatgaaagttcattgaggcctatggtgaaaaaccgaatatcccagataaaaacttgaaagaaactatcaatgaaactgctttgtgatgtgtggattcacttcacagaattaaagttttgtttgattcagcaggttggaaactttttttttttttttagaatctatgaaggcacattttagagcccattgatgcctgtggtgaaaaaccgaatatcgtcagataaaaactagaaagaagtaatgtgtgaaactgctttctgaggtgtggattcacaattcaccacgtagactgaaacttttctttccactcagcagattggaaacacttttttttttaagaatttaggagcccattgagcattgtggtgaaaaaaccaaacatctccagataaacactagaaagaagctatctctgaaattcctttgtgatgtgtggattcatctcacagaggaaaacccttttttatttatcagcaggttgggaatattcttaatgcagaatctgcagaagaacatttgtgagaccattgagacttatggtgaaaaattaatatccccagataaaaacgagaaaaaatatgttggtgaaactgctttgtgatgtgtcaattcacctcacagagttaaacctttctttggattcagcatgttagaagcacattttttaacattttgaagcccattttggcctaccattaaaaactgaatatccacagattacagagtagaaagaagatctgtgttaaactgctttggatacgtggatttatctaacagaagtaaagctttcctttaattctgcagtttggaaactctttttttgtagaatctgggaagggatatttgagagtcctttgaaaactatcgagaaaaactgaacattccctgataaaactagaaataatctatacgtgaaaactgctttgagatgagtggattcatctcacagggtttaacctttcttttgattcagcaggttggaaacactttttttgtttaatctgtgaagagacattttggagcccactgggaacccaagtgaaaaaccgaatatccacagataaaagctagaaagaatctatctctgaaacagataaaatatttcttctcccagagttaaacctttcttttgattcagcaggttggaaactctctttttgtagaatctgtgaagggacgtttgggagccaattgagacctatggtgaaaaactgaatatcccatgggaaaaactagaaagtagctatctatgaagctgctttgtgatgtgtggatttatcttacagaaataaagctttctttggattaagcatgttggacacactatcattgtagaatctgcaaagggacatttgtgagtccattgagtcctatggtgaaaaatggaatatccccagttaaaaagcagattaaaccttttttaaattcaacaggttgtaaactctttttgttgattctgtgaaaggatatttgagagtccattgaggcctatggtaaaaaactgaacatccaagataaaaactagaaacaaggtatttgtgaaactgctttgtgatatttggattaatctcccagagagaaaatttcttttctttcaacaagttgttaacactctttttgtagaatctgcgaaaagacattggggatcccattgtggtctattgttaaaaatattatttacagataaaaactagaaagaagctgtctgtgaaactgctttatgatgtgtggattcatcttaaggagtcaaacttttctttttattcagcaggttggaagcattcttagtaggatttgggaagggacattttggggcccctagaggcctatgatgagaaaccaaatatctccagactaaaaactagaaagagactatctgtgaaactgttctaagatgtgtggattcatttcacagagttaaagctgccttttgatttagaaggttgaaaacactctttttgtagaatctgtgaagggacatatagagcccattatatcctagggtggaaagtcaaatatccccagataaaaactagaaagaagctatctttgaaactgctttgtgatgtgtgaattcatctcacagagttaaacctttctgttgattcagcaggttggaaacactctttttgtggaatctgctaaatacatttgggagcccattacagactatggtgaaaaacagtataaccccagtggaaaaactagaaagaagatatctgtgaaactgctctggactgtgtggattaatctaataaagttaaactttcctttgatttatcaggttgtaatcactctttttcgtagaatctgcaaagggacatttggaagcccactgaggcctacagagaaaaactgaatatgtgtactatctatgaaactgctttgtgatgtatggattcatctcacagagttaaacctttcttttgattcagcaggttggaaacactttttgtataatcatcaaagggacatttgaaagcccattgtggcctatggtgaaaaactgaatatccccagataaatactggaaagaagctacctgtgaaactcctttgtgatgtgtgcattcaactcaaatattttaattttttaaaattcaacaggttggaaatggttgataagctttcttttgatgcaccaggttggcaactctattattgtaaaagctgtgaaaggactttcaagaaacccttgtgacccatggtgaaaagccaaatatcccctgataaaaactagatagaacctatctgtaaaactgctttgtgatgtgtggatttgtctcactacattacaccttacttttgatttatcaggttggaaatactctttttgtagaatctgcaaagaaatatttgggagccccttgaggcctgcagagaaaaacagattatccccagaaaaagctagaacaatgctatctgtgaaactgctttgtgatgtgtggattcatctcacagagttaaacttttcttttgattcagcaggttggaaacactctttttgtagaatctaagaagggacatatgaaagcccattgtggcctatggtgaaaaactgaatatcctcagataaaactacaatgaagctacctgtgaaactcctttgtaacgtgtgcattcatctcaacaatttaaaaatttcttttaattcagcaggttggaaacactgtttttgtagactattcaaagaaacatttaaggacccattgtgtcctcctgttacaaaccaaaaatccccagatcaaaacaagaaggaagcaatctttgaaactgctttgtcagttgtgggttcatctacaagagttaaaactttcttttgattcaccaggatggcaactttatttttgtaaaatctgtgaaaggacatttaagaacctttgtggcctatggtgaaaaaccgaatatccccagataaaaactagaaagaagctacctgtgaaattgcttgttgatgtgcacttttatctcaaagatttaaacctttcttttgattcagcaggatggaaatacttttttttgtagaatctgtgaagaaacatttggaagccccttgcggcctaaagtaaaaaacagaatatccccagataaaaactagaaagatgctatctgtgaaactgcttttaaatgtgtggattcatctcacagaggtaaacttttcttttcattcagcaagttggaaccactctttctgtagaatatgtgaagggccttttggagcacattgagacctatgttaaaaaacagaatatccccagataaaaactagaaagaagctatctgtgaaattgcttcatgatgcatggattcatctcaaagaggtaagccttccttttgattgagcagcatggaaacacagtatttgtagaatctgggaaggggcattttgtaacccattttttcatatggtgaaaaaccgaatatctgcaattaaaaaatagaatctatctgtgaaactgcttcatgatgcatgtattcgtctcagagagttaaacctttcttttgattctgcagattggaaacactcttttttgtagcaactgggaagggatctttgagagcccattgacttctatgttgaaaaactgaagaaccccagataaagataagaaagaagctatatatgagactgctttatgatgtgtggattcatctcagggagttaaaactttcttttgattcattcggtttgaaacactcttgttgtataatttatgaagaaacatttgggagcccattgatgactatggtgaaaagccaaataaccccagataaaaactagaaagaagatatctttgaaactgctttgttatgtgagtactcatcttaaagagttaaaactttcttttgattcatccagttggaaatgctctttttgtagaatttgtgaagaaacatttgggaggcaattgaggcctatggtgataaatggaatattccaagatgaaaaactatagaaagaactttccatgatactggtctgggatgtgtggattcatctctcagagtcaatcctttcttttgattcaacaggttggaaacactttttgtaaaatcttggaagggacttttggagttcactgaggcctatggtgaaaaactgaatatccccagataaaaaatagaaacaatgtatctttgaaactgctttgtgatggctgtattcttctcacagagttaaacgtttgttttgatccagcaggttggaaaaactctttttgtagaatctacaaaggggaaattggaagcacattgaggcctataatgaaaaatgggcattcccagatcaaaactagaaggaagctatctgtgaacatgctttgttatgtgtggcttcatctcacaaagttcaacttttattttgattcagcaggttggaaacactattttagtggaatctctgatgggacattttggagcccattgaggcctatggtgaaaaactgaatatagctggatgaaaactcaaaaagaggtgtctgtaaaattactttgagatgtgtggatttatctctccatgttaaaccattctattgattcagcaggttgggaaaacactttctgtaaaatctacaaaaggatatttgagacctgtagtggcctatggtgaaaaactgaatatcccctgacaggaactagaaataaattatctgtgaaactgctttgtgatgtgttgattcttttcactgacttaaacctttttttgattcagaaggttggaaaccattttttgtagaatatgcgaagggacatttgggagcccattgaggcctatgttgataaactgaacatacccagataaaaactagaaagaagctatatttaaactgcttatgaagtgtgcattcatctcacaaattaaacctttcttttgattcagcaggttggaaacactctttacgtggaatctgtgaagagacattagggagcccatggaggcctttggtaaaaatctgaaaaatccaagataaaaactagaaataaagcatctgtgaaacttctttgaaatgtgtggattcctctcacagagttaaacctttcttttgattcagctggttggaatcactctttttgaagaatctgcaaaaggacttttggagcccattgaggaatatggtgaaaaagagaatatccctagataaaaactagaaagaaggtatctgtggaatcctttgagatgtgtggattcatctcaagtagctaaacctttcttttgattcagcagattggaaacacagtttttgtagaatctgggaaggggcattttggagtccattgagtcctgtggtaaaaaactgaatatcctcaattaaaaactagaaagaatctacctgagacagtccttcatgatacgtgaaatcatctcacagagttaaaccattcccttgattcagcaggttggaaacactctttttgtagaatctgggaagggacatttgagagcacattgagttctatggggaaaaacagaatatccccagatcaaaacttgaaagatgctatctgtgtaactgctttatgatgcgtggattcatctcaaagagggaaacctttattttgattcagcaggttggaaacactctttttgtagaatttgcaaagaaacatttgggagccctttgaggactgtggtgaaaaaccaaatatatccagataaaaaactataaagaatctaagtgtgaaactgctttgtgatgggtagatttatctcacagggctaaacatttcttttgatccagcaggttggaaactatcttcttgtagaatctgcaaagggatattttgaagcccattgaggctatggtggaaaaccgaacatccctagataaaaactagaaagaagctatctctgaatctgctttatgatgtgtgcattcatctcacagaattcaacctttattttgattcagcatgttggaaacactctttttgtggaatctgcaaagggacatttgaaagcccattgaggcctatgatgaaaaactgaacatccccagataaaatctagaaagaaggtatctgtgaaactgcttgatgatgtgtgaattcaactcacagggttaaacttttctttggattcagcaggttggagacactctttatatggaacatgcaaaggacaattggaagcccattgaggtctatggtaaaaaactgaaaaatccgagataaaaactagaatgaaggtatctggaaagctgctttgaaatgtgtggattcatctcacagagctaaacatttcttttgattcagtgggtggaaaccactctcattgtagaatctgtgaagggacatttggagtttattgaggtctaagttgaaaaacagaatatccacagagaaaaactaaaagaaaaatatctgtgaaactcttttgtgatgtgacgattcatcccagagagttatccctttttttgactcaaaaggttgaaaccattctagtggttgaattagtgaagggacattttagagaccactgaagcatatggtgaaaaactgagtaaccccaattaaaaactagaaagaatgatctgtgaaactgcttcatgacgtttgtactcatctgacaaagctaaaactttctttggattcagctgattggaaatgctctttttgtagaattttggaagggacatttgagagcccattggattttatgttgaaaaaccgaatatccccagataaaaaccagaaagaagctatctgtgaaactgctgtataagctgtggatttatctcaggtagtgaaaccttccttttcatttggcagcttggaaacacactttttgaagaatctgagaagaaacatttggagtcatttgagaaatatggggaaaatctgaatatcccaagataaaaagaagaaagaagctatctttgaaacagctttgtgatgactggattcatcttaaaaagttaaacctttcttttgattcagccaattggaaagcctcttttttagaatctgcaaagtatcatttgggagccctttgtggcatatggtgataaaccaaatatcccaagacaaaaaattagaaagaagttatctgtgatcttctatgggatttttggattcatctcacagagttaagcttttctttagattcagcgggttggaagggctttttgtagaatctggacagagacttttggagctcaatgaggcctatgatgaaaaactgaatattcctagataaaaactagaaagaagctcttggtgaaactgctttgtaatgtgtgaattcatcttaaagagttaaacctttcttttttattcagcaggttggaaacattgcttttgtggaatctgcaaagggacatttgagagcccattaaagcatatggtgaaaaacagaataccccagaagaaagactagaaagaaaatatctgtgaaactgctctgggatgtgtggattcatctcacaaagttaaactttttttaaaattcatcaggttggaaacaggttggaaactttctttgtagaatctgtgaagggacatttggaacccatttgaggcgtatgttgaaaaactgaatatcccaagataaaaaacagagagaagctatctttgaaactgctttgtgatgtgtggattcatctcagagttaatcctttcttttgattcatcagattggaagcacgctttttgtagaatcagggaagggacatttaagagactaatgatgcctatgaagaaaaacaatatcaacagagaaaaaccaaaaatatgctctctgtgaaagtctttcatgatgtgttggttcatctcacagagttcaacctttcttcttatttagcaggttggaaacattctctttgtgaaatctgagaaaggacatttaggagtgcattgaggcctatggtgaaaaaaagaacatctccagataaaaagtagaaagcagctgtctgtgaaactgctttgtgatttgtagattcatctcacacacttaaacctttcttttgatttagcaggttggaaaagctcttttgtagaatctccaaagggatagtttagcaaagaggcaaatggtaaaaagctgaatatcaccagataaaaactataaagaacattctgtgaaactgcttttttatgtgtggattcaactcacagaattaaaactttcttttgattcagtaggttgggtacactctttttgtagaatctggaaagggacatttgggaagccattaaggtctatggtgaaaaaatgaatatccccagttaaatactagaaagaagatatctgtgaaacttcttcatgagaagagatttatctcacacaggtaaacctttcttttgattcagcaggttggaaacactctttttgtagaattctggaagaaatatttgggagcccattgcatcctatggtgaataattgaatatacccagataaactctagaaagaactttctatgaaactgttttatgatgtgtggattcatctcagagagttaaacctttcagtggattcaccaggttggaaacactttttttgtagaatctgcaaagaaacatttgggagcccattgaggtctatggtgaaaaacaacatatccccagaaaaaaaagtagaaagaagatatctgtgaaactgtttcagatgagtggatttatttcacagagttaaacttttcttttgattcagcaggttggaaacactttttgtagcatctgtgaaaagacatttgagagcccactgtgtcctatggtgaaaaaccgaatatccccagataaaaactagaaagaagctatctgtgaaacagctttatgatgtgtgcattcatctagagagttaaacctttcttttgaatcagtagcttggaaacaatctttttttagaatctgtgaagaaacatacgtgagcccattggctttgtgatgggtagatttgtcttaaaaagttaaacctttcttttgattcatcaggttggaaacactcattttgtagaacctgtgaagggacatttggtagccttttgaggactatggtgaaaaaccgaatatccccagataaaaactagaaagaagctatctgtgaaacagctttatgatgtgtgcattcatctagagagttaaacctttcttttgaatcagtagcttggaaacaatctttttttagaatctgtgaagaaacatacgtgagcccattggctttgtgatgggtagatttgtcttaaaaagttaaacctttcttttgattcatcaggttggaaacactcattttgtagaacctgtgaagggacatttggtagccttttgaggactatggtgaaaaactgaatatctccagatgaaaaactaaaaagaaactatttgtgaaatggctctgggatgtgtggattcatcacaagaggtaaattttttttgattcagcattttgtaaacactctttttgtaaagtctgggaagaaattttggagaaatttggggcttatggtgaaaaatggaatatctccaaataaaatctagaaagaagctatctgtgaaacaactttgtgatgtgtgaattcatctcacagagttaaaacttacgtttgattgagcaggttggaaacactctttttgttgaatctgtgaagtgacatttgggagcccattgatgtctatggtgaaaactgaatatccccagataaaaactataaaaaagctatctgtgagactgattcatgacgtgtgaattcatcttacagatttaagcctttcttttgattcagcagcttggaaacactttttttgtagaatctatgaagagacatttggggcccattgagacatatggtgaaaatcaaatatccccaaatgaaaactagaaaaaagctatctgtaaaagttctatttcaagtgtggatttagttcacagagttaaactcttactttgtttctgcacattggaaacattctttttgtagaatcagcaaagggacatttaactgcccattcatgcctagggtgaaaaatcaaatatcaggagataaagaccagaaagaagctatttttgaaagtcctttgtgatgtgtggattcatctcagagagttcaacttttcttttttttcagcaggttggaaacattttttgtgtaatctgtgaagggaaatttcagagttcattgaggcctatggtgaaaaagagaacatcccccaataaaaagtagaaagaaacaatctgtgaaactgctttgtgatgtgtggattcatctcacagagtaaaaactttcttttgatttagcaggttggaaaaactctttttgtagtatctgcaaagggacatttgggagcccattgagacctatgttgaaatcacatatcttcagataaaaactagaaagaagttatctttgaaactgctttttgatgtgcagattcatctgacagagttaaacctttcttttcatttagcaggttggatacacacttcttgtagaatctgtgaagggacatatgaaagcccattgtggcctatggtgaaaaactgaatatccccagtttaatactagacagaagctatctgtgaaactgttctgtgatgtgtgaattcatcttacagagttaaacttttcttttgattcagcaggtttgatatactctttttgtacaatctgctaagaaatttttggagacaattaaggcctaaggtgaaaaaccaaatatccccagataaatattagaataaagctatctgtgaaactgcttcgtggtgagtggatttatctcacaaagttcaacgtttcctttgattcagcagattggaaacactttttgtaggatctgtgaagggacatttgggagcacattgagtcttacggtgaaaaaccaaatatctccagataaaaaatagaaagaagttacttgtgaaactgctttataatgtgtggattcatgtcagagaggtatacctttcttttgattcagcaggttaaaaacacttttttttgtagactctgtgaagaaacatttgggaacccattgaggactatggtgaaaagcagaataccccagataaaaactagatagaagctatgtttcaaactgctttatgatttgtggattaatattaaaaagttaaacctctctttacactcagtaggttgaaaacgccctttttttagaatctgcaaagtgacatttgggagccctttgaggcctacggtgaaaaacagaatatccacaaacaaaaaactgaaacgaacatactgtgaaactgctctgtgatgtatggattcacctcacaacgttaaactttacttttgattcagtaaattataaaaaatctttttgtagaatctctgaagggacatttgggagcacattgaggactatggtaaaaaaacaaaatatccccattaaaaaaaactaaaaaaaaaaagattgtgaaactgctttgtgacgtttggaatcatctcacagaattaaaactgttttgattcagcgtgttaaaataactctttgtgtggaatatgtgaagggaattttggagcccattgaggcctatggtgaaaacaatttttttccaattaaaaactcaaaagaatctatctgtgaaacagcttcatgatgcatggatttatctcagaaagttaaaactttcttttgattcagcaggttggaaacactctatttgtagaatttaggaagggacatttgagagcctttcgagttctatggtgaagaacccaatatccccagataaaaactggaaaggtgctatctgtgacactgctttataatatgtggattcatctcagagagttaaacattttctgtgattcaacagattggaaacacactttttgaagagtttttgaagggacactaggaagccatttaggcctatggcgtaaatctgaatactcccagataaaaactaggaagaagctatctgtgaaactgccttgagatgagtgcattcatctcacagagttaaacctttcttttgaatttagtgggatggaaacattctttttgtagaatctgcaaatagacatttgggagcctattaagaactatggtaaaaaactgactatccccagataaaaagtagaaagaatctatcagtgaaacttttatggaatgtgtatattaatcttaaagaattaaacgtttcttttgattcagtagattggaaacactctttttgtagaattcacaaagggacattgggagccctttaaggtctacgatgataaagcaaatatcccaaaatgaaaaacaaaaagaagctatctgtgatacagctctgggatgtgtggattcatctcacagagttaaacgtttcttttgattcagcaggttgaaaacactctttttgtaggatctgggaagggactgatggaactcattgaggcctacagtgaaaaaccaaatatctgcagataaaaaagagaaagaacctacctgtgaaactgttttttgttgagtggattcatctctctgacttaaatttgtcttttgattcaacaggttgcatacactcttattgtaaaatctgtgaagataaatttgtcatcccattgaggcctatggtgaaaaatcagtatccccagttagaaactagaaagaagctatctgtgaaactgctttgtgatgtgtggtttcacctcagagagttaaatgtttcttttcttcagcaggtttgaaatatcctttttgtagaatctatgaaaggacatttagagtgcattgaggcctatgataaaaaatcaaatattcctagataaaaagctagaaagaagctatctctaaaactgctttttttatgtgtgggttaatctcacataattaaacctttctttttatttagaaggtaggaaacaacttttttgtagaatctgtgaaatgacatttgggagacccttgaggcctgcagtggaaatccaaatatcccaagatgaaaacaagaaagatgtgatctgcgaaactgctttgtgatatgtggattcatcttacagaattaaacctttcttttgattcagcaggttggaaatactctatttatagagtctgtgaagaaacacttggagctgatggtggcctatggtgaaaactgaatatccccagataaaaactgcaaagaagctgtctgtgaaactgctttgtgatgtgtggactgatatcataaaatttaacctttcttttgatccagcaggttgaaagcactgtttatgtagtatccttgaaaagacattttggagatcattgaggcctagaaacaagaatgaagctatctgtgaaactgctttgtgatttgtggattcaccccatagagttacccctttcctttggctcagaaggttggaaacacaatttttgtagaatctatggagaagcatttgatagcacattgaagcctatggtgaaaaaccaaatatccccagataaaaactagaaagaatctgtgaaacagctttgtgatgtgtggactcatctcatagagttaagcctttcttttgattcagcaagttgaaacactctttttgcagaatctgcaaagggacatttggaagctcattgaagttatgattaaaaactgaatatccctggatgaaaagttgaaagaagctgtctctgaaactgctttgtgatgtgtggattcatctcacagaagtaaacctttcttttgattcagcagttcagtaacacttttttgtagcatctgccaaagtacgtttgggagtcccttgaggcctttagtgaaaaatcaaatatccttagatagaactagaaagaacatatctgtaaaactgctgcttgatgtgtggattcatctcaaagacttaaaccttcctttaggttcttcaggtaggaaacactgtttttgtacactattcgaagaaagatttgggggcccattgaatcctatgctgaaaaattgaatatcgcaagatcaaaacaaaaaagaagctatctggaaaactgctttgtgatgtgtggttttatctcaaagagttaaacctttcttttgattctgaaggttggcaactctctttttgtaaaatctgtgaaaggacatttgggagccaatggtggcctatagtaaaaaacagattattcccagatgaaaactagaaagatgctatctgtgaaactactttgtgatgtctggattcatcttacagagttaaacatttctattgattcagcaggtagggaacactctttttgtagaatatatgaaagtatatatggagtgctttgaggtctacggcaaaaaattgaatatccacagataaaaactggaaacaagccaactgtaacggctttgcaatgtgtgggttcatatcacagagtaaaaacttacttttgatcagcagtttggaaacactctttttgtagaatctgtgaagggacatttaaaaaaaccactggagtcctacggtgaaaaacagaatatccccagataaaaactagaaacaacctatgtgtgaaactgctttgtgacgtgaaggaatatttgggaggccattgagacctatggtgaaacaccaaatatcctcaaataaaaactagaaagaagctatctgtgaagctgctttgtgatgtgtgcatttatctcaaagacttaactttttttttgattcaacagtttggaaacactctttttatagaatatgtgaagggacatttgggagccccttgagacctaaggtgtaaaatcaaatatctgcagataaaaactggaaacaatttatctgtgaaactgctttgtgatgtgtggattcttttcacagagttaaaacttacttttgatcagcatgttggaaacaccctctttggagaatctgtgaagggacatttgagagcccattgaggcctatggagaaataccgaatatcaacagataaaaactagaaagaaacacctgtgaattgacattgtgatgtgtggattcatctcacagagttaaaccttactttttatcagcaggttgggaatactcttgttgtagaatctgcaaagtaacatttgggaactatttgaggtctatcgtggacaacagaatatcaacagataaaaaatgtaactaagctatctgtgaaacttctttgtgatgtgtgaattcatctcatagagtttaacctttctttgattcagcaggtcggaaacactctgtttgtagaatgtgtgaagggacatttaggagaccaatgggcccatatggtgaaaaactgaatatcctcagatgaaaactagaaaggagctatctctgaaactgcttttttatgcgtgattcacctcaaaaaggtacaactttttttgtttgtttcagcaggttaaaaacactgttttttaaaatcagcaagaagacatttgggagcccattgagacctataatgaaatgcaaaatattcacagataaaaactagaaagaagctctctgtgaaatggctttgtgatgtgtgcattcatgtcaaaatgttaaacctttcttctaattcagcatgttggaaacactcttcttgtaaaatttgcataaggatgtttgaaacccagttgaggcctatggtgaaaaacagaacatccctagacaaaaactagaaagaagctatctgtgaaactgctttgcaatgtgtggattcatctcacagagttaaaccttactttttatcagcaggttgcaaacatcctttttgtaaatcctgccaagaaacatttggagcccattgtggcctatggtaaaaaactgaatattccaagataaaaactagaaaaaagctatctatgaaaatgctttctgatgtgtgaacttatctcatggagttaaatctttctttagattcaggattttggaagaactctttttgtagaatctgagggtgcacaaacaggggacattgaggccaatggtgaaaaacagaatatcttctaataaaaactcgaaagaagctatctgtgaaactgctttgtgatgtatggattcatctaagacagctaaacctttcttttgattcacagcttgaaaacactctttttgtgaagtacgtgaagggacatttggagaccatttaggcttatgttgaaaaaccaaatatcttcagataaaaattaaaataagctatatctgaaattgcatggtgatgtgtggattcatctcatagagttaaacccttcttttgatcagcaagttggaaacactgtttttgtagaacatgtgatgggacatttgggagcccattaatgcctatggtcaaaaatggattatccccagataaaaactagaaagaagctatctgtaaaactgcttcatgatgtgttgattcatctcacagagttaaactgttcttttgatcagcaggtgggaaacagttttttcttagaatctgcaaagggatatttgggagcccactgaggcctagggtgaaaaatcgaataaaccacataaaaactagaaagactctatctgttaaactactttgtgatgtgtggattcctatcacagagttaaaccatttttttttgtttcatgaggttgaaaataatctttttgtaaaaaatgctaagggacatttgtgagcccattgaatcctatggtgaaaaaccgaatatcttcagatagaaactagaaagaagatgtctgtgaaacttctttgagatgtgtggatcatctcccagagttatatgtttcttttggttcagcaggatggaaacactctgtagaatttgcaaaaggacatttgggagcctattgaggcatacagtgaaaaacaaagtatctatggataaaaattagaaaggagctatctgtaaaactgctttgtgatgtgtggattcatctcacagagttaaacctttctattaattcagaaggttggaaacacactttttgtagaatctgagaagggatatgtggagcccaggaggcctatggtgaaaaacgaaatatacccagataaaaactagaaagaagctttctgagaaactgttctgtgatgtgtggattcatctcaaagagttaaacatttttttttgcttcagtaggttggaaacacgttttgtagtatgtgcaaagggacatttgggagctttttgatgtctatagtgaaaaaccaaatatcctcagatagaaactacataaaatctatctgtgaaaccagtttgtgacgtgtggatttatctgacagagttaaacctttcttttgattcagcaggttggaaataatctttttgtaaaatctgcaaagggacataaaagagtgcattgagatctatggtgaaaaacagaatatccccagataaaatctagaaagaagctatctgtgaaaccgatttgtgatgtgtgcattgatttcacagggttaaacctttcttttgattcagaaggtttgtggcactgtttttgtagattctgtgaagaaacatttaagagatatttgaagcctgtggtgaaacacagagtattccaaataaaaacttgaaagaagctatctgtgaaacttttttgtgatgtgtggattcatctaacagagttaaacctttctttgattcagcacattggaaatactctttttgtagaatctgtaaaaggatatttgggagcccattgaggcctatggtaaaaaacagaatatttccagataaaaactagaaaaaagctatctgtgtaactgctttgtgatgtttggattcatctcacagaattaaacatttctttttattcagcaggttgaaaactcttttgtacaatctgtgatgggacatttgagggcccattgacgcctatggtgaaaaactgaatatcctgataaaaactcaaaagaaactatctgtgaaactggtttgtgatgtgtagattcatcacacggagttaaacatttctttttattcagcagatgggaaacacttttttgtagaacctgtgaagggacatttgagagcccattgaggtatacagtgaaaaaccaagtatccccaaataaaaactagaaagaagccatctgtgaaactggtttgtgatgtatgcattcatctaactgaagtaaaccttgcttttgattcagcaggtggcaaacactttttcgtagaaactgtgaagggatatttgagtgcccatagagacctatgatcaacaactgaaatttcccagataaaaaaattgaaggaagctagatgtaaaactgctttgtgatctgtgggttaatctcattccttctgaaactattcgaaacaatagaaaaagagggaatcctccctaattcattttatgaggccagcatcatcctgataccaaagccaggcagagatgcaaacaaaacagagaattttagagcaatatccttgatgaacattgatgcaaaaatcccaataaaatactggcaaactgaatccagcagcacatcaaaaagcttatccaccatgatcaagtgggcttcatctctgggacgcaagcctggttcaatatacgcaaatcaataaacctaatccagcatataaacagaactaaagacaaaaaccccttgattatctcaatagaggcagaaaaggcctttggcaaaattcaacaatgcttcatgctaaaaactctcaataaattaggtattgatgggatgtatctcaaaataataagagctatctatgaaaaacccacagccaatatcatactgaatgggcaaaaactggaagcattccctttgaaaactggcacaagacaaggatgccctctgtcaccactcctattcaacatagtgttggaagttctggccaggacaattaggcaggagaaggaaataaagggtattcaattaggaaaagaggacgtcacattgtccctgtttgcagatgacatgattgtatatctggaaaaccccattgtctcaacccaaaatatccttaagctgataagcaacttcagcaatgtctcaggaaacaaaatcaatgtacacaaatcacaagcattcttatataccaacagacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaatattccatgctcatgggtaggaagaatcaatatcgtgaaaatggccataatgcccaaggtaatttacagattcaatgccatccccatcaagctaccaatgactttcttcacagaattggaaaaaactactttaaagttcatatggaaccaaaaaagagcccacatcaccaagtcaatcctaagccaaaagaacaaagctggaggcatcatgctacctgacttcaaactatactacaaggctacagtaaccaaaacagcatggtactggtaccaaaacagagatatagatcaatgggacagaacagagccctcagaaacaatgccacatatctacaactatctgatctttgacaaacctgagaaaaacaagcaatgggaaaaggattccctatttaatatatggtgctgggaaaactggctagccatatgtagaaaactgaaactggatcccttccttacaccttataccaaaattaattcaagatggattaaagatttaaacgttagacctaaaaccataaaaaccctagaagaaaacctaggcaataccattcaggacgtaggcatggacaaggacttcatgtctaaaacaccaaaagcaatggcaacaaaagccaaaattgacaaatgggatctaattaaactaaagagattctgtgcagcaaaagaaactaccatcagagtgaacaggcaacctacaaaatgggagaaaattttcgcaacctagtcatctgacaaagggttaatatcaagaatctacaatgaactcaaacaaatttacaagaaaaaaaaaacaaccccatcaaaaagtgggcaaaggatatgaacaggcacttctgaaaagaagacatttatgcagccaaaaaacacatgaaaaaatgctcaccatcactggccatcagggaaatgcaaatcaaaatcacaatgagataccaaatcacaccagttagaatggcaatcattaaaaagtcaggaaacaacaggtgctggagaggatgtggagaaataggaacacttttacactgttggtgggactgtaaactaattcaaccatggtggaagtcagtgtggcgattcctcaaggatctagagctagaaataacatttgacccagccatcccattactgagtatatacccaagggactataaatcatgctgctataaagaaacatgcacacgtacgtttattgaagcactattcacaatagcaaagacttggaaccaagccaaatgtccaacaatgatagactggattaagaaactgtggcacatatacaccatggaatgctatgcagccataaaaaatgatgagtttatgtcctttatagggacatggatgaagttggaaatcatcattctcagtaaactatcataagaacaaaaaaccaaacactgcatattctcactcataggtgggaattgaacaatgggaacacatggacacaggaaggggaacatcacactctggggactgttgtggggtggggtcaggggggagggatagctttagaagatatacctaatgctaaatgacgagttaatgtgtgcagcacaccagcatggcacatgtatacatatgtaactaacctgcacattgtgcacgtgtaccctaaaacttaaaatataataataaaaaaaaaatctcacagagttaaacctttcctttgatgcaaccggttggaaacactctttttgtagaatatgcaaagggacatttgggagcttagtgagacctatggtgaaaaaatgaaatgtcatcagacaaaactcagaagaagctatctgtaaaactgcttactgatgtatggattcatctcacagagttaaaagtttccttttactaagatggttggaaacatgctttttgtagaatattcaaagggacttttgtgagcccattgaaatccacggcataaaacaaaatatccccagataaaaactagaaagaagctgtctgtgaaactgctttgtgatgtgggaattcatctcaaacagttaaactttttttttgattcagcacattagaaacactcttgttttagaatcagagaagaaataattaagagccctttgaggcctctgttgaaaaaggaattatctccagataaaaattcgaaagatgctatcatcaaagctgctttgtgatgtgtggattcacctcactgatttaaaccttgcttttgattcattaggttggaaaccttttttgttgaacctgagaagaaacatttgggagcctattgaagcttttgggaaaaaacagaatatcttcagataaaaaccagaaagaagttatacattacattaaactgctttttcatgtatgcatttatctcatagagttaaaccttgcttttgattcagcaggttggcaacactctttttgtagaatctgtgaagggatatttgggagcccattgaggcctatggtgaaagacagaatattcccagataaaaactagaagggagctatctgttaaaatgctttttgatgcatggattcatctcacagagttaaaacgtttttttatttagcagtttggaaacactctttttgtagaaactgcaaagggacatttgggagccaagtgaggcctatgctgaaaaacagaatatccccagataaatagtagaaagcagatatctgggaaaatcctttgtgatgtgtggattcattccaaagagtttaacctatcctttgagtcagcaggttggaaacacctttttgtggaatctgtgaaaggacatttgggaacccattaaagtctatggttaaaaacataatatcccctgataaaaatgggaaggaagctacctgtaaaacttctttgtgatgtgtggattcatctcacagtgtgatacatttctgttgactcagtaaggtggaaacactctttctttagaatctgtgaagttacatttgaaagcctatggtggcctaaggtgaaaaacagattatccccagataatatctaaaagtaagctatctgtcaaactactttgtgatgtgtggattcatctcacagagtgaaaccatacttttgattcaacaggttagaaaccctcttcttatagaatctgtgaaaggacttcaggaccccattgaggcctatgctgtggcctatggtcaaaaacagaatatccccagataaaaactagaaagaatctatctgttatacttctttgtgatgtgtggattcatctcacagtgttaaattgttcttttgcttcaggaggttgaaaacactcattttcttagaaaatgcaaagagacatttgtgaatccattgaggtctatggtgaaagacaaaatattcatgaacgaaaactagaaaggagatatctgtaaaactgctttgtgatgtttggattcatctcacagagtttaactttccttttgattcagcaggttggaaacactctttttgtagaatctgcaaagggacatgtgaagcccattgaaacctatggtaacaaatggaatatccccagacaaaaatgagaaagaagctatctgtgaaactgctctgtgatgtgtagattcatctcacagacggaaacgtttcctttgattccacagtttggaaacacgttttgtagtatctgtgaagggacatttgaaagactattgaggtctaaagtggaaaacctaaaatacccagacaaaaactagaaagaatctatatgtgaaaccggtttgctatgtgtggcttcatcacacagaggtaaatctttcttttgattcagcagattggaatcactctttttgtagaatctatgaaggaacatttgggagcccattgagacctttgatgaaatactgaatatctgcagataaaaactagaaagaagctgtctgtgaaattcctttgtgatgtgtggttttatctcacagggttaaacctttcttttgatataggaggttggtaacactgtttttttagattgtgagaagaaacacttgggagcccattgacgcctatggtgaaaaacagaatattcccagataacaacgaggaataagctatctgtgaaactcctttgtgatatatggattcatctcacaaagttaaatttttctttgattcagcaggttggaaacactctttatgtagaatctacctatggacatttgggagcccattgaggcctatggtaaaaatcagaatatccccagataaaaactagaaaaaagctttctgtgaaactgctttatgatgcatagattcatcttacagggataaacctttcttttgattaagcaggttggaaaccttctctttgtagaatctgtgaagggacatgttggtgccatttatgcctatggtgaaaaactgagtatcttcagataaaaactagaaagaagctggctctgaaacttgtttgtgatgtgtgcattcatgtgacagagttaaacctagcttttcattcagcagttggaaaacccttctttgtagaatctacaaagggacatttgagagcccattgaggcctatagtgaagaacttaatgtccccagataaaaaaaaatattgaaggaaactatctgtgaaactgctttgtcatgtgtggattcatctcacagaggtaaaacattcctttcatccagcaggttggaaacacaccttttgtagaatctgcaaagaggcattttggagccctttgagacctatggcaaaaaaccgaatatactcagataaaactagaaagaagctgtctgtgaaactgcttactgatggatggattcatctcagagagttgaaccttttgttttactgagaaggttggaaaaactttttcgtacaatatttgaagggacaattttgaggccatagaggcctatggtaaaaaactaaatatccccatataaaaaatagaaagagtctatctgctttgtgatgtcaggattcctctcaaataattaaatttttcttttcattcagcacattggaaacactctttttgtagaattggcaacaggacaattaagagtccattgaggcctctggtgaaaaagtgaatatccggagataaaaattagaaagaagctatcttttaactgctttgtgatgtgtggattcatctcacagagttaaatcttgcttttgattcatcaggttggaaacagtttttttatagaatctgtgtagggacatatgggagcccagtgaaacctatgggaaaaaacgaatatcttcagatagaaaactagaaagatgctatctgtgaaactgctttgtgatgtgtacagttatctcaaggagttaaaactttctttggattcagcaggttggatacactgtttttgtagagtcttcaaaaagacatttgggggcccactgaggcctaaggtgaaaactagaaataaagtatctgtgaaactgctttgtgatgctttgatacatctcacagagttaaaccttatatttgatcaacaggttgaaaacactctttttgaagtatttgcaaagggacattttaaagcccattgaggcctatgttgaaacattatatccccagataaaaactaaaaagaagctatctgtgaaactgctctgttatatgtgcattcttcccacagaggtaaacctatcttttgattcataaggtcgaaatcaccctttttgtagaatttgcatagggacatcttggtgcccatagaggctttggttaaaatcagagtatctccagataaaaactagaaagaaactatcacagaaagtgctctgtggtgagcagattcatctcacagtgttaaacctttcttttgactgagcaggttggataaactttttctgtagaatctgagagggaatatttggcagcccattgaggctcatggtcacaaaaaatccccagataaaaaggagacaaagatatctgtgaaactgctttgtgatgtatggatttatctcacagaattgaatctttcctttgattcagcaggtgggaaacactctttttgtagaatctatgaaggttatgtgggaggccttttaggcctttggttaaaaccaaatatcccccaataaaaactagaaagacactatctgtaaaactgccttttgatctttggattcatctcacaaatttaaaactttctttcaattcagaaggttgtacactcttttgtagaatctgtgaagaaacatttggaagacagtgaggcatattgtgagaaaacaaatattgccagataaaaattacaaaggagctatctgtgaaattgttttgcaatgtgttgattcatctcacagacttaaataatttttgattcagcaagtttttaacactctttatgtagaatctgtgaaggaacatttgaaagccctttgagtcctatggtgaaaaacagaatatccccagataaaaactagaaagaaggtatcaatgaaactactttgtgatgtgtggattcatctcacagagttaaaccattattttgattcagcaggttggaaacacttttttttgaaaaatctgtgaatgcatattttggagactattgaagcctagggtgaaaaatcaaatatccccagggaaaaactagaaagcagcaatctgtaaaacaactttcttgtgatgtgtgaattcatctcacagatttaaacttttcttttcattcagcaggttggaaacaatctttttgaagattctgtgacaatttgggagctcatactggcttatagtgaaaaacagattaccccacataaaacaagaaagaagctatctctgaaactgctttctggtttgtggactcaactcacagatttaaaacatcccttttactaagcagattggaagcactctttttgtagaatctacatagagacatttgggagcccattgtggcctttagagaaatactgaatatccccagataaaaactacaatgaagctatcagtgaaactgctttgtgatttgtggattcatctcatggtgttaaacattactttgaattcagcacattggaaatactctttctgtagaatctgcaaaagaacatttggagcccatggtggcttactgtgagaaactgaatatccccaggtaaaaactagaaagaagttatctgtttaactgctttgggatatgtggattcatctcacagatgtaaaactttcttttgactcagcatactggaaacactctattcctagatgttgcaaagtgacatttgagagtccattgaggactgtattgaaaatttaaataactgtagataaaagctacaaagaagatatctgtgaaacttgtatgttatgcgtggattcatctcacatacttaaaactttcttctgattcagcacattggaaacacgctattttttgaacctttaaagaaacatttgggagcacatggaaacactctattttttgaatctttaaaggaatatttgggagcacactgaggcctatggtgaaaaaccgaaaatttcctgatcaaaactagaaaaaagctatctgtgaaacagtttcgtatcgtgtggagtcatctcctagagttaaacctttgttttgattcagtaggttataaataccctctttgtagaatctgtgaagtgacatttggagcccattgaggcctacctatgatgaaaaacagaatatccaaagataaaaactagaaagaagcaatatgtgtaactgctttgtgatgtgtggattcatctcacagagttgaaactttcttttgattcaccaggcttgagacactctttttgtaaaatctgtgaaaatatattttggagcccatagaggcctatggtaaaaattggaacatcttcagataaaaactagaaagaacctatcggtataactgctttgtgatgtgtggattcatctcaaatagttcaacctttcttttgattcagcagattggaaacactctttttgagattctacgtagggacacttgggaacccattgaggcctatggtgaaaaacctattatcccaaaataaaaaccagaaagaagctatttgtgaaagtgctatgtaatgttttgattcattgtacagagttaaacttctcatttggcttctcttttgattcagcaagttggagacaattttttgaaaacattctgtcaagggacatattggagcccattgatgactttgatgaaaaactgaatatctccagataaaaactggaaagaaactatctgtaaaactgctttgtgatgtgtggattcatcccacagagttaaagttttctgttgattcagcaggttgggaagactccttttgtagaatctgtaaagggagattttggagcccatgaagacctacagtgaaaaacagaacatccccaggtaataatagaaaaatgttatctgtgaaactgtcttgtgctgtgtagattcatctcagagagttaaacattggttttgaatcagcaagttgtaaacactgtttttgcagtatgtgcaaagggacatttgggaaaacattgatgcctatgttgaaaaaagggaggttcacagaaaaaactacaaataagctatctgtgaaatagctttgttttgagtttattcatttcactgagttaaagctttgtttagattcagcaagttggaaacaccatttttgtagaatctgtgaagggacatttgaaagcccattgaaacctatggtgaaaaatcgaatatcttcagttaaaaactagaaagaaactatttgtgaaactgctttgtgaggtatgggttcatctgagttaaccctttctttagattcagcaagtcagaaaaccctctttttgtagaatctatgaagggacatttggtacctcattgaggtccctcgtgaaaaaagacatatgcagaaaaactagaaagaagctatctgtgaaactgcattttgatctgtggattcatctcccagggaaaacactttcttttgattcggcacatttgaaacagtcactttgtagaacctgtgaagggacatttgggagcccaatgaaacctattgtgaaaaacagaacctccccaaatgaaaactagaaagaagccatcagaaaaactggtttgcattgtgtgcattcgtctcacagagttgaaacattttttttgattcagcaggttggaaacactcttttttgtagaatctgtgaaggaatatttgggagcccatttagacctatgttgaaaaaccaaacatccccagagtaaaactagaaagaagctatacttgaaactgctttttgatgtgtgagttcatctcacagatttaaacctttctttaaattaagcaggttggaaacactattttaaagatatctttaaagggacatttgggagcccattgaggcctagggtgaaaaaaaaatccccagttaaaaactagaaaaaaagctatctgtgaaactgccttgtgatgtgtggattcatccaatagagttaaaagtttcaatgattcagcagattggaaacactctttttgtagaatctgcaaagaaacattttggggcccattgaggcctatggtaaaacatcaaacatacccaaataaaaagtagaaagaaactatctatgaaactgctttgtgatgtttaaattcatctcaaagagttacatcttttttttgattcagtagatgggaaacactctttctgtagaatctgcaaacggatatttgagagctcattgagacctgaggtaaaaaactaaacatccccagataaaaactagaaaaaagcaatctgtgaaactgctttgtgatctgtggattcatctgacacagtttaaattttctattgattcagcatattggaaatcctcttcttgtagaatctttgaagggacatttttgagcacattgaagcctatggtgaaaacccgaacatccccagataaaaactagagagaatgtatctgtgaaactgatttttgatgtgtggattcatctcacaaagctaaacctttcttttgattgagcaggttagaaaccctctttttgtataatctatgatgggatattttggagaccattgaggcctatcgtgaaaaactgaatatccacagacaaaacctagaaagaaggtgtctatgaaatttattgggatgtgtgtattcatctcacagagttaaaagtttcttttgattcagcaggttggaaacagttttttgtagaatctgtgaagggacattttggagcccaatttagcctattttaaaaaaccgaacaccctcagttaaaaactataaagaaactatgtgtgaaactggtttgtcatgtttgcattcatgtcacagagttgaaatattcttttgattcagaagtatggaacactctttttgtagaatctgcatagagatatttgggagcccattgaggtctatggtgaaaaacagaacatcaaagattaaaactgaaaagacactatctttgaaactgctttgtgatgtgtgggatcatctcccatatcaaaaacattcttttgattgaacatgttggaaactccctttttgtagaatctttgatcagacatttgggaactaattgaggtatatggtgaaaaactgaatattcccagataaaaactagaaagaaactctctgtgaaactgcttcatgatgtgtagattcatctcaaaaagttaagcctatcttttgattcagtaggttggaaaaactctttttgtagaatctgagaggggatatttgggagcccattcaggcatatggtgaaaaattgagtaccctccagataaaaactagaaactatctgtgacactgttttgtgatgtgtggagttatctcacagagttatatgtttctttggactcagcagtttgaaaacactctttttatagaatctgcaaggttacattttagagcccattgaggcctttggtgaaaacggactatcccaagatgaaaactagaaagaagctctctgtgaaactgctttgttttgtgtaatcatctaacagagttaaacctttaaacctctgttttgattaaggaggttggaaacacacttttttggagtgtgtacactccagggaacaatttgtagcccattgaagcctattgtgaaaaacctattatcctcagacaaaaactggaaataagctaactgtgaaactgctttgtgatgtgtggattcatttcacaaagttaaaccttacttttgatcagcaggttggaaacactttttgtagaacctgtgaaaggacatttgggagcagttggggcccatggtgaaacaccgaacatccccagataaaaaatggaaagaagtgatctgtgaaacttattgtgatgtgtggattcatctcacagaggtaaaccatacttttgatacagcaggttggaaacatttttttttttgtagaatatgcaatggaacatttgtgagcccattgaagcatatattgaaaaaccaaatatcaacttataaaaccagaagaaaccatctgggaagccgatttttgatgtgtgaaatttcatctcatggagttaaacttttcttttgatttggcaatttggacaaactctttttgtagattctgtgaagaaacatttggcagcccattcaggtctatggtaaaaaagcaaatatcaccagataaaaactggaaaggagctgtctgtgaaactgcttggtgatgtgtggattcatctcactgagttaaactgttcttttgatcagcaggttggaaaatagtcattctgaagaatctttgatggaacaatttggtgctcattgagtcctacactgaaaaaccaaatacccatgaatgaaaactagaaaggggctgtctgtaaaactgctttgtgatgtgtggatttatctcacggagttaaacccttcttttgattcagcagattgaaaacacagcttttgtaaaatctgtgatggtacaagtggagcccatttaagcctattttgaaaaaaggaatatcctcagataaaaactagaaagaagctatctatgaaactggtttgtgatgtgtggacccatttcatagatttaaacctttcttttgattcaacagtttagaaaaacttgttatagaatctgcaaagggatatttggcagcttattgaaacccatggtgaaaaactgaaattcccctagaaagaagtgctctgtgaaatggttctgtcatgtgtggttacaactcacagaattaaaccgttcttttgactcaacaggttgaaaacactctttttgtagaatctgctaaggggcatttaggaggccaaaaaggcttatggtgaaaaaccaaatattttcttataaaaactagaaagaaggtatctgtgaaacagttttctgatatgtgaaatcatctcatggagttaaacttttctttggactcatcagcttggagacactctttttgtagagtatgtgaagggacattttggtgcccattgagtcctatggtgaaaaacagaatatccccagataaaaactagaaaaatctagctgaaaacttgtttgtgatgtgtagattcatctcacagagataaatcttggattttattcagcaagttggaaacactctttgtgtaaaatctgggaagttacattaggcagcccactgagacctaaggtgaaaaacagaatatccatagattaaaaactagaaagaagcgatctgtgaaactgctttttgatgaatggattcatctcacaaaattaaaactttcttttgactcagcaggttggtaacactttttttgtagattctgtgaggaaacatttgggagccctttaaggcctataatgaaagaccgaatatccccagaggaaaactggaaggaagctatctgtgaaactgctttgtgatgtacggaatcatcccacagttaaacctttattttgattcagccagttttaaacactttttgtgtaaaccgtgaagggacatttgggagcccattgaggcctatggtgaaactttgaatatcccctgataaatactagaaaaaagcaatttgtgaaactgctttgtgatgtgtggatttatctcacagagtcaaacgttttttttggtacagcagtttggaaacactctttgtgaagaatctgcaaagggaaatttggggtcccattgaggcctaaggagaaaaaccaaatattcccagacaaaaactagaaagaagctatgtgtgaaagtgctgcatgatgtgtggattaatcttacacagctaaagttttcttttgattcagcaggtttgaaaaacttcttttgtagaatctgtgaagggacagttaagatccctttgaagcctagagtgaaaaacagaacatcccagataaaaagtagaaagaagccatctgtgtaacttgtttgtgatgtgtgaattcatctcacagagttaaaactttgttttgattcagcaggttagaaattatcttttggtagaatctgcaaaggggcaatttgtagccaattgaggcctatggtgaaaaacggaataccccaagataaaaactagcaggaagctatctatgaaactgctttgcaatgtgtggattcacctcacacagttaaatctctcttttcattgagcaggtcagaaactctttttgtagaatctgtgaagacacatttggaatcccattatggcctatggggaaaaacagaatatccccagagaaaaagaagaaagaagctatctgtgaaactgctttgtgatgtgtggattcatatcacagggttaaaactttctgttgactcagcaggtgaaaaacagtctttttgtaacttctgtcttaggacatttgggagccccttgatgcctgtagtgaaacattgaatatccctagataaaaactggaaagaagttatctgtgaaactgctttgtgatgtgtggattcatctcacgtggataaacctttcttttgactcagcaggttggaaacactcttttaatagaatctgtgaaaagacatttggaacccaatgaggcttatgaggaatgaaaaactgaatatccccagatagaaactagaaagaagttatctgtgaaactggattttgtagggtggacttatctcacagagttaagcctttgtcttgactcagcaggttggaaacactctttttgtagcatctgagaagccacatttgagagcccatttttgcctactgtgaaaatccaaatgatcccagataaaaactagaaagaagctatctgtggaacagttttatgaagtgtggattcatctcacacagttaacacattcttttgattcagcaggctggaaacagtcttttgtggaatctgtggatggacatttgaaatccctttgagacctgtagagaaaacggaatactctcagagaaaaagtagaaagaagctatatgtgaaactgctttgttttacgttgattcatttcaaagagataaacctttctttttattcagaagttggaaacagtctttttgtagggtccgcaaggagacattttggagcccattgaggcttgtagtgaaaaatcaaatatccccagataaaagctagaaagacgctgtctgtgaaacgactttgtgatgtgtggattcatctcacagagttaaacctttcttttgattcagctggttggaaacacttctttttttagaatctgcaaaaggatatttgggagcccactgaagcccttgttgaaaaactgaatattgccaaatgaaaattagaaagaaactatctacaaaactcgtttgtgttgtgttggttcaccacactgagttaactctttctcttgattaacatgttggaaacactctttttttagaatctgcaaagggacattgcagagcccattgaagcctgcagtgaaaaacgaaatatccccagataaaaactagaaagaggaaatctgtaaaattgctttgtgatgtgtggattcatctcacagagttaaactttacttttgatcagcatgttggaaacagtctttctgaagaatctgcaaagagacatttgggagcccattgtggcctttggtgaaaaacagaatatccccagaaaaaaagtagaaaaaactatctgtgaaactgctttgtgatatgtggattcatctcacagagttaaactttaattcagcagtttctaaactctgcttttgtagaatatttgaaaaggcatttgggagcccattgaggcataaggtgaaaaatatcccaagacaaaaaaagaaagaaatatctgtaaaactgctttgtgatgtgtggattcatctcagagagttatatattacttttgactcagcaggctggaaacactctttaagcactctttttgtagaatctgtgaagggacatttgggagaacattgtagcctatggtgaaaaactgaatatcctagataaaaacaagaaagaatttctccatgaaagtactttctgatgtgtgcagtcatctcacagaggtaagcttaaattttctttctgcagaccggtaacacgtctttgtaggatctgcgaagggacattgtttaggccattgagacctgtggtggaaaacagaatatccccaactataaactagaaagaagctaatagtgaaattccttcatgatgtttggattcatctcacaaagataatcctttcttttcattcattcgcttttaagctctctttttgtaggatatgttaagggacattttagagcttattgaggcctatagtaaaaaacaaaatatcctcaaataaaaactagaaagaagctatgtgtgaaagtgcttgatgatgtgtgcattcatctcagagagttaaacctttttttttattcagtgggttggaaacactctttttgtaaaacctgcaacagtatatctgggagagcattgaggcctaaggtgaaaaactgaatatacaaagataaaaactagaaggaagttatctgtgaaactgattttttgaagtttggattcatctcatgaaattaaacctttcatttggttcagcaggttggaaacactctctttatagaaactactaagggacatttgaaagcctattgaggcctatggtgaaaaatagaatatctccagataaaaacgagaaagaagttatctgtgaatctgctttgtgatgtgtgcattcatctcatagcgataaaagtttcttttgatttgactggttggaaacactcttttcatagaatctgggaagaaacatttttgggccccttaaggactatggtgaaaaatcaaatatccccaggtaaaacaaaaaagcagttatctttgaaagtcctttgtgatgtgtggattcatctcacagagttaagtctttcttttgatttagcagttaggaaacactttttttgtagaatctgcaaagtgacatttgggagcccattgaggactatggtgagaaaccaaatatccacagattaaaacgagtaagaagctgtctgcgaatgtgcattgtgatgtctggattcatcacacagggatacaactttcttaaatgcagtaggttttatgcactctttttttagagtctgcgtagggacagttgggaaccctttgaagactgtggtgaaaaaacatatattcccagataaaaactagaagcaagctatctacaaaactgctttgtgatttgtagattcatcttacagtgttaaacctttcttttgaatctgtacattggaaaaactttctttgtagaagctgcaaagagacatttaaggggcaattgaggcctatggtgaaaaactaattatccccagaaaaaaaaaagaaaaaagttatctgtgaaactgctttgtaatgtatggattcaagtcacaaggttaaacagatcttttgattcagctggttacaaacactctttttgtagaatctgtgaagagacatttggtagtgcattgaggcctatggtaaaaaaaaagattatccccctaaagaaaacagaaaaaagctatttgtgaaactgcttattgaggtgtagattcatctcacagagttaaacctttcttctgattcagaagattggaaacactctttttgtggaatttgtgaggggacatttgagagcccgtggaggcctagggtaaaaaattgaatatcccaagataaaaacgagaaagaatctatctgtgaaagtgctttgtaatgtgtggattcatctcccagggttaaacatttcttttgattcagcatgttggagacactcttttgtagaaactgcaaagggaaatttgagagcccattgagtcctatggtgaaaaactgaatatcccaacataaaaactagaaagaagatagctaagatagtgctttgtaatgtgtggatttatcccactgagataaacctttcttttgattcagtgtgttttaagcactctttttgtagcatgtgcaaagggacatttgaaagctgattgggtcatataatgaaaaacagaatatgcccaaataaaaactagaaagaaactgtctgtgacactgctttgtgatgggtggattcatttcacagagttaaaactttcgtcttattcagctgtttggaaacgctccttttgtagaatgtgttaaaggacatttgagagcccatggaggcctaaggtgaaaaactgagtatacccaaatgaaaaccctctgtgaatcttctttgtgatgtgtgtattcatctcagagggttacacctttcttttgattcagcaggttggaaacactctttttgtataatctgcaaagggacatttgggagctgattgaggcctagtataaaaaactgtatatgcctagataaaaactagaaagaagctatcagtgaacctgcttaatgatgtgtggattcatctaacagcgctaaaagtttattttggttaagtaggttggaaaaactttttgtagaatctgtgaagagaaatttaaaagccctttgagggctatggtgaaaaactgaatatcctgagataaaaacaagaaagaagctatctgtgaaactgcttttggatgtgtggattcatccaaaagagttaaacacttcttcgtgttcagcacgttggaaacacacttcttggagaatctacaaatggacatttctaagaccattgtagcctaaggtgaaaaaccgagtatcttcagataaaaactagatataaggtatctgtgaaactactttgtcatgtgtggattcatttcacagagttaaagctttcttttgattcagcaggaagaaaacacactttttgtagaatctgcaaagggacatttggaagcccattgaggcctacgatgagaaacacattatccagaggtaaaactggaaagaagttatctgtgaaactgcttttgatgtgtggatacatctcacagagttcaatgtttcttttgaatcaggaagttggaaacactctttttccagaatcttcaaagaaacacttgggagcccatagaggcatagggtgaaaaatcgaatatcccagtatgcaaactagaaagaagctatctgcgagactgcttttgatgtgcagatacatatcacagagttaaacctttacttttgattcagcaggttggaaacattctttttgtagaatctgcaaaaagacatttcagaacctattgaaggctatggtgaaaaacagaatatccacaggtaaaaattggaaagaaactatctgtaaaagtgctttgtgatgtgtggattcatctcagagttaaacgtttgttttgattcagcaggttggaagctcttcttttgtagaatctgcgaagggaaatttggcaacccagagagtcttgtggtgaacaatagaatatacccaaataaaaattagaaagaagctatctgtgaatctgctttgtgatgtgtggattcatctcacagggttaaacatttcttttgattcactagtttggaaatcctctttttgtagaatctgtgaagggacatttgggagcacattgaggcctaaggtacaaaaccaagtatcccagtatacaaagtagaaaaaagctatctgttaaactgatttctgatttgtggattcatttcatagagttaaattttttttttatttaacatgttggaagctgtctttttatggaatctgcaataagacatttggaagctatttgaggcctaccataaaaaccagatatccccagataaaaactagaaacaagctatcatttaaactgttttgtgatgtgtcatttcatctcacagagttaaaacctttcttttgatttggcaagttggaaacacttttgttgtggaatgtgagaagagacattttgaagcccattgaggctgataatgaaaagcagaaaatctccatataaaaacttgaaagacactatctgtgaaactgctttgtgatgtgtggattcaagttacagatttaaaaccgtcttttgattcagctggttggaaacactcttatgtagaatctgtgaagagacattttggggccctttgaggcctatggtgaaaaccagaatatcctcagataattactagaaagaatctatctgtgaaaatgctttgctatgtgtatattcatctcaaagagttaaaactttcttttgattcagtatgttggaatactttttttgtagaatctgtgaaggaaaattttggagcttattaagtcctatggtgaaaaacggaatattcccagataaaaactagaaagaagctatctgtgaaactgctttgtgatgtgtggactcatctcacagagtaaaacctttcttttgattcagcagtttggaaatactctttttgtagaatctccaaagggacatttgagagcccatgatggtctaccataaaaatctgaggatcctcagataaaaactagaaagaagctatctgtgacactgcttgtgatgtgtggattcatcacaaagagttaaaagtttttttgattcagcaggttggaatcactctttttgtagaaactgtgaagagacatttgagagccctttgaggcacacgctgaaaaaccaattatccaaagataaaaactagaaagaaactatttgtgaaactgcttggtgatgtgtctattcatctcaaaatttaaacatatattttgattcagcaggtttgaaacactgttttgttagaatccgtgaagggatattagagagcccatttaggcatatagtgaaaaaccaaatatcctcacataaaaactagaaagaaactttctgtgaaattgctttgtgatgtgtggattcatctcagagagtttaaccttttttgattcagcagtttggaaacacttctattgtagaatctgtgaagagacattttggagttcatttaggcctatggtaaaaaacaaatatcaccagaaaaaagaactagaaataagctatcggtgaaactgccctgtaattagtggatttgtctcatggagtaaaacttttcacttgattcagtagtttggaaacaccctttttgtagaatatccaaaggaacattttggagcccactgaggtttatgttgaaaaacctaatatccccagataaaaactataaagaagcaaactgtgaagctgctttgtggtgtgtgaattcatctcacagttaaacttttcttttgattcagcatgttggaaacaccctttttgtagaaagtctgaagagacattagggagccctttgatgcctatgttgaaaaaccgattatccaaagataaaaaggagagataagctatgctttgtgatacgtagattcatctcagaaagttaaacctttcttttgatttagcacgtttgaaacactctttttgtaaaatgtgcaaagggacattttggagtccattgaggcctatggtgaaaaacagaatatccctacatgaaaactagaaagaagctatatgtgaaagtgctttgtgatgtgtgcattcatctcacacagttaaaccttgcttttgattcagtaggttggaaacacaccttttgtggaatccatgaagggacatttgtgaactgttggactatggtgaaaaaatgattattcccagataaaaactagaaagaagctacctggtaaactgctttgtgatgtgtagattcatcacacagagatgaacctttcctttgattcagcaggttggaaacacttcttttgtagaatctatgaagggatctttgggagtttattgaggcctatagtgaaaaacagaatatcaccacataaaagctagaaagaagctctctgtcaaattgctttgtgatgtgtggattcatttcatagagttaaacctttgttttcattcagcagtttgaaaacactctttttgtagaagctgcaaaggaacatttgggagcctattgaaatctttggtgaaaaaccgaatattcccagataaaaactagaaggaagctatctatgaagtgctttgtgatgtgtggattcatctcacagtgttaaacctttcttttgactcaacaggtggtaacactcttttgtgaaaatctgcaaaaagacattttggagcactttgagccttatggagaaaaacagagaatccacagataaaaactagaaagaagctgtttgtgaaagtgttttgtgatgtgtggattcatttcacagagttaaaccattcttttgattcggaatgttggaaacactctttttgtagaatctgtgaggggacatttaagagcattcaggactacaatgaaaaactaaatatccccagaaaaactagaaagatgctatttgtgaaagtgctttgtgattggtggatttatctctctgttaaacattttttttattcagcaggtgggaaactgtctttttgtagaatctccagggggacatttttgagcccattgtggactatggtgaaaaactgaatatttcaagataaaaactagaaagaaactatctgtgaaactgctttgtgatttgtggatttgtatcacagagttaaacctttcttttgatacagtaggttggaaacactctttttgtagactctgtgaacagacacttgagagcccattgaggcctatggtgaaaaacaaattgtccctagataaatactagaaagaacctacctgtaaaattgccttctgatgtgtggattcatctcaaagggttaaactttacttttgactcaccaggtggtagcactctttttttttggaatctgcgaagggtcattttggagcccttttgagccctatgttgaaaaacagaaagtcctcagataaaacctagagagaaacttcctgtgaaactgctttttgatatattgattcatcacacagagataaaactttcttttgattcagcaggttggtaacacttctcttgtagaatctgtgaataaacaatttggagcccatttatgcttatggtgaatgaccatttattgccagataaaaagtagaaagaagctatctgtaaaactgctttgtaaggtgtagatttatctcacagagttaaacttttcttttccatcagcaggttgaaaacacagcttttgtagaaactgcaaagggacatttggaatcccactgagtcctatgggtggaaaattgtaaatcaccccataaaatctagaaagaagctttttgtgaaactgctttgtgatgtttggattcaggtcacagagttaaacctttgttttgattcagcaggttgtaaacactcttttagagaatctgcaaagcaacatttttaacccattgaaacctatggtgaaaaactgaacgtccccagataaaaactagaaagaaactacctgagaaactgcttgtgatgtgtggatttttctcacaaagttaaacctttcttttgattcagcatgttggaaacactttttttgtagaatctgcaaagggacattttggtggccattgaggcctatggtgaaaaacagaataaccccagataaaaatgagaaagaagcaatctgtgaaactgctttgtgatgtttggatttatctcacagcattgaacctatcttttgattcagcaggttggaaacacctttttgtagaatctgtaaagggacatttgggattccattgatgcctaaggtgaaaaaccgaatgtccccagagaaaaacatgaaagaagctgtctgagaatctgctttgtgacgtgtagactcctctcacagagtcacccctttctttcaattcagcagtttggaaacactctttttgtagactctgcaaacggtaattttggaacccgagtttgcctatggccaaacaccaaatattcccagataaaaactagaaagaagctctttgtaaaactgctttgtgatgtgtagattcatctcaaaaagttaaaccctccttttcattcagcaggttaaaaacactatttttgtagaatctgcaaagaaacatagtgggcttattgaggcctgtgttgcaaaactgaatatccccagagaaaaacaagaaagaagctacttgtgaaactgccctgtgaagtgtagatgaatctcacagagttaatcctttcttttaattcagcaggtttgaaacaccctggttgtagattctgcaaagagttatttgagagcattttgaggcctatgataaaaaaccgaatatccctagatgaaaactagaagaaagctctttgaaaaactgctatgttttgtgtagattcatctgaaagagttaaacatttcttttctttcagcaggttggaaacactctttttgtagaatctgcaagggacatttgggcacctgttgatgagtatggtgaaaaaccatatgtccccaaataaaaactagaaagaagctatttgtgaaactgctttgggttgtgttgatttatctaacagacttgaacctttcttttgattcagcaggttggaaacattctttttgtggaatcagcaaagagacatttgggagcccattgtggcctatggtgaaaaaaaaaagaatatccccagataaaaactagaaagaagctatctgtgaaattcctttgtaatgagtagatttatcttacagagttaaacttatgttttgattcatcaggttggaaacactctttttgtagaatctgcacagggacttctggagaccatttaaacctatggtgaaaaccgtatatacccagattaaaagtaaaaagaagttatatgtgaaacttctttgtgatatgtgggttcatctcaaggtgttaaacatttcttttgattcagctggttggaaaccctctttttgtagaatctgcaaagggacacattaaccccccttgagaactatggtgaaaaacagaatatcctcagataaaaactagaaagaagccatctgtgaaactgctttgtgataagtggattcatctcacagagttaagcctttctgttgattcagcagtttggaaactgtttgtgtagcatctgcaaagggacttttggaagccaaatgaggccaatggtgaaaaaaagaatatccccagaaaaaaactagaaagaagctgtctgtgaaactgctttgtgatgtttgaattcaccacacagagctgaaactttcttttgattcagcagattggaaacactctttttgtagatctgcaaagggacatttaggagccaactgaagccagtgttgaaaaactggacatccccaaataaaaactagaaaaaagtgatctgttgaactgctttgagatgtgtggattcatctcatagcattaaacatttcttttgattcagcaaattgaaaacactctttttgtagaatctgcaaaggaaatttgggagcccattggggcctatggtgaaaacaccataaaaactacaaaaaatttatctgtgaaaaatgctttgtgatgtgatgattcatctcacagagttaaacttttcttttgatttaaaaggacggaaacacttttttttaaataaaatctgtgtagggatatttggcagcccattgagggctatcatgaaaatcaaaaatccccagataaaaactagaaaaaagctattggtgaaactgctttgtggtgtgtggattcatctcacagagtaaaatttttcttttgattcagcatgttggaaacactcttttttttttataacaaaaccagaaagtt

SEQ ID NO: 205 - DNA, 294 bp, Homo sapiens
gcatcagcaacaattaaaaatattcacttggtatctgtagtttaataatggaccaacatcaacatttgaataaaacagcagagtcagcatcttcagagaaaaagaaaacaagacgctgcaatggattcaaggtagaatgggttttatattttcaaactaaaataagttaatggaaaatttttatgtatagaaaggccactaactgtcaaaaagaacattatatctcatattacaatttttccattgaagcgtacattaaaatattaacaaaataatccctatattgatttaaat

SEQ ID NO: 206 - DNA, 350 bp, Homo sapiens
ccatttatagtagatagttatatattacaattatggttatttttatgtgtaggaccaggactatgacaccaggaatggagaaagtaaggaattatttaggagatagaattttgctgtttttctcattcacattgtaccatatttaatacttttatatgtacaaatattcaactttattcacagaatattatttagtttaattataataattaccttttccggaatactgatgtgctctctcctttatcttctgcaaaattaactaattttgtatcatcaggaacactcttctcaggtgctatctcagtgccaatgtgatttttatatttctgagaagcatatgtcagctt

SEQ ID NO: 207 - DNA, 402 bp, Homo sapiens
ctgaatttctcccttttattccaattcaacaattttcatggctttttgtgtttgttttgttctggacatatttacagaaaattacctgaagagttccaacctgaggcctcctcatggatgggtcaaacgtgacatcatttgttgttgaggaacccacgaacatctcaactggcaggaacgcctcagtcgggaatgcacatcggcaaatccccatcgtgcactgggtcattatgagcatctccccagtggggtttgttgagaatgggattctcctctggttcctgtgcttccggatgagaagaaatcccttcactgtctacatcacccacctgtctatcgcagacatctcactgctcttctgtattttcatcttgtctatcgactatgctttagattatgagc

SEQ ID NO: 208 - DNA, 1385 bp, Homo sapiens
ctgagaacttttctcattaatttctttcccctcatctgttattccattggcatcttcatccaaatccttacaattctgttttgtttctttaagagattcaacattggcctgttcgtgcactgttaatatattttctgaacttctgtgggagaaatcatcatcaaagtcattattatagaaatttggcttatttatctcagaaagagatcttgcttgtaaatgggaagtttgtctggtatctgaatcctctgaattcacaggtgtacccacgatctgtttctcatttcctggtacaatcttactatctttcttttcagtttgtgcctttaatttcctctgcatactcctggttcttctagttgcaattccagagaatgaaatgtctgagcttgatgtctcagcatcagatatagcttctgtatgagattcttggcttggatctgtcagagatttagccttacttcttctggctcctgtagttttttctgtaggaagcacaattctagaaatacctgaaacatgagattctgcttcagacactatttcttcagtgtaagactcctttgttggagttactttcggctttttcctaacactggacactggggagcatgcaattaagatctgccttctcctagttacccttaaaatggtatcatggtgctcagacacagaataatttgactctgcctcagaggtttctccatccgtagatggttcagtcccctttggtagtgagcctgtagttctgctcttcctctttctagctttaggagttctagggattaaactttgcttcccagtggtctgtgattcagcagtagttcgggcatcagatccagtactactttctggatgcgcttgaatcccattagcagcaaaactctgcaaaccagagaaaacacactgtaatttaggtagggctggaacaagggcaaagcaaatgaaatactgaccccaaaagctaaaacccagtaaacaagattacctttaaaacaaaaaacaaaaaaacctgcccaactcatgatttttaaaaaatcaaaatttggccgggcgcggtggcttacggctgtaatcccagcactctgggaggccgaggcaggtggatcacgaggtcaggagttcgagacagcttggccaacatagtgaaaccccatctctactcaaagtaaaaaaattagcggggcgtgttggtgcgcacctgtaatcccaactactcaggagcctgaggcagaagaattgttggaatccgggaggcagaagttgcagtgagccgaggctgcgccactgcactctagcctgggcgacagagcaagactccgaatcaaaaacaaacaaacaaaaaaatcaaaatttaaacactggagccaaccctgcatttactt

SEQ ID NO: 209 - DNA, 1407 bp, Homo sapiens
tttctcagaaagcaatcaaacacacgacagagaaaaaaagttatttcatatcctatgtttaaatggtacatccatcttcaagagagaaagaatttcatgtcatctggcacttacccttcatctcccgaggcaagctccttctgaccaagcgtccctggcccccacgtccgtcccttcttctttggggccctcttctcctcctcctccccttcctcctttgggacgactgagctcctgccccaggttttgctgctttcacctggtgtcactgtgaatcacaagggttggataggatctagaaaatggacagacagggctcccccaaactagcctctataccaccacacacacacacacatttggagctgcagggaagttagaccttatcaaaaactctgtgcccaagtggacccttccaggaaagtaatggagttctcagccaccaatcatttagctctctcaaagtactaaacatggaaacacttcttcaattttcacaaatccaatgtaaagctagagcttaggccagccagacatcagagttccaaacagatctgactttacctgttttgttgggtgggattgggtagtgagcaaataaggaggcaggtaaggggggaaaaaagacaaggggtaaggaaggcgtggaaatgcaggaatcttggaaagaaagggttgggaagaaaatgaggagttcaaggttatggaaaaggaagtctggagtgggagaaggggaagaaagaggcctagagaaagacagataagagaggaggaatatttttctgacattaataccttggagcaagggttgagacccaaatgccccagggactgtgcttatatcataaacgagcaaactagttaccaaaaaacaaggagttgaaggggctgaggcaaaatatggagtatacggaagctgctattagtgccagccaactgtagccacatgaaaaaagaaacctactgatttgatttcatttttcaaggaaagctagaaatcttggatttttcttttttgagacggagtctcactctgtcgcccatgctggaacgcagtggcgcaatcttggctcactgcaacctccgcctcctgcattcaagcgattctcttgcctcagtctcccaagtagctcggactacagatgggtgccaccatgcccagctaacttttttgtatttttagtagaggcggggtttcagcatgttggccaggatggtctcgatctcctgacctcatgatctgcccgcctcagcctcccagagtgctgggattacaggcataagccaccatgcccagccgaaatcttggatttttaaataaaatctgtctttaaaccagggaaactaattcattcacatataggtgtatgttcacacacacacacacacacacacacttacatgtat

SEQ ID NO: 210 - DNA, 1440 bp, Homo sapiens
tttgaattcagtaaggtggctagaaagtttagggtattttgaaagatggtgattgaccttggactgaaccactattgaagatttatttgataataatttgtaagttttaactcagtacctcccttctgcttttatagttcaaggagcagggacaagttacaggaatgttctccaagcagcaatccaaaagagtctcaaggatccttcaaataacttcagggtgagtctggagaaaacatatggaatcccagcatgaaaccgtttcagagttctaataaaaatatgcatattctcacagcatgtactttatttaatatctgaaaaaattgtgatagaaatgtgtatttgttttaaaaacgtgtaacttcttatatttcaaagctaatacatgttcattgagatatttggagactatagagaaagataaaagaaaataaatcacctatattccactatccaaagacaaccactgttagtattttggtatatttccttctagactcttttttatgtgggtttgcatctgtatctgtatgtatgtatatatatatatatatacatacatacatacatacagttggacaattggacatttttttcactgttcatttattcacttgaaattgtaacttaaaaaaagaaaatgtaactttaaaaataaaaatagatgcaccatgcctatggaaaaaaatttaaatgtactacaagaggttttaaaagtatttttttgcccgggtgcggtggctcatgcgtgtaatcccagcactttgggaggccgagccggaaggatcacctgaggtcaggagttcgagactggcctggccaacatggtgaaactccatctctactaaaaaatacaaaaattagccaggtatggtggcaggtgcctataatcccagctacttgggaggctgaggcaggagaatcatatgaacccaggaagtggaggttgcagtagccaaatcgcgccattgtactccagcctgggtgacaagagcaaaactctgtctcaaaaaaaatgttttcttcctacccctataatactgacctccaattatttttcctaaaggcagctgttgtgaactagttcattctgtaactatccagagatagtctacacatatatttcatttttgcttttttctcttctacagatgataacaccctatgcccattgtcctgatctgaaaattcttggaaattgttccatgtgattaacatggaactgcctctacttaatcattctgaatgattaaatcgtttcattttctaaatgtgttataatgtgtttagccctttcttgttgctgtatgtttagatgctttccaatcttttgttactactaataatgctataaaataaatatccttgtacttctttgtgcatttgtttttttactgagctaattttaatgatttcagcaaaagttattttgttatt

SEQ ID NO: 211 - DNA, 1483 bp, Homo sapiens
ctttgtgcattagtttcctttttcaaatgagagaaccgatcagaggacgcttaggagatgctggactgttgcgggagttctgaggtcctcaggaggccacactccagttcccagacctgggtgaacagcacgaggcccagagagggaaaggaacggcctgaggtcacacagcaggtgagccaggcctccgggacctcatttctcagagccaggtgggcgggtcccagggtccaggaggggagaggcttaggcatggagggagcgccaatcatgcccccacccccagtgctagccacgactcgaaaaaggggcccggaaagagacacaatgcacagagacacacacgcagagacggagagataggaagagtggaagagggaggcccaggcgccgggaccagacaaaggacgcgcggcggcgcggggagcggagtcgcgcggcaggggcgggggtggagccggggtggggctataactggccagccccgcccccgggatacgcccgggctgccgagtgggaatccgagggctcgggcgaggccgggcccccggggccctgggggcggggcctagatgggcgtgcccgggcgtggccaggcagggcgtggcagggcgggaggggctgcgcgctcgggagctgaccagctccgtggctgctgaaagcaccgagcgcggggctagcggtgcgggcgagcaggcgggcgggccgcgctcaaggtcacctcgcggcccagagccttggcgaggtggggagcctggacctggcctaagggggctgtctcggcctcccaccccatctcccggggggcggagacccgggagcccagaggtgcccccccaacccgcgggccctcctctcccctccccctccccgcagcccgaggcgcccgcgcgaggctgcggcccgcgaagaagcgccgagaaacaaagggacgcggcagcagcggcggcgggcccgcggggcctccgggcgcgccccctcctctcccctccccgcttgccgcaaggtcgacgggctcgaggacgagacgcccgcctcccgggtgcggccgaggcccggggcgcgcgatccgacgccacccgctttcccagggctctcggggacgctttgtcgctttggcttggcccagcaccagtgatcgggccctgcgtttgcctgggcggcctgcggggtctgggcctggatggaggaagcatccttagccgccgcggcccctcccccatcaggcctgctggagagggggcaatcccgcctccagggcggcgtcggacgcctcccgaatcgcagtcagtctccctaaggccctctcagaccaagctctaagcgccctcagcactctgggcgcggccctgcccactctcaggccccgaggcttggtcctacccccccaacccgggcctagctaggcctggtcctaccccccccgccgcacccgcccaatctccgcggagcctgggcccaactcctccccgtcccgattccc

SEQ ID NO: 212 - DNA, 1497 bp, Homo sapiens
ctaaaaactcccaaagttttaacatagcctcaaaatgagacatccacgtgagattcagtatggagctcatctttgaaggatcttgggaaattagacaatgaaaagttaacacagctcagttcccagttggtgagtctcacctgaggtggggagtcacttttccatcctgcacccccaaccactgtagactaaccccacaccgcttccaaaaatgcaaaggttcaagacaggcacatttggggcaggagggcagctggcacaaactgggaaaccgagcaagttttgaaatgaaattttttagtctttcatgtcagtgaagtgctgctttagatagttactgcttttaaatgcagggcacatatattatcattcatgacgagattatctgaacataaggacaataaataatctattatttaaaaatctttattaaaaaaacaaaactccaaactgtttaaagaaaaccaagacaacagccaggtcattgctggtaaatacatgcaggtgggtggaggaaggaacagggttaagactcattcttctggcttcctggcgtgttatgctgcaaggggccaggcagcttaattggacctttgcgctcttgtccagctcacccgcttggtctagagatttgatttgctgggtgctcacattcctcttggagggggcagggagagttgtaaatgcttgtgctaattaacaagattgctttggacacaattgatttctactacactaatcatgtgagaaaaagaaaaaaagaaggaaagaaagggagggaggaaggaagagatgaagaattagcagcctgaagctggagagattctggattacatgcaacattcatgtgtccacaatttccaccagggaatttaccttgtgcacgttgggagggtttatttacaactgtgctgtcctacacaaataggatgtgagccacatatgtcattaaggttaagtaggcacattaaaaaatttaaaaatgcaattaattttaaaaatataggttaacacaacatatccaaaatattatcatttcatcacatacaattgacataaaagttctcatgaactctttcgcgttctccttttgtactgagtctctgaagcccactgtctggtgatgctggcagcagctctgggcactaggccagttcgtggtgggcactggccacgtgtgcccagaggctgctggatcagacagcacagctcagagagctcagcagtctcccagaagagatcctctcttataagatcaccttgaaaatgcatctaagaaaagatacgtgaccacataatcccacaaagaaggtaggggcagaatcaaaggcgaagctgcatgcatcttacctgattatatatgttgtatttgttgacatggttttggtgaaaaatcagtttaagaaattgtcctactgcatccacataaactgattttagttcccgggctttgcaacctgtcttttcattatcacagagagacacgtagctgaaaaa

SEQ ID NO: 213 - DNA, 1815 bp, Homo sapiens
gaatacatctctaaaccttataaatattccactgttctatataaaagagtcaactgacgtaaaaagttgactcattttactggtctttaaaataggggcttaataactctgaaacttatgatttctcatatactttgacttcaaaacttcacttgtaggaatttatcctacagatatgaccacacagaaaatgacatataacatattaagaacattttctaatatgaaataattagatataagctaaatagttaacgatatagaactagttacatatattatgaacaacagaataccctgctaccataagcaaaatgaggacttttattaatataaagtatatacagaagataaaaaggtagagtgcagtaatactggtatgcttacatttatattaaaagagaaaatattatgtatttaattaaaaatgcatattaaggctgggcgcggtggttcacgcctgtaatcccagcactttgggaggccgaggcgggcggatcaggaggtcaggagatcgagaccatgctggctaacacggtgaaaccctgtctctactaaaaatacaaaacaattagccgggcgttgtggcacgcacctgcgcctgtggtcccagctactcaggaggctgaggcaggagaatggcgtgaacctgggaggcagagcttacagtgagccgagatcacgctactgccctccagcccgggagacagagcaagactccgtctcaaaaaaaaaaaataaaaaagcataccagatttctggataaggggacaaaggttataagcagaatcttgccttttcttttcttttctttttttttttttttgcatttttcaactacatgcatgtattttctcttgaaaaataagtggataaaccctaaatacagtaagatcatgatgatggtaaggtcaagcatggccagagtctctctgagagatacttggaatatattttgctcttttaaacaaatccaaactttatctgctttttgagccttgttccataggcatctcctctatgaaactgactgaggctatcctaatcattattatttacattatttttcaacccattttgagtatccactatgtgcaagtcatcatttggcactttataaacttataaggataacgtaaacataaatttcctttcataaatcttgtaatctggatatgtagaaaatataaaaattttaatttctataatttaaaattgttgttcatacaatctagtgtgtggttttatattatttacttgtttcaaatttctctctatgaaaattatttttctaagcaaattataatctctttaggctaggagtttgtctctgtctttcctcctctgtgtccagcattgacctagtcctgtggtcaggaaatagcaggccctgaatgaatattagagaatgattgattgattgatattgagcttgtggcttttcctatttttaaattgtatattgttaaagtaaaataaattatactttttcttttttaacaggtgatcatttcaaaccaagcatcagcaacaattaaaaatattcacttggtatctgtagtttaataatggaccaacatcaacatttgaataaaacagcagagtcagcatcttcagagaaaaagaaaacaagacgctgcaatggattcaaggtagaatgggttttatattttcaaactaaaataagttaatggaaaatttttatgtatagaaaggccactaactgtcaaaaagaacattatatctcatattacaatttttccattgaagcgtacattaaaatattaacaaaataatccctatattgatttaaat

SEQ ID NO: 214 - DNA, 1991 bp, Homo sapiens
aaggaaaagagagtttggtttcattagccagaaaaaagaatacaagaagaggattcctggttcaggcagggaaaggggaattagtgacgtcaagtacctgaggacatctaaatgaacaaataggtacttggatttaaaggtctgaaagtgacagtgagaagcatcaaggctagaaaatatagatttaggagaaaacagtgcaaggtgttggctaaagctaagggtttgggtaaagttaccttaacagtaattccttctgaaattatatgtaaaatgtctatatgcacatgtgcatttttttccgggtggaagaggcaggcaggcattcacagctttcagattctcaacagtctacactagttaagaacttaagaactaaaagtatagcaagaaaagggaaaaaaacaaaacccctgggatcataattggtgggtgtaagatgaggaacactgaccctgtattgatttatttttaaagcattatcattcatagataggattttattgtaaaaagaaatgactgttttagagagaaggaaaaaactaacacattaggccaatgtggtttcactgtaggaaaattaagtcttttaccaaggactaatttctaaaagtgattggttagttctgtgaaaacctaacagcacaattaacttacctcatttttctttttctccttgatctgtgttagggttctcttgttagactgtagtttatctgcattaaaattaatatacaaaccacccaactgcttgatactcagaccagggtctatgctgctgcttgtcaacttcagactgaaaaagaaatcatcacttaaagatcaagtaattaaatcaaaatggaaacatataagatggcattttaaaaaatcacttattcttctcttcccttgtattgtccacaataaagaaaaaaaagcatcttatttttatgaggaattcctgaaaaaaaactctaaataaatatatttttcatcattttattttattttttgagacagggtctcactgttggcccaggatggagtgcagtagtgaccactgcagccttgaactcttgggactcaagtgatcctcctacctcaacctccctgggtggctgggactacaggtgcacacccaacacctggctccataatgtcaaatgaatgagccattccatgaagaacccaaggcagtgattttctcattccccaggctaacatttcatatttttatggtaaattaaccacttgaaatacatgtatcaaaaacttataaaaataaaggaaaaacttacagtttagcctttgtgctatttaggaagtcttcttcatcactaaactcatcttcattttcgtcatggtctgatgaatcttcttcacttttttcatcctcttcctcttctttttcttcctcaatggcaacctcacttgccttgtcttcctcttccaagtaaaaatttttatcagcactcattccaggagttgtgtcaattacaaacaatgcattgtcacatgacagacttcctgtgtctccacttaatgactccctttggccactattttcaacaaaacataaagtatcctcttcattctcactgttttcagactgttggctttcatcactgctgagaactagtaagacagaattatctttaccctgagatgtgttgggcgcagacgtgtatagtttggtatcacattcaaaatctacattcccttcactgttcatgtcttcactgacacttataactgtggactcttcttcatcatcactaccaccacaatcaccaaactttgtcaagtcacttgcttttatggggctctttttgttgttattccatctgcctacttccacagttgcaaatgtttgagttaatgatttcattacagcctcagagttcagattagagtgcactgatacagcatttttattttggggggttgaatgtctctgagaaactaactgttgaaggctagtgtcctgaagttcagaaagattcttcagc

SEQ ID NO: 215 - DNA, 2436 bp, Homo sapiens
tctaaagactatataaaccaaactcttcaaggatgcgtagaataaacagaccatgtcggaccaagaagttctcattagctaaagaactttattctttgtctattttattgttcactgtatatcctcagcacttggaaagaagtctgacatatagtaggcattctataaagatttagtgaataagtaaatgaataaatttgaagagaagattcaggtttaaaaaagaaagccaaggtttttattcaaggtttttattatatgtttttatataaaccagttttattcccacgggataattttaggactaatcttatatctgatgataagcctaataaatgaaagatctttgcattcttgggctgacatttgggattgggaatattaatccacactacctaccccagaaaatcctgaagggaaatgggaaagtgagctgatgagaaagtagctgactacactgtactacatgttggctctccccatttccctgcctagctaactggatttaggattggaccaattggccgggcatggtggctcacacctgtaatcccagcactttgaaaggccaaggtgggaggatcgtttgagcccaggaattcaagaccagcttgggcaacatagggaaaccccatctctacaaaaaataaaaaaatttgccaggtgtgatagtgcatggctgtggtcccagctactcaggagtctgaggcaggaggaacacttgagcctgggaggtccaggctgcagtgagccatgattgtgccactgcactccagcctggtcaacacagcaagaccaaatcttaaaaaaaaaaaaaaaaaaaaaaggattgagccagttaaaacaagcaaaaaccatcagtggtctcttttgcatcccccagttaaagacttggggaatatgaaatccttgaatacccaagagttaagttcactttcatttgtagcttgcttagtgtctgtgcttttactcagtcaactgatagttgagataatttggaatatatatacgtatctatctaaaaagtataattttcctggtcctaaacaagaatatcaagtctggccaggtgcagtggctcatgcctgtaattgcagcattttgggaggccagggtgagtggataacttgagatcaggagtttgagaccaggctggctaacatggtgaaaccctgtctctactaaaaatacaaaaattagccaggcatggtggcaggtgcctgtaatcccagctacttgggaggctgaggcaggagaaacacctgagcctgcaaggcagcagttgcagcaagccaagatcacaccactgcactcactccagcctggacaacagagtgagaccctttccccacactgcccccgccccacacacacacaaaaaaagaatatcaagtctaaaagagaaaggattaaatcacatgtgttgaaagaatctggaatctccctttttggttgccatatttccaagagaagaggaggaaaaagggctctacctgcttttcatcattatcccggataatcttggaagtccatagcccaggaataaattagtgttagaaaacggagtatgtagcaatgttctccctgaatcataacataaacctgtttgcctggtgtgtacacatttcattgtaccaaataagtacttctaaattctttttacatttaactggtgccatccagtagccagagcttgctttagactaaggtgacctgcttctgttggaagatttaccttaacttctccaacagaagaccaacaaatgtgaattgtttctgaagttggattaggtcctatggatgacagaagatagtctgccgacttgcagatggacttcgggatctatttgcctttaccgggcttaaaatttgttttatcttagagaaatacctaaatttaacacaactgattcttacgtttataatagggaaagaaatagaaaattcactaggcagttaatattcttaactgttttgaattattacccccttacaaattcctaaagtgtgccagtgtcttattacagccatgaaaaatacaagtttaaaggaatgattcctttttaaactttttaatactgtagctgtaaaaagctcatctacaaatacattgaatgccaccagttgtgcatggggttaaaagtggatgggaagcagatttcaaccaaatgtaagaaacatattcaaatgcataaactcgtctgtctgtggaactagagcaggccagctcaggtagctctaggattctctaatattgctccaagtgggaagtcgtgtttacctaggccttgtgcaaagagaaacagcaggaacagggatggaggctgttgtgattcttgtgggagacaatggcaagacgggtccatctgaaatggagatttcatttgggaaaacaggaagtgttgaagagttgcatgaagaaataggtatcaaatt

SEQ ID NO: 216 - DNA, 2525 bp, Homo sapiens
atcaatgatcaacactcgtaaaaggtcagggtgtctaatcaaagaccagatcatctatctctcaaggtaaagcgtacaacataatccagaaatgtggcgctgctggccatggagagtgagaaaatccaagggaaagagaaacttcagttccactttggtgaacaggaagaatgttctgctcatacaaaatgtgcagccagccttctgcgggcgatcctcagtggctcaggtgggcctgaaggggatgaacaaaggccacgctctgaagggggagcttctccaacatgctgggcttccaggttctgataaaaacattttagacttcaaaatgtcacagcaagtctatcacttgctctccaattcccgaaactcagtattttaaaaaataatatgtaaatataaatgcaccaacagcaaataacaaaaatcccaaactgctatcgaggtgttaaaatgaggagtgatacattttaacaaccagaatgaatacactaaaatgctaatagaactgagtagtggaaaagaaacaaaaagagagatcttgtttacccaatgtgggttctgtgcatatgcttgagtggagaggggagacaactgtgggatgggggcataagtatatcctgtgaaacagaacagaatactatcccaggaatcccgttcatatatctcatgaaatagaatcaaataatatctcatgtagcccatgaaacagaacaggattggaatgcacagctggatggctgcacatgccaaggattggaaaggttttcccaaaatacctatgtctaaccccaaagtgcttctgcctccaccacaccccagaccaatcaaaccagagtattaattttggcatttgtatttcttaaaacaaaaaacaaaagcctatgtgaatctcacatgaagacaggtttgagaaccactaactttaaagggagagaccctttttagggaagggaggtccttagagatgaggaacctccggtttcccaagggcacctctccttcttctgcagaaatacagctcgcctgtttatttctcttcctttttggcattagcagttccagttgttaaaggcaggaaaactggagtcattgtctctctctttttcatgatttatgactcagaagcaagacaggggcaggaggttggagggtaatgcttgcggctgtggttgctgttatttttattttgtatttttcttaaagaaaataaaagaaatatgcttttctgaaaaatcttgaagccttgaagccacctgcagggctgttgttttccaaggccttgcacttacgtaattgacatctacatagacacactcctggaacatatcgggggaggcaggcattctgcttgttctcatttgttctcaaattacatgataaaatacatgttttggaccttttaaaccaaagggagttattgagcccgcttacaaaatccataacatgttagcaggacttatctagctgcctccacagaatagccaagcaactctacacccgctttagcccccacaaaaacaagcggattgcactacaaataatttgcctatttggaaaatgaaagcttctctgtagtttgaggtcctattttttctttaagttgttacagtcttttcatggtccttgaggtctaggttaggtttttgtttggggtaatttttgtatcctatggatactatttaatctttagtattgagtcagtatttctcacttaggccttaggggaatactgcctgaagtatgtagggggcatgcggaattcagacgtggcttggaaactgcaccatgggttcacccaagaaacagaccagaggcaacacattctatcactaaaacgtgttctcagttacacttcccttccaaaggtaagcatcttaattcttcaactttttaagaggctaaacccagtgagggcccgtatgtccacaaatagatgacacacccatccaaagcacgcgtgtgtattaagggacagcgtgtcctcccacgttccagccgcccccctggctgccagccgcgggctcagcgcacgtacggtccctgtcacccgagcgtacctgtcccgttctggccttggagaacgcagtggctcacaagggcaccgctagcacgcgaggcgcggcgaagggagcggagggaagcggcgggctgtcgcgcaggtgcggccccacctgccgccggattggccgcggcggctgcggcgctccgcgggaggagggcggatgatggatggcctgtctgccggcccgggtccgagccgcgggggccgccgagggaaagacgggcgcgcgcgcgccgctccgtgcccagcgcagacagcgagatgcctgcacaaaaggatggggcttggaatgtttggattttgaagattagtttctattatatctctgtgggagaaaggaaaacgcgctatgggaaagtggagggcgaagaacccccgaataatttcggactgatgtttcacaaatcatttcgccagggaacaacccgcgagcctccccttcccaaatggcaaacagttc

SEQ ID NO: 217 - DNA, 2562 bp, Homo sapiens
accagcctatctttcataacacagttaactcttcattcttctactctttctcctttcatttaaacatattgagaaagggaataaactgtcttttatttatttttcttttttaagccaaagcagaaagaaagaagtgcttggatgaatgataatctgttactgacaaagtattctactcaatttaagattgatgctagcatttcttagcttgatttaattacttgtctgtcgtccggtagttacggattcgagaccttgaaggagctttgcaagtagagaaggccagtcaagcagaagctgttgctgatttggaaattatcaagaatgaattcaaagaagttgaaagtgcatatgagcgagaaaagcataatgcacaagagagctttgcaaaactaaatttgtaagtattctattgtaaaattctctaaattaacataaagattttaaaagagctatataaaatatgaatgtatactatgtattttagatatagctcccattaatgtcagtggtagactggggcaagtgacttcataaaacataactatactttcctgtataggtaaaaatggaaatgctcttttggatattgaagtatattccaagtagcccaagaaattgagtaataaactagaaagtaaatacattaatgtagtttgtattatatgagtgatgtaacgcaatatctttaagtatcaagaccagcttgggcaacatagtgagactttgtctctacaaaaaaaataaaaaaattagccaagtatagtggtgtgcacctgtagtcccagctactcgagaggctgaggtgggaggatcacctgagcccgggagttcaaggctgaagtgagctatgatctaaggctaagatctggggctaagatttctaagtcacataaaatggtctatatgaagatggataatatttgacattttctcaaactacagaaataataataatagcagtaacactactactaatagtggccaacatgcattgtggctcacttcatacctagcattgcagtttcatttgtctaacaccgtatgaggaaggtattttaaaaaatctcttttacagatgtggaaattgaggctaaacaagagtaaggacatacagctcctaagtggcagaattagaatctttctgactcctactgattttaacctttttcagtttaaaagcctttcatcttcaaaattctgtgaaatgatttaagaagtttataatgcattaatatgtttccaaaaataagtcaatagtagacattttaaaccatttccccccccagagggtgaaattcatactaccattagtatgtggcatgataatacattggcatattagaattatattttaatcttagtttctatttatggcaagtagataatggttttccatttatagccacaatataaagatcccttttaaaatgctttattggctgggcacggtggcttacacctgtaatcccagcactttgggaggctgacgcgggtagatcacctgagttcaggagttcgagaccagcctggctaacatggtgaaaccctgtctctactaaaaataaaaaaattagccaggtgtggtggcgggcacctgtaatcccacctacctgggaggctgaggcagaagaatcacctgaacccgggaggcagaggttgcagtgagctgagatcgcgccattgcactccagcctgggcaacagagggagactgcatctcaaaaaaaagagaaaagcttcatttattataagaagtgagttaacttaagtgaaagtgtgatttaaatagcggtaatttttgtgagtgtgacaaaaatcacgaagattgcacctgaaagactgaaaacattaaaaactcttaaactgtttgtttctttaattaataatgcttataatattttaaaccaataattcttaactgaatttccttgcttccctctagtatgacttaaatgacattctgtgaatgttattctaaggacttatttatcctttatgttctttgaaccattgcttgaatgcatacatttaatacatttgaatgtattcaaatattattcaaatatgtattcaaatattattctgcatataaatctatttgaaaggcttttatgtagaatatagtgcagatttctttacttttgctttaaggtaatgattaggacctacaagtaaaactgtaagaagtcagaatgagctcccaataattaaagctttctagcaatgaaataatagacatctttcagggaactagtgagttccctgccttgggaaattcaaaacacagagtggatgattctctgtcatggatgttgaagaagagagtcttataaagattggactggaggaattttaacctacttgctaacacttaagctctgagtctaacctatatactttcctaattggaccccaaagcagtttttttccttaagttttgttttgctgttatttgtattttggtacttgaaaatttttactcaaatttagtattccagtaagcaccaactgacaattctaaacattagttacatattccaactaggcactagctaactaa

SEQ ID NO: 218 - DNA, 3375 bp, Homo sapiens
aaggaaaagagagtttggtttcattagccagaaaaaagaatacaagaagaggattcctggttcaggcagggaaaggggaattagtgacgtcaagtacctgaggacatctaaatgaacaaataggtacttggatttaaaggtctgaaagtgacagtgagaagcatcaaggctagaaaatatagatttaggagaaaacagtgcaaggtgttggctaaagctaagggtttgggtaaagttaccttaacagtaattccttctgaaattatatgtaaaatgtctatatgcacatgtgcatttttttccgggtggaagaggcaggcaggcattcacagctttcagattctcaacagtctacactagttaagaacttaagaactaaaagtatagcaagaaaagggaaaaaaacaaaacccctgggatcataattggtgggtgtaagatgaggaacactgaccctgtattgatttatttttaaagcattatcattcatagataggattttattgtaaaaagaaatgactgttttagagagaaggaaaaaactaacacattaggccaatgtggtttcactgtaggaaaattaagtcttttaccaaggactaatttctaaaagtgattggttagttctgtgaaaacctaacagcacaattaacttacctcatttttctttttctccttgatctgtgttagggttctcttgttagactgtagtttatctgcattaaaattaatatacaaaccacccaactgcttgatactcagaccagggtctatgctgctgcttgtcaacttcagactgaaaaagaaatcatcacttaaagatcaagtaattaaatcaaaatggaaacatataagatggcattttaaaaaatcacttattcttctcttcccttgtattgtccacaataaagaaaaaaaagcatcttatttttatgaggaattcctgaaaaaaaactctaaataaatatatttttcatcattttattttattttttgagacagggtctcactgttggcccaggatggagtgcagtagtgaccactgcagccttgaactcttgggactcaagtgatcctcctacctcaacctccctgggtggctgggactacaggtgcacacccaacacctggctccataatgtcaaatgaatgagccattccatgaagaacccaaggcagtgattttctcattccccaggctaacatttcatatttttatggtaaattaaccacttgaaatacatgtatcaaaaacttataaaaataaaggaaaaacttacagtttagcctttgtgctatttaggaagtcttcttcatcactaaactcatcttcattttcgtcatggtctgatgaatcttcttcacttttttcatcctcttcctcttctttttcttcctcaatggcaacctcacttgccttgtcttcctcttccaagtaaaaatttttatcagcactcattccaggagttgtgtcaattacaaacaatgcattgtcacatgacagacttcctgtgtctccacttaatgactccctttggccactattttcaacaaaacataaagtatcctcttcattctcactgttttcagactgttggctttcatcactgctgagaactagtaagacagaattatctttaccctgagatgtgttgggcgcagacgtgtatagtttggtatcacattcaaaatctacattcccttcactgttcatgtcttcactgacacttataactgtggactcttcttcatcatcactaccaccacaatcaccaaactttgtcaagtcacttgcttttatggggctctttttgttgttattccatctgcctacttccacagttgcaaatgtttgagttaatgatttcattacagcctcagagttcagattagagtgcactgatacagcatttttattttggggggttgaatgtctctgagaaactaactgttgaaggctagtgtcctgaagttcagaaagattcttcagctgagaacttttctcattaatttctttcccctcatctgttattccattggcatcttcatccaaatccttacaattctgttttgtttctttaagagattcaacattggcctgttcgtgcactgttaatatattttctgaacttctgtgggagaaatcatcatcaaagtcattattatagaaatttggcttatttatctcagaaagagatcttgcttgtaaatgggaagtttgtctggtatctgaatcctctgaattcacaggtgtacccacgatctgtttctcatttcctggtacaatcttactatctttcttttcagtttgtgcctttaatttcctctgcatactcctggttcttctagttgcaattccagagaatgaaatgtctgagcttgatgtctcagcatcagatatagcttctgtatgagattcttggcttggatctgtcagagatttagccttacttcttctggctcctgtagttttttctgtaggaagcacaattctagaaatacctgaaacatgagattctgcttcagacactatttcttcagtgtaagactcctttgttggagttactttcggctttttcctaacactggacactggggagcatgcaattaagatctgccttctcctagttacccttaaaatggtatcatggtgctcagacacagaataatttgactctgcctcagaggtttctccatccgtagatggttcagtcccctttggtagtgagcctgtagttctgctcttcctctttctagctttaggagttctagggattaaactttgcttcccagtggtctgtgattcagcagtagttcgggcatcagatccagtactactttctggatgcgcttgaatcccattagcagcaaaactctgcaaaccagagaaaacacactgtaatttaggtagggctggaacaagggcaaagcaaatgaaatactgaccccaaaagctaaaacccagtaaacaagattacctttaaaacaaaaaacaaaaaaacctgcccaactcatgatttttaaaaaatcaaaatttggccgggcgcggtggcttacggctgtaatcccagcactctgggaggccgaggcaggtggatcacgaggtcaggagttcgagacagcttggccaacatagtgaaaccccatctctactcaaagtaaaaaaattagcggggcgtgttggtgcgcacctgtaatcccaactactcaggagcctgaggcagaagaattgttggaatccgggaggcagaagttgcagtgagccgaggctgcgccactgcactctagcctgggcgacagagcaagactccgaatcaaaaacaaacaaacaaaaaaatcaaaatttaaacactggagccaaccctgcatttactt

SEQ ID NO: 219 - DNA, 3611 bp, Homo sapiens
tgtcgggcttggcattattaatttttaaatggtgaacttacaaaatagtaacgacgagtgaaaagaacttcataaacgaggaaaaagaccaacccgcagacccacggcgcgcaccacggaggggcttgcagcgagaagacagggacctccgttcccaagtgcccagcactgcgccacaggccgggtggaacgggccttgagggcctctggtttgaggtcccccacggtcgggctttgggcccaccgcgtgcggcgccgtgctgggctcctaggatcggcagcgagtccagtgactcccaccgcacccccagtaatcacagggcggccgtcgaccgcgggcaggggagggggtctgggaaggcccctggagaaggtggcatttcctcgaggtcggtggaatttggctacgcgaaaggaacagcgcgtacgaaaacttcaggcgggaacgcgcggtggcccgtgcgcggcgggtagacgtgcggggccccgggtggggccgtggggagaggtcggcagggggctttcccagggcagagagttagaatttcacgtcctacagaccgggggcacctcgccctggggctgcggggggcggcgaccgtcccattcaagagcgtgattctgaggtttgcacagctgtttcgggccagcagagccttcgctggctcttgacgtccttgcgaggtgatctctgcgaccaccagacaggagagaagacccattttacagatgaggtagtgctatctccaagtcctcaacgaggaaaccgagaagcctctagtcccgggtcttcagaaaacgcagaggtggagccgcgccgcactcgggcactccccggcgtgggcgctcccggcgggcgggccttggccgagggcgctcggcggcctggaacggtgagccgggtgccgggcctgccacgcagccgcagagactcagccccgccggcgggcggcaggaagggaggcgacgccccctggagcgcggcaggaacccggcccggcccgcctcccagtccgcctagccgcgccggtcccagaagtggcgaaagccgcagccgagtccaggtcacgccgaagccgttgcccttttaagggggagccttgaaacggcgcctgggttccatgtttgcatccgcctcgcgggaaggaaactccatgttgtaacaaagtttcctccgcgccccctccctccccctcccccctagaacctggctcccctcccctccggagctcgcggggatccctccctcccacccctcccctcccccccgcgccccgattccggccccagccgggggggaggccgggcgcccgggccagagtccggccggagcggagcgcgcccggccccatggacagctcggccgtcattactcagatcagcaaggaggaggctcggggcccgctgcggggcaaaggtaccggggctgcggggagggggccgaagccggggcgccgtgggaggagagaaggggccgggatcttccccaggggagccgccgccgccgccccgggcggccgccttagctgtgcccgaagctcccagcccgagagggagcagggagagagtttgaactcagaggaggctcagagacgcggggcggggcctggcgcctttggggcgctcctgttcgctcgaggtgaggaaactgaggcaggaatagagagggaactcttcgggggtttcctggcaggcattgcgtggtgcatgggcgcccccccaccattggcgccaatggggctgggagatgggggagctgaggagggcgcctatgggccacccgctgagactccgccccaccccccacccccacccccccgggctgcggtccggtagggtcttgggagggggcgccgaggtgacagcaggctggggaggcttggagggatctcccgccaacacacagctacgttccccacaaacttcgcgtcacgcgtggaggcgccgaccccctcggaggcacagagaggacggccggcacttccaagagtcgcttggcgcccgcggggagagtcgtgcgcctagtgggcacgcaccaccccgcaaagcctcgccgccccgacgaggctgcgtcccccagcgtggctgggccggggtgggggggtctgtcttctccttttccccgtgtggacctcaggatctggacgctgcccccaggtctgcccaccctcgcctgggtctggctgccccggaactgagggcaaggtggaaaggctagttgcagggggccggaggggggtggggtgggaggggtatctgtcaatcaggctgctgggctccaggtcggaggtctgggcggggcagggcaaacagatggccactggacactggccccaggccgcgggactgcacccctgcctctgggcccagccgcagtgaggacttcgtacccacgggggtggagaggatggagggagggcaggggtggactgccctgggtcccaggccctggctgtcctgagcaggggtgctcaggtaaggtggggtcaggaggcaccgcaatggggctgatcagcagcagtcatggaggctgtgagaggcagggagagagcaccccaggacctccttctccaggccacgcactccctatgtgggcgccttaatacctgctagacctatttgtctgggagctgcaggagccttgcagttgattgtggagccctgacaggggcgtttcagagaaagtcaggagctgccttcgtgtgtctggatgaaggggccacggcaagatcctcctggctcaggggttcacacctgggcacacatgcaggattctgcaggccagtgtgcaccgagcctccaacttgtgcctccctacttcaggtgaccagaagtcagcagcttcccagaagccccgaagccggggcatcctccactcactcttctgctgtgtctgccgggatgatggggaggccctgcctgctcacagcggggcgcccctgcttgtggaggagaatggcgccatccctaaggtgcgtgggggccaggtggggccacgggggcacctggactcagtcttcagggctttaggggaaggggctcctgactgagcttttcaggatggacttgcagacctgaaaggtgcagagtaggagggtggcagcctcccctgccaggccctgcccactgtggggaaactgaattctccctcataagtggaagctttttcctaccttggtttttagagaggtctcaaagagccaagaggcctacccaagccctagagctggcaggggcaaagctgggaagggggaagtatctgttcctggggcctggggttcctctggagacggctagggggagaagcctgcgtgggaggaaggaccaggcccggagagaggcaccccagccagccccgccctccctacagcagaccccagtccaatacctgctccctgaggccaaggcccaggactcagacaagatctgcgtggtcatcgacctggacgagaccctggtgcacagctccttcaaggtgggccctgctcaacagccctcagcccgggtctcggggggcatcccccaccctggcctgggagggaggtgtgtgctggaccccatgccctggggctcctcctccaactccagcagctcttttccccccacagcca

SEQ ID NO: 220 - DNA, 4016 bp, Homo sapiens
actccaaatttcagtgaagaacatgaagtgcataaaggaatcacctgagtaaagatatgaaatcaataattcacacaaaagtactctgtttccaaagaaattactgaaatgctatattttaaattgtttttatataataaaatgtcaaaagagttaaaatattttattatgatttgtaagatgatagatgcaaataaaaagcagactgaaaaagatcaggaaacaagtgaactagaaaacagaaataaaagcttttgattgctcttcccctacccaacacacaaatagaataaacataattgagagttataaagaacagatattaaaaatgaaaaaaataagaattgtagagaaaatattaaacgtaaaggcaaattagacaaaaaaggacatagtgtttctaaacaaaataaatggactaaattgaggagaaagagaaaaaaaagtcacaggggaagaaactttcctggaataataaaagtctaggcataataggtggacctttccattagggtatgctgtgctaaaatttctgaacttcagtatttgggaaagaaactgtaagggctcttgggtgtaaacagcaaacgaaccccaaagaaggttggatgggagattggagagactagactgacctcagactttgcagtactctaacagtgaattgtttctccacaaacatttgaggaggtcaggtgacccaagaaattataaccagcgaaactgctgttgaagtactgaataatcattaaactgtataaaagtatggatgcagaggattaatttaaacatatattaaacactaggaagatggggaaggagggacgctgagtttgagctttgtgattacagatcaaaatatgtgatgatttttgatattctaaatttaacaataagatttttttaaatttcagaggtgagtaaaaagaaagtgggaggaacataaatacgttattttccttttttcactatactttttataaatgaaatgttattaaaataatatactttaatatttttcttaatgttatcttttagatagtgatagatcttgtcttgtagtaagaaagtatctacgtgactttcagcaatgcctttagttatacttattttattgttaaatttcatataatttaataatttaccattttaatataataggaataaaattcttaatttttatctctctctttttctctcccacctcacctctctgtctctccatagagctataactacagtaattatactaatatttaaagatgattatttcaagatagtgggctttggaatagaaacttaaaaaatgttcatacttacatttttagattcattaaaaatagcaggtaaaatttgtacataaaacagtaattttttaaaagaaaataacttattctgtaagttttggcactctcctcaaaaaagattaaatgtcataagtaaaacccaagtatactcgtaaatattctaatatattggtatacttcttgggtcagcaaacttttcttcaaagggctatgaattaaatatttttgatttgtggaccatattatctctgttgtggctatgcaactctgttactgtaatgggaaagcagcaatagacaatatgtaaacagactggcatattccaataaaactttatttacaaaaataagcagtcagttctgggtcgtggtttgttgacccctggtatacacatcatcaactttagtgattaaaatattatcagcctatctgtgaaatactgaggtaaggaaactaatacaaaatattcctgatgtattgattttatattcttgctccaaatacttattactgtaatacttagctttgatgagaaagggaagtgttgctaaataatttacatacatattcatatacatgcaaattttcatatcttttgatgtctcaaaaatgctgacatttaagaaaggaagggcatattttgcttcttacagttcatatgtgctgtactcaagctgacttcttccttcccattttacatttctaactttgatctcagaatgtaggagctggacaggatcaccgagtgcatcaggtaaataatttcattcacacaagaagaaaatttacggccactaaagttaaacggttaccatgctagttcttgccaaagtcaggactggaattcagtctcctggctcccattgcagagttttgcccactacactatattattgtacatggcttggttcaagccacagaggaactaatcaaagattaactatctgatttatacatatgtatatatatacttacttatatatatatatttttatacttacatatatatatatatatatatatatatatatttttttttttttttttttttcctcgagagggcatctcgctctgtcacccagtctggagtgcagtggtgtgatctctgctcactgcaacctctgcctcccagattcaagcgattctcctgcttcagcctcccgagtagctgggattacaggcatatgccgccacgtcaggctaatttttgtatttttagtagagatggggtttcaccatgttggtcaggctggtctcgaacacctgacttcaggtggtctcctgcctcggcctcccaaagtggttggattactgacttgagccacaatgcctgggccaactgactgattattatattaggaatgcatttatattgactcctctgttctgagtacttactagttatcctgattctatttgttctctattttaaaagtaggtttataaataaagttatttaagagcaatcagtcattacacatgaggagtggtattgctctatgtatactccgtttcattgagaaacagccttttcgtaaaatggcaaaaaaaacacagctgcagttatccctttcttctgggtcatttctaatagtttagatcagtggttctcaaactttaacatgtatcagaatcacttgaagagcttgctaaaacacagattgctggggcctcctccagagtttctgattcaataggtttgggatgacgcctgagaatttgcatttcagacacgtttccaagtgacagtgatactgctagtctgggtaaaaaattttaaaaaccactgggtttaaattctcagccctaaaggcatattataattaccaggagaggcattaatccactaattaattcccaggctccatcatcaattggcatagaatgtctagggcttgagactgggtatgagtattttgtcttttttttttttttttggtttaagtaattaatcggtgcattaataattgtacatatggggtacaatttgatgtttcaatacatatctgtggtgtagagagatccaatcagggtagtgactgtatccatcacttcatgcatttaccacttctttgtggcgagaactttcaaaagcgtttcttctagctgttttgtaatatacaatattttaatgttaaccatagtcaccctactgtgcaacaggacaccaaaatttattcctcctatctaattgtaactttgtacccactgaccagtctctccctattctcccgtctcttttccctcccccagtctctggtagccactgaagtgcctcaggtgattctaatatataaccaagtcggagaagcaattaagaaaagtaatgactgaaaaagtttattttgtctgatgaattagtgcaaaattttttaaacatattcctctattatgtggggataatttttatactgtcatttcatggtaaagtataaatgagatagtataaagatgactttaccaagtgattccataaattgaaggtaatttgagtgtagttttatgctactaatcgtataaagtgctgagaatataaggtagctatagaattttacttttaaaatgttgttattgtaaaatttttgccattaataaaattatttcatgcctcagttccttaaattatttttattagcattgtatagacagcatagatactaactcctaaaattcttaatttctctctttatagtgaaagatgcagatgta

SEQ ID NO: 221 - DNA, 4299 bp, Homo sapiens
tgcttcatccatgaatatttaatatgccacaaaactatcagagattgctaatatatcccataatataatatgaaaccaaaagatttttcaaaaagctaaacttgggagagactcatagcaaaatgacatgtaattctgaggtcatcactgagtatggtacttgagtctatcgccacatgtgaaaagcatctgaatataatccaaaaagctattgcagtcatgggctgcagaataatgcggtggccaagaggctgtaatattgtgatataataagatatacatatttggcctttgatcccagttcctggcacagagttcctaaggcccttgtaattccctgagcaataggggtgctaggagagtcttttgttctaatatttggtctttgaccaaatatgtcagttcctaacattgagctctaatcccttggaatttcctgggtaacaggagcatcttttgttctaatgaggtgaccccttgggggacccctgaatggggactctgactagaaggaccaagccatgattagaagtttgaaactttcagctctaccctcatcttccagaaaatcgagagtggctagacattgagttaataatcaactatatctatttgatgaagcctccacaaaaatccctgaactacagagctccgagaacttccaggctggtgcacacacagaaatgctgagagggcagcatgccccagaagctctgtaacccttcccacacaccttttcctgtacatctcttctattttgttgttcatttgtatcctttggaatatcctctataataaactggtaaattgaactaaagagctttcatgtattctgtgaactgctctaataaatcatcaaacccaaggaggggattgtgggaacccccagtagggttcccagtaggtcagaagttccagaagcttggacttgtgattggcatctgaagtggggagcagccttatgggatcctttaacctgtgggatctcactgtatctccaggtgaataatgtcagaagtgaattgaattgaattataggacaccaagttggtgtccactgaagaatgtattggtcagtctggaagaaaaaccaacatgttggccgggcgtggtggctcagccctgtaatcccagcactttgggaggctgaggcgggcggatcacaaggtcaggagatcaagaccatcctggctaacaaggtgaaaccccgtctctactaaaaatacaaaaaatcagccaggcatggtggcagatgcctgtagtcccagctactcgggaggctgaggcaggagaatggcatgaacccaggaggcagagcttgcagtgagccgagatcgcgctactgcactccaacctgggcaacagagcaagacttccatctcaaaaaataataaaataaaacaaaacaaaataaaataaaataaaaacgaacatgttttggtgactagaagtgttgaatgttgagaatatagtaggagaaaatggtcagtttgggggttttctacaaatacacagagccctttcgcattgcgcagcatccaatttgaatcctggacctgcaaactcatgcccaggatatagtgccatatcaagggcagcatttgcatgtttctggcaggccggacgttcagtagctgcaggagttagatcagtgttggtgagtgaaagccatgctgttgaacacatacagacctgcatcctgccaccatagttactgccttcataagtccatttttaccagcactagggtggcctgtggagaagactgcttagtgtgaactggcctatagtcactgtttacttggtttagaagaggtttagagcctcttctattgtggatgctttctagtgggcattagcatgtaacacaaagatattcacaattttcccaatttcataaataaaaagatttcccattttcataaacctatccaagtgcctcttcctcaaatttcattgttcttcatcttctaaacctcctccttccaagcacttgaccaaccaaccaagccatttgccactgcccatgtattcacaaatattcttccattaggccattattctttctacacaaaatagataatcaggtgcactactcaaagctttgcccattgggaagatttacaatttctactgtcttccagaactactcttgagtgtggctataatgcagcagcagtccattttcagctcacaccaatgtgttgagcagatacatccatgaaccaaggtcatcttatttttcctccattagccaatcataaagtacccctccccccccatgacagattaaagatggctgcaaactatcggacaatcatcccatcaggagggctatctatttcccctccccttgaatctgtgctagtctatgactgttttgacaaaaacagcgtggcagaagtgacaccatgccagctctggggccagcctgtaagagaactggctgttcctccttgctatcctggagtcctgaatttccaagtaaaaagtctatcatgctgggcagaccatgtagaaaggccctgagatagcatgaagacagagaaaatgagcccaaacttacagtgaacccaccaaggtgccaggcatgtgagtgaagctgtctcggaccctctagagcagtccatctgccagctgaatacttccaagggatcccagctgatgcaacatggaatataaggaaacccagccaatttcgttccaaattcttggcccacaacatgtgagatacaataaggtttgtgttcatttaagccattaaatttggggagactttgttatgcagcaataaataactagaacactcccatgagccactggtatgagcaagttgggaagtaccaaggccacagcgtggaggacatgggaatctgggccccccacttcagcaccttgcatttaccctccagttctgcccatgactgatgcaggatatacgacttctctcttacaactgatgatgttgcaaccactagacctcatcacttgattgatttgacaggacccagctcatgatggacagttgtagcctaatagccatttgatgtctcatgatcaggagctctgtctctagtaaggcccaagagcaagctaggacttgtttcctaatggggtttactttcctgcagcagacagcatagatttgatgaagaaccccagggatctatgttgtgattttcctttcaaggcttgcccaaaatgccacactgtatcttttcccaccactgatacctttagtgccccagagtctattgagtcacatgaccaaagcactaccacacggctgatatgacagcttagaacagctgcggaccccaggtctgctctgggcttcagtcagtcgctagtaaactgttccatgtggtattcccatgagtgtggaatatgtttcctctagatcctaaataggacaaccaagcattctctaccctggagaagaggaaggagaagaccaagattcactgctggaagaagaaaacagcctatgaggctacagaaacaggcagaaaagaacgtggagaagaaaactgacaaatacacacagttctcctcaagacctatggactcctggtctgagcctaataaagactgtttattccaaaaaacacctctgtattataaattcttctgtgtaatagtgtgttactgtgcatctctttccaattctgcattactggtgttaagtgtgaaatgcaataatgtgttcttactttagagggatgtcctggcacaaagtctaaaaacttcaaagatgtggaggatgctgaatcttcacagggtgtatttcccactctctggagtgcatttgtcttaccagtgccgccaatatgcttgccctcatggctcattctgtttggttaataagatattgttgatacagtggaacgatgtcatgttttgtggaatgtccagaaggtccacgtccagtggtgtgctgcatgcagctagctcatactgcctcatggagccaactgttaaattttcagaaattgtgcaaaccagttgttaaacatgactattattttaaaataagttattttaaggcataggtaacaaatccctaagctcttcattttctaggtatttaactatcttatcatattttccatactcttctggttatttatatctgttatgtctatataataaagatactaaataatgttgtctgtataataaaaatattctggattggtgatgagcaacaatcaccatctttcgtttgagtctcatggccatgagaccaaccccatgcactgctctgagacctgccagccactcccattcctggggtgc

SEQ ID NO: 222 - DNA, 4829 bp, Homo sapiens
aaggaaaagagagtttggtttcattagccagaaaaaagaatacaagaagaggattcctggttcaggcagggaaaggggaattagtgacgtcaagtacctgaggacatctaaatgaacaaataggtacttggatttaaaggtctgaaagtgacagtgagaagcatcaaggctagaaaatatagatttaggagaaaacagtgcaaggtgttggctaaagctaagggtttgggtaaagttaccttaacagtaattccttctgaaattatatgtaaaatgtctatatgcacatgtgcatttttttccgggtggaagaggcaggcaggcattcacagctttcagattctcaacagtctacactagttaagaacttaagaactaaaagtatagcaagaaaagggaaaaaaacaaaacccctgggatcataattggtgggtgtaagatgaggaacactgaccctgtattgatttatttttaaagcattatcattcatagataggattttattgtaaaaagaaatgactgttttagagagaaggaaaaaactaacacattaggccaatgtggtttcactgtaggaaaattaagtcttttaccaaggactaatttctaaaagtgattggttagttctgtgaaaacctaacagcacaattaacttacctcatttttctttttctccttgatctgtgttagggttctcttgttagactgtagtttatctgcattaaaattaatatacaaaccacccaactgcttgatactcagaccagggtctatgctgctgcttgtcaacttcagactgaaaaagaaatcatcacttaaagatcaagtaattaaatcaaaatggaaacatataagatggcattttaaaaaatcacttattcttctcttcccttgtattgtccacaataaagaaaaaaaagcatcttatttttatgaggaattcctgaaaaaaaactctaaataaatatatttttcatcattttattttattttttgagacagggtctcactgttggcccaggatggagtgcagtagtgaccactgcagccttgaactcttgggactcaagtgatcctcctacctcaacctccctgggtggctgggactacaggtgcacacccaacacctggctccataatgtcaaatgaatgagccattccatgaagaacccaaggcagtgattttctcattccccaggctaacatttcatatttttatggtaaattaaccacttgaaatacatgtatcaaaaacttataaaaataaaggaaaaacttacagtttagcctttgtgctatttaggaagtcttcttcatcactaaactcatcttcattttcgtcatggtctgatgaatcttcttcacttttttcatcctcttcctcttctttttcttcctcaatggcaacctcacttgccttgtcttcctcttccaagtaaaaatttttatcagcactcattccaggagttgtgtcaattacaaacaatgcattgtcacatgacagacttcctgtgtctccacttaatgactccctttggccactattttcaacaaaacataaagtatcctcttcattctcactgttttcagactgttggctttcatcactgctgagaactagtaagacagaattatctttaccctgagatgtgttgggcgcagacgtgtatagtttggtatcacattcaaaatctacattcccttcactgttcatgtcttcactgacacttataactgtggactcttcttcatcatcactaccaccacaatcaccaaactttgtcaagtcacttgcttttatggggctctttttgttgttattccatctgcctacttccacagttgcaaatgtttgagttaatgatttcattacagcctcagagttcagattagagtgcactgatacagcatttttattttggggggttgaatgtctctgagaaactaactgttgaaggctagtgtcctgaagttcagaaagattcttcagctgagaacttttctcattaatttctttcccctcatctgttattccattggcatcttcatccaaatccttacaattctgttttgtttctttaagagattcaacattggcctgttcgtgcactgttaatatattttctgaacttctgtgggagaaatcatcatcaaagtcattattatagaaatttggcttatttatctcagaaagagatcttgcttgtaaatgggaagtttgtctggtatctgaatcctctgaattcacaggtgtacccacgatctgtttctcatttcctggtacaatcttactatctttcttttcagtttgtgcctttaatttcctctgcatactcctggttcttctagttgcaattccagagaatgaaatgtctgagcttgatgtctcagcatcagatatagcttctgtatgagattcttggcttggatctgtcagagatttagccttacttcttctggctcctgtagttttttctgtaggaagcacaattctagaaatacctgaaacatgagattctgcttcagacactatttcttcagtgtaagactcctttgttggagttactttcggctttttcctaacactggacactggggagcatgcaattaagatctgccttctcctagttacccttaaaatggtatcatggtgctcagacacagaataatttgactctgcctcagaggtttctccatccgtagatggttcagtcccctttggtagtgagcctgtagttctgctcttcctctttctagctttaggagttctagggattaaactttgcttcccagtggtctgtgattcagcagtagttcgggcatcagatccagtactactttctggatgcgcttgaatcccattagcagcaaaactctgcaaaccagagaaaacacactgtaatttaggtagggctggaacaagggcaaagcaaatgaaatactgaccccaaaagctaaaacccagtaaacaagattacctttaaaacaaaaaacaaaaaaacctgcccaactcatgatttttaaaaaatcaaaatttggccgggcgcggtggcttacggctgtaatcccagcactctgggaggccgaggcaggtggatcacgaggtcaggagttcgagacagcttggccaacatagtgaaaccccatctctactcaaagtaaaaaaattagcggggcgtgttggtgcgcacctgtaatcccaactactcaggagcctgaggcagaagaattgttggaatccgggaggcagaagttgcagtgagccgaggctgcgccactgcactctagcctgggcgacagagcaagactccgaatcaaaaacaaacaaacaaaaaaatcaaaatttaaacactggagccaaccctgcatttacttcactagcctcatccttcctagatgtaacttcagaagcagaacgattaaaatttttctgtttaaagtcaaatataatgggtagaccaacattctgacccacctatagaagaggggagaaagggaatattaactctgaacaccgatgtgtttaggaacacactgatggaatcagtcgccgcccttacctttacgtacaggaaaaaatcgccgccgctccgttccctgcatcgctgagtcagaatgagacagccgactaacgccactaagagtcaccaggcgacgacaccacagccctcctcacgccttaaggaggtgatgctggacagctgccagcctccccacgtgaaaacgaagctttttttccagcccccctaaatggggcttgtgcatggtggccgaaattaaccctccttggtaccgtgttaacagtaaggtttaaaagttcgaactgtgcttctgcattaaggagttgaacgacccaaataaagttatctaacctctcttccatactaaaaattgccttaagagacagtggtgaaggctaaacagtttccgtgacaggcttagcacggggcctgggagacccaagcgcgcggcaagctcgggtcctctctgtcggcaggtcctcacccttaaccggacccttgcgccgccccgcctgcctgagcgcggctctgcgaagcggcgagaagtagggaagactggatttcctaccttttgcccggaactttcagccgacgcggcttggatgctggccttagcccgtgcagatctggtaaccaccatctttccggctccctcgcgaccaccacgacttccctcttccctggcgctccggaaatgcgtcagagaactgcctcgagcgcgttttccgcgcagatccgagaattcgcgagaatctccgcccagccagttcaggccagggcggtcagagacaaagggcctgggtttaagtgtgcatttcagagctgtagaaggcaagccagatttttgctgggaaagaccttcatcggggcggcgaagcccgcagtgacagagggtcttagcgtacccgttcacatgaattgtaaaaacgcacttacatgccattcgttctttcatttgtttagtagaatcgtttgaacccgggaggcgttctttcatttctacgttctaaagagcttaatgtagccattggtatgtccaagggagaagtttgagatatttgtgctttttaaagaaagacaatatttactcgtgtattgtgacgctaactataaataaaatttaaggacttggttggggtaaaagggatataaggtgctcgcaggaactgggagacgaagtggaaagctgtataatctaaacgtgagatggtgtttagggattgggaatagcagaaaagaaaaaaacgttaaagaaattgtaaaggagaagaataaggttttgttgttgttgttgttgttgttattgtc

SEQ ID NO: 223 - DNA, 5816 bp, Homo sapiens
attttacagatgaggtagtgctatctccaagtcctcaacgaggaaaccgagaagcctctagtcccgggtcttcagaaaacgcagaggtggagccgcgccgcactcgggcactccccggcgtgggcgctcccggcgggcgggccttggccgagggcgctcggcggcctggaacggtgagccgggtgccgggcctgccacgcagccgcagagactcagccccgccggcgggcggcaggaagggaggcgacgccccctggagcgcggcaggaacccggcccggcccgcctcccagtccgcctagccgcgccggtcccagaagtggcgaaagccgcagccgagtccaggtcacgccgaagccgttgcccttttaagggggagccttgaaacggcgcctgggttccatgtttgcatccgcctcgcgggaaggaaactccatgttgtaacaaagtttcctccgcgccccctccctccccctcccccctagaacctggctcccctcccctccggagctcgcggggatccctccctcccacccctcccctcccccccgcgccccgattccggccccagccgggggggaggccgggcgcccgggccagagtccggccggagcggagcgcgcccggccccatggacagctcggccgtcattactcagatcagcaaggaggaggctcggggcccgctgcggggcaaaggtaccggggctgcggggagggggccgaagccggggcgccgtgggaggagagaaggggccgggatcttccccaggggagccgccgccgccgccccgggcggccgccttagctgtgcccgaagctcccagcccgagagggagcagggagagagtttgaactcagaggaggctcagagacgcggggcggggcctggcgcctttggggcgctcctgttcgctcgaggtgaggaaactgaggcaggaatagagagggaactcttcgggggtttcctggcaggcattgcgtggtgcatgggcgcccccccaccattggcgccaatggggctgggagatgggggagctgaggagggcgcctatgggccacccgctgagactccgccccaccccccacccccacccccccgggctgcggtccggtagggtcttgggagggggcgccgaggtgacagcaggctggggaggcttggagggatctcccgccaacacacagctacgttccccacaaacttcgcgtcacgcgtggaggcgccgaccccctcggaggcacagagaggacggccggcacttccaagagtcgcttggcgcccgcggggagagtcgtgcgcctagtgggcacgcaccaccccgcaaagcctcgccgccccgacgaggctgcgtcccccagcgtggctgggccggggtgggggggtctgtcttctccttttccccgtgtggacctcaggatctggacgctgcccccaggtctgcccaccctcgcctgggtctggctgccccggaactgagggcaaggtggaaaggctagttgcagggggccggaggggggtggggtgggaggggtatctgtcaatcaggctgctgggctccaggtcggaggtctgggcggggcagggcaaacagatggccactggacactggccccaggccgcgggactgcacccctgcctctgggcccagccgcagtgaggacttcgtacccacgggggtggagaggatggagggagggcaggggtggactgccctgggtcccaggccctggctgtcctgagcaggggtgctcaggtaaggtggggtcaggaggcaccgcaatggggctgatcagcagcagtcatggaggctgtgagaggcagggagagagcaccccaggacctccttctccaggccacgcactccctatgtgggcgccttaatacctgctagacctatttgtctgggagctgcaggagccttgcagttgattgtggagccctgacaggggcgtttcagagaaagtcaggagctgccttcgtgtgtctggatgaaggggccacggcaagatcctcctggctcaggggttcacacctgggcacacatgcaggattctgcaggccagtgtgcaccgagcctccaacttgtgcctccctacttcaggtgaccagaagtcagcagcttcccagaagccccgaagccggggcatcctccactcactcttctgctgtgtctgccgggatgatggggaggccctgcctgctcacagcggggcgcccctgcttgtggaggagaatggcgccatccctaaggtgcgtgggggccaggtggggccacgggggcacctggactcagtcttcagggctttaggggaaggggctcctgactgagcttttcaggatggacttgcagacctgaaaggtgcagagtaggagggtggcagcctcccctgccaggccctgcccactgtggggaaactgaattctccctcataagtggaagctttttcctaccttggtttttagagaggtctcaaagagccaagaggcctacccaagccctagagctggcaggggcaaagctgggaagggggaagtatctgttcctggggcctggggttcctctggagacggctagggggagaagcctgcgtgggaggaaggaccaggcccggagagaggcaccccagccagccccgccctccctacagcagaccccagtccaatacctgctccctgaggccaaggcccaggactcagacaagatctgcgtggtcatcgacctggacgagaccctggtgcacagctccttcaaggtgggccctgctcaacagccctcagcccgggtctcggggggcatcccccaccctggcctgggagggaggtgtgtgctggaccccatgccctggggctcctcctccaactccagcagctcttttccccccacagccagtgaacaacgcggacttcatcatccctgtggagattgatggggtggtccaccaggtgagggccaggaagaggcagtggtgggcttggcatctgcctccagaccctaggctcttcccaccaatccggagcgcctcggatgggaattggatacatgtggaatgtcagaggcccagagagggtgtgagacttgtcccaaagtcacacagaacctcaagggcttgtgctgactccaagcctgcagagtgggctcctcctctaggctcccccgtgctgtgctccctcgccccaccctgcccgggacccagttcaagtaattcaggataggttgtgtgctgtccagcctgttctccattacttggctcggggaccggtgccctgcagccttggggtgagggggctgcccctggattcctgcactaggctgaggttgaggcaggggaagggattgggaattagggacctcgtgaggtaggactggccagtggagtggaagttttgatcgttttctggcggggggtgggtacagtttccccagcagtggtcagggtagctggccaagcggagcctgcgggcccagtctccttcctgtgcgcctctgcctccctggcccatgccctgccagccctcggccacccccacactgccccactggcccgcagccccctcactggcccgccccccaggtctacgtgttgaagcgtcctcacgtggatgagttcctgcagcgaatgggcgagctctttgaatgtgtgctgttcactgctagcctcgccaaggtgagccccacaggggtcccggggcaaccctgccctcctacctacctcccgcatgcagcccaatgaacctgcgggccccaggatgacccacctcctgctcccagtacgcagacccagtagctgacctgctggacaaatggggggccttccgggcccggctgtttcgagagtcctgcgtcttccaccgggggaactacgtgaaggacctgagccggttgggtcgagacctgcggcgggtgctcatcctggacaattcacctgcctcctatgtcttccatccagacaatgctgtgagtgcgggctggactgggactgggacaggagctgagacccaggaaggggtcagtccattcaggccaccttggcctcttggatccccagttggggggtgggtgccctcccagtccttcctgcattcattgcctgtgcctgccgcccactcccctcatccacctgccctgtagccatatggtcttttcccctcgcacaaagcagagcatctgccatgcacaggggcccccacagggcaacggagtttggaaagtttcaatttttcgaattgccagttgtgacctactgatggcccacagaattaatttagtgggttctgattgggaattttaacaaaatgaaatagaatagaaaatatccggtcgggtgcagtggctcatgcctgtaatcccagcactttgggaagctgaggtgggcaggtagctgagcccagtagttcaagaccagcctcggcaacatagtgaaaccttatgtctacaaaaaatacaaaaactagccaggcgtggtggcgcatgcctggagtcccggctatgcagaaggctgaggtaggagtatcacttgagccctggaggcagaggctgtggtgagccaagattgtgccactgcactctagcctgggcaacagagcaagaccctgcctcaaaaaaaaaaaaaagtatccgagtgcttcgcacagataaggttaggaattgtgaagcttttgcattgttacgttataaatgtgttttcctggggattgctgtcaaaaaagtttgaacactgtgggtgaggggttttcagaaactgcatgatctgagtagtggctacatagggctggcctggaaattctgcacccaggaccacctgcccccctcatcttcctacacccacttccccaggtaccggtggcctcgtggtttgacaacatgagtgacacagagctccacgacctcctccccttcttcgagcaactcagccgtgtggacgacgtgtactcagtgctcaggcagccacggccagggagctagtgagggtgatggggccaggacctgcccctgaccaatgatacccacacctcctcccaggaagactgcccaggcctttgttaggaaaacccatgggccgccgccacactcagtgccatggggaagcgggcgtctcccccaccagccccaccaggcggtgtaggggcagcaggctgcactgaggaccgtgagctccaggccccgtgtcagtgccttcaaacctcctcccctattctcaggggacctggggggccctgcctgctgctccctttttctgtctctgtccatgctgccatgtttctctgctgccaaattgggccccttggccccttccggttctgcttcctgggggcagggttcctgccttggacccccagtctgggaacggtggacatcaagtgccttgcatagagccccctcttccccgcccagctttcccaggggcacagctctaggctgggaggggagaaccagcccctccccctgccccacctcctcccttgggactgagagggcccctaccaacctttgcctctgccttggagggaggggaggtctgttaccactggggaaggcagcaggagtctgtccttcaggccccacagtgcagcttctccagggccgacagctgagggctgctccctgcatcatccaagcaatgacctcagacttctgccttaaccagccccggggcttggctcccccagctctgagcgtgggggcataggcaggaccccccttgtggtgccatataaatatgtacatgtgtatatagatttttaggggaaggagagagggaagggtcagggtagagacacccctcccttgcccctttcctgggcccagaagttggg

SEQ ID NO: 224 - DNA, 6078 bp, Homo sapiens
tgcttcatccatgaatatttaatatgccacaaaactatcagagattgctaatatatcccataatataatatgaaaccaaaagatttttcaaaaagctaaacttgggagagactcatagcaaaatgacatgtaattctgaggtcatcactgagtatggtacttgagtctatcgccacatgtgaaaagcatctgaatataatccaaaaagctattgcagtcatgggctgcagaataatgcggtggccaagaggctgtaatattgtgatataataagatatacatatttggcctttgatcccagttcctggcacagagttcctaaggcccttgtaattccctgagcaataggggtgctaggagagtcttttgttctaatatttggtctttgaccaaatatgtcagttcctaacattgagctctaatcccttggaatttcctgggtaacaggagcatcttttgttctaatgaggtgaccccttgggggacccctgaatggggactctgactagaaggaccaagccatgattagaagtttgaaactttcagctctaccctcatcttccagaaaatcgagagtggctagacattgagttaataatcaactatatctatttgatgaagcctccacaaaaatccctgaactacagagctccgagaacttccaggctggtgcacacacagaaatgctgagagggcagcatgccccagaagctctgtaacccttcccacacaccttttcctgtacatctcttctattttgttgttcatttgtatcctttggaatatcctctataataaactggtaaattgaactaaagagctttcatgtattctgtgaactgctctaataaatcatcaaacccaaggaggggattgtgggaacccccagtagggttcccagtaggtcagaagttccagaagcttggacttgtgattggcatctgaagtggggagcagccttatgggatcctttaacctgtgggatctcactgtatctccaggtgaataatgtcagaagtgaattgaattgaattataggacaccaagttggtgtccactgaagaatgtattggtcagtctggaagaaaaaccaacatgttggccgggcgtggtggctcagccctgtaatcccagcactttgggaggctgaggcgggcggatcacaaggtcaggagatcaagaccatcctggctaacaaggtgaaaccccgtctctactaaaaatacaaaaaatcagccaggcatggtggcagatgcctgtagtcccagctactcgggaggctgaggcaggagaatggcatgaacccaggaggcagagcttgcagtgagccgagatcgcgctactgcactccaacctgggcaacagagcaagacttccatctcaaaaaataataaaataaaacaaaacaaaataaaataaaataaaaacgaacatgttttggtgactagaagtgttgaatgttgagaatatagtaggagaaaatggtcagtttgggggttttctacaaatacacagagccctttcgcattgcgcagcatccaatttgaatcctggacctgcaaactcatgcccaggatatagtgccatatcaagggcagcatttgcatgtttctggcaggccggacgttcagtagctgcaggagttagatcagtgttggtgagtgaaagccatgctgttgaacacatacagacctgcatcctgccaccatagttactgccttcataagtccatttttaccagcactagggtggcctgtggagaagactgcttagtgtgaactggcctatagtcactgtttacttggtttagaagaggtttagagcctcttctattgtggatgctttctagtgggcattagcatgtaacacaaagatattcacaattttcccaatttcataaataaaaagatttcccattttcataaacctatccaagtgcctcttcctcaaatttcattgttcttcatcttctaaacctcctccttccaagcacttgaccaaccaaccaagccatttgccactgcccatgtattcacaaatattcttccattaggccattattctttctacacaaaatagataatcaggtgcactactcaaagctttgcccattgggaagatttacaatttctactgtcttccagaactactcttgagtgtggctataatgcagcagcagtccattttcagctcacaccaatgtgttgagcagatacatccatgaaccaaggtcatcttatttttcctccattagccaatcataaagtacccctccccccccatgacagattaaagatggctgcaaactatcggacaatcatcccatcaggagggctatctatttcccctccccttgaatctgtgctagtctatgactgttttgacaaaaacagcgtggcagaagtgacaccatgccagctctggggccagcctgtaagagaactggctgttcctccttgctatcctggagtcctgaatttccaagtaaaaagtctatcatgctgggcagaccatgtagaaaggccctgagatagcatgaagacagagaaaatgagcccaaacttacagtgaacccaccaaggtgccaggcatgtgagtgaagctgtctcggaccctctagagcagtccatctgccagctgaatacttccaagggatcccagctgatgcaacatggaatataaggaaacccagccaatttcgttccaaattcttggcccacaacatgtgagatacaataaggtttgtgttcatttaagccattaaatttggggagactttgttatgcagcaataaataactagaacactcccatgagccactggtatgagcaagttgggaagtaccaaggccacagcgtggaggacatgggaatctgggccccccacttcagcaccttgcatttaccctccagttctgcccatgactgatgcaggatatacgacttctctcttacaactgatgatgttgcaaccactagacctcatcacttgattgatttgacaggacccagctcatgatggacagttgtagcctaatagccatttgatgtctcatgatcaggagctctgtctctagtaaggcccaagagcaagctaggacttgtttcctaatggggtttactttcctgcagcagacagcatagatttgatgaagaaccccagggatctatgttgtgattttcctttcaaggcttgcccaaaatgccacactgtatcttttcccaccactgatacctttagtgccccagagtctattgagtcacatgaccaaagcactaccacacggctgatatgacagcttagaacagctgcggaccccaggtctgctctgggcttcagtcagtcgctagtaaactgttccatgtggtattcccatgagtgtggaatatgtttcctctagatcctaaataggacaaccaagcattctctaccctggagaagaggaaggagaagaccaagattcactgctggaagaagaaaacagcctatgaggctacagaaacaggcagaaaagaacgtggagaagaaaactgacaaatacacacagttctcctcaagacctatggactcctggtctgagcctaataaagactgtttattccaaaaaacacctctgtattataaattcttctgtgtaatagtgtgttactgtgcatctctttccaattctgcattactggtgttaagtgtgaaatgcaataatgtgttcttactttagagggatgtcctggcacaaagtctaaaaacttcaaagatgtggaggatgctgaatcttcacagggtgtatttcccactctctggagtgcatttgtcttaccagtgccgccaatatgcttgccctcatggctcattctgtttggttaataagatattgttgatacagtggaacgatgtcatgttttgtggaatgtccagaaggtccacgtccagtggtgtgctgcatgcagctagctcatactgcctcatggagccaactgttaaattttcagaaattgtgcaaaccagttgttaaacatgactattattttaaaataagttattttaaggcataggtaacaaatccctaagctcttcattttctaggtatttaactatcttatcatattttccatactcttctggttatttatatctgttatgtctatataataaagatactaaataatgttgtctgtataataaaaatattctggattggtgatgagcaacaatcaccatctttcgtttgagtctcatggccatgagaccaaccccatgcactgctctgagacctgccagccactcccattcctggggtgcggtcctcctggttcagaagtgattttccattaggctatcttttaatttaaacatgaactctgctgtgcccatcactgtctgtgtgcagtcacaggtagagggagagccttcagatggcaccctcagcacttcccaaccctttccttccctctaggccagaaggtggtggtcgtacaatgcgagagcatcaacatttctggcaagttctacagaaacaagttgaagtacctgggctttctccgcaagcggatgaacaccttctggaggccctgccatttctcggccctagccgcatcttctggtggatggtgcaaggcccactgccccacaagactcaccaaggccaggccgccctcaaccacctcaaggtgtctgacggcattccaccgccccatgacaagaaaaagctttggtggttcctgctgccctcaagcttgtgtgtctgaagcctacaagaaaatttgtccgcctggacaccgagcttatgaagttagctggaagtaccaggcagtgacagccaccctgaagaagaggaaggagaaggccaagatccactaccagaagaagaaacagcttatgaggctacagaaataggtggaaaagaacatgaaaaagaaaactgacaaatacacacaggtctcctcaagatccatggacttctggtctgagcctaataaagactgtttgtttattcctcaaaaacaaacaaacaaaaaaaaaccctctgtattataaattattctgtgtaatggtgtgttaccatacatttctctacaactctgcattttcagtaatctcacattgacagtttaaaattggccatggtgagaatatttacactgcagaaatcagcaaatgatgtaaatcaaggcttttttgcctggacttgcagcacatccatgtcccattggaccctattatgacgggagagttttaacatggtactgaagcaaaaatgtaaatgtaaatgtacacttatatccatacctgtaaattcaaactgcctttggtctttcttcctgatagtatttgaaaagaacacattcagccaggcacggtggctcacgtctgtaatcccagcattttgggaggctgaggcaggcagatcacgaggtcaggagttaaagaccagtctgatcaatatggtgaaaccctgtctctactaaaaatacaaaaattagccaggcgtggtggcatttgcctgtagtcccagctactcaggaggctgaggcaggagaatcgctcgaacccgggagggggaggttgcagtgagccaagatcatgccattgcactccagcctgggcaacagtgagattccatctcaaaaagaaaagaaaagaacacattattcaccagattaatagccatataacatggacctgaaaccgtgctaatcaggcacaacagctgtaattacagctatttcttggttgagtttgtgctagtctggtcatctttcaagttgcatctgatatttgtagtgaccagactggtgaattaaatgtgaaatatgatagaaacaaacccccgcaccctttaaaggtggcctcaatcagccatttcccttgaattgtgatattgttcttgattcactgtctttgcggtaagaggtgtagattcagggcttccacttcaatctgtagctcgtactccacagactaaagaactatgtggggattctgccaatggccaagcatgtgcattccagttacagatttagagactgcagaaatgactactgggtagatccatggacctagtacatgccatttattagc

SEQ ID NO: 225 - DNA, 6273 bp, Homo sapiens
ctgtgcatgtttaatgggatattcatataggatttttgaatagatcattgaatatcagcatttatagctggcatcctactagtttgactctcagtaataagacttgtcaaagatccaagaatctgaaagttgatgataaatttccatgtgtatcaccatcaatgactgaaagtcagcatccacagaattgggagagatgaacttaatagataaagatgaattggagttgtgtttctcttagagaatgatactctccatgacttgtgtgagtcacagctgccagaaaacaaagaggccaaggaacatattaaagaagcacagcaaattcagtcctagagtgcctctgcttggcttcgtgttatagttctgacttctaaaaaatcactttttggcaaaatatactttgtgtttcttcccctcttgcaaactgcaaccaaacagaatcctttttagcaaggcatttttgtgttctttgaccaaagcaacatataaataacaaaaagaagtaagagaaagaacttttttttgtgtgtataggctagtatttaacataaacttgagagtgagtgccagtattatatttaggatttagggactagataggaaaactggatagaaatctaaagattgctgactcaaacacaatgtggtttctttgctttattttcacagctctgaattcacaactattagttatatttatatgcactataactttagaaagcaccttcccaaaccaaattttatgtgatttcttataatttagatgactttattatagaattgaatttccaactgttcataagaattattgagcatttgctgcatagtatcatctcagctgtgtccacatgagctacctatcaccttgtgttaatgaataatggttcaccaggaatattggttttggcatttaaagtgatctgtatttaatgcagataggaccagggaccactcttgaacattaatgtccaagcatcttaaaattacacagaatgctttcataatcagaattctgcctcactctccatctttagcccttttccccatgtgccctttctctggcattactgaactgcctgcaatgccctactcactcatccttctcttgtaggcaaatacattcactctttcacaccttactccctctcttgctgcttcctggcatactgccaacctttcctgccctctaccccttgtaatctggctagcctcaatatttaagtctctgcttggccatgatttctagaaaaccatccctgacatgctttattttcattctttttaaatcctaatgcctactatgtatgtagcaggactcagtaaaaaattgctgagtaaaataaagaatgtttatacaaaggtgatatgcaagactgtcccctacagtcttggagccgaggggacagacatgtggagcaataacgtacatttgagatggtaaagatgcagtagaaaaataagtaaagtattaaggcagcctcaaggaaggaggtacctgtttatctggggaaagacatgcagaatcaaggaagacttcacatagcattgttttaaaagatgaaaaaaattgtcagaatagtggagggaaacatttaaatattaggaagacattgtacactaataaaggtgtcagcagtgattttggaaatcatttacaaggcactattaggaagtggagaacagtatactgtgttaccttatatgtttctgccgtattttaatattgtgttcctggtggttttgttcatttacgttgggtggatgaatttgtgagtgaatgtttgacatgtttgtatgtcctcaatctggtggactctggtatctccccaagtggtttgttgaagttttggagaattattacttaagtaactatttcatgaaagattaagcttcatttaagcgctcaatttatgaaatgaaatgtcttaaatctatttttataaaaacaatagttttaaattgttctaagtggttcattttaaccaaatatatggatttcacttcagaacaagacttaaagctgacatcagaggaagagccacaaaggcttaaaggaagtgaaaatagtcagcatgaggcatgtaaaattttaaatttaaatttctggtttaatgttcttttctttgctttgataatagtagatagtccaaatgaaattacctttcagactaggctttgataatcaataaattttttaaaataattttttaatagattcttaaagtttattttaatagatttagtgaccttattaacagaagaatcaatagaatctaatttaatatttgatatttaacttaaagattataacccactataaaatttaaaatattcttatttaaaatattcttatctgccttcttgattggcttatagctaatctttccctttggaatagaggcaaaacaaatccagaactttatttgttcttttatttttacaacatccttacatgataaagaaagtaacatcaattattggatcatattatcaagcaattgaaattatgaacaatgtagcagtgatggtccctgagctggattcatggcaaaggagtaatcatggccagtgattgaaaatctgcggttttatattgccagtcagtgatgccaaggttaaagatgaattctacctgtggtctctcactgacctcagggtttctgttcagggagagaaccaggtcttaaaagcaacccaactgcctattacaataatcatatcttgcagaatgagacctttgttgttagtgtacaaacacagtaacattttaacatttcagttgcagaacatcagtacatattatttaaaaatttttatcctctgtcattagtacacattagaatatattagaactggacttaagccgatagtctagatacataacatgatcgtattatagtacataatttcaattaaaatgtaacaatttgcatttctttctgtttggtgttgattttggctcctaataatttaaagtgtgcctacactccagttagtaatcttttaaaaaaccacctaaatgcactgtaggggctcactacttaaggtatggtgaagtaaaatcttttcaagtgagaaaaaccctacaaattacctgctaattcattttggtagatttaacacataatgaattaagtttaatccaaacaaaaggtgacaaagttaagttttccagttcatgtttttcttctttctttggctaaggtgaatttttttatgttttagtcagaagccagtgatgtggcagtagctaaacatagaataaaatgttaattcttcattttagttatttaattattatttctttaattattttaacaggtaaattttaattttaattattttctaattttttattgtccatacttgattacttaagaataaaattattttaaaaacatgtactccaaaagagcagacatctgagaaacacaacaagcaaattaaccttctataattgcatctgcagaaagtgactcaagaaccagacataaataaggattgcgatagagaggtatacctttatattcaaatgtttccgttgaattagatttttacattatgttgtttaacaaagtataataagtttaggcatgtatgattctatcatgtaagtagcataaatcatcagtgaaaaatttagtatgtaactcagaaagctgagttgtgtacattaagttttaaagagagacaaaccctagaaatattcttcattattatggaataatcctgaatggtgccaaaaatgctacgtaatgctactttaggagctttggatcaatcattttatctttcttggtattagtctgattatcaatagataatatggctaaagaagataatttgttattctgtatatcctctagctagaaagttttatggccactgaatgtgaaatttggggagcgtctcatttactggaattccatgctagcacctcagcagttttattctgctttttgtgttgtgggaaactttggttcccatgtttcagtgagcactttcatgtttttgatatcccagcaaccatatgaaaaagcaatgatcacaggcagtgggggagaagaatattttagtgcaggaaagggaaatcttcctttctattcctggagcccgacagtgtctcatcctctaaatctgactgcttaatggaaaatccaggttgtaaagatggaagaagacacattttgcatctttgtgtttttatttgtgtgttcccacaagtcaaatggggtgaatatttatattagattctgaagagtggttgggaataaaagcacaaaatgaaattttgaaattttggaaattttgaaattttggaaaattgttctattcattcaaagagaaataaagcaaactttacaaaaattttaatgatatactaatgatgtaataattacatcttaaaattatatggtaacagttctgtatatatgatcaaatttaagtgtgaaatatttttaatgacaaattatgacaaactgagtcaaatgataaaatcaattaaaacaaaaaggtactttttattcaataaagcaataactgtccttaatatcaaacttccactcaaggttgaagaagaaatgcagaagcatggaagtaataatgtgggattatcagaaaacctgactgatggtgctgctgctggcaatggtgatggtggattagttccacaaagaaagagcagaaagcatgaaaatcagcaatttcctaacacagagattgaagagtatcacaggtaagcctatggcaacatttaacaggagataactatgtgctatcaaactaatccgaatttggactaatattcatgatgaaaaaattttatacttttcctaggatattcagccttgcctggtaatcagaagaatgaaaatcagcaaacaatgagttatattttttccagtcattaatttatttgaaaaataaccagtgttggcaaatgtgagggaaaaagcattttcttttctttttagtgaacttttattttagcttcaggggtacacgtgcaggtttgttacataggtaaactgtatcatggagattggggttacagattatttcatcagtcagataataagaatgatacccaataggtagttttttggtcctctccctcctgccatgctccaccctcaagtaggccgcagttgtctgttgttctcctctttgtgtccatgagttctcattgtttggttctgacaaatgagtgagaatatgtggcatttgattttctgttcctgcattagtttgcttaggataatgacctccagctccatctgtgttgctgcagaggaaatggactcactgaaaaggatattttcatacactgttggtaaatacattttgagtgttaatttagtagcatattcacacacacacatatataacagtaaggatataaaatatatgtatgttatggatatttgtatagatatattacatatatacttatgtataaggacatttattatagcataattatatcaaaaagttggagctagtccaaatccttatcaataggaaatagctcagaaaataatatagtatgcaatcagttttttaaaatgaagttagatctagagtgtactgattatttcacaattaacatgtatttaaagcatttagtttgctgacccatcttaagacaattttgttagaattcttgtagtatctgctgtgttgcaaatggaagctacatgctatgttgacactgtaccttgttagcaacaatatcgctagttattaaattatggttgtcagtgcctgagtgctgaaataattggaccctcaactgaacattgccaaaggattgcacatggggatctgtattttatgtaaatatttcagtatattggataaaacttgtttaaatacatcaaaggatctttgatctactaaaacaggaattggccagcttttttctgtaaagagccagttggtaaatattttaatctttgtggactatatgtacttatttttttgagacaggttctcactctgttgcccaggctggagtgcatttgcgtgatcatggctcactgcagcctcaactttctgggctctagtgatcctcccacctcagtctctctactagctgggaccacaggtgtgcaatatcacacccagatgattgactctatggactataaagtaaataagcatggctgtgtttcaagataccttacttaaaaaaacaggcagtgggctggagtgggcccacaagtgttaatttgctgacccttgtgctaaaaggaaggtgttgctaat

SEQ ID NO: 226 - DNA, 6727 bp, Homo sapiens
ctcaactaactaaatcaaattatcttacctctcaaaatacgcttcttcttttatcatccaacttagccacaccaccatcagctgctcctgttcaggtgtactatataaaatataccagaatgtcactggtttaaattagatatactagcatatgaataaaaagcattctgaagttatttttggtagaaattatttttcctgccctattttcaagtatcaagtcaaattaaaggcttgctgaattgggccattaattgtcattgaggtatgaagtaattctagagctcaagaatgaggacctttgctttttttcatggatcccctctcaaagtcttagttactgccttcacaggttggaaagagtaagattcttcacattccttagaaaacaaaggccccttgggattaacttgttaaaacaactacacaacagctgatatttatttcatatagaaaaaaatctagtgttaacacttaagcatcaaaatatcacaaactgagtgccaaacagtaatgagcagtccatcttctggaaaaatgaaatttaatttatagaaaccttatgagtagatctcaaagttacagagaaataaatgatcactaatcatgggaaaaaaggcagtcacaggcttaccagatatgaaaaatggctataaaaatacgacttttctttgagacaatgtcttgctctgtcgcccaggctggagtgcagtggcgcaatcatagctcactatagcctcgaccacccaagctcaagtgatcctcccacctcagcctcccaagtagttgggactacaggcatgcgctactgcatccagctaatattttttatttttagtagaggggaggtctcactatgttgcccagtctggtcttgaactctcgagctcaagtgatacgcctgcctaagcctcccaaagtgctggaattacagaggtgagccaccatgcctagcctaacaatgactttttaaagggaattcctaaattctgagatggagtttcactctcgttgctcaggctggagtgcagcagcgcaatctcagctcactgcaacctccgcctcccgggttcaagcgattctcctacctcagcctcccgaatagctgggattacaggtgtctgccaccacacctggctaatttttctatttttagtagagatggggtttcaccctgttggccaggttggtcttgaactcctgatttcaggtgactgacccgcctcagcctcccaaagtgctgggaatacaggcctgagccaccacacccggtctaaattttaattgaaaagtacaagctgacgttgacttgtgaaaattttttcaccaatctctttccacttcagtgcagtaaaaatagatgcaacaaaaagcaaatgaaaagtataattcttctattaccaaaagctaagaaaataaaaaaggtcattctcaactatacctaaaccatataacaaataataaagtgttatgtagtagaaagattacagcctttacagcctaccacatctgagtgagaatcccatctctgctaattactggtagtgtgatcttgaagaagaaacacaaataatctttcttttcctttttcactgtagctctcaaatgttaagaactttttttttgtttttgagaagtttcgctcttgttgcccaggctggagtgcaatgacacaatcttggctcactgcaacctccacctcccggattcaagagattctcctgcctcagcctcccgagcagctgggattacaggtgcccaccaacacacccagctaattttttatatttttagtagagacggggtttcaccatgttggccaggctggtctcgaactcctgacctttaggtgatccacccaccttggcctcccaaagtgctgggattacaggcatgagccactgtgcctggcctatcttaaggacttttaagtatctttctaaacattagtttttctatctataagatatagacaaaaataccttataaggctgggcacagtggctcttgcctgtaatcccagcaatttgggaggacaagacaggaggatagcttgagcccagcagttcaagaccagcctgagcaacaaagtgagatcccatctctacaaaaaaatttaaaaattagacaggcatggtggcgcatgtttgtagtcccagctacacgggaggctaagatgggaggatctcttgagcccaagaggccaaggctgcagcgagccctgatcgtgccactggactccagcctgcgaaacaaagcaagatcctatctaaaaaaaaaaaaaaaataccttataagagtaatgaggatttgagataatgtttagaaagtacttcaagtaaaaagaaaagaaagaattcatgtacctaattttacaccatcctgaaactccattaaagctacattaaagggattttcttaaaaggcataaacgcataagatattgaggagggacaacaccacaaaatactggaagctagagaatatatagataaatggaaacggactcagcagacctgaggaagcaaaatgctaaactggtagaagagaaaacccatccattttataccacggaattcccaaagggctcaggctactccaggcagttccaggactgagagtgaagacagactaaaattaagaggttgacattctatataagtagtagacctccaaatcacctcctgcattctgcacaactagaagaatacccttccctcagcagagagaagactggagatttattgtctggaggtggtaaaatcatgcatctgaattaagggacaaccaggtatatctggagcaccattctgaaagtaggagaattaagtaaacgattatactgcaggctgatatctaccagcccttaaccctcactctttaactttgtttatgggtttctgtataggtcttccctctccaggccagacaataatctttagaactctgatcagcccaagagtttcccaaagacccacttatgcattagaggttctaatatgctttttcatttcctagtcttaaatatgaacaatcggccagacgtggtggctcacacctgtaatcccagcactttgggaggccaaggcaggcagatcacctgaggtcaggagttcgagaccagcctgaccaacatggagaaaccccatctccactaaaaatacaaaacttagctgagggtggtggcacatgcctataatcccagctactcgggaggctaacacaggacaatcacttgaacccgggaggcagaggttgcggtgagccgagatcacaccattgcaccatgggcaacaagagcaaaactctgtctcaaaaattatatttatatatgtatatgaacaattaatattggctgggtgtggtggctcacacctgtagttacagcactctgggaggcaaaggcaggaggatcaccttaggccaggagttcaaaatcagcctgggcaacaaaagtgagaccccatccctacaaaaaacttttaaaaataagccaggtgtggtggcccacactggccacttgggaggctgaggtggaaggatctgttgaccccagaagttcaaagctgcaatgagttatgactgtaccactgagtttgccccgagcaacagagagagcccccatctctaaataaataaataaatagaaatttaaaaataataataaatattaagtatctgagaaaagcttctaactttaaaaatagagacccaaaaaaggcagggaaaaaaagcagcttagagaaaagaagcaatacaaataataaaatctcttcaaaatcagtatgactaatatcaaagaaattatgctataatgaaccaatagacactacaaagaagaaacattcagagagccaaaaaagcactcttagaaattaaagactgaataggaattgaagataaagttaaagacaaatcctaaaaggcagaatgatttcttttttttttttttttttttttttttttttttttttttctgagatgcagtcccgctctgtagcccaggctggagtgcagtggcgcaatctcggctcactgcaagctctgcctcccaggttcacgccattctcctgcctcagcctacaggactgcaggcgcccgccaccatgaccggctaatatttttttgtattttttttagtagagacggggtttcaccgtgttagccaggatggtctcgatctcctgacctcaggtgatccacctgcctcagcctcccaaagtgctgggattacaggcgtgagccagtgtgcctggccattttgctccttcagaatgggtatgtgtgaagtaaattctttttgagactgggtatttctgaaaatatctttgtcctactttgacatctgattgatagtttgatggggtatggaattctaagttggaaataatttcctttcaggactttgaaggtgttgcttcattgtcttctaacttccagtgttgtcaggaagtctgacattctgattcctggtcctttgtgtggcctatttgtttttaatatagaaactcgtaggattagttttttatccctagggttttgaaatttctggatgatatgccttagcctgagtctctttttgactattgtcctaggcattcagtaagccctttgaacctggaaactcatgtctctcagttctaggaaattttcctgaataaatttgttggtaatgttttcttcttgggtgttctgtctaaaacctccttttatttggaattggactttttgaaatgattgtcgtattttcttatcctttcctcttttccttcccctcaatcttgttctactttttagaaaacagctttattgagatgtaatatacataccataagatttacccaaagtgtacaattgagtggtttttagtgtatatacagagttatgcaaccaccaacacaacagaattttagaacctgttcagcactctaaaaataacttgctcattctaagaccaggtacagtggctcacccctgtaaacccagtggtttgagagactgaggtgggaggactgtttcaggccatgagtttcagactagcctgggcaacacagcgaaacactgtctcttaaaaaaaaaaaattctccaggggtagtggaacgtgccttagtcccagctatttgggaggttcaaggagaaggatcacttcaacccaggagttcaagattacagtgagctatgattgtgccatagcactacagcctgggtgaaagagcttaaaaaaaaaaaaaaaaaaaaaacagaggctgggcacggtggctcacgcctgtaatcccagcactttgggaggccgaggcgggtggatcgcgaggtcaggagatcgagaccatcgtggctaacatggtgaaaccccgtctctactaaaaatacaaaaattagccgggcgtggtggcaggctcctgtagtcccagctactcgggaggctgaggcaggagaatggcgtgaacctgggaggtggagcttgcagtgagccaagatatcgcaccactgcactccagcctgggcgacaaagctagactccgtctcaaaaaaggaaaaaaaaaaaaaaaaaaagaaagaaaggataggttttctttttaatttttttttttttaaacaaagacaggagtcgcactatgttgccccagctggcctcgaactcatagcctcaagcaaccctcccgcctcagcctcctgagtagctgggactacaggtgtgagccaccacgcctgggtaatatgatgatatgagatataagaaacagaagatccaacaaaggagagatgaagcaagtctccaaaatgatggtgaaggtcaatcccaggatgagagctttatactaccaggtatacctggtaaccattccagaccaaaatgctcctgaagaaatctcctcaagaagatgaaactcacagactgtctaatgagtcaaaacatctggagagaagatttaggctggcagagagtttgaggttacatgaatggtacatataacaccaagaaagttaaaagcaaaaaacaaaaacacaggataaatattaatccaaaaaaaaaaaaacaagttttacaaggaagtaaaaaataatcatatactgcatggttgagttctcagtagtgcttacataatcataacaactatatattgatctaatctaaattataaccatactaggagaatgagaggataggaaggacatgtatggatgtgtttaggacagggagaaaaaagacagagaactaatttctcatctttcatactgggaactcaataaaaaatacctaaaagcaaaaatcaagaggtatcaaatacaaacatattattacagatgtagcagtaaaacacaaaataaacagctaaaagaattgaaagacactgcttctaagaaagataaaataggaaggagagaaggaaggactgctatttgccttaacaaatcctgaagaactatttcgacttatttaaacaatgtacatatataagataaataaaatgaatcagatgctactgatatccttattttaaaaaaatacaaataagctgggccagtggcatacacctgcagtcccagctacttgggaggctgagtcaggaggattatttgaggccaggagttcaaggctgcactgtgctatgatcatacccatgaacagccactgtactccagcctgggcaacaaagctagaccccttctcttaaaaattggaaaaaacaaaacaaaactacgactgtccatacctagaccagc

SEQ ID NO: 227 - DNA, 6794 bp, Homo sapiens
gacaatttcccttcaaagtggatacaggcaggacatgcaaagatgaatatctctggcactggactctggcaagtaggaaaataaaaacaaaagatgaacatcttgggccgggcgcggtggctcacatctgtaatcccagcactttgcgaggctgaggcagaaagatcacgaggtcaggagttcgagactagcctgaccaacatggtgaaaccccgtctctactaaaaatacaaaagttagccaggcgtggtggcgggcgcctgtaatcccagctactcaggaggctgagacaggagtatagcttgaacctgggaggcagaggttgcagtgagcagagatcgtgccattgcactccagcctgggtgacagagattccatttcaaaaaaaaagaacatctctacaaactggatcaccagtaaataatagctacatatacttgtactcaccatatgtggacacccacatatgtacactcagtcgataaacacccacatttaaacataccatgtgggccaggtgcagtggctcacgcctataatctgagcactttgggaggccaaggtgggaagatcacttgggcctaggagtttgagaccagcctgaccaacatactgagaccttatctctacaaaagagaatttgtttttagttagctgggcgtggtgatgtgcacctgtagtcccaactactcgggaggctaaggcaggaggattgcttgagcctaggaggtcaaggctacagtgagccacgttctcaccactgcactccagcccaggtggcagagcaagatcctgtctcaaaaaataaataaaaaattaataaacaaaaaatgcatacaatgtatagatacacaaagtgtatatatatacatatatatgtatacacattcacatatacacacatgctgtgttcacaatcacctagatgacatatgtatgtgtatacatacttacacatatacccttacatgtacacgatatatctctacccatacactaccatgtacacatgtccatttgtacacagctgtatatgtacacacacaattttgcacacacctgtatatgtatacaatgtatggatccccatatccacattacacacaatgtgtacgcatctacctgtgtacacacacccacctatgaacacaatgtagacacatctgtataaacacacttgagatacatgcctgtgcacataggcaagtatgtgccaagtatttacacacctgaagtagaagcacacacacacccacactatgcctgcacaccaccgcatggccacgttcaccagcgccccgggcctccatctcccagctaacgtgtcccgttttcctcccctgacagccatgctggtcgttcagatgcctttctcctttcccatggcccacttcatcctctttgtctttacggtttccactatatttcacgttcagcagcggctagcgaagattcaagccatgtgggagttaccggtgcagataccagtgctagcctcaacatcaaaggcactgggacccagccagctcagggggatgtggacgatcaatgcaataggccgcctggggaaccagatgggcgagtacgccacactgtacgccctggccaagatgaacgggcggcccgccttcatcccggcccagatgcacagcaccctggcccccatcttcagaatcaccctgccggtgctgcacagcgccacggccagcaggatcccctggcagaactaccacctgaacgactggatggaggaggaataccgccacatcccgggggagtacgtccgcttcaccggctacccctgctcctggaccttctaccaccacctccgccaggagatcctccaggagttcaccctgcacgaccacgtgcgggaggaggcccagaagttcctgcggggcctgcaggtgaacgggagccggccgggcacctttgtaggggtccatgttcgccgaggggactatgtccatgtcatgccaaaagtgtggaagggggtggtggccgaccggcgatacctacagcaggccctggactggttccgagctcgctacagctccctcatcttcgtggtcaccagtaatggcatggcctggtgtcgggagaacattgacacctcccacggtgatgtggtgtttgctggcgatggcattgagggctcacctgccaaagattttgctctactcacacagtgtaaccacaccatcatgaccattgggacgttcgggatctgggccgcatacctcacgggcggagacaccatctacctggccaattacaccctccccgactcccctttcctcaaaatctttaagccagaggcagccttcctgccggagtggacagggattgccgcagacctgtcccccttactcaagcactaatgctggcccattctttgagaccttttctccttctctgcctccctcaagatgagtgcccgggcatgagaagcacatggttccatgagcaggacccatctctcttctgtgaagatgcgttgggctgcaagtaacagaaatctcagtgaacagtggcctggcgtggtggctcatgcctgtaatgctcgcactttgtgaggccagggtgggtggatcacttgaggtcaggagttcaagactagcctggccaacatggtgaaaccccatctcgactaaaaatacaaaaattagccaggcgtggtggtgcacacctgtaatcccagctactcgggaggctgaggcaagagaatcacttgaacccaggaggcggaggttgcagtgagccaagatggtgccgctgcactccagtctgggtgacacagcaagactccatctcaaaaaaaaaaaaaaaaaaaagaaaagaaaaagaaatgaatgggttcaaagaccataatcatgcatatcacataagaccagaagtggcccaggtccagggtcagttaatttagcggctccacaaagtcatcagtcacctgagctccatccatcttcacatgctgtgctaccatttcttagctgtatcatcccatggtcccaaaagggctgctacacatccagccatcacatgcagataattcctttcaaaaacagcagaaagaggctcgttcttgtcttggtcccttttgaagaatgaatgaaaccttcctaagccttccagcaatttccccccaactccgatgggtaggaattgtcacatacccatgtgacccgataggaggcaaaagaaatgagacttctgggattagtttagcctcagattctgcagctgagaagttgatcagccacctctgaaggacatgcagcttgcagaaaattagggtggtgttaccaaggtgaaaaggggaaatggctttagagtagacaacagagatgccctgaggggttgtgtaggttgttcactgcaggaagtcccctggttaagaaggcaagtggggtttaaacagacccacagtctactcatcaaaccaggtgtccttggcattgtgtccacccagagagctcactgttttcttttctttttcttttctttttttttttttttttgagatggagtcttgctgcatcccccaggctggagtgcagtggcatgatcttggctcactgcagcctccgcctcccaggttcaagcgattctcctgcctcagcctcccgagtagctaggattacaggtgcgtgccaccacgcccagctaatttttatatgtttagtggaaatggagtttcaccatgttggtcaggctggtctcaaactcctgacctcatgatccgccttcctcggcctcccaaagtgctgggattacaggtgttagccactgcgcccggccctagagctcactgttttctagttagtccatctggaagtggagcctttttccagtttgcacaaatgtgccatattggcttgtagctggcatgcatccaagtccataggtcctgcctcttcaatcctggctttctagggcctgggatgatcattgctagaactgagagaccagcctggctcagtgaacttcagggcgttccgttcattctttcagtaaatgtttgcagcacatgtgttacatgtcaggcagtgaaaccccccacagcagccttccctctcagaggatacatttgtaaccattacacagtcatcaaaggaataattttttttaatcaccagtgtgcatacagtcatggagttgggtattcccagctaccagggaggctgaggtgggaggattgcttgatgccaggagttagggaatatagtgcaccgtgattggacttgcgaatagccactgcactgcggcctggacgacgtagtgataccctgactcttataaataaataaatgaataaacacaattatgactttgcggatgggagaaaaggttctctgagagcgtattacataagtatcacatgaactccaaaatacatcttaggccaggcatggtggctgtaatcccagcactttgggagggtaaggcgggcggatcacctgaggtcaggagttcgagactagcctgggcaacatagtgaaaccctgtctctactaaacatacaaaacattagccaggggtggtggtgcagacctgtagtcccagctacttggcaggcttaagcaggagaatcgtttgcaccagggaggcagaggttgcagtgagccaggatcacaccattgcactctagcctggacaacagagtgagactccatctcaaaaaaaaaaaaaaaattcttaagagtagatggaatcctattacaagtctggatcaaaaaggcagctttggctgggtgcagtggctcacacctgtaatcccagcactttgggaagctgaggcagatggatcacttgaggttaggagttcaagaccagcctggccaacatagtgaaaccctgtctctactaaaaatacaaaattagctaggcgtggtggtgcatgcctgtaatcccagctgctagggaggctgagacagaagaatcgcttgaacctgggagatggaggttgcagtgagctgagatcacaccattgcactgcagcctgggcaacaagagcgaaacttggtcaaaaaaaagaacaaggcaacttttacaacgattttttagatctcaatattacagtattttctccagactacccacaaatacatactgtgcacctatcatgtatcagaaagcaatctaggagatacgatccctgctctcaagacggcattaacaaatcacttcaaaatataattggtacaggccaggtgcagtggctcacgcctgtaatcccaacactttgggaggccaaggtggcagggtcacttgagagcaagagttcaagaccagcttgggcaacatagggagatcctgtctctacaaaaaataaaaaactaactgggtatagtggaatacaactgtaggaccagctactcggaaggctgaagtgggaggatcaattgagcccaggagtttggggcttcagtgagccacaatcacacctgtgcatagccactgcattccaaagtcgcaacatagcaagacaccatcactaacaaaatttttaaaaatcgaaaagatacaggccaggcgtggtggctcacgcctgtaatcccagcactttgggaggccgaggcaggtggatcacaaagtcaagagatcaagaccatcctggccaacatggtgaaaccctgcctctactaaaaatacaaaaattagctgctgtggtggcacgcacctgtagtcccagctactcgggaggctgaggcaggagaactgcttgaatccgggaggtggaggttgcagtgagccgagattgtgccactgcactccagcctgccagtagcgcgagactccgtctaaaaaaaaaaaagataattgaaaagatacaattagatcctgaggcaagcaggtgctatggctcacatctgtaatcccagcactttgggaggccaaggtgggtggatcacttcagatcaggagtttgagaccagcctggctgacatggtgaaactctgtctgtgctaaaaatacaaaaattagccaggcgtggtggtgcacacctgtaatcccagctactcgggaggctgagtcagtagaatcacttgaacccaggaggtgaagtttgcaatgaactgacatatcgccactgtactccagcctgggcaaaagagcgaaactcaagagagagagagagagaaaagagagaaagaaaagagaaagaaagaaaagaaagaaacaaagaaggaaggaaggaaagaaagaaagaaagacaaagaaagaaaggaaagaaagaaagaaagaaagaaagaaagaaagaaagaaagaaagaaagaaaagaaagaaagaaaggaagaaagaaagaaaaaagaaagaaagaaggggaggggaggggaaggaggccaggtgtggtgactcacgcctgtaatcccagcactgtgggaggccaagaccagtggattacctaaggttgggagttcaagaccagcctgaccaacgtggagaaaccctgtctctactaaaaatacaaaattagccaagtgtagtggcgcatgcctgtaatcccagctactcaggaggctgaggcaggagaatcgcttgaacccaggaggcagaggttgcggtgagccgagatcatgccattgcactccagcctgggcaacaagagtgaactccatcaaaaaaaaaaaaaaaaaaaaaagaagaagaaggaaagaaggaaaaagagaggaaggaggaggagaaatattttttccagtctacacaatgaacatgactatatccttttggggagggagtacgtttataatataaattagtaatttttggtattttgatgttggtggtct

SEQ ID NO: 228 - DNA, 8121 bp, Homo sapiens
ctcagaaggcgttatgaacattgtgattgggctctgactctgaccttaatacatattattgaccaatattaaagagaaaggaggaagaaatcaacatttttttctgcatgtgaggtgtgccagtactttgccatgtaatgttttagtgtttgagataagtattacatccccatttcacagaggaaggaactgagactgagctaggattctcacctagtctgtgactccatgctctttcccccataccaaagtgcctcccaagcagtggttacttagcttaagaggggaaaactgggagggtaccttggccaagtctcagagagggaaagcgtcagggctgcctggaaaatcctgcacaggtgctgttgcaggaatgcagggctcgtgctgaggatcaggctctaggcgggaggaggaaagaggcaggcagagacccagccacactgggccttttgtgccatgtttggacttggccaggaagtgatggagttacggggttttaagcagggaagtgacaggatctgatttgtgtgggtccctccagcagccagcacagaggatgaatagactataagaggtattgcagcattcatgcaactgatgaagctagaatgactccccccagctcctctggctcaggcttggcccctccccaaaccccgtgcacatctccccacccgtagggccatcggcttcccttgtggtatcctcctcttcatcctcaccaagcgggaagtggacaaggaccgtgtgaagcagatgaaggctcggcagaacatgcggttgtccaacacgggcgagtatgagagccagaggttcagggcttcctcccagagtgccccgtcccctgatgttgggtctggggtgcagacctgaggagcgctgcgaccctcctaggctattgactgttaagtcctcaggtttggcccagattccagttcgtgcctctgaggtccaccagagggcgcatgaagcccaggctgttgccaaaccctaccctgccccacaccaaggagccagccaaaggcaaataaagttattgagtgtttagtagaaaggaaccaggtctgggtttgtgagtcccttgggatgggaggggcagagggtggggctggttactcatgtgtgctccctctcacagagctcagtgttcccagctggatggtggggcaaacccagagacttaagtgcaaccagcctaggccccgggccctcgggaccaagccctcagagctgccggccaggagggtggggtcccgctcagccttgaaacaataaagagaatcaaagaaggtattcagggtgtggaggcaaaaaaaagcactgctctttactgagtccaaatgactcgactctgggcctcagtttcctcatttgttttgttttttgttttttgttttttgagacggagtctcgctctgttacccaggctggagtgcagtgttgtgatcgtcagctcactgcaacctccacctcctgggctcaagtgatcctcctacctcagcctcctgagtagctgggaccccaggtgagtgccaccatgcccagttactttttgtgttttttttttttttttggatttttttttacttattttttttttttttttttgagacagagtttcactcttgttgcccaggctggagtacaatggcatgatctcagctcactgcaacctccaccttctgggttcaagtgattctcctgcttcagcctccagagtagctgggattacaggcactcaccgccactcccagttaatttttttttttttttgtacttttagtagagatggggtttcaccatgtttggtctggctggtctcaaactcctgacctcaggtgattcccccccaccgccctcggcctcccaaagtgctggagttacaggtgtgagccaccgcaccaggcccagtttcctcattttgtaagatgggactggagttgacatggactgaacctgcagtccatcccctcctccatctgcaaaactgtaggtatacatacagctctttgaggaagagagttagctctcatgagcttttggaaagggtccatggtgcagaaaaggtcaagcactacagccaagaggtctcttccatatccagtgatccagtgtgatagggttgagctctccctttccccacccaactcctgagccttcactagtctattgcatccgtccccggaaactgctgcagtaaagtgtatttgattaccttggaaaaggtgggacagcccaagccagaatgcagaaggaagaagtggatactttgggcagagccacacatactcctggagccatacagggttttaacttctagacataaactttattacatttatagttgtatccctttgtgtgatatagttaggatttctctattaagtaattaatcctaactatatccttgggctgatttgatttctgcccccacccgacagactgacccttgtcccccttccccattccagctcaaggcacttaatattacaaagaaggcagtggctggctggagagatgggcctcaagtcagaaatcccccagtgcaacttaagacaaacagagagaagtcaccttcctcttaggaccctccctgggttagcagaaggaaagaacccagaagtcttcagtaccacagtaggcttcggtatctccctagccaggtgagggacccccaggcattctccctgcccgcaccgagtctctcttcaccctggctacttcctggccacacgtatgactctgccccttactttctgctctgagctgcctgaatacaggaagcaagagttcactctgaccagagatccagaagcctgcaaggaggccccagcagctttcaagaatggggagcagatggccacatgtggcctgctctgtcttatagcgtcacaagccaggagcaagcccaggggagatgctgttccatgctggcctgtataggttactttgctcgttctgttatctgtcccccatccctaacccagataaacaatacatatgtcactgaaacaagaagggattgaagcaaggagacccatgggcacagatctcttctaccttcctgagctaaaagatgccaagccaaaggaatacaggataatggcctatgtgtccaggaggccggggacaaagctctctggctttgctgggggaagaaatagctccaactacgtagtcaagaagcctgtgacagaggtgggaggggaacctcgtgaccttgaagtcacttctacctttcatattcccttctagctatcgaataggctcttttcatattcctcacaaccccagctgttaggaagaatgtggtgtcatacagtaggtggcggggagaagacacatcttcagcctagtccctgccaagcccaccaagagcaacagttagtccctagctcctccgtccccaccaagtacccacacatccatagccagagaggccacctgtctccaggacagaaaggaaactgggcatgttactcaaggggaaggaaaggggcctaaagcccagaccacagtcatagggcccagccctctagcttggaagggagagcccaggatcgggtgaaaatgggggcttgctccttaattgcgatcccccatcagctgcagcacaaaggtgaagatgtagatgatgtctgtgtaaatctgcagggcgccagtgatgtagtcctcggggctgatggtgtgcttccggttccccaggaccagctgtgtgtcgtaagccaggaactgcaaggatagggaagccagaagtgagaactcaggcatcagtgtccagagctcatttttggtcagcagatttgtcttgggggcctatgcgccacacagtgcttagggccacattaacgcacagcataacatatgggctctatactgtagctgctcacagtctaggaaaggaggcagacacaccgttctcaatatggctgactagtgttctaatagcaggcagcttgaacaagagatggcaagagtgcccacaaaaatcaatggaatctctggacagtagtgagaggaatggcctgctatggccccattccctgcctcccaggcagtctaaattcatgcccccttccctagattcctcccctcatcccctcagctccccttcctagagtggggctgggacttaccagggtgaaacaaatggcccccagagcagcatagagcatgtggagccagtaaacctggagaagaaggggacagagaatggcattagaaacctcagcaaaccacaggcccacaggccccagcttcccccgggatagtggcatgagagtgggtagagctgggaagctagctctccatgaaaggctactgcctttccagatcttggaggaaattaagactggtgatatatccagcagagaaagcagaggccatcctgcaatggctgtataaaaccaatctccaaagccagtcaaggtacacaagtgtctactatacttctagaaaaaaagcagttgagttacagctctgaaaggggcagacccagcattcaatagaccagttcctacagcccagcctgggaggggtagactaaggaagaagggaggccccccaacccctctggtgagtatcaaaatccgggagcacccacaggacagcccacatgacatgcccacaggtggccgtccacagaaggacagagctggcccatgggcaggcagccctcgtgtccccatccttccccttcggcactgttctcccccagctgaacagaataaaggaaataattggatccagagacccccgcaaggtcccttccacctaggcccatcatctcagtcctctgggttcctctcccagtctgcctccgagaacctgattctcagctgccagccagattgaacccaccccttcccctaggagtgcagtgatgcagtccagggcttcaggtgctctggctccaaggccgcccatctccacacagagagtctaccctcacccagaaggatgctgcctccacgttggtgcctttgctagccagtcgagaggttctggaggtcagagcctgccccggggacctttggggcctgcgagaccatgctatataggaagtctgccctgagcactgggttccctgaccccagctctcctgggacactcacgtattggaagtagagcacaatgctagtgacaatcccagtcaccaggagcacaattcccaggacacagaagaggcctgtgcacgaggtgaagtccacctgccaggaagcaagaaagaggcacctgtcagatggctgtgacaaccagcccagtcagactggccctgccagggagtcccagtgctgcctcctagggggtatgggaatgtccacaacattctaaggacagaaacaggacacagttttgtaggtgcggatgaggagaaggggatcaggtctctagggaacatccctagtgtgccggggtccgggcctgataagaaaggggagtcggggggccagggaagggccctccatgccctcaccttggtctgaaagcagaagatggtgactgaaatggataccaccgcagtgatgatcattgcaatgatgacggctttggtttggtacatactggggagaagcaggagttacagacaagaggcattaagccacgtatgaatgacttcaaaatcaccacttccagaggggacctgcccagaatccacccacgcagctggctgccggcccaggaacaccccactccccacaatacacatttcccaagagtggtgctttatccctgaatgtacctggaaatggtgcccgtcatgaagcccatggcaaaagtctaagggaaggagagagacaagaatgaaacacttaaaaaggaaggaaggcagggtgctgggggagtggccatggtggcctctgccagagctggggaacgccaccaagttggaaagaggcagccacagaggagatcagaacaggcggcccagataaggtggaggagacagccaggacatccttctgaaatgggtccccatcccttccctgggagcagtctccctcacagcatctccacaccctcctgccacccttctagacttacaaaaagggtcagcagaatgatgttccatgggaaacggcgtctgaagggaaagagaagccttgattaaatgacttggggcccctcaggcgtcagaggctcctacagcagaaggaagcgcttggctcctgtgcctggaggattaagccttgactccaaggagggaggttggcatggcctttggcacctgttcaggtgtggtacgcagggacaacatgggccaatgagacagacctgtgttgtggcgccagaaacacctggattggtttgcaactcttaaactgactgcctgtgtgatggggagaaagttactcagcctctttgagcctcgggttcttcctatttgttaactggctaaaatgctacctgtcttgcagggttactataagagtgacagctagttagctcctaaacacacatggtcctttgtatacacctgaacagtagctgtcatcgtcatcctcctcctcatttcttgtaagtttccattcagctgctataaaggaatccttctttccaaaatactcggcccccatcccaatccctgtcacccctctcactgtgttaagtctctgggactcacctgggtccctggcagcaggcaaggatcaggtaggtgacaacgaagacagcactagggacaaagagatggggaagcagttcaggcccaaatctgccccgcttggcagcacacaccaggccagtgatttggggcccaaatagccgtttggaagtctgaggggaagcaactcaacaggaagcaagaacgagattacccccagccagggtcactgagatgctctgaagcaccaggctccggccaggaaggaggtctggggaggctgcagctgacgggctgagaggacatgggggctgcagcgcagcgtgcacgccaccaccagcaggtcccactcttgctctcgagttctaggggtctgctactcatctgggcacgcacacccacaccctctggcacgggaaactggcaccaacttgggggccctctcaaaaagcattttgatcctgccctgagcaaagctggtcacctagaaacagaagctgccacccctgcctccctgcccaaccacagaggagcacacactcactaggacacgtagtagacagccacatttctcctcacaaaggcgctgacaggttccctgtggggcacaggaggacaggagtagtcaccctgaggcttgtctgccccacccaggccagccaggcagccctggcttcaccttctctaattgcccatggtcaccctgagagcagggcccaccgccacccacacccccagcaggtgaccctgaacccccagggcagtaggagtgggtggcaaagcctagagacttacacaaaggtgaagatagcaatgatggccacagtgatgagcagctgcacggagatgatggagtaaacctggacacagacggccgggcatgggtcaccatccggcacccctggcctgccccaggaagctgccagcccccagtactttcctcccactcaagaaccctccctagctgcagcctggcccagaggcgaccccagtgagatgcctggctcagaggcaatgtgcacttcttcctcagccccgctcccatgctccctgccatctcccctcctgtccaacaccagcctcggtgactactgacttgccctgcctggccaccatactctaccagtatggcctctgcactcccagcagctcagtctgcacgctctatgcagctgtgagatggagagggtgggttacaagcgagtaggatcatttctggctccaagctgcctatagtctaaagggagaaagatgtctggggaaggcgggcgctgtggcagaacccacctaggagattctcccagactgaatgtgtcctcccaaaacatggtcaagaagagaggtgcaaaaagagagggaaccctggggttagagaagccaggtgcccctctgagaagcagacaaggctagagaagacaggcagccagtgtatttcatggaattgatgccctggggctactgtggcctacccacttcccattcccacagcctgaggggccccaggtacacccacc

SEQ ID NO: 229 - DNA, 8399 bp, Homo sapiens
caatctctcatttgaccctgtctttttaatctgcctgttttaaaagttgcgtctgtagtagccgcttgctgtgaagacacatcttgacagtccaagtgattttgtgaccagtgatttgggtcctgttttccgctcttctaagaaaaaacaaaaagaccgtgagttattgcccagcaataatcatgttgttactgtgagttagcaacatgcctgacttcctgatagcattactgttttctagttttgtttattgtatattatgtgtggttttatttggtatttatttgtgttttgaggtcttgcaatgtttttgtgtttctgatgctaataactaaagtttgtaagactgtagaatgcaaaactcggagatgctaaactgtcttattagaggaaaataaatctgattatggagtctcagtctctgatcacaccgtctcttgcaggctgggccccaggtgagtggcttccctcctgccggactccccgggctgtcctctcagtggctgggcccagtatggccgcctggccaagacctgtgtggccagaggcccgtgcttggtttgctgccctctgtcaccgtcttgaaatactttgcaattctcagcgaggggcctgccgtcgccttttccactttgcttacagttttgcctgcggcctttaacctgaagggaatcccaggggccaggctcgcaaatctgtgtcttggtccagagcagataaggcggagctctgacctcctgcccggacacgtgcccgccatctggcatggtggaaagggcgtgctggacccacaggcctggggtcagtctcagctccacgacttcgtgggactttggaatcttcgagcctcagtttcctcctctgtccgttggaaggacagcacctccttccacgccgaaacaaggtggttaatgaggagtgacaccagtgctgatgtgcaggcggctgcagggtctgggcagtgtccttctggcagctgctcgtggcagttaagggctcctgggctgtcaccgccaccatggcctgccttccatttctccaggaagttgtttgggtcaggcctggtagcaggaagccctgcatctcccccaaaattatcagatggggagaaccgctcagccctcccccactgtcctgccactcccagggtcccctgcagccaccacagcgccctgctcagtccctccccatccttcaaggcactgcatggggccacatccagaacagatgccatcggtccccacgtgtggcccactgagcagggaggagtggacctaggagcagcaccccagggtcctccctcagggtctcagggcctctcctgagggtcccttgccagcgcagcaccagccccgccctctctgcgggcccacaccacccctgccgtgccctggctggtggcagtagtggggcgctggaatcctgggactggcagcctccaccccacacacgatggggagcctgtggtaccttggctcccgggagctgccccaggacacagccttgctggtccttccgtctgggggatcccaaatcctcacacccctgtggtgggggcctgcgctccatccatctccctgggcgctcaagcccagggtcctgccgcagccttgaggacaccgggacacctatggagaccaggcagtgtgcagttgtcaccgctgaccgcaagtgtgagctgggccgggggtgggatggcgaggacagccagcgcgatgtgccgatgaatggggaatgtcagctggaggcttgagggattgcagaaactggattccttttttttttttggagacggagtttcacttgtcacccaggctggagtgcagtggcgcaatcttggctcaccacaacctctgcctcctgggttcaagcaactctcctgcctcagcctcccaagtagctgggattacaggcatgcgccaccacgcctggccaattttttgtacttttagtagagacggggtttctacctgttggtcaaactcccgaacacaggtgatccgcgtgccttggcctcccttttttttttttttttgagctggggtctctctctgtcacccaggttggagtgcagtggtgtgatctcagctcactgcagcctcaacctctcaggctcaagtgatcctcccacctcagtctcctgagttgctgggaccacaggcgcatgccaccatgccaggctaatttttgtatttttaatagagacggtttcgccatgttgcccggggtggtccggaactcctgagctcaagtgatccccccgcctcggtctcccaaagtgctgggattacaggcgtgagccacccccggcctggattcttgcaccctcctgggagtcctacaggagaggagatgggcggcaaaccccaagacctgctggactggcctgggctgagggtgctggtggggacatctgcagagctggcctcagatcatgcagcaagaaacggcgggggggaggaaggggagcttctgagctgctccccccagggcattgggcagggactccctgcccccagcctgacgtccagacctcaagggggttggagggactgagtccagccctcaggtgcacaccgggccatcacctggctccgtcctgctgtggggcagcccagatcttgcagggaattgggaaccaggggtgtcacagtctaggcctagggaaggaggaggccgtggccctcgcctgcctcccctcagctcagggggctgctctgttctggcccagatgagtgatgccggaaggggagcggtgcagagcagggaggcacacgctcagagccctccgtggccctgactctgcactgcagcagcccccacgcccaagagtcaacccagcatccaaaccagggaagagtctggactgaaagcgcaaccgtacttggtgagaggccggtaatctcgagttctggtaaggaaagcaaggcctggggcggaggctggggctcggctgctgggctggatcaggcggcacacccggctcacactgccctgcagtcctgtgggagacagcggcactcggacccgctcacaagccctgcaggacaccagtggaaccacatgggtggaagcctagaaatcagattctgaattgaagtccagggggttttctgttttctgaaaatgagtagttgcataatctaaccctaaaatcaaccatttcttgttaaaagaccagaagaaccaaagtgctgtgcaggggaggtgtccgcgccgcctatgctttttgtcttagttttttaattttcaaggtcatccttaaagcctctgccttgaccctgcagccacaggtgacttggaggctggaggccaggcctggggtctgtgtccttcaaataaatgcctcagtgccgcttgggggactcggtcctgtgccggagttactcgattagaagttaaaggtggaggggaaagacacctgtggggccatcccaacccacttcctccactcagaccacagctttgaatgggctcagtccccagggacccccaggccccagggtcagcctcgcagggcagagctcagaaccccctgcccagaccccagggagccaaaggggcccagatctgggcacagggcaggaagagggctggcacctgctgggaggggtctaggagccaggggcacagctcacatgagtgcatacccagcacctctgcttcatgtcaaagggagatgatgctggcgtccacccgagaggccacatggaaagcactcgacatggacaggacatcgcccacaggaaaaacccctgcaagggaccttggaccttggggaaggcggctgtgccctcccgggctgggccttgcaccctggcctgcagccattcggctcggaggactcccggcacccacaggcacttggctcccgccacttccctggcccctgtggcacttggggctccacagctctccgactccctgctgagggttgagccgtttgcaagcatgtgtccccatgtgtgcttgagggccgggggcacctgtgcatatggtcaagggccttctgtgcacacatggcacctgcagtgtggtcccagccgttcctcagcacccgtgggcccagctccatctcgggcggcctgcttggcgcagctctcgctggtcacctcgtgccgggtgactgctctccatcagctgtgcccgggctccacatacatagcccgggtcacatccactcacgtcctggtccagccagccttgcggggactctgcccaaggagggacagtaagggtttttgagtaccaagtcagtgaccctgactgccagcagcggctcctcttgacccggaggccggtgaacacctgacaacatttccctccatacagcgcaggggcaggggcagattaaccctccgtgcggaaggaggagtggaggtggaggcgggacagtggctggcccctggtccaagtcttgcagagccctccccatctggggtggggttgaagcaagtcactcaggggcagcttcctagctggtgctcccgagaccctcagctccccaacaccctgatgtcctcctccttcctcccattgtccatggatggagaagggaccaacggttcctccggggctgagctctcgtctcctggtgctcctgcttccctaccccccaacccccaggccagggctgcagcctgaaggggcactgggtccctgcgccctgtgagatgggcgctgccacccttgctctgcaggtgacgaatggaggcgaagtgaattgcagtgtcatatggcatttgagtcctagacagcgcccaggactggtccgaccaccgctagatgccaccaggggggctctgcctgtcccccaccccagcagacagcaggcccagccccatccaagctaggtggagacccctggtccataccctcctgggcttccctctgagttgtatccaacccacccagcaacagctgctctcagcaagcctcctggcctcacctgcactctcttccctcctctcctgcctcttgccttcctttttttgtgagacagatcttgctctctcgcccaggctggagtgctgtggcgcaagctcagctccctgcaacctctgcctcctgggttccaacaaatctcctgcctcagcctcccaagtagctgggattacaggcacccatcaccacgcccagctaatttttatatttttagtagagatggggtttcaccatgttggccacgctgatctcgaactcctgacctcaggtgatctgcctgccttggcctcccaaagtgctgggattacaggtgtgagccactgtgcccagccaccttcctttaaaaacaaaaacaaaaaaccccaaaaacctgaggtcttgctctgaggcccaggctggggtaatcgcagttcactgcagcttcaacctcctgggctcaagcaattcttcctcagcctctgcggcgccgggaccacaggcatgagccactgcaccgggtgttcttggctccctcgaagcatccctcatgttcccgtctcaaggccttggcgggctctttccctgtcttgctgatgtcccaggcccaccccaccttttccctggccctgccatgtgcaggaggcagggctgtcactcttgctgcctccacacctcaggggaggctgtgagccagcgtggccagtcagagcacagcaacctcaggctacaggaactggtgcagagttggagacaggaaccaatcagagacctcactgagaccctcctgccatggcctggtcaaggaggtggtgagtctcactctcccaagacaccttccctgccacgtggagaaggccgtgcacacggaaaccaacacaggagggccgccagccatagcggagacagacacagggaccaagagactgagacagcctctagatgctgaagcctgcgctgaagcagttgggccgtgagaggttcttcttactggaggaaactccggggctttgcatttctccacgtccctgctgaggttctgagccatttgcaagtttgtgccctcatgtgtgcctgagggccgggggcacctgtgcatatgctcaagggctttctgtgcacacatggcacctgcagtgcggtcgcagccattcctcagctcacatctttgcatgtgagtggttctggtaccgcttgtctgcccagcgccctggtgcctatctgctgcctcatgtgagctcgctgggccaccctctgactgctggacccacctccagaggccactcagggcaagagagatggatcccaataccccacccagccagccccagccccctatggtctgccaccttcaattcaacctcctcactgtggctgcagctgtgatctcatccttcctgtctcattttaatgccacctttttcaggaagcctcccctgaccaggaagccaagtggcctcactaccctctccacacagcacaatctaggaatggcctgcccaggtggagcagcagtagtcaaagaggctccattgctgccccaagtcctggccgtccagcactctggactcccctgaggccccaccatcaggagagggagccccagcctctgggccctttcagtcctggctgtggccctgagcaccaggggtgaagtttgctgagcctcacctggccctctgcatttatggtggcggtggggatggggggcagagccagacactcaggggtgaagcccaacgcagccctgtcagtcaaactgcctccttcccactgagaagcaagacaaggggcaaaacagttgtgacccccaagtatcctgtttgttcctggttgaggacatgtgagtccagcaaggggcagccaaactccaggaccgtgaggacccaccctccccgtcctaggctgggccagcaccacagagccactgagcgcagggacctctgctcaaggcgatccctccaaggtaaggggcaatgctggtggcatcagagatgtcgaggcaaggcgcccacccgggacacaaaaagaggcagagctccccccagtggcggctccttcctccccggatgcagcatatcactcatgaaagaagcaaataccaggccaagcaaaggggtgctcatggcagagtctgcagatgaggggtgggggtgcaggaaacagcaggatggcctggagggtggaaggccctggaagtctccaagactgagtagtttccctttcaccttcagtcctctgcctacatacccacctccaccatccttcctgcacccttccctagtcactcatccaccatcctgccattggaacccagtgtaaccatccaccattctcccccttccatcagctacaaccagtgtctccccaatccacaaggcacaccatccatctctccaccagtaatcccctaatgaccaattcaccaccctcccagaaactcatctccccatcatcaaatcatccaaacatcatgcacaatccatttgctgttcatctttctacctctctgcttcccaacacccacaaatccatcctccattcactcaccacccagccattccaacgtgcatgatgcagatccaagcatgcactgcagacccattcccccaacccccatcaatcatccatccatcacctagcgcacattcattcacaatttatccaccatgctctgtccacccacccattgatttatatccagtaactcctgtactcttatccatctacctactgtctctctacttactactatccattcacacatcatctaaaattcattcaccattattcatccaccatcaatccatccctccaccatttggtcttgtccaccatccatctacatccaaaatccacaactttttctcacccaccgtgcattgcaacaactatccatacatacacatctgttcaacagctacgatttctctttcacccatcaaccatccactatgcaaccatgattcattttgccaccgtccgccctttccctcgttctcctttattcaactaccatctaccatccatcaaccatccttccataatcactcttctatccatccatccaccaataacattcaccatctgtgagctgccatccatacacttacccattcaccatccacaatcaactatctactctttttttttttttttttttttttttttttaatagagtctcactctgtcgcccaggctggagtggagtggcacaatctcggctcactgcaacctctgcctcccaggttgaagcaattcggccccagcctcccaagtagttgggattacaaatgtgcaccatcacatttggctcatttttgtatttttagtagagacaaggtttcaccatgttgtccatgctggtcttgaactcctgacctcaagtgatactccatcctcagcctcccaaaatgctggggttacaggcgtgagccaccgcgcccagccaactatctgctttcatctaccatccgtca

SEQ ID NO: 230 - DNA, 8552 bp, Homo sapiens
atttgacatagtggctcatttactagtcttacttgagaacacctccttttgacattgcttctgtgatagaattagagctgctttctgtttttatatattggattgtccctttttcatcagcatcactcataagttaatctgaattttttttttttttttttttgagatggagtctcattctgtcaccgaggctggagtgcagtggcacgatctcgggtcactgaaacctctgcctcccaggttcaagcaattctcctgcctcagcctcccaagtagctgggactacaggcatgtgccaccatgcccaactaatttttgtattttagtagagacggggtttcaccatgttggccagggctggtcttgaactcctgacctcaagtgatttagccgcctcagcctcccaaagtgctgggattacaggcgtgagccactgtgactggcctaataaaattaagatttctcttcattaaaagacactataaataaagtcaagccatagtgctggctttggcagcacatatactaaaattggaatgatacagagaagattagcatggcccctgcacaaggatgacatgcaaattcatgaagcagttccgtatttttaaaacacatgcacacatatgtttattgcagcactatttacaatagcaaagacttggaaccaacccaaatgcccatcagtgatagactggataaagaaaatgtggcacatatacaccgtggaatactatgcagccataaaaaagaatgagttcatgacctttgcagggacatggatgaagctggaaaccatcattctcagcaaactaacagaggaatagaaaaccaaacaccacatgttctcactcgtaagtgggagttgaacagtgagaacacatggacacagggaggggaacatcacacactggggcctgtcggagggtggggatagcattaggagaaatacctaatgtagatgacgggttgatgggtgcagcaaaccacaacggcacgtgtatacccatataacaagtctgcatgtactgcacatgtatcctagaacttaaagtataataatttaaaaaaaagtcaagctataaatagggaaaagacatctgtaatacataaaactaacaaaggattagctgttaacatattaaatagatggggaatctccccaaatcaatattacgagacaggaacccaattaaaaaaatgacaccaccaggcgcagtggttcatgcctgtaatcccagcactttgggaggctgatgtggaaggatcatttgaggccaggagtttgagagcagactggggaacatagcgagacccccagctcctgaaaaaataaaaaaattagctgggcatggtggcatgtgcctataatcctagctactctggaggctgaggtgggaggattgcttgagcccagggggtcgaggctgcagtgagccatgatggcaccactatactccagcctgggcaacagaacgagactccatctcttgaaaacacacacacacacacacacacacacacacacacacacacacaaaacaatgacaagaaggcacaatttggcatttcacggaagagaaaacaagtggcctctcagcatatgaaaagatgccaaacctttctaatcaggataaggggcataaagaccatagtccttggttggtagaaattaagatgactgataactgtaagtgttggtgagagtgtggtttcatagaaattcttgtgctgctagtggaagtatttgttgttacctctgctttggagagcagtttggcactcatttacaaaactggcctttcgtacaacctacacaccagcgactcctctctgctctttagatgtagagtccagagcaaggactggtaaactctttctgttacgggcaagagagtaaatatcctaggctttgtggactacatacacacttagtctttgtttttataacacttaaaaaatctaaaaagcattcttagttcaaagaccttacaaaaataggctgctggctggatttgatttgcaggctgtagtttgccaattcctggttctctgatctaggggacgcatcctggagaaacttagttacatgcagtcttagtggcaggagggccaggggaaaagcacagagcggtatgggggagttgagagagactgggagggtggcctcctggagaaggtcgggggctggactgcatgtgtctgggtaggctcagccatggcctggctgggtgggcctaggggaacgtagagcttctgaggcacaataggccagtgtggagagcagagtggcaggcagggctgggggctgcaggtcgaggctggtcaacccttttacctggcgggcaaggctagtaccaggtgcccttgctacttagcttggaaagattagtgagcatcataatggaccggcaagtttgtaagcaaatgacatctataatacatatactttaacattaatgttttgaaaactttgttttcacaaataagtaatttcccacattttgccacagttatgttctatgaagctaacccaagtgtggctagaacgccagttcatccatctctcaaattgtctgctgccggcgttcattcctgtttgcttctagctgtaaagtcaggctaggagtctgtcagctcatgtgcctgtcagcttcatgcaggcagcaagaacggggctcggaagcaagggctccgcccgcccacccagcaactacctccccaggatgcccaggagctcaggggtggaaggaatttggctcttatttttctaagtagcaaaaatagatgaattgggtacaggaacgcagtgtatttttgagggagctggtgagttgtgaaagaaacttcctctgttcacctgaggcttaccgtatcgtgagaaaggatggaggaggcatggaggtgggaaactctacacaagaaaaatcctatagtgcagcagctactgatgtgaggcggctggtctaggcagcggtgttccctgaggctcctgagtctggttctcactgggtccctcacctcccttcacagccactcccttccttaccaaggtacatgggagtacagggctggccaggggctgttgacagtgggggagtggtgcaggctgagccttagagacaggaagggcatctgtgctggagctgccctgcagaagcctcgtaaaggtcgtaaggcactgggcaaaaacttttccaagaaagttcatggtgcacacgctgacctaaacactggccgacattcccaaggtttttttcattatggaagtgcatggccattgcatggtatccagaaaacaaagaccagagaagccagactttataccaccatctggaaacatttaatttgtgctttaggtaagtgttagcaaatatttaggatgattgatcaaatcattagtgtgtttatgagtgcatggtgtaatttttactaaagctcacatttcttcaggaactcgattcaactcctttacattcctggttattttcatttacttgatcttgaggtctcatctggcagagctgtgcaagctgggacctttgtggcttattttgaggagctgtttactttacctgttgatgggaacttgcaggtgggaggcagccagtcttaaagagtaccttgttagcaagtgtggaagagagtccgcgcagacagacttgccctatgtggtgtcccctctgccagcccagcccttgggcacattggcacctacctgaacccgagccccctcatgcacacagggagccgcacctccctcacacgctcctcaccagtgtgacatggtgtgacgtgctctgtgggtccacaacgggcccactccacagctctgtgcacagcatgctgggtcagggtggtgctagattaataagatgagggtgaatgtcaaaactgagcactttgagtactgtgggcacactgtcacagggtttacccaggaaggaacaacccctgggctccagaagcaggttgaccaggccagtctgagttgtagcattgagactcatctagcggaagtcaatgaggaaggaaaactggctgagaacagctgttgtttcagttaaaatctcagaatgatgcattgaattcaaagttacaacacagcaaaatagtatatgtatttttttaaacctcaaaaatactgtattattaactttaaaacatttttggctggtgtggtggctcacacctgtaatcccagcactttgggaggctgaggcaggcagatcacgaggtcaggagattgagatcatcccggctaatgtggtaaaaccccgtctctactaaaaatacaaaaaattagccaggtgtggtggtggccgcctgtagtctcagctactcgggaggctgaggcaggagaatggcatgaacctgggaggcggagcttgcagtgagccaagatggcgccactgcactccagcctgggcaacagagcgagactccgtctaaaaaaaaaaaaaaaaaatttttggagacagggcctcgctctgttgctcagcctagagtgcagtggtgccatcatagcttggtgcaaccttcaactcctgggctcagcaatctttccacctcatcccaatttattaagtatactttttaggaagttttttgaataataatatcaatagttactatgtgtttgggtaaaatagaaaggatggaagcatatttgatcatgttttgttcccaacacatattaaagttgggaaggattcttgtgttgcctaaaactgaaagacagcaggtctcaggcacttttgctttcccaaagctgtgtttgtttccttgcatgagaggatatgatggcactctactgttttttcccgacagaactcctctttcctaaaatggagtcgagtaaaaagatggactctcctggcgcgctgcagactaacccgccgctaaagctgcacactgaccgcagtgctgggacgccagtttttgtccctgaacaaggaggttacaaggaaaagtttgtgaagaccgtggaggacaagtacaagtgtgagaagtgccacctggtgctgtgcagcccgaagcagaccgagtgtgggcaccgcttctgcgagagctgcatggcggccctgctgaggtaggcgccctcgcccggcccgtcgcccggccccttctcagccctcggcctcaccctctccttcattcgtttctctaaaaataaacctctagaggtttaaagccctaaagaagtccataaaagcctccgggcccagcttgtgaatcctttagggaggtgcagtgggatcccacgtgtgggtttactgaggcctctgcgtgtctctgacctgccccgcccgtgtcttcccactccgtctgtagagccttggtgcccctcatatgtgttgctgtattttattgaggaacctcacagttccatggaggagatacaccaggaaatgacaagccagtcatttaagggcacgtgtgctggtgtgcaaggatgccgcagagaggagggaggatggggtcagcttaaaggactggacaggtccctacccgagcagaaacctaggccgcatgcttactcagcaggcgtgtgtggaacatgcaccgagcccatggcagccctttgctgctgagtgccagtgctggtaccgctggtggatcatgaaggcaggctggagctttactgcagaatagcatcggccagaagagcaccttgattcaccctgcaggcctcatgttttctggcattgtgctgggtgctggggtcgctgcgggatgccctggtcttggccactgccgtcagggcatgtcggcctgggaaggttgccagctcctcctcccacagcactcaagcctgggctgcacccgagccccagcctgggcacagcagccagccccctgccctgtcacctgccttcaccctcccccttctccatgcttccctctgtggtcttacccactcatcccaaatagtcagctaacctttgcccacttgggggcaaaatgacacttgagcttagtgacagcacaggagacacagaacaccgtgtctcctaacacaagagcctggactacacctctgggcccaggagaagcttcccggtggaggaggggctggagcccccatatatggtgggccacaggggagggaggctggtccccctgtgcaggtgccattggccttccaatagacagtgaagccaaatggcctgtggagaagggctggctgcttttacaacgcaggagcaaggctctccaagtaaacaggtactcacactgaagagctgctctgcagacagctagctttggtttctgaaataaaatttcacttttacattaagtggaaggggctttccaagtgggactgaactaaactgttctacttggtaacttccttttgaaaaatcagcattttaaaaaatgtagcccttttctcccatggcttcctatgtaaagtgaatcaccagggcgtcctgaagctctgctggttgctgtgagccactgtgcagacctgaccataaagtgaatgctcccagaatctcctgagtcctctcaagaaagggacttccactctaatgcagtcacttgtgtttccctgcagctcttcaagtccaaaatgtacagcgtgtcaagagagcatcgttaaagataaggtattctggggttttttttaatcattttgtcacatgttttcagctgggtaatacttttcacatagtttgcattcggcactctggcacaacacattctctcagttttggcagctgatgcggcaggctcccaggcaggacactgtgccatgtgatcacctgggcagacagtggattcagatccacttggccacttccctactgtgtgaactctgtgagctacttcaccccctcacctgtaataatcatatcacctgctaagaccgcagggagctggtgtgaggagtaaggggttgatgtgagcaaagtgctgagatgcctgtctgtggcagggctgtctgtggttgggtcacttccgtcattgcaggtctttatcccagacagcttctactcaactcttacactaggttttaccttcagactcgctaggctgaggggttcatttgagtttgtgctccctgccccccaggccccctgtgatatctttaagtcattagacatgagtgagattagccccttctcgccccctgtggctgtcctcagctagagcccgtgggcgtctctgcacattcagaggatggggctgcccagcctgccaccagcttctctcctggggcctggtccttctcatggagactgacagtcatccatgtgctgctgtaccctgccaggtatacttggagtttgaaacaattcttttcttttctttctctctcctttctttcttctttttcttttttttttgcgacagagttcactcttgttgcacaggctggagcacaatggcacgatcttggctcgctgcagcctccacctcccaggttcaagcaattctcatgccgcagcctcccgagtagctgggattacaggcacgagccaccacgcccagctaatttttgtatttttagtagagacggggtttcaccgtgttggttaggccagtctcgaactcctgacctcaggtgatccacctgcctcggcctcccaaagtgctgggattacaggcatgagccaccgcacccagcaattcattcttaaagtgcttaaaatatcaataaaaatgtgtgtttccctactttgagtaatatacctaaccattttttaaatgcaggtcactaagttgtacaataaaattcttactctggggttttcctgtctaaagcaccttgcagattgggtttgttggtcagagcagcccaggtgagtgcagtgatttgaggattgctggtagtcagtgtccctgggctgccaggcacacaggcatccagtatagccgctctggaagggggagagatggaattggccacctggccctgtaccttttctttctctgcatttacctgctgctgctgcaggcttggttagttccttgagtgaaaacagcccctcccctccactctgtgccttggcctagcatggtactcggccgccttgttaacatgtgcctaacgtgtgagtgagagagaagctcgcgacgatggctgagatgtttttttagtatctctgttttgttatgcagaatcattatccctattttttaatgacataagtagctgaagaaaaatggctagttttatcaaagaatcatgaacgagatgcactcaagttgtggaccctcatggagagaatggagctgtctgggccccgggtgacccggatcctcacccgtcagcaggtcatccaggggtgggcgggcctctggtcttcatctgtaaacagagacattttgagtaaatagtctcagatcctttccattccaaagttctgttgactttagtatctcaagtcatgaccttcttttttttttagtcatgtttatgaaagataagctttggctccaaattagtttatttttaactcttaacagctgttgattttatttctctcagcagtccaaaaaggcacattaagctcctgttattccactttcatagagcaaca

SEQ ID NO: 231 - DNA, 9064 bp, Homo sapiens
aaaaagaaatacctgctcagtaaaaatttcctgtgtgaagattgtcttcatcctgctcaaggagcttggcttaattacaatctaaaattaccaaaagaattccaacagcatgtaaaaatatatgaaacacaatttattctagggaacttatctaaaatggctatgatacacataaatgttcaaatgttcaagtactctactctgttttagaagtgctttcccaaacccaacattaaagtgttaatactcaaaaacagaaccaatataaaaagcacttaataaatactattattggcattttcagtcggttgggggaaacagattatttactacatggagctaggatagctgcccctctgtgaggccaagagaaatatgtgtgtgtgtgtatgtgtgtgtctgtgtctgtatatacgcacatatacacacacaaatatatgtatatatgtatatgtacagatagacacacatacactttttgcacatatcacaccatacaccaaaagaaactccaagtagattaaaatgttcaaatgtaaaacatgaaaccaccaaaaaaaactagaagaaaatataagtgaccacttatataaacccaagaaaggaaaacatttctaagcataagagcaaaatagaaaacacaaaaagaacatttacagccaggtgcagtggttcacgcctgtaatcccagcactttgggaggccgaggagggcagatcacaaggtcaggagatcgacaccatcctggctaacacagtgaaaccccatctctactaaaaatacaaaaattagccgggcgtggcggtatgtgcctgtagtcccagctgctggggaggctgaggcaggagaatggcatgaacctgggagacggagcttgcagtgagccgagatcgcaccactgcactctagcctgggcgacagagcaagactccatctcaaaaaaaaaaaacaaaaaaaaaacatttaatatactacataaaaataataatgataataatttccacatggcgaagttaaatggcaaaaaatactggaaaaagtcaattataacatattgaactctccacttttaaagatactataagatatgtcactgatttaatattacagtagcttttcaagaaaaaagtaggagttggaacactaccactttcatattacatgtcaactgtaaaatgaatcccaatttcaatactgggtaaaatatacgtcttgaaatatatgaagtaagatgtataaggcataatgacatatctttccttttgaatcagtgaaagaaaaaaataaatcaaagtccctacaggaaaattaggatactgatcagcttttcacaaaagaaataaacaagccaaaacacataaattttaaatactaagtttcactagtaatcaaagaaattcaaactaagtgataccactgttcatcaaccaaatttgcaaagattaaaaaaaaatagtaatgctcagtcatgttgaaagtttagaaaaacagtagttcttactaacggtaagagttaaactgatacaatctttcgaaaagataatctgacagtactcatgaaacaccttaacatagtcatacacttttccttagcaattaccttctagaaatttatcctaagaaaataatccaacaggtgtatgaagagatacatgtgggtgcctatgtgtgtatttacataaacaaggacattcctctaagcattatacagaaactagaaaatctacatgggaaataataagggacctattaagaagatcaaacaatggactataagacaatgcagtcattaaaaattatactgtattataatatttattgatatgagtaaatgctcatcatatattaatttttttaaatcatcaaatatgtacgtcactttaaagaaagaacagacatcagaatattaatagtagtatactaggtatctctgaatcatggaattataagatatctttcccttttctgtgctttccaaggtttttgcatgagtatctattattttagtaaatacaggtttcaaaatgcatttttctaagcgctcttgataaaacttctattaaacaattaaaattacttaaatgaaaacaatctatttacactacaacaaaatgtccagcttagaaacacctttttttttttagaaagaagttaaaagaaaattaccttcatccccaaagtggaacagaccaagtcaatgatagcactaagctggttgctgtgaaagtacatagccaccaataataacatctccccaaaagaagcagagacgcctgaagtactgtcaaaacaaaataggaaatatgaattttccaaagagagaagaagaaaagctttctcaactaactaaatcaaattatcttacctctcaaaatacgcttcttcttttatcatccaacttagccacaccaccatcagctgctcctgttcaggtgtactatataaaatataccagaatgtcactggtttaaattagatatactagcatatgaataaaaagcattctgaagttatttttggtagaaattatttttcctgccctattttcaagtatcaagtcaaattaaaggcttgctgaattgggccattaattgtcattgaggtatgaagtaattctagagctcaagaatgaggacctttgctttttttcatggatcccctctcaaagtcttagttactgccttcacaggttggaaagagtaagattcttcacattccttagaaaacaaaggccccttgggattaacttgttaaaacaactacacaacagctgatatttatttcatatagaaaaaaatctagtgttaacacttaagcatcaaaatatcacaaactgagtgccaaacagtaatgagcagtccatcttctggaaaaatgaaatttaatttatagaaaccttatgagtagatctcaaagttacagagaaataaatgatcactaatcatgggaaaaaaggcagtcacaggcttaccagatatgaaaaatggctataaaaatacgacttttctttgagacaatgtcttgctctgtcgcccaggctggagtgcagtggcgcaatcatagctcactatagcctcgaccacccaagctcaagtgatcctcccacctcagcctcccaagtagttgggactacaggcatgcgctactgcatccagctaatattttttatttttagtagaggggaggtctcactatgttgcccagtctggtcttgaactctcgagctcaagtgatacgcctgcctaagcctcccaaagtgctggaattacagaggtgagccaccatgcctagcctaacaatgactttttaaagggaattcctaaattctgagatggagtttcactctcgttgctcaggctggagtgcagcagcgcaatctcagctcactgcaacctccgcctcccgggttcaagcgattctcctacctcagcctcccgaatagctgggattacaggtgtctgccaccacacctggctaatttttctatttttagtagagatggggtttcaccctgttggccaggttggtcttgaactcctgatttcaggtgactgacccgcctcagcctcccaaagtgctgggaatacaggcctgagccaccacacccggtctaaattttaattgaaaagtacaagctgacgttgacttgtgaaaattttttcaccaatctctttccacttcagtgcagtaaaaatagatgcaacaaaaagcaaatgaaaagtataattcttctattaccaaaagctaagaaaataaaaaaggtcattctcaactatacctaaaccatataacaaataataaagtgttatgtagtagaaagattacagcctttacagcctaccacatctgagtgagaatcccatctctgctaattactggtagtgtgatcttgaagaagaaacacaaataatctttcttttcctttttcactgtagctctcaaatgttaagaactttttttttgtttttgagaagtttcgctcttgttgcccaggctggagtgcaatgacacaatcttggctcactgcaacctccacctcccggattcaagagattctcctgcctcagcctcccgagcagctgggattacaggtgcccaccaacacacccagctaattttttatatttttagtagagacggggtttcaccatgttggccaggctggtctcgaactcctgacctttaggtgatccacccaccttggcctcccaaagtgctgggattacaggcatgagccactgtgcctggcctatcttaaggacttttaagtatctttctaaacattagtttttctatctataagatatagacaaaaataccttataaggctgggcacagtggctcttgcctgtaatcccagcaatttgggaggacaagacaggaggatagcttgagcccagcagttcaagaccagcctgagcaacaaagtgagatcccatctctacaaaaaaatttaaaaattagacaggcatggtggcgcatgtttgtagtcccagctacacgggaggctaagatgggaggatctcttgagcccaagaggccaaggctgcagcgagccctgatcgtgccactggactccagcctgcgaaacaaagcaagatcctatctaaaaaaaaaaaaaaaataccttataagagtaatgaggatttgagataatgtttagaaagtacttcaagtaaaaagaaaagaaagaattcatgtacctaattttacaccatcctgaaactccattaaagctacattaaagggattttcttaaaaggcataaacgcataagatattgaggagggacaacaccacaaaatactggaagctagagaatatatagataaatggaaacggactcagcagacctgaggaagcaaaatgctaaactggtagaagagaaaacccatccattttataccacggaattcccaaagggctcaggctactccaggcagttccaggactgagagtgaagacagactaaaattaagaggttgacattctatataagtagtagacctccaaatcacctcctgcattctgcacaactagaagaatacccttccctcagcagagagaagactggagatttattgtctggaggtggtaaaatcatgcatctgaattaagggacaaccaggtatatctggagcaccattctgaaagtaggagaattaagtaaacgattatactgcaggctgatatctaccagcccttaaccctcactctttaactttgtttatgggtttctgtataggtcttccctctccaggccagacaataatctttagaactctgatcagcccaagagtttcccaaagacccacttatgcattagaggttctaatatgctttttcatttcctagtcttaaatatgaacaatcggccagacgtggtggctcacacctgtaatcccagcactttgggaggccaaggcaggcagatcacctgaggtcaggagttcgagaccagcctgaccaacatggagaaaccccatctccactaaaaatacaaaacttagctgagggtggtggcacatgcctataatcccagctactcgggaggctaacacaggacaatcacttgaacccgggaggcagaggttgcggtgagccgagatcacaccattgcaccatgggcaacaagagcaaaactctgtctcaaaaattatatttatatatgtatatgaacaattaatattggctgggtgtggtggctcacacctgtagttacagcactctgggaggcaaaggcaggaggatcaccttaggccaggagttcaaaatcagcctgggcaacaaaagtgagaccccatccctacaaaaaacttttaaaaataagccaggtgtggtggcccacactggccacttgggaggctgaggtggaaggatctgttgaccccagaagttcaaagctgcaatgagttatgactgtaccactgagtttgccccgagcaacagagagagcccccatctctaaataaataaataaatagaaatttaaaaataataataaatattaagtatctgagaaaagcttctaactttaaaaatagagacccaaaaaaggcagggaaaaaaagcagcttagagaaaagaagcaatacaaataataaaatctcttcaaaatcagtatgactaatatcaaagaaattatgctataatgaaccaatagacactacaaagaagaaacattcagagagccaaaaaagcactcttagaaattaaagactgaataggaattgaagataaagttaaagacaaatcctaaaaggcagaatgatttcttttttttttttttttttttttttttttttttttttttctgagatgcagtcccgctctgtagcccaggctggagtgcagtggcgcaatctcggctcactgcaagctctgcctcccaggttcacgccattctcctgcctcagcctacaggactgcaggcgcccgccaccatgaccggctaatatttttttgtattttttttagtagagacggggtttcaccgtgttagccaggatggtctcgatctcctgacctcaggtgatccacctgcctcagcctcccaaagtgctgggattacaggcgtgagccagtgtgcctggccattttgctccttcagaatgggtatgtgtgaagtaaattctttttgagactgggtatttctgaaaatatctttgtcctactttgacatctgattgatagtttgatggggtatggaattctaagttggaaataatttcctttcaggactttgaaggtgttgcttcattgtcttctaacttccagtgttgtcaggaagtctgacattctgattcctggtcctttgtgtggcctatttgtttttaatatagaaactcgtaggattagttttttatccctagggttttgaaatttctggatgatatgccttagcctgagtctctttttgactattgtcctaggcattcagtaagccctttgaacctggaaactcatgtctctcagttctaggaaattttcctgaataaatttgttggtaatgttttcttcttgggtgttctgtctaaaacctccttttatttggaattggactttttgaaatgattgtcgtattttcttatcctttcctcttttccttcccctcaatcttgttctactttttagaaaacagctttattgagatgtaatatacataccataagatttacccaaagtgtacaattgagtggtttttagtgtatatacagagttatgcaaccaccaacacaacagaattttagaacctgttcagcactctaaaaataacttgctcattctaagaccaggtacagtggctcacccctgtaaacccagtggtttgagagactgaggtgggaggactgtttcaggccatgagtttcagactagcctgggcaacacagcgaaacactgtctcttaaaaaaaaaaaattctccaggggtagtggaacgtgccttagtcccagctatttgggaggttcaaggagaaggatcacttcaacccaggagttcaagattacagtgagctatgattgtgccatagcactacagcctgggtgaaagagcttaaaaaaaaaaaaaaaaaaaaaacagaggctgggcacggtggctcacgcctgtaatcccagcactttgggaggccgaggcgggtggatcgcgaggtcaggagatcgagaccatcgtggctaacatggtgaaaccccgtctctactaaaaatacaaaaattagccgggcgtggtggcaggctcctgtagtcccagctactcgggaggctgaggcaggagaatggcgtgaacctgggaggtggagcttgcagtgagccaagatatcgcaccactgcactccagcctgggcgacaaagctagactccgtctcaaaaaaggaaaaaaaaaaaaaaaaaaagaaagaaaggataggttttctttttaatttttttttttttaaacaaagacaggagtcgcactatgttgccccagctggcctcgaactcatagcctcaagcaaccctcccgcctcagcctcctgagtagctgggactacaggtgtgagccaccacgcctgggtaatatgatgatatgagatataagaaacagaagatccaacaaaggagagatgaagcaagtctccaaaatgatggtgaaggtcaatcccaggatgagagctttatactaccaggtatacctggtaaccattccagaccaaaatgctcctgaagaaatctcctcaagaagatgaaactcacagactgtctaatgagtcaaaacatctggagagaagatttaggctggcagagagtttgaggttacatgaatggtacatataacaccaagaaagttaaaagcaaaaaacaaaaacacaggataaatattaatccaaaaaaaaaaaaacaagttttacaaggaagtaaaaaataatcatatactgcatggttgagttctcagtagtgcttacataatcataacaactatatattgatctaatctaaattataaccatactaggagaatgagaggataggaaggacatgtatggatgtgtttaggacagggagaaaaaagacagagaactaatttctcatctttcatactgggaactcaataaaaaatacctaaaagcaaaaatcaagaggtatcaaatacaaacatattattacagatgtagcagtaaaacacaaaataaacagctaaaagaattgaaagacactgcttctaagaaagataaaataggaaggagagaaggaaggactgctatttgccttaacaaatcctgaagaactatttcgacttatttaaacaatgtacatatataagataaataaaatgaatcagatgctactgatatccttattttaaaaaaatacaaataagctgggccagtggcatacacctgcagtcccagctacttgggaggctgagtcaggaggattatttgaggccaggagttcaaggctgcactgtgctatgatcatacccatgaacagccactgtactccagcctgggcaacaaagctagaccccttctcttaaaaattggaaaaaacaaaacaaaactacgactgtccatacctagaccagc

SEQ ID NO: 232 - DNA, 9079 bp, Homo sapiens
gttcaagcctgacataagtgtgagtttggggcacaaattctgctctgaataccagggacagcccatgtaatacagcatttccctttgtgcccacgcagccctaagggaggtgtggtttgttgttgttgttgtatctttttgagatggatttttgctcttgttgcccaggctggcatgcaatggtacaatctcggctcactgcaacctccgcctcccaggttcaagcgattctccttcctcagcctcccaagtagctgagattacagtcatgagccaccatgcctggctaattttttgtatttagtagaaatggggtttcaccatattagtcaggctggtctcgaactcctgacctcaggtgatccacccgcctcagcctaccaaagtgctgggattacaggcatgagccactgcactggctcttttttttttttttttttttttttgagacggagtctcactgtgttgtgcaggctggagtgcaatggtgtgatctcagctcactgaaacctctggggaggtgttgtttttatccctccccacaaccccctgttgatggacagacaaggacaatgaaacacagagaggtaaaagccctgggttaaagtcacacagcacataaaaggttcctgatcatgccgtgcagggcatctcgccaaacctcaaaaattcacaatctcatagcgcagcttgctctgtgaggcctccccacctcttccttctctccttccaggctccagtcaaggtcagtgcccagcttcctgctctgggccactcagcagccaccttcctccttcctgggtaaggaggtagggagctaccaaggaggcagggacatccgtgtagaacattctgcttttcttttttctttttttttaagatagagcctgactctgtcgcccaggctggagtgcagctgtagtgtaatggcacaatcgcagctcaccacaacctccatctcccaggttcaagtggttctcctgcctcagcctcctgagtagctgtgattacaggcatgtgccaccacgcctggctaatttttgtatttttagtagcgacggggtttctccatgttggtcaggctgctttcaaactcctgacctcaggtgatccgcccccgcttggcctcccaaagtgctggaattacaggcgtgagccactgcgcctggcctaattttctctaaaatagagacaagttctcactatgtggtccaggctgatctcgaactcctgaactcaagcaatcctcccagctcagcctcccaaagtgctagcattacatgtgtgagccatcatgcctggtccctgtctgtttcattctccctgtctctctagtcctgcctctctctgtgtcttctggtctttttctctatttgtctcttcctctgtcccttttatcatctctgtcccttccctccctccctccctcccttccttccttccttccttccataggtgagaaaaagtagcatcttttcctcacctatcacaaagtttgcagctggggcacctacagtaaaaggttaacagacacaagcataacaaatgtatttaaggcaagtgttgacatgggagccttcagaaatgaaggcctaaagaaacagggaaacctgggtgggttttttgttttgttttgtttttagatggagttttactctgtcgcccaggctggagtgcagtggcgcgatcttagcttactgactgcaatctctgccttccatgatcaagtgattctcctgcctcaacctccccagtagctgggattacaggtgcgcgccaccatgcccagctaatttttgtatttttagtagagaaggggtttcactatgttggccagactggtctcgaactgctgacctcaggtgatccacccactttggcttctggaagttctggcattacaggcgtgagccactgtgcccggctacctcccgttctatgatctatggtttaaacgctacatttgaccactatcaatactcccagtatcaaaactgggaaacctgggttcttcacccagagcctaaaacgaacagcattctttgccttgtgggtgacaatagcaaacatttaccgcctgtgtatatgtgccagacactgttttaatcctcagagaggtgatgtcacttgcccaaaatcacacagctcgtgactgtgagtctgaaattggccagagcttgtgcacctagccactggtggtgatgtgtctttgagtcatcgagtccagcattctgtgttggacttagtgaaaggatatacttttgtagtgatgagaaaggagctttatctagaatttgtgaggccaggcatggtggctcacgcctgtaatcccagcactttgggaggctgaggtgggtggatcacttgaggtcaggagtttgagaccagcctggtcaacatggtaaaaccccgtccgactaaaaatacaaaaattagccaggtgtggtggtgcacacctgtaatcccagctactcaggaggctgaggcaagagaattgcttgaacccaggaggcggaggttgcagtaagccaagatggcgccactgcactccagcctgggtgacagagcaagactccatctcaaaaaaaaaaaaaaaaaaaaaagaaaaggaaaagaagtgaactggttcaaagaccataatcatacatatcacacaagactgcaagcggaccagggtcagttaatttagcggctccacaaagtcatcagtcacctgagctccatccatcttcacatgctgtgctaccatttattttattttatttttttttttgagacggagtctcgctctgtctcccaggctggagtgcagtggcgcgatctcggctcaccgcaagttgcgcctcccaggttcatgccattctcctgcctcaacctcctgagtagctgggactataggcgcccaccaccacacccggctaatttttttatatatatttttagtagagacggggtttcaccgtgttagccaggatggtctcgatctcctgacctcatgatccgcccgccttggcctcccaaagtgctgggattacaggcgtgagccaccgcgcccagccagctaccatttcttagctgtatcatctcacggtcccaaaagggctgctacacatccagccatcacatgcagataatttctttcaaaaacagcagaaagaggctcgttcttgtcttggtcccttttgaagaatgaatgaaaccttcctaagccttccagcaactccccccacaactccgatgggtaggaattgtcacataaccatgtggcccgataggaggcaaaagaaatgagacttctgggattagtttagcctcagattctgcagctgagaagttgatcagccacctctgaaggacaagcagcttgcagaaaattagggtggtgttaccaaggagaaaaggggaaatggctttagagtagacaacagggatgccctgaggggttgtgtaggttgttcactgcacgaagtcccctggtcaagaaggtaagcggggtttaaacagacccacagtctactcatcaaaccaggtgtccttggcattgtgtccacccagagagctcactattttcttttcttttcttttctttttttgaaatggagtcttgctgtgtcccccaggctggagtgcagtggcatgatcttggctcactgcagcctccgcctcccgggttcaagcaattctcctgcctcagcctcccgagttcaagcaattctcctgcctcagcctcccgagtagctgggattacgggcgtccgccaccacacctggctaatttttgtatttttagtagagacagggccttgtcatgttggccaggttggtctccagctcctgacctcagctaatctgcccacctcggcctcccaaagtgctgggattacaggcgtgagccaccgcgcccggccacaactcatcttttagagccagcctacacttgtcataggccatggccgatgaatgggaagtccacggtggagctgggtgttcctctcaagttcaactggctgcggccaggagggcaggcaggccaggtggacaatttcccttcaaagtggatacaggcaggacatgcaaagatgaatatctctggcactggactctggcaagtaggaaaataaaaacaaaagatgaacatcttgggccgggcgcggtggctcacatctgtaatcccagcactttgcgaggctgaggcagaaagatcacgaggtcaggagttcgagactagcctgaccaacatggtgaaaccccgtctctactaaaaatacaaaagttagccaggcgtggtggcgggcgcctgtaatcccagctactcaggaggctgagacaggagtatagcttgaacctgggaggcagaggttgcagtgagcagagatcgtgccattgcactccagcctgggtgacagagattccatttcaaaaaaaaagaacatctctacaaactggatcaccagtaaataatagctacatatacttgtactcaccatatgtggacacccacatatgtacactcagtcgataaacacccacatttaaacataccatgtgggccaggtgcagtggctcacgcctataatctgagcactttgggaggccaaggtgggaagatcacttgggcctaggagtttgagaccagcctgaccaacatactgagaccttatctctacaaaagagaatttgtttttagttagctgggcgtggtgatgtgcacctgtagtcccaactactcgggaggctaaggcaggaggattgcttgagcctaggaggtcaaggctacagtgagccacgttctcaccactgcactccagcccaggtggcagagcaagatcctgtctcaaaaaataaataaaaaattaataaacaaaaaatgcatacaatgtatagatacacaaagtgtatatatatacatatatatgtatacacattcacatatacacacatgctgtgttcacaatcacctagatgacatatgtatgtgtatacatacttacacatatacccttacatgtacacgatatatctctacccatacactaccatgtacacatgtccatttgtacacagctgtatatgtacacacacaattttgcacacacctgtatatgtatacaatgtatggatccccatatccacattacacacaatgtgtacgcatctacctgtgtacacacacccacctatgaacacaatgtagacacatctgtataaacacacttgagatacatgcctgtgcacataggcaagtatgtgccaagtatttacacacctgaagtagaagcacacacacacccacactatgcctgcacaccaccgcatggccacgttcaccagcgccccgggcctccatctcccagctaacgtgtcccgttttcctcccctgacagccatgctggtcgttcagatgcctttctcctttcccatggcccacttcatcctctttgtctttacggtttccactatatttcacgttcagcagcggctagcgaagattcaagccatgtgggagttaccggtgcagataccagtgctagcctcaacatcaaaggcactgggacccagccagctcagggggatgtggacgatcaatgcaataggccgcctggggaaccagatgggcgagtacgccacactgtacgccctggccaagatgaacgggcggcccgccttcatcccggcccagatgcacagcaccctggcccccatcttcagaatcaccctgccggtgctgcacagcgccacggccagcaggatcccctggcagaactaccacctgaacgactggatggaggaggaataccgccacatcccgggggagtacgtccgcttcaccggctacccctgctcctggaccttctaccaccacctccgccaggagatcctccaggagttcaccctgcacgaccacgtgcgggaggaggcccagaagttcctgcggggcctgcaggtgaacgggagccggccgggcacctttgtaggggtccatgttcgccgaggggactatgtccatgtcatgccaaaagtgtggaagggggtggtggccgaccggcgatacctacagcaggccctggactggttccgagctcgctacagctccctcatcttcgtggtcaccagtaatggcatggcctggtgtcgggagaacattgacacctcccacggtgatgtggtgtttgctggcgatggcattgagggctcacctgccaaagattttgctctactcacacagtgtaaccacaccatcatgaccattgggacgttcgggatctgggccgcatacctcacgggcggagacaccatctacctggccaattacaccctccccgactcccctttcctcaaaatctttaagccagaggcagccttcctgccggagtggacagggattgccgcagacctgtcccccttactcaagcactaatgctggcccattctttgagaccttttctccttctctgcctccctcaagatgagtgcccgggcatgagaagcacatggttccatgagcaggacccatctctcttctgtgaagatgcgttgggctgcaagtaacagaaatctcagtgaacagtggcctggcgtggtggctcatgcctgtaatgctcgcactttgtgaggccagggtgggtggatcacttgaggtcaggagttcaagactagcctggccaacatggtgaaaccccatctcgactaaaaatacaaaaattagccaggcgtggtggtgcacacctgtaatcccagctactcgggaggctgaggcaagagaatcacttgaacccaggaggcggaggttgcagtgagccaagatggtgccgctgcactccagtctgggtgacacagcaagactccatctcaaaaaaaaaaaaaaaaaaaagaaaagaaaaagaaatgaatgggttcaaagaccataatcatgcatatcacataagaccagaagtggcccaggtccagggtcagttaatttagcggctccacaaagtcatcagtcacctgagctccatccatcttcacatgctgtgctaccatttcttagctgtatcatcccatggtcccaaaagggctgctacacatccagccatcacatgcagataattcctttcaaaaacagcagaaagaggctcgttcttgtcttggtcccttttgaagaatgaatgaaaccttcctaagccttccagcaatttccccccaactccgatgggtaggaattgtcacatacccatgtgacccgataggaggcaaaagaaatgagacttctgggattagtttagcctcagattctgcagctgagaagttgatcagccacctctgaaggacatgcagcttgcagaaaattagggtggtgttaccaaggtgaaaaggggaaatggctttagagtagacaacagagatgccctgaggggttgtgtaggttgttcactgcaggaagtcccctggttaagaaggcaagtggggtttaaacagacccacagtctactcatcaaaccaggtgtccttggcattgtgtccacccagagagctcactgttttcttttctttttcttttctttttttttttttttttgagatggagtcttgctgcatcccccaggctggagtgcagtggcatgatcttggctcactgcagcctccgcctcccaggttcaagcgattctcctgcctcagcctcccgagtagctaggattacaggtgcgtgccaccacgcccagctaatttttatatgtttagtggaaatggagtttcaccatgttggtcaggctggtctcaaactcctgacctcatgatccgccttcctcggcctcccaaagtgctgggattacaggtgttagccactgcgcccggccctagagctcactgttttctagttagtccatctggaagtggagcctttttccagtttgcacaaatgtgccatattggcttgtagctggcatgcatccaagtccataggtcctgcctcttcaatcctggctttctagggcctgggatgatcattgctagaactgagagaccagcctggctcagtgaacttcagggcgttccgttcattctttcagtaaatgtttgcagcacatgtgttacatgtcaggcagtgaaaccccccacagcagccttccctctcagaggatacatttgtaaccattacacagtcatcaaaggaataattttttttaatcaccagtgtgcatacagtcatggagttgggtattcccagctaccagggaggctgaggtgggaggattgcttgatgccaggagttagggaatatagtgcaccgtgattggacttgcgaatagccactgcactgcggcctggacgacgtagtgataccctgactcttataaataaataaatgaataaacacaattatgactttgcggatgggagaaaaggttctctgagagcgtattacataagtatcacatgaactccaaaatacatcttaggccaggcatggtggctgtaatcccagcactttgggagggtaaggcgggcggatcacctgaggtcaggagttcgagactagcctgggcaacatagtgaaaccctgtctctactaaacatacaaaacattagccaggggtggtggtgcagacctgtagtcccagctacttggcaggcttaagcaggagaatcgtttgcaccagggaggcagaggttgcagtgagccaggatcacaccattgcactctagcctggacaacagagtgagactccatctcaaaaaaaaaaaaaaaattcttaagagtagatggaatcctattacaagtctggatcaaaaaggcagctttggctgggtgcagtggctcacacctgtaatcccagcactttgggaagctgaggcagatggatcacttgaggttaggagttcaagaccagcctggccaacatagtgaaaccctgtctctactaaaaatacaaaattagctaggcgtggtggtgcatgcctgtaatcccagctgctagggaggctgagacagaagaatcgcttgaacctgggagatggaggttgcagtgagctgagatcacaccattgcactgcagcctgggcaacaagagcgaaacttggtcaaaaaaaagaacaag

SEQ ID NO: 233 - DNA, 9383 bp, Homo sapiens
aaaaagaaatacctgctcagtaaaaatttcctgtgtgaagattgtcttcatcctgctcaaggagcttggcttaattacaatctaaaattaccaaaagaattccaacagcatgtaaaaatatatgaaacacaatttattctagggaacttatctaaaatggctatgatacacataaatgttcaaatgttcaagtactctactctgttttagaagtgctttcccaaacccaacattaaagtgttaatactcaaaaacagaaccaatataaaaagcacttaataaatactattattggcattttcagtcggttgggggaaacagattatttactacatggagctaggatagctgcccctctgtgaggccaagagaaatatgtgtgtgtgtgtatgtgtgtgtctgtgtctgtatatacgcacatatacacacacaaatatatgtatatatgtatatgtacagatagacacacatacactttttgcacatatcacaccatacaccaaaagaaactccaagtagattaaaatgttcaaatgtaaaacatgaaaccaccaaaaaaaactagaagaaaatataagtgaccacttatataaacccaagaaaggaaaacatttctaagcataagagcaaaatagaaaacacaaaaagaacatttacagccaggtgcagtggttcacgcctgtaatcccagcactttgggaggccgaggagggcagatcacaaggtcaggagatcgacaccatcctggctaacacagtgaaaccccatctctactaaaaatacaaaaattagccgggcgtggcggtatgtgcctgtagtcccagctgctggggaggctgaggcaggagaatggcatgaacctgggagacggagcttgcagtgagccgagatcgcaccactgcactctagcctgggcgacagagcaagactccatctcaaaaaaaaaaaacaaaaaaaaaacatttaatatactacataaaaataataatgataataatttccacatggcgaagttaaatggcaaaaaatactggaaaaagtcaattataacatattgaactctccacttttaaagatactataagatatgtcactgatttaatattacagtagcttttcaagaaaaaagtaggagttggaacactaccactttcatattacatgtcaactgtaaaatgaatcccaatttcaatactgggtaaaatatacgtcttgaaatatatgaagtaagatgtataaggcataatgacatatctttccttttgaatcagtgaaagaaaaaaataaatcaaagtccctacaggaaaattaggatactgatcagcttttcacaaaagaaataaacaagccaaaacacataaattttaaatactaagtttcactagtaatcaaagaaattcaaactaagtgataccactgttcatcaaccaaatttgcaaagattaaaaaaaaatagtaatgctcagtcatgttgaaagtttagaaaaacagtagttcttactaacggtaagagttaaactgatacaatctttcgaaaagataatctgacagtactcatgaaacaccttaacatagtcatacacttttccttagcaattaccttctagaaatttatcctaagaaaataatccaacaggtgtatgaagagatacatgtgggtgcctatgtgtgtatttacataaacaaggacattcctctaagcattatacagaaactagaaaatctacatgggaaataataagggacctattaagaagatcaaacaatggactataagacaatgcagtcattaaaaattatactgtattataatatttattgatatgagtaaatgctcatcatatattaatttttttaaatcatcaaatatgtacgtcactttaaagaaagaacagacatcagaatattaatagtagtatactaggtatctctgaatcatggaattataagatatctttcccttttctgtgctttccaaggtttttgcatgagtatctattattttagtaaatacaggtttcaaaatgcatttttctaagcgctcttgataaaacttctattaaacaattaaaattacttaaatgaaaacaatctatttacactacaacaaaatgtccagcttagaaacacctttttttttttagaaagaagttaaaagaaaattaccttcatccccaaagtggaacagaccaagtcaatgatagcactaagctggttgctgtgaaagtacatagccaccaataataacatctccccaaaagaagcagagacgcctgaagtactgtcaaaacaaaataggaaatatgaattttccaaagagagaagaagaaaagctttctcaactaactaaatcaaattatcttacctctcaaaatacgcttcttcttttatcatccaacttagccacaccaccatcagctgctcctgttcaggtgtactatataaaatataccagaatgtcactggtttaaattagatatactagcatatgaataaaaagcattctgaagttatttttggtagaaattatttttcctgccctattttcaagtatcaagtcaaattaaaggcttgctgaattgggccattaattgtcattgaggtatgaagtaattctagagctcaagaatgaggacctttgctttttttcatggatcccctctcaaagtcttagttactgccttcacaggttggaaagagtaagattcttcacattccttagaaaacaaaggccccttgggattaacttgttaaaacaactacacaacagctgatatttatttcatatagaaaaaaatctagtgttaacacttaagcatcaaaatatcacaaactgagtgccaaacagtaatgagcagtccatcttctggaaaaatgaaatttaatttatagaaaccttatgagtagatctcaaagttacagagaaataaatgatcactaatcatgggaaaaaaggcagtcacaggcttaccagatatgaaaaatggctataaaaatacgacttttctttgagacaatgtcttgctctgtcgcccaggctggagtgcagtggcgcaatcatagctcactatagcctcgaccacccaagctcaagtgatcctcccacctcagcctcccaagtagttgggactacaggcatgcgctactgcatccagctaatattttttatttttagtagaggggaggtctcactatgttgcccagtctggtcttgaactctcgagctcaagtgatacgcctgcctaagcctcccaaagtgctggaattacagaggtgagccaccatgcctagcctaacaatgactttttaaagggaattcctaaattctgagatggagtttcactctcgttgctcaggctggagtgcagcagcgcaatctcagctcactgcaacctccgcctcccgggttcaagcgattctcctacctcagcctcccgaatagctgggattacaggtgtctgccaccacacctggctaatttttctatttttagtagagatggggtttcaccctgttggccaggttggtcttgaactcctgatttcaggtgactgacccgcctcagcctcccaaagtgctgggaatacaggcctgagccaccacacccggtctaaattttaattgaaaagtacaagctgacgttgacttgtgaaaattttttcaccaatctctttccacttcagtgcagtaaaaatagatgcaacaaaaagcaaatgaaaagtataattcttctattaccaaaagctaagaaaataaaaaaggtcattctcaactatacctaaaccatataacaaataataaagtgttatgtagtagaaagattacagcctttacagcctaccacatctgagtgagaatcccatctctgctaattactggtagtgtgatcttgaagaagaaacacaaataatctttcttttcctttttcactgtagctctcaaatgttaagaactttttttttgtttttgagaagtttcgctcttgttgcccaggctggagtgcaatgacacaatcttggctcactgcaacctccacctcccggattcaagagattctcctgcctcagcctcccgagcagctgggattacaggtgcccaccaacacacccagctaattttttatatttttagtagagacggggtttcaccatgttggccaggctggtctcgaactcctgacctttaggtgatccacccaccttggcctcccaaagtgctgggattacaggcatgagccactgtgcctggcctatcttaaggacttttaagtatctttctaaacattagtttttctatctataagatatagacaaaaataccttataaggctgggcacagtggctcttgcctgtaatcccagcaatttgggaggacaagacaggaggatagcttgagcccagcagttcaagaccagcctgagcaacaaagtgagatcccatctctacaaaaaaatttaaaaattagacaggcatggtggcgcatgtttgtagtcccagctacacgggaggctaagatgggaggatctcttgagcccaagaggccaaggctgcagcgagccctgatcgtgccactggactccagcctgcgaaacaaagcaagatcctatctaaaaaaaaaaaaaaaataccttataagagtaatgaggatttgagataatgtttagaaagtacttcaagtaaaaagaaaagaaagaattcatgtacctaattttacaccatcctgaaactccattaaagctacattaaagggattttcttaaaaggcataaacgcataagatattgaggagggacaacaccacaaaatactggaagctagagaatatatagataaatggaaacggactcagcagacctgaggaagcaaaatgctaaactggtagaagagaaaacccatccattttataccacggaattcccaaagggctcaggctactccaggcagttccaggactgagagtgaagacagactaaaattaagaggttgacattctatataagtagtagacctccaaatcacctcctgcattctgcacaactagaagaatacccttccctcagcagagagaagactggagatttattgtctggaggtggtaaaatcatgcatctgaattaagggacaaccaggtatatctggagcaccattctgaaagtaggagaattaagtaaacgattatactgcaggctgatatctaccagcccttaaccctcactctttaactttgtttatgggtttctgtataggtcttccctctccaggccagacaataatctttagaactctgatcagcccaagagtttcccaaagacccacttatgcattagaggttctaatatgctttttcatttcctagtcttaaatatgaacaatcggccagacgtggtggctcacacctgtaatcccagcactttgggaggccaaggcaggcagatcacctgaggtcaggagttcgagaccagcctgaccaacatggagaaaccccatctccactaaaaatacaaaacttagctgagggtggtggcacatgcctataatcccagctactcgggaggctaacacaggacaatcacttgaacccgggaggcagaggttgcggtgagccgagatcacaccattgcaccatgggcaacaagagcaaaactctgtctcaaaaattatatttatatatgtatatgaacaattaatattggctgggtgtggtggctcacacctgtagttacagcactctgggaggcaaaggcaggaggatcaccttaggccaggagttcaaaatcagcctgggcaacaaaagtgagaccccatccctacaaaaaacttttaaaaataagccaggtgtggtggcccacactggccacttgggaggctgaggtggaaggatctgttgaccccagaagttcaaagctgcaatgagttatgactgtaccactgagtttgccccgagcaacagagagagcccccatctctaaataaataaataaatagaaatttaaaaataataataaatattaagtatctgagaaaagcttctaactttaaaaatagagacccaaaaaaggcagggaaaaaaagcagcttagagaaaagaagcaatacaaataataaaatctcttcaaaatcagtatgactaatatcaaagaaattatgctataatgaaccaatagacactacaaagaagaaacattcagagagccaaaaaagcactcttagaaattaaagactgaataggaattgaagataaagttaaagacaaatcctaaaaggcagaatgatttcttttttttttttttttttttttttttttttttttttttctgagatgcagtcccgctctgtagcccaggctggagtgcagtggcgcaatctcggctcactgcaagctctgcctcccaggttcacgccattctcctgcctcagcctacaggactgcaggcgcccgccaccatgaccggctaatatttttttgtattttttttagtagagacggggtttcaccgtgttagccaggatggtctcgatctcctgacctcaggtgatccacctgcctcagcctcccaaagtgctgggattacaggcgtgagccagtgtgcctggccattttgctccttcagaatgggtatgtgtgaagtaaattctttttgagactgggtatttctgaaaatatctttgtcctactttgacatctgattgatagtttgatggggtatggaattctaagttggaaataatttcctttcaggactttgaaggtgttgcttcattgtcttctaacttccagtgttgtcaggaagtctgacattctgattcctggtcctttgtgtggcctatttgtttttaatatagaaactcgtaggattagttttttatccctagggttttgaaatttctggatgatatgccttagcctgagtctctttttgactattgtcctaggcattcagtaagccctttgaacctggaaactcatgtctctcagttctaggaaattttcctgaataaatttgttggtaatgttttcttcttgggtgttctgtctaaaacctccttttatttggaattggactttttgaaatgattgtcgtattttcttatcctttcctcttttccttcccctcaatcttgttctactttttagaaaacagctttattgagatgtaatatacataccataagatttacccaaagtgtacaattgagtggtttttagtgtatatacagagttatgcaaccaccaacacaacagaattttagaacctgttcagcactctaaaaataacttgctcattctaagaccaggtacagtggctcacccctgtaaacccagtggtttgagagactgaggtgggaggactgtttcaggccatgagtttcagactagcctgggcaacacagcgaaacactgtctcttaaaaaaaaaaaattctccaggggtagtggaacgtgccttagtcccagctatttgggaggttcaaggagaaggatcacttcaacccaggagttcaagattacagtgagctatgattgtgccatagcactacagcctgggtgaaagagcttaaaaaaaaaaaaaaaaaaaaaacagaggctgggcacggtggctcacgcctgtaatcccagcactttgggaggccgaggcgggtggatcgcgaggtcaggagatcgagaccatcgtggctaacatggtgaaaccccgtctctactaaaaatacaaaaattagccgggcgtggtggcaggctcctgtagtcccagctactcgggaggctgaggcaggagaatggcgtgaacctgggaggtggagcttgcagtgagccaagatatcgcaccactgcactccagcctgggcgacaaagctagactccgtctcaaaaaaggaaaaaaaaaaaaaaaaaaagaaagaaaggataggttttctttttaatttttttttttttaaacaaagacaggagtcgcactatgttgccccagctggcctcgaactcatagcctcaagcaaccctcccgcctcagcctcctgagtagctgggactacaggtgtgagccaccacgcctgggtaatatgatgatatgagatataagaaacagaagatccaacaaaggagagatgaagcaagtctccaaaatgatggtgaaggtcaatcccaggatgagagctttatactaccaggtatacctggtaaccattccagaccaaaatgctcctgaagaaatctcctcaagaagatgaaactcacagactgtctaatgagtcaaaacatctggagagaagatttaggctggcagagagtttgaggttacatgaatggtacatataacaccaagaaagttaaaagcaaaaaacaaaaacacaggataaatattaatccaaaaaaaaaaaaacaagttttacaaggaagtaaaaaataatcatatactgcatggttgagttctcagtagtgcttacataatcataacaactatatattgatctaatctaaattataaccatactaggagaatgagaggataggaaggacatgtatggatgtgtttaggacagggagaaaaaagacagagaactaatttctcatctttcatactgggaactcaataaaaaatacctaaaagcaaaaatcaagaggtatcaaatacaaacatattattacagatgtagcagtaaaacacaaaataaacagctaaaagaattgaaagacactgcttctaagaaagataaaataggaaggagagaaggaaggactgctatttgccttaacaaatcctgaagaactatttcgacttatttaaacaatgtacatatataagataaataaaatgaatcagatgctactgatatccttattttaaaaaaatacaaataagctgggccagtggcatacacctgcagtcccagctacttgggaggctgagtcaggaggattatttgaggccaggagttcaaggctgcactgtgctatgatcatacccatgaacagccactgtactccagcctgggcaacaaagctagaccccttctcttaaaaattggaaaaaacaaaacaaaactacgactgtccatacctagaccagcttttgtagaaaactcttatctaatgctatacaattttattgagtaaataaaagtaaaccttgagaaaatggagcaacttatatagttaggtacctgacaagtgtagaaaaggccagtagcatacaaaaggaaagtgaaacaaagcgaaccccagctggcgtagcaggaggacggctcgtcatcaactgcagtaattgctcagcttcttcttcagttggtctaaaaaggaatacatcattaggctttacatttttagttgggatgaagaagaaaaagtgaatttttaaccttttagttacaaattttaaactttataatg

SEQ ID NO: 234 - DNA, 10167 bp, Homo sapiens
gaaccattactcttccacatgaattataacttttaaaataattttttagtgtgcatttaaaagctatgttgggcaaaatagtaacaataaaaatcaaatagaaaccctagagataaagaatacaataactgaactaaagtgtttgacagaaagctacaatagtagacttgatcaagcagaagaaagaatcagtgaacacaaagataggaattttgaaattatccagtcagacaagcaaaaagaaaagaaaaataaaggtctatgggaattatgggacaacatcaagagactaacctatgcaaaataggagtccttgaaggagagacaaaaaggcccagaaagtatatttaatgaactaatggctgaaaagttttcaaatctggggaaagatgacaacgtccaggtactgaaagctaagaggctgtcaatgaaatccaatccaacagttcaccaaaatacatcataatcaaattatcaaaaatcaaaaacaaagaaagaatactgaaaacagtaagagcgaaaaaacatatcacagtcaagagagttccaatacagctgtcagtggatttcttggcagaaaccctgcaggccaggagagggtagaatgatatattcaaagtgctgaagggaaaaagaccctgctatccaagaatattttccttcagaagtaagacagaagtaactttcccagacaaacaaaggtgagggatttgatcaccactaggcttgcactaggcttggaattgctaaaggaagttatttaagctgaaatgaaaggctactacctaataacataaaacatatgaaagtaaaaactcaatggcataagtaatacatagtcatattcaaaatactgtaagtgtggtgtgaaaagcaattgtatctctattatgaaggttaaaagacaaaactattgcaaacaactgtagctataataaattgttaagggacccaaattagaaaaaagggtaaattttaacacaaaaaatcataaaagatgttggggggagtgaaagtgtagagtttttgtttgcaatcaaagttgttatcagcttaaaatagcctgttttaattataagatttttatataaatgctaggatttgaatgtgccacccaaaagttcatgtgttggaaatgtaatccctctgccctcatgaatggattaatgtcactatcatgagactggctttattacaaaagcagctctctctggctttcttgattttggtctcttgccatgtgatgccttccattatgtcatgactcagcaagaaggctctcatcagatgccaacaccatgctcttggacttcttagcctccagaactgtgagataaataaacttctattgtttataaattacccagtttgtggtattctggtataaaaacagaaaagggactaagccaataggtcttatggtaaccacaaagcatgaacgtatagtagatgtaaaaaatataaaaagaagggattcaaagcagaccaacacaggaaaccaccaaatcacaaaggaagacaccaagggaggaagaaacaaataatctatgaaacaaccagaaaacaaattacaaaattgcagcagtaagtccttacctatcaatatttgactggaatgtaaatgaatcaaattgttcaatcagaagacactgggtgggtgaatggatttttttaaaaaacaggaaacaactatacactgcctacaagagactcactttactagtaaggacacacagagtgaaagtgaagggatggaaaaaaatattcaacacggatggaaaccaaaagagagcaggagtagttatactaatataacataaaatcaactttaagtcaaaaacgataaaaagagaaaaagaaggtcattatataatggtaaaggactcaattcattaagaggaaataataattgtaaatatacacacacccaacattggggcatctaaatacacaacgtgattattaagtgacctgaagggaaagatagacttgatacaataatagtattttacagtaatacactaccccactttcaacaatgaacagatcatatagatggaacattaataaggaaacactggattgaattacactttagaccacttggacctagcagacttatgcagaacatttcactcaacagcaacataatacactttcttctcaagtgcacacagaacattcttctggatagatcctatgttaggtctaggccacacaacaagtcttaacaaacttaagaactgaaaatatatcaagtatttttttgggtcacaaaggcatgaaactagaaatcataatgagaaatcttggaaaattcacaaatatgtggaaattaaacaacatgttcctaaacaaccaacaaatcatagaagaaattacaaagggaatttaaaaagcccttgagacaaacaatgaaaacacagcataccaaaacttatgggatgcaccaaaagcagtcctaaaagggaaatttatagcaagaaatgcttatggcaaaaaagagaaaagattttaaataaacattctaattgaaatggtttggatatctgtcccttccaaatctcatgttgaaatgtgatcctcagtgttggaggtggggattggtgggaggagattggatcacgtgggcagatccctcatgaatggtttagcagcattcccttggtaataagtgagttcatgctcagttagttcacatgagatctggtttttcaaaagcctgggactccctcctctctcccctgctctcaccatgtgacacgcttgctccccttcaccttctaccatgactggaagcttcctgaggccctcactaaaagcagatgctggtgctatgcttcctatacagcctgaataatagtaagccaattcaaaaaacctcttttccttatgaattacccagtctccagtatttctttatagtgatgcaaaaatggcctaacacactaatgctacacattgaggaactagaaaaagaaaaaactaagcccaaagctagcagaaggaaggtcataataaatactagagcagaataaataaaattgtgactagaaaaacaatagaacaaaataaataaaactaacagctagttttttgaaaagatgaacaaaactgacaaacccttactagactagaaaaagaaagaaaagactcatatatcagaaaggaaagtggtggcataacaactgatatcacagaagtaaaaaggatcacaagaaactactataaacaattgtataccaaaaattggatatctagaagaaatgaatacattcttagacacataaaaccttccaagactgaatcatgaagaaatagaaaacctgaacaaaccaataacaactaaagtgattgaatcaataataaagttcttccatcaaagaaaagcccaggatttaatggcttcatggctaagttttatcaaaaatttaaagaaaaagcaacatcaatccctctgaaactcttccaaaaaattaaagaagaggcaacacttccaaactcattttatgaggccagtattactgtaatactaaagccagacaaaggtattacaagaaagggaaattacagatgaacagatacaaatacaaatatccctgatgaatatggatacaaaagtccttaacaaaattctagcaaaccaaattcaacagcacattaaaaagatcattcactatgatcaagtaggatttatctctgaaatgcaagcatggttcaatataggcaaatcaataaatgtgattcatcacagcaacaaaatgaaggatgaaaccatatgattatctcaatagacgcagaaaaagcatttcataaaattcaataccttttttattcttgagatggagtctcgctctgtttcccaggctggagtgcagtggtgcaatctcagctcactgcatcctctgcctcctgggctcaagaaattctcctgcctcagcctcccaagtagctgggattacaggaatgcgccaccacacctggataatttttgtatttctagtagagatggggtttcaccatgtttgccaggctggtcttgaactcctgacctcaggtgatccacccacctcagcctcccaaagtgctgggattacaggtgtaagccaccatgcccagcctaaaattcaataccttttatgataaacattgttaacagaataggtatacatgcaatatacctgaacacaataaaagccatatatgacaaatgtatagctaacattatattcaatagtgaaagttgaaagcttttcctctaaaatcagggacaagacaaggatgcctactttcattactttttttcaacatagttctggaaatcctaaccagagcaattaggcaagacaagaaaataaaagatatcctaactggaaaggaaaaagtgaaattgtctctgttgatgacatgatattatacaaagaaaatcctaaagactccaccaaaaagctgttagaactgataaattcagtaaagttgtaggaaacaaaatcaatatttaaaaattagtggcatttttatacactaataacaagctatctgaaaaagaaattaagaaaacaattccatttacaatagcaacaataacaaaatacttattttattgtctgtttatattcatattttgttatcaaatacttctttataggacttgtatactaaaaactgtaaaacccttgtgaaagaaattgaagaaaatacaaataaatgtaaagatatcccacgttaacggagtaaaagaattaacattattaaaatgtctgtactactcaaagcaatctacagattcaatgcaattcatatcaacattccaatgtcatttttcatagaaaatgtcatagaaaaaataatccttaaattcatatggaaccacaaaagacctcaaattgtcaaaacaatcttgagcaaaaagaacaaagctagaggcatcgtactacctgacttcaaaatatattatgaagcaatcaaaacagaatgatcctggccaaaacaaaacaaaaccaaccaaacaaacaaacaaaaaacaacagaatcactgaccaatagaatctgatagaaagccaagaaataagcctgtgcatttatagtcaattgatttttgacaaagacgcttagaacatacattggagaaaggacagactattcaataaatgatgctgggaaaactggttatcctcatgcagaagaataaaattagaccctcatcttacatcctgcacaaaactcaactcaaaacgggttaaagacttagacctaaaactataaacctaccagaagaaaacatagggaaaaacttcacaatattggcttaggcaaggaatctttggatatgaccccaaaggctcaggcaacaaaagaaaaatagacaaatggaattgcattgtattagtccgtttttatgctgctgataaagacatacttgagactgggtaatttatagagaaaaagagttttaatggactcacagttcacgtggctggggaggcctcacaatcatggaggaaggcaagggggagcaagtcatatcttacatggtggcaagcaagagagaatgagaaccaagtgaaaggggtttcctcttataaagccatcagatctcatgagacttattcaccaccatgagaacagtacaggggaaactgcccccatgactcaattatctaccactggagtccctcccacaacacatgggaattatgggagctacaattcaagatgagatttgagtggggacacagccaaaccatatcattccacccctgggccctcccaaatctcatgttctcacatttcaaagccaatcatgccttcctaacagtcccctaaagtcttaactcatttcagcattaactaaaaagtccacagtccaaaatctcatgcaagacaaggtaagtcccttctgcctatgaacctgtaaaatcaaaagcaagttagttacttcctagatacaatgggggtacaggcattgaataaatacacccattccaaatgggagaaatgggccaaaacaaaggggctaaaggccccatgcaagtcagaaatccagcggggcagtcaaatcttaaagctccaaaataatctcctttgactccatgcctcatatttaggtcatgctgatgcaagaggtgggttcccatggtcttgggcagctctgctctgtggatttgcagggtacagcatccctcctggctgctttcacaggctggccttgagtgactgcagcttttccaggtgaacagtgcaaggtgtcggtggatctaccattctggggtctggaggacagtggccctcttctcacagctccactaggcagtgccccagtgggggctctgtgtgggggcttcaaccccacatttcccttctgcactgccctagcagaggctctcaatgagggccccacccctgctgcaaacttctgcctgaatatccaggcgtttccatacatactgcgaaatctaggcggaagtccccaaacctcagttcttgacttgtgtgcacccacaggctcaacaccatgtagaagctgccaaggcttggggcttgcaccctctgcagccatggcctgagctgtacctttgtccctttcagccatggctagagcagctggaatgcagggcaccaagtccctaggctgcacacagcatgggggccctgggactggcccaagaaaccattttttcctcctaggcctccaggcctgtgatgagaggggctgtgagaaagctctttgacatgccctggagagacattttccctgttgtcttggccattaacatttgtttcctcattacttatgcaaatttctgcagccagtttgaatttctcctcagaaaatgggtttttctttttctatcacatcatcaggctacaaattttccaaacttttatgctctgtttcccttttaaaactgaatgcttttaacagcacccacgtcacctcttgatgctttgctgcttagatattttttccaccagatatgctaaatcatctccctcaagtttaaagttccacaaatctctacagcaggggcaaaatgctgccagtctctttgataaaacatggcaagcattacctttactccagtccttatctccatctgagaccacctcagcctggatttcattgtccatatcattatcagcattttggtcaaagccattcaacaagtctctaggaaattccaaactttcccatattttcctgtcttcttctgagccctctaaactgttgcaacctctgcctgttacccagttccaaagttgcctcctggcagggaaattgttttgggatgattcaagcatattacatttattgtccactttatttctattattattacattgtaatatatcatgaaataattatacaactcaccataatgtagaatcaatgggataaattttagtagatataaatgaaggcttaatgaattttttttttttttttttttgagacagagacttgctctgtcacccaggctggagtgcagtggtgtgatctcggctcactgcaacctctgcctctcaggttcaagcgattctcctgtctcagcctcccaaggaaccaggatttcagttgcacgccaccacacctagccaatttttgtattttcagtagagacagggtttcgccacattggccagtctagtctcaaactcctgacctcaagtgatccatctgcctcaccctcccaaagtgctggcattatggtgtgagccacggtgcccagcctatttctttttcttttctttctttttttttttttttttgatagctgggtggcagatgtataaattgtcattgacctaacagaattaagctgggccatggagaaaactgagaacatcacgattcaaaacacagaattctcaaatggaccagtgtgtttagacctgactgtggaatggaatgccacacctaggcatatgaggtatggttggggcactgtcacatgtccagcttgggagccatcatgtgcccaggtcgggagaggtaaatccacgagacacagacatgtgctgggggtgcagtcgcatgtccaggtcaggtgccctcacttgctgggagtgccatctgctagtgggagccagtcacatgttggggtgcaaccacctgttgggggcgcaatcctgtgctggagacacagtcacatgtcgggagctagtcacccgctgggggcgctgcctcgagcctcatggctgcccctgcttccgtcatgggcccactcgggccctctgccctgggccttctgctgctgctcctggtggtggcccctccccgggtcgcagcattggtccacagacagccagagaaccagggaatctccctaactggcagcgtgggtaggccctgccccaggggcggatgggcggctggagacagtgcccttggggcgtctgtcggtgctgggcctcctcccccatgtcgcctgcccatcccttcccctcccccatgtcccctgccttcccttcctcctgtgtcccctgcccctcccccacgtcccctgcctgccctacctctcccgtggccccagcatggctccaccgtcagctccgttctccctgcagcctgtggtcggcccagcatggaggggaaaatcctgggcggcgtccctgcgcccgagaggaagtggccgtggcaggtcagcgtgcactacgcaggcctccacgtctgcggcggctccatcctcaatgagtactgggtgctgtcagctgcgcactgctttcacaggtaagcgggcgccggcctgggatggtgtgggtagctgggcctgcacggagtgcccacagcggcttggatggaccccacgcaagcctcccccatcaccattgtcgactcccttcaccactgtcgacccgcgcaaggccaggtccccaccagtgaggctggtccccaaacacacagctgggtccccattcttgaggctggtcccccaagtgcacagccaggtcctcaagagtgatgctggtccccaagatcacagccaggtcctcatatgcaaggctgatcccctaagtgtacagttaggttcccatgagctaggttggtcctcaaatgcacagcctggtccccatgtgcaaggctggtcccctaagtgcacgaccaggtccccacgagtgaggctggtcctcaagggcacagccagattcccacaagtgaggctggtcctcaagggcacagccagattcccacaagtgaggctggtcctcaagtgcacagccaggtcccacaaaagtgaggctgctcctcaagtgcacagccaggtcctcataagcaaggctggtctctaagcacctggccttcccgattgctcctccaacagccccattcaccacagctgccccgcacagcaggcacgcctctcctgtggccatctggcctccagagggatgtgtgcaaccaggttgtcagtaagagtcagagcaggtctcacatgcatgggctgctggcctgtacagctggtggtcgtgtacagacttgggtccccagagcctccatgggccaagtcgactctttagggggcaactcttccagacagccagataggtccctactatgctgcaggaagaaactggcttttcaatcccaccgagtgagtgccagccccttgcgcttggcctccccaggcctgtgggctgaccacacaggaagctgcgggcattgtacctctgttctcacccccacagggacaagaatatcaaaatctatgacatgtacgtaggcctcgtaaacctcagggtggccggcaaccacacccagtggtatgaggtgaacagggtgatcctgcaccccacatatgagatgtaccaccccatcggaggtgacgtggccctggtgcagctgaagacccgcattgtgttttctgagtccgtgctcccggtttgccttgcaactccagaagtgaaccttaccagtgccaattgctgggctacgggatggggactagtctcaaaacaaggtaggaatacagtgcagggctttgtgggcaggatgaaggcttctcttccaccacagggaagaaaatgctctgccagctaagggggtccaggtgtttggggactggaatccccacctgtcaatcaacatttatttgtttgtcagtgtggatattttgttgttttgttttatttctgactggctttgttgtatgcagaaaaatacagcta

SEQ ID NO: 235 - DNA, 10253 bp, Homo sapiens
ccctcagcagtttctatgaaccaccctggcagtaatggtgcagatggctcgcgcacagctggtggtgacccgactttcctgcctccaccctggggctcctcagaggcttcatggaacccaaactgctggtctcacctccgagccctgccgtcgcccagggagggcggctccgtccctcctgcactccctaatcccgctctgaatcaccgcttctgttctgggtcggagaataaaggtggggtttccaagtgatggccctacgttattgtctgaagctcccttctcctccccagggtggaagtgataatgccgggaatccgggaatcccggggaggtgcaggaagacagcgagctcgaggcagtggggtgcgactgagccggatgtgctgagctgcccggggcacggggcggttggggtagagaaaggctttcagagctgggggacaggacggggccccgggtgagcggagagctgggttatttcacgggaacagctggtgacaaagccggaggggtgtgcggggccggcgagagactgggattgtgtcttaagaggcatagggagccctgaaggggctgcgagctgggaaggggcagggccggcgctgggtgtaggggacagaggggagaggaggaagccgggccgcaatagaaagacgtggacggggctggacgtggtggctgacgcctgtaatcccagcactttgggaggccgagacaggcggatcacttgaggtcaggagttcgagaccagtctggccaacatggagaaaccccgtctctactaaaaatacaaaattagccaggcgtggtggtgcatgcctgtaatcccagctactcgggaggctgaggcaggagaatcgtttgaacccgggaggcggaggttgtggtgagccgagattgtgccattgcactccagcctggggaacaagagcaaaactccgtctcaaaaaaaaaaaaaaaaaaaaaaatctcagtaagatagaccaggtgtggtgtctcatgcctgtaatcccagcactttgggaggctgaggaaggagaacagaggacctcctgaggccaggagtttgagatcagtgtgggccacatagcaagaccccctccccaccatccctacaaaaaaagcaattcaaaaaaaataatgccttcaggcagaatgggagtggtgcttggttcaagcctgacataagtgtgagtttggggcacaaattctgctctgaataccagggacagcccatgtaatacagcatttccctttgtgcccacgcagccctaagggaggtgtggtttgttgttgttgttgtatctttttgagatggatttttgctcttgttgcccaggctggcatgcaatggtacaatctcggctcactgcaacctccgcctcccaggttcaagcgattctccttcctcagcctcccaagtagctgagattacagtcatgagccaccatgcctggctaattttttgtatttagtagaaatggggtttcaccatattagtcaggctggtctcgaactcctgacctcaggtgatccacccgcctcagcctaccaaagtgctgggattacaggcatgagccactgcactggctcttttttttttttttttttttttttgagacggagtctcactgtgttgtgcaggctggagtgcaatggtgtgatctcagctcactgaaacctctggggaggtgttgtttttatccctccccacaaccccctgttgatggacagacaaggacaatgaaacacagagaggtaaaagccctgggttaaagtcacacagcacataaaaggttcctgatcatgccgtgcagggcatctcgccaaacctcaaaaattcacaatctcatagcgcagcttgctctgtgaggcctccccacctcttccttctctccttccaggctccagtcaaggtcagtgcccagcttcctgctctgggccactcagcagccaccttcctccttcctgggtaaggaggtagggagctaccaaggaggcagggacatccgtgtagaacattctgcttttcttttttctttttttttaagatagagcctgactctgtcgcccaggctggagtgcagctgtagtgtaatggcacaatcgcagctcaccacaacctccatctcccaggttcaagtggttctcctgcctcagcctcctgagtagctgtgattacaggcatgtgccaccacgcctggctaatttttgtatttttagtagcgacggggtttctccatgttggtcaggctgctttcaaactcctgacctcaggtgatccgcccccgcttggcctcccaaagtgctggaattacaggcgtgagccactgcgcctggcctaattttctctaaaatagagacaagttctcactatgtggtccaggctgatctcgaactcctgaactcaagcaatcctcccagctcagcctcccaaagtgctagcattacatgtgtgagccatcatgcctggtccctgtctgtttcattctccctgtctctctagtcctgcctctctctgtgtcttctggtctttttctctatttgtctcttcctctgtcccttttatcatctctgtcccttccctccctccctccctcccttccttccttccttccttccataggtgagaaaaagtagcatcttttcctcacctatcacaaagtttgcagctggggcacctacagtaaaaggttaacagacacaagcataacaaatgtatttaaggcaagtgttgacatgggagccttcagaaatgaaggcctaaagaaacagggaaacctgggtgggttttttgttttgttttgtttttagatggagttttactctgtcgcccaggctggagtgcagtggcgcgatcttagcttactgactgcaatctctgccttccatgatcaagtgattctcctgcctcaacctccccagtagctgggattacaggtgcgcgccaccatgcccagctaatttttgtatttttagtagagaaggggtttcactatgttggccagactggtctcgaactgctgacctcaggtgatccacccactttggcttctggaagttctggcattacaggcgtgagccactgtgcccggctacctcccgttctatgatctatggtttaaacgctacatttgaccactatcaatactcccagtatcaaaactgggaaacctgggttcttcacccagagcctaaaacgaacagcattctttgccttgtgggtgacaatagcaaacatttaccgcctgtgtatatgtgccagacactgttttaatcctcagagaggtgatgtcacttgcccaaaatcacacagctcgtgactgtgagtctgaaattggccagagcttgtgcacctagccactggtggtgatgtgtctttgagtcatcgagtccagcattctgtgttggacttagtgaaaggatatacttttgtagtgatgagaaaggagctttatctagaatttgtgaggccaggcatggtggctcacgcctgtaatcccagcactttgggaggctgaggtgggtggatcacttgaggtcaggagtttgagaccagcctggtcaacatggtaaaaccccgtccgactaaaaatacaaaaattagccaggtgtggtggtgcacacctgtaatcccagctactcaggaggctgaggcaagagaattgcttgaacccaggaggcggaggttgcagtaagccaagatggcgccactgcactccagcctgggtgacagagcaagactccatctcaaaaaaaaaaaaaaaaaaaaaagaaaaggaaaagaagtgaactggttcaaagaccataatcatacatatcacacaagactgcaagcggaccagggtcagttaatttagcggctccacaaagtcatcagtcacctgagctccatccatcttcacatgctgtgctaccatttattttattttatttttttttttgagacggagtctcgctctgtctcccaggctggagtgcagtggcgcgatctcggctcaccgcaagttgcgcctcccaggttcatgccattctcctgcctcaacctcctgagtagctgggactataggcgcccaccaccacacccggctaatttttttatatatatttttagtagagacggggtttcaccgtgttagccaggatggtctcgatctcctgacctcatgatccgcccgccttggcctcccaaagtgctgggattacaggcgtgagccaccgcgcccagccagctaccatttcttagctgtatcatctcacggtcccaaaagggctgctacacatccagccatcacatgcagataatttctttcaaaaacagcagaaagaggctcgttcttgtcttggtcccttttgaagaatgaatgaaaccttcctaagccttccagcaactccccccacaactccgatgggtaggaattgtcacataaccatgtggcccgataggaggcaaaagaaatgagacttctgggattagtttagcctcagattctgcagctgagaagttgatcagccacctctgaaggacaagcagcttgcagaaaattagggtggtgttaccaaggagaaaaggggaaatggctttagagtagacaacagggatgccctgaggggttgtgtaggttgttcactgcacgaagtcccctggtcaagaaggtaagcggggtttaaacagacccacagtctactcatcaaaccaggtgtccttggcattgtgtccacccagagagctcactattttcttttcttttcttttctttttttgaaatggagtcttgctgtgtcccccaggctggagtgcagtggcatgatcttggctcactgcagcctccgcctcccgggttcaagcaattctcctgcctcagcctcccgagttcaagcaattctcctgcctcagcctcccgagtagctgggattacgggcgtccgccaccacacctggctaatttttgtatttttagtagagacagggccttgtcatgttggccaggttggtctccagctcctgacctcagctaatctgcccacctcggcctcccaaagtgctgggattacaggcgtgagccaccgcgcccggccacaactcatcttttagagccagcctacacttgtcataggccatggccgatgaatgggaagtccacggtggagctgggtgttcctctcaagttcaactggctgcggccaggagggcaggcaggccaggtggacaatttcccttcaaagtggatacaggcaggacatgcaaagatgaatatctctggcactggactctggcaagtaggaaaataaaaacaaaagatgaacatcttgggccgggcgcggtggctcacatctgtaatcccagcactttgcgaggctgaggcagaaagatcacgaggtcaggagttcgagactagcctgaccaacatggtgaaaccccgtctctactaaaaatacaaaagttagccaggcgtggtggcgggcgcctgtaatcccagctactcaggaggctgagacaggagtatagcttgaacctgggaggcagaggttgcagtgagcagagatcgtgccattgcactccagcctgggtgacagagattccatttcaaaaaaaaagaacatctctacaaactggatcaccagtaaataatagctacatatacttgtactcaccatatgtggacacccacatatgtacactcagtcgataaacacccacatttaaacataccatgtgggccaggtgcagtggctcacgcctataatctgagcactttgggaggccaaggtgggaagatcacttgggcctaggagtttgagaccagcctgaccaacatactgagaccttatctctacaaaagagaatttgtttttagttagctgggcgtggtgatgtgcacctgtagtcccaactactcgggaggctaaggcaggaggattgcttgagcctaggaggtcaaggctacagtgagccacgttctcaccactgcactccagcccaggtggcagagcaagatcctgtctcaaaaaataaataaaaaattaataaacaaaaaatgcatacaatgtatagatacacaaagtgtatatatatacatatatatgtatacacattcacatatacacacatgctgtgttcacaatcacctagatgacatatgtatgtgtatacatacttacacatatacccttacatgtacacgatatatctctacccatacactaccatgtacacatgtccatttgtacacagctgtatatgtacacacacaattttgcacacacctgtatatgtatacaatgtatggatccccatatccacattacacacaatgtgtacgcatctacctgtgtacacacacccacctatgaacacaatgtagacacatctgtataaacacacttgagatacatgcctgtgcacataggcaagtatgtgccaagtatttacacacctgaagtagaagcacacacacacccacactatgcctgcacaccaccgcatggccacgttcaccagcgccccgggcctccatctcccagctaacgtgtcccgttttcctcccctgacagccatgctggtcgttcagatgcctttctcctttcccatggcccacttcatcctctttgtctttacggtttccactatatttcacgttcagcagcggctagcgaagattcaagccatgtgggagttaccggtgcagataccagtgctagcctcaacatcaaaggcactgggacccagccagctcagggggatgtggacgatcaatgcaataggccgcctggggaaccagatgggcgagtacgccacactgtacgccctggccaagatgaacgggcggcccgccttcatcccggcccagatgcacagcaccctggcccccatcttcagaatcaccctgccggtgctgcacagcgccacggccagcaggatcccctggcagaactaccacctgaacgactggatggaggaggaataccgccacatcccgggggagtacgtccgcttcaccggctacccctgctcctggaccttctaccaccacctccgccaggagatcctccaggagttcaccctgcacgaccacgtgcgggaggaggcccagaagttcctgcggggcctgcaggtgaacgggagccggccgggcacctttgtaggggtccatgttcgccgaggggactatgtccatgtcatgccaaaagtgtggaagggggtggtggccgaccggcgatacctacagcaggccctggactggttccgagctcgctacagctccctcatcttcgtggtcaccagtaatggcatggcctggtgtcgggagaacattgacacctcccacggtgatgtggtgtttgctggcgatggcattgagggctcacctgccaaagattttgctctactcacacagtgtaaccacaccatcatgaccattgggacgttcgggatctgggccgcatacctcacgggcggagacaccatctacctggccaattacaccctccccgactcccctttcctcaaaatctttaagccagaggcagccttcctgccggagtggacagggattgccgcagacctgtcccccttactcaagcactaatgctggcccattctttgagaccttttctccttctctgcctccctcaagatgagtgcccgggcatgagaagcacatggttccatgagcaggacccatctctcttctgtgaagatgcgttgggctgcaagtaacagaaatctcagtgaacagtggcctggcgtggtggctcatgcctgtaatgctcgcactttgtgaggccagggtgggtggatcacttgaggtcaggagttcaagactagcctggccaacatggtgaaaccccatctcgactaaaaatacaaaaattagccaggcgtggtggtgcacacctgtaatcccagctactcgggaggctgaggcaagagaatcacttgaacccaggaggcggaggttgcagtgagccaagatggtgccgctgcactccagtctgggtgacacagcaagactccatctcaaaaaaaaaaaaaaaaaaaagaaaagaaaaagaaatgaatgggttcaaagaccataatcatgcatatcacataagaccagaagtggcccaggtccagggtcagttaatttagcggctccacaaagtcatcagtcacctgagctccatccatcttcacatgctgtgctaccatttcttagctgtatcatcccatggtcccaaaagggctgctacacatccagccatcacatgcagataattcctttcaaaaacagcagaaagaggctcgttcttgtcttggtcccttttgaagaatgaatgaaaccttcctaagccttccagcaatttccccccaactccgatgggtaggaattgtcacatacccatgtgacccgataggaggcaaaagaaatgagacttctgggattagtttagcctcagattctgcagctgagaagttgatcagccacctctgaaggacatgcagcttgcagaaaattagggtggtgttaccaaggtgaaaaggggaaatggctttagagtagacaacagagatgccctgaggggttgtgtaggttgttcactgcaggaagtcccctggttaagaaggcaagtggggtttaaacagacccacagtctactcatcaaaccaggtgtccttggcattgtgtccacccagagagctcactgttttcttttctttttcttttctttttttttttttttttgagatggagtcttgctgcatcccccaggctggagtgcagtggcatgatcttggctcactgcagcctccgcctcccaggttcaagcgattctcctgcctcagcctcccgagtagctaggattacaggtgcgtgccaccacgcccagctaatttttatatgtttagtggaaatggagtttcaccatgttggtcaggctggtctcaaactcctgacctcatgatccgccttcctcggcctcccaaagtgctgggattacaggtgttagccactgcgcccggccctagagctcactgttttctagttagtccatctggaagtggagcctttttccagtttgcacaaatgtgccatattggcttgtagctggcatgcatccaagtccataggtcctgcctcttcaatcctggctttctagggcctgggatgatcattgctagaactgagagaccagcctggctcagtgaacttcagggcgttccgttcattctttcagtaaatgtttgcagcacatgtgttacatgtcaggcagtgaaaccccccacagcagccttccctctcagaggatacatttgtaaccattacacagtcatcaaaggaataattttttttaatcaccagtgtgcatacagtcatggagttgggtattcccagctaccagggaggctgaggtgggaggattgcttgatgccaggagttagggaatatagtgcaccgtgattggacttgcgaatagccactgcactgcggcctggacgacgtagtgataccctgactcttataaataaataaatgaataaacacaattatgactttgcggatgggagaaaaggttctctgagagcgtattacataagtatcacatgaactccaaaatacatcttaggccaggcatggtggctgtaatcccagcactttgggagggtaaggcgggcggatcacctgaggtcaggagttcgagactagcctgggcaacatagtgaaaccctgtctctactaaacatacaaaacattagccaggggtggtggtgcagacctgtagtcccagctacttggcaggcttaagcaggagaatcgtttgcaccagggaggcagaggttgcagtgagccaggatcacaccattgcactctagcctggacaacagagtgagactccatctcaaaaaaaaaaaaaaaattcttaagagtagatggaatcctattacaagtctggatcaaaaaggcagctttggctgggtgcagtggctcacacctgtaatcccagcactttgggaagctgaggcagatggatcacttgaggttaggagttcaagaccagcctggccaacatagtgaaaccctgtctctactaaaaatacaaaattagctaggcgtggtggtgcatgcctgtaatcccagctgctagggaggctgagacagaagaatcgcttgaacctgggagatggaggttgcagtgagctgagatcacaccattgcactgcagcctgggcaacaagagcgaaacttggtcaaaaaaaagaacaag

SEQ ID NO: 236 - DNA, 10352 bp, Homo sapiens
aatcccacacatgattttttttttttttttttgaagccaaggaattaagtggcctggaagacaggccaactcattacagcctcgagccaaatttgaagttgcggggaagacggacaaacaacaagcttcttttagctattcctgccctccccaattcaacacttcaaacagggcatgttcacttggaccagagagacatgaggttaacaaagatagaagaaaatggctcaatcacttatatacaagatagggtaaggtcttttcatgagttggctctagccatcaaactttatctagatggcagcttatgctacttcttagctatgcagtcacatttgtgatgtgttaatgcttgcaaaagatacactcagaagaagaaaatgcaaaaataagactcaatagtgcagcacacagaatgacagaggtagccacctctgaaggtcagtaaaaaggagcagtagataccaatgacacagacatagtacaagaggtgggacctacggaaggcaggatctgggactgtgaaataatgctgttgggtaggctgttctgtctgctttccgtagtgacctcagcccaagtcacttgaaacccagtcatgggctgatagagattggccttggccatcttccaagaaaagtgaccggtgatgttcacatcctggacgatgaatgaagcagaaaggttctcaggcttagctagcaccttagaaagaacatgacctgcagcaatgcaagaaggaaaaccaggattaggcgactggagaaggtgtgcccaagggatccattgtaggaattttcagcggccagtctatgggatgatattaatagaagcaatgtgaccttgttctttaaacatgggttcagacaatcacccctttgacatatggggataggttgagtaggaatctcctcactccaactttgtactaaatgcttcttccagtcttttggggatcatttttagaatgctcttttgaagatggaggcaggagagcagtttagaccctggcaagacttaactatttcttaaagaatagcattgactgcagtgagaaggtaaatattaaagctgttagaagagttattaaatccgaagcttttttttttttttttttttttttttttaaaaggtgagatcttgctatgttgcccatgttggtctggaactccagggctcaagtgattctctcatctcagcctctcaaagtactgggatttcaggcatgagccgccatgcctggccaaatccagggcatttaaaagactttttcccactgcaagacagggacattggcaaggagatgggatggaaggtacagatgtgaggtttgccaggttggcatggaaagtgtgtgagtataacccacgcagcaaaggggtgggaaaataatgaaataattatatcaaactttcccaaaacacaagcggtatctaaatgtttgccttcatttccaaagggataacattactatcaaaggacatctttccaagcctgttaggctttaaaataacacattcattcctacatctcttccctccacattgggccatcataacacaacttagaaagagaggcacttttggttttcacggtcttgtgaaacgcagtttgacaaggtttgcaaagcgctgctgacaccgtagacctagatgtagaagtccttcaggtgaaaacgtacctgcttcgcccaggcagccaacaggcttgtggctcttccccttaagagcagagcatggtggagtagtgaagaaaacagcttctgccttggagtgactttttggccgtattggttggacagtcaccttatacttgcaggaaaatgacagatcttgaagaattatgtaattttcctagagcaagagaaagagaattatgctagcaataaatctcattagggattaaaaaacactggcaagaattgaaatcatattccatccaacaaggatgttttcctatatagtgtgtgcaatatggcttttataaaaagtacaaagcacatactgtccacattttgattaatgacaattgtgaaacactcccatggctgcgggatatgccttctagaattaaacagtatcataataattcctcatcaaagcaggctacttctaaggtcgcaatcagcatttttgagttggtagcagtgcaggtagtggtgtaaagctgtaaatacaaatctaacttttttcagttaaaaaaaactaacgcaggcttctctgagacatagaattagtttatatgtaagtttttctgttaaaaaatgatgatattctttagcaatataatttttcccttttttggagtgctgttactgttttctgccataatgttgtgattaaatataaataaaagaaagaggctaaatggtaaggagtcacgggctaagaatataactttatgataatgtcaaaagatgacatttcctgtgataacaggtgtgtatctctgtttctttcatatttggctaaatggcacttatccattctgttttgtatttaccaattcttaatgtatatgtataaaagtgcagatggatagctgggcatggtgactcgtgtcatagtcctagctactcgagaggctgaggtgggaggatcgcttgaactcaggagtttgtgaccagcttggtcaacatagtgagactccatggtttttacgtgtgtgtgtgtgtgtgtgtgtgtgtgtgtgtgtgtttaattattttttaagagaggaaaaaaagtacagatggaatatctctggcactcattggatgatgggtaggggatcttgctagaaagcagcagcgttgacgggaaaaacatgagacaagaattaaaatcaaaactgaggcttgagtgatttacttaagtgaggagtggaagtggctgcaggtgacagagcactgaatgttcaaaagagaccgggagtgacctccaggtgtgctggcccttcatccagatggtgacaggagatggggtgcacccaactctgcagccagttagcacaaacagtgaataggaaacaaatcaatctggacaacgcaagaccaacccaagcccaacccaagcccaagccaaggccaccatgtttctttgggagtctgaattgcttttctttggaaataaatctgctctttacatgggactatactggaatccaaggttagctattaaggatcctgtttcacagatatttcaagattgttttcatattgcataggagacagacatctgcagcagtaagtgaattagtggatgctccattgtagcataaaaacaaattataataattggatctaaaggtttaaaactaaatacagataagttctaaacccctagaaggataatttttcaggagtttgatttttatttctaccagatacattacatctgctcagcaaatagttgttaccactttcagagttcctaaagatgataagcctaggattggggaattgcattgacataagcccagttctgtaaggttctgaggcacacacatataagtaaaacaaaaacctcacccctctgcccacaaaaatattaataattccagcttctgtttattgctttctctgcttttcaaatcgacttccttatttagaatgtctgtttaattattttactgaaggtcacaaacattggagctaatttaaggataaatacaaggagaaacattgctgaacatgagacaaattaagtccagtaaaaaagaaaaagaatctgtgtatttctgaaaatccagtgacttgttttatctcactctcttaaaattatgccagcaggtatggttcttaaaatatcgtgcttgctttagaaaatgttcaaaacaaaaatattctagttacatatcacaaaccaaaacattctatgtttggggccatgtttttggattttttaaactgtcctgaggtatcacatataaactgccatcaaagtgtattatacactgtataataaaatgacctcttaaatattttgtgttagtttgttgattctaatctataattcatgaatgaaccccaaaatatttggaataacattttgggcaatattgacagagttgctatcctcagagagtttaatgttctcttaaagttgaaagtcaaaatattggtgcatgctatacaggacagggagattatttcactaactgagctgatggcagttagggacatggtgctcaatgatagagtcacatagaaatccacttgtaccattacacctttagatcacggtgacatgtcaaaattcagaaaataattcaaagcttttgtccagttaagatgaagcacacacatactcagacatatttccccctgaaatatgggagttctttaagaactgtgtctttagtctctgcactttaggttttgctccatgtggataacagagtaagctcccagtgcaatggtgtgaatggataaaagaatgagtgaatataatgaccattctgctttccacttccatcaagtcattactccatagctgatttgtgggaatgagttatctgtttgacctgtctagtttgtacatcctcctgtctaattatgttcacagatcaagttggcctagagatcatgtccttacgtgggtcatgccagatgatgcctctgatccggttgttctgttgtgggcacacgcttcaggaaaccaccgcacatgatatcggttgacagtgggatctataatgccaaaacacgcaaacaaaaataataggctggatgttacattccaggtagcctggggttcttgaacttgagaggagaaaaggagaggaaatgaaactctacaggtgaccaataaatgcacagtgagccaaaggaggtgagattctgattacttaataattataataattagtaattctgaatacttaatcattaagaacaaagtaagggaaaaaagtaatatactgccaagggaaaacctgtgttgaagtgcaagcactaagtagaaaaaaaaattagtaaattcatagcaaaatgattccaaagatgtcttgagaataacctagccatggtttttacagtaagcaaagccctacaatgaaaggcaacacctagcaacagctctcgtaattcctgttgcaaaagagaatcatcagaagtttctcaatcctacctttttttttgataaagatgagatactattgaatccacacaagaacaaaaacattcccttcacacttgcagaattggctatccacgtttatttcctgttatgtattgccataaagaagttcttttgtccaaaggatagggacgtatgcttcccactctcccttaaccaagcgcatcgtggcatttctgtatggctgatccctactgaaatatgacttggtgttctcaaacacaggccagaagactgaccctttgaacacgtttattcccagggcaagaggaatattttctgtacatttctttactttggacaataaagtggggggaaaaaagataaaatagcggcaagcaactcaatgagtgtgggaaagcagaccttgacagtctcgggtttattaatcaccccagtgtgtccgaggagtgtgaaatggcaccaaatggcaccattttgcaggtgatttaacatcttgtcccccaacatcatgccaagtgtttgatgggagttttcagaggagaaaactctttgatgaaattgggttgatctagtgggaacttcgctttgagcactttggaaccagaaaagaagaactttaaatccgagaaagcaaacagatataaaagtgggcactccgggcatttagctaaaagagaaatcatgtactagaggttttaatttttacatagcagacatcaagagtttattttttaaaaaaagaattataggctatgcacaacgctgaagtcaatcactgagtgtgttcatgttcttccattcaacagcaatgaaataatcacacaggagtggctgctgccctcctgaattttacatagtaatggggccaataataacagagaataaatacaatacatagataagatagatattatgttagaacgtagtaagtccacatataaatacagaaggtggctgggcacggtggttcacgcctgtaatcccagcactttgggaggccgaggcaggcagatcactaggtcaggagtttgagaccagcctggccaacatggtgaaaccccctctctactaacaatacaaaaattagccaggcgtggtggcaggcgcctgtaatcccagctactcgggaggctgaggccagagaatctcttgaaaccggaaggcggatgtttcagtgagccgagatcacgccactgcactccagcctgggcaacaagagcaaaactccgtctcccaccaccccccccccaaaaacaaaaaaacaaaaaaataaaacaaaaaaaaaaccagaaggtaagggcagtagggtggattgacaaaaagtgctgattttatataaggcggctggcgtgtgttcaattctgagtcaggacttgaagaaggtgtagcagtgggtagtggcactgcagagacctgtgggagggtgttctcagccagtcctgtccaacagaactggcgggtgtgatggaaatgttctgtctgtggtaaacactagtcacctgtgcctataaagcatttcacatgtcctctgtttaacagaggaatttaattctttattctgtttcattttaattaatttaaatttaaacagctgaagatggccatggttacaatattgggcagcttaaatgctctaccagcagggaatacacagcacgtgccaaagtgctgacatgagaacggagcatgacggatgactgaaggtctttggtgaagagcagtcaggggacttggggtggctacattacagcaatacaaggaggcttggctgccctggggatcctccatatcctaaaaatcctttacatattttacaatgcaattatattttcataggaggcagcatcaagagtgacacatggggcactccttttgggttccctcccttttgttagccctaaatctcgccatgtctgagttcactgcactttcatcttctctctgtgtcacctccatgaatcacttcattgattcccatggtttgaaaaatttttctgctgacagctcccaaatgtctactttcacctgagctagtcccttgaagagctgatgctccctccttcctctcccatgtggaggctttccaaactcaactttgctgtagctaccatgttgatttctgcacctcaactgctccttgcattcacacttttctttctggctgtaggatgcagaattttgaccccacacataaccttcgaggaaggtgggcttcagcaagcaactccaacagcctcagtgagcctcattccctgtatctgagaataaggatactaattcagccaatgcaataggtttggtgtgttttaaatcagttcatgtactggttttctacagctgctgtgacaaattaccttgagtgtagatgcttaaaacaatataaatgtcttctcttctggaggtctgaaatgggtgtcactggtctaaaatcaaggcaggcctgtactcctttctggaggctccagggaagaatgtattttcatgacttttcaggtttctagaggcttctggaattctttggctggtggtgcccttccaccagcttcaaagtcaacaacactgggctgagtccttcgcaccatgccatctctctgattcttgcactctgcttccctattctacttttaaggacttttgtgattgtattcgtttccacccaaataattaagggtaatatccccatctcaaggttggctttgagtcattgaatggcttttctctgccctctgaataaagacactaatactcagcctggcttccaggtctccactgcctctacatattcatctcatgcagacactcctctcgttcccaatgttttgtttgattctgtggttacttcatgaatccctgtcaaccccatttggttagagctccataactataaagataatgcctatttgctgtcactgttgcataaacaaagatgagcatggtgcctggcaggtgataaacagacagtaaacatttaatgaataaataagtgaacaaaggtataccagttcaaattcacttttatttctctactcattctggcaacagtgaaaataattccttataatctaagacacggaagaaagtgtgaaaagacatgatattacataaggtaattaaaagcaatctgagaaagtaaaatataaattaaacttagattaaaaatgccctgaaagtattgtaaatggcacccccaaatgaccagtatggggactaacaatgcccacactcatttatgtgagttgagctcaattttaacagatcaattcatagatatttgctttgatggaagtcatttatacaaacatcatgtccttagctttatcttgctaattactaaaatcctaagagcttgtattttaggttatgactgcaggtctcaatctgtaactagaatattaaaaatagcatagttcaggccgggcgtggtggctcatgcctgtaatcccagcactttgggaggctgaggtgggtggattgtctgaggtcaggagctcaagagcagcctggccagcatggtgaaaccctgtctctactaaaaatacaaaaattagccaggtatggtggcacatgcttgtaatcccagctactcgggaggctgaggcaggagaatcgcttgaacccgggaagtggatgttgcggtgagctgagatcatgccattgcactccagcctgggcaacaacagtaaaactctgtcttaaaaaaataataataaaataaaataaatagccaaacacttcctgaaaggctgtatctgaaaattctgtgctaaatacccagttgatctggttccttagcttaattccttccacaaataaatgacattacaaagaaagtacctgaaaagtatttttaagtgataaaaaatttacctgtaatatgcttcaactatggttcaaaaattagatgggtctaattttcttttcaaatagatgtaactcacagtgtctggcataaacaaagggctctaaaatttttcattaaatgtgaattcctcagttcgcaaaagtctaatgacaaagaatgatagggttattgacattagagctctgagaaagaggcaatccttgggttctccagaataataattgctttaaaaagaattgtaagtcacagcactagggaagggggcacacacttagagaggtgtcacagaatgccaattccatcagggtagggatttctgtctgcctctttgcagtgttttagcatcggaaatggtgcattgcatacagtaggtgctcagtaaaggttagttgaatgaagtcctctcatggatcaatgcctcatactctatctgtaaacatgatctggtgaaacagaactttctgatgtacaactaaaataagaatttttgagtatcacataggcatttctacttaaaatagaagcatgaatgtttcctctatgtctgagctaacttttcacatttacgttgtagagacacaaagtctagagccagaaaaccatcaagatgcagtggctcatgccttcaaccccagcgttttgggagtctgaggctgaaggatcacctgaggccaggagtttgagaccatcctgggcaacatagcaagaccgcatctctacaaaaaatatattttttaaaaaattagctgggcggccaggcactgtgggtcacgcctgtaatcccagcactttgggaggctgaggtgggtggatctcctgaggttgggagttcgagaccggcctgaccaacatggagaaaccccgtctctactaaaaatacaaaattagccaagcgtggtggtgcctgcctgtaatcccagctacctgggaggctgagacaggagaatcactcaaacccggaaggcagaggttgtggtgagccgagattgcgacattgcactccagcctgggcaacaagagagaaactccaaaaaaaaaaaaaaaaaaaaaagaaaagaagagaaaagaaaattagctgggcatggtggtgcatgtctgtagttccagcttcttgtgaggctgaggcaggaggattgcttgaggccaggagtttgaagttgcagtgagccatgatcatgccactgcactccagcctgggtgacagagcaagaccctgtctctatgacaaaaaaaaaaaaagaaagaaagaaagagagagagagaaaggaaaggaaaggaagggaaaggaaaggaaaagaggagaggagaagaaagagagagggagggagggaggaagaaaggaaaggaaagggaaggaaggaaggaaggaaggaaggaaggcaggcaggcaggcaggcaggccagaaagc

SEQ ID NO: 237 - DNA, 10890 bp, Homo sapiens
acttcctgtatgggctccttgaagaggaccagaaaggggagacctctggctaggcccacaccagggcctggctgggagtggcatgtatgacgtgactggcctgctggatgtggagggggcgcgtgcaggcagcaggatagagtgggacagttcctgagaccagccaacctgggggctttagggacctgctgtttcctagcgcagccatgtgattaccctctgggtctcagtgtcctcatctgtaaaatggagacaccaccacccttgccatggaggttaagcactttaacacagtgtctggcacttgggacaaaaacaaacaaacgaaaaacatttcaaaaggtatttattgagcacctgcaggcgtgacctgacagcccaagggtgggtggggtgagggcttgaggacttgggcgggacacaggctccaaactggagcttgaaatagtgtctgatgaatgttaaattatctatctatctatttatttatttatttgagacagggaaagggtctccctctgttgccaaggctggagtgcagtggcgcaatcttaactcattgcaacctccaccttctgggttcaagcgattctctttattcagccccgggagtggcgcgcgccaccacgcccagctaatttgtgtattttcagcagagacggggtttgccatgctggccaggctggtctcgaactgctggattcaagtgatccgcccatctccgtctcccaaagtgctgggaattacaggcgtgagccaccaaacccggcctgattaaagttaaataaatactagttcccttctcgtccaaaggagcagggaatgggaaccgggaaggcacgaagtctctaaagcatccagaagacccctacaccagggtctggtccgctcctattcgccgcagcctttctgttccgcctgcaacccattttccagacagtaaaacggcggcgcacttctttctccgtcaggcaccaggtcataaggaacccaagagtctgtgcctctgaggcccaaattatttgctgtttcctcaggggagccggcggccgcgactcccacgccgcgccgttaccgctccctctctgctgactgctccccctaggggcagagacggtcccgacgcccgccatcccgccccggcctcacccctccccgccaggcggaacgacgcggggaggcgggcgctcggggctcgcgccaggggccccagaatccttcggggagagtgggtgggaggaagctgtgtgggcggggagccccctctgccttagggagcggctgggcacccattcgccccattcaggggctgcactttatagacgttccctaggctgtttctaggctcccccaagtccctcctccagcctcgtcgggtccctcagaccccagcccaggacctgcggagggccgcagcgaggagaggccaacaggcctttccctagagttgaacctgggccgggtgttgcacctggaagaacccccgatttcctggggacccagcagggcaggcggcctggctccgcgctcaggtccggacgcttgtttatgagaagaatttcctctttcttaaaagggcaacgatgcgagtgggtccctcaaggagagaagagatgggaccggtctggtgcgacctgggcaagcgctgcagagggtacctgggcaagagggccgcccgcctcctctgggtttggcactggagaagatgggtccatgccagctgaaggaggagatggatgggggacgtttagcgaagaaaggcatctcccagatcctttagcctcctggaagtgcccccgttgtaccccctacacacccctcttggcattgagtgccagtcctctgccaggctctgtgttacaagttggggagggcggcaaagtcccgaattaaagatgtcagttctcaaggaccccacactccagcggcgggagacagctgtgcaaacaagtccctgtggcaggatgcggtgaagggcgctgcccgtgacgccagccagggaaggggactgaatcttgctgaagggggggtcggcggtaggggggagtgttgacaggacagcccaggaggaatgagagtgccaggagcatgggggcacgtgtgtgcacatctgccaagacctgaagctttctggggacgtcttagatcttgtggggcaggacgggggacggcagagtaatgggcaggttggtcaagaagacacggagacccggctaaagggctacccaggacctgggcaaagggctagtgatgaggtcgcgccaaggtcagtcatttggacactggaaggcgtctacttagagctgcccccattccccccatagtagctctggttcttccagcctggcctcaaatcgaccctccaggaagaggggtgcagagttgctcttctggaagctccctttaggcctcccagggagggcgtggtcgcacttggcactccccaagagcctgctgaatgcaccccgactttgtgcacggctccccgcctccccctgggttgggcttttaccagccctgtttggcagatggggaaactgagggactgtgttggaagagacgcttccaaatccacaggtgccagacagcaccttgctgaatcccgttcctgcccctccccgtttctgacttgtggcccccatgattttatttttcctggggtgcgaatgataaaacagacaaaaaatagagtgcataaagcgacctccacctgtagagacagagggcagctgggtgtagacaacccctacagtgaggacactcgaaggacccccctccccccacgcaatcctggcctctcgctcactccgtaactaactacccgccccaggcgtggggagataagtccagggctccaggcagaaggcgcggctacctctgccgctttgggagcctgggaggaggagttaggtctccctgggaaaagaactgcacgggcaacggcttgaagtggcgataagatggggtggaggaggtgggggattcctgaggaatcctgtgagctcaggatggcgcgtctgggaatggtgggtgtggggacagccggccaggtaccagcccccttcacagagggagaggaaagcgcgccacccaacccaggccaagggcgaggccacgactccactcagtccctcgccacacgcttccttttggggtcatgagggccccgcatccggagataaagccgaggccccacccagggggccggaccgcaggggagacagatgtcccgctcccaggctggaatcccgcctttgcccttgccggtagacccgaagcacgtcgcttcctttcttgaaactcagtttcctcatctgtgaaatgggttaagaaggaggccgttctaaggggtaaatgagattagggggcgcagccagagcaggcctaggaaaacgccagcagcgtgtggcgatcacggtgatgaagcgcaatggtggccgccccgtgggctacccaggagcaggaggagggccgagggatccagcccggggaccggggtatcagtccccgacagtcccctcccgcccctactcccagcctcagcgcacgaagccgccgcgccttctggcagacgccgctcccctcccttcccctcccggcccccgcgcggggcctcccctccccggctccccctcggcagggcctggcggacgtgcgccgcgtcgcacccggcggccggacgggacaggacgcgcccgccccgccccgccacggaggcccgcgggagagggggaggggaggaagtgccgaggggtgtttgtcgggcttggcattattaatttttaaatggtgaacttacaaaatagtaacgacgagtgaaaagaacttcataaacgaggaaaaagaccaacccgcagacccacggcgcgcaccacggaggggcttgcagcgagaagacagggacctccgttcccaagtgcccagcactgcgccacaggccgggtggaacgggccttgagggcctctggtttgaggtcccccacggtcgggctttgggcccaccgcgtgcggcgccgtgctgggctcctaggatcggcagcgagtccagtgactcccaccgcacccccagtaatcacagggcggccgtcgaccgcgggcaggggagggggtctgggaaggcccctggagaaggtggcatttcctcgaggtcggtggaatttggctacgcgaaaggaacagcgcgtacgaaaacttcaggcgggaacgcgcggtggcccgtgcgcggcgggtagacgtgcggggccccgggtggggccgtggggagaggtcggcagggggctttcccagggcagagagttagaatttcacgtcctacagaccgggggcacctcgccctggggctgcggggggcggcgaccgtcccattcaagagcgtgattctgaggtttgcacagctgtttcgggccagcagagccttcgctggctcttgacgtccttgcgaggtgatctctgcgaccaccagacaggagagaagacccattttacagatgaggtagtgctatctccaagtcctcaacgaggaaaccgagaagcctctagtcccgggtcttcagaaaacgcagaggtggagccgcgccgcactcgggcactccccggcgtgggcgctcccggcgggcgggccttggccgagggcgctcggcggcctggaacggtgagccgggtgccgggcctgccacgcagccgcagagactcagccccgccggcgggcggcaggaagggaggcgacgccccctggagcgcggcaggaacccggcccggcccgcctcccagtccgcctagccgcgccggtcccagaagtggcgaaagccgcagccgagtccaggtcacgccgaagccgttgcccttttaagggggagccttgaaacggcgcctgggttccatgtttgcatccgcctcgcgggaaggaaactccatgttgtaacaaagtttcctccgcgccccctccctccccctcccccctagaacctggctcccctcccctccggagctcgcggggatccctccctcccacccctcccctcccccccgcgccccgattccggccccagccgggggggaggccgggcgcccgggccagagtccggccggagcggagcgcgcccggccccatggacagctcggccgtcattactcagatcagcaaggaggaggctcggggcccgctgcggggcaaaggtaccggggctgcggggagggggccgaagccggggcgccgtgggaggagagaaggggccgggatcttccccaggggagccgccgccgccgccccgggcggccgccttagctgtgcccgaagctcccagcccgagagggagcagggagagagtttgaactcagaggaggctcagagacgcggggcggggcctggcgcctttggggcgctcctgttcgctcgaggtgaggaaactgaggcaggaatagagagggaactcttcgggggtttcctggcaggcattgcgtggtgcatgggcgcccccccaccattggcgccaatggggctgggagatgggggagctgaggagggcgcctatgggccacccgctgagactccgccccaccccccacccccacccccccgggctgcggtccggtagggtcttgggagggggcgccgaggtgacagcaggctggggaggcttggagggatctcccgccaacacacagctacgttccccacaaacttcgcgtcacgcgtggaggcgccgaccccctcggaggcacagagaggacggccggcacttccaagagtcgcttggcgcccgcggggagagtcgtgcgcctagtgggcacgcaccaccccgcaaagcctcgccgccccgacgaggctgcgtcccccagcgtggctgggccggggtgggggggtctgtcttctccttttccccgtgtggacctcaggatctggacgctgcccccaggtctgcccaccctcgcctgggtctggctgccccggaactgagggcaaggtggaaaggctagttgcagggggccggaggggggtggggtgggaggggtatctgtcaatcaggctgctgggctccaggtcggaggtctgggcggggcagggcaaacagatggccactggacactggccccaggccgcgggactgcacccctgcctctgggcccagccgcagtgaggacttcgtacccacgggggtggagaggatggagggagggcaggggtggactgccctgggtcccaggccctggctgtcctgagcaggggtgctcaggtaaggtggggtcaggaggcaccgcaatggggctgatcagcagcagtcatggaggctgtgagaggcagggagagagcaccccaggacctccttctccaggccacgcactccctatgtgggcgccttaatacctgctagacctatttgtctgggagctgcaggagccttgcagttgattgtggagccctgacaggggcgtttcagagaaagtcaggagctgccttcgtgtgtctggatgaaggggccacggcaagatcctcctggctcaggggttcacacctgggcacacatgcaggattctgcaggccagtgtgcaccgagcctccaacttgtgcctccctacttcaggtgaccagaagtcagcagcttcccagaagccccgaagccggggcatcctccactcactcttctgctgtgtctgccgggatgatggggaggccctgcctgctcacagcggggcgcccctgcttgtggaggagaatggcgccatccctaaggtgcgtgggggccaggtggggccacgggggcacctggactcagtcttcagggctttaggggaaggggctcctgactgagcttttcaggatggacttgcagacctgaaaggtgcagagtaggagggtggcagcctcccctgccaggccctgcccactgtggggaaactgaattctccctcataagtggaagctttttcctaccttggtttttagagaggtctcaaagagccaagaggcctacccaagccctagagctggcaggggcaaagctgggaagggggaagtatctgttcctggggcctggggttcctctggagacggctagggggagaagcctgcgtgggaggaaggaccaggcccggagagaggcaccccagccagccccgccctccctacagcagaccccagtccaatacctgctccctgaggccaaggcccaggactcagacaagatctgcgtggtcatcgacctggacgagaccctggtgcacagctccttcaaggtgggccctgctcaacagccctcagcccgggtctcggggggcatcccccaccctggcctgggagggaggtgtgtgctggaccccatgccctggggctcctcctccaactccagcagctcttttccccccacagccagtgaacaacgcggacttcatcatccctgtggagattgatggggtggtccaccaggtgagggccaggaagaggcagtggtgggcttggcatctgcctccagaccctaggctcttcccaccaatccggagcgcctcggatgggaattggatacatgtggaatgtcagaggcccagagagggtgtgagacttgtcccaaagtcacacagaacctcaagggcttgtgctgactccaagcctgcagagtgggctcctcctctaggctcccccgtgctgtgctccctcgccccaccctgcccgggacccagttcaagtaattcaggataggttgtgtgctgtccagcctgttctccattacttggctcggggaccggtgccctgcagccttggggtgagggggctgcccctggattcctgcactaggctgaggttgaggcaggggaagggattgggaattagggacctcgtgaggtaggactggccagtggagtggaagttttgatcgttttctggcggggggtgggtacagtttccccagcagtggtcagggtagctggccaagcggagcctgcgggcccagtctccttcctgtgcgcctctgcctccctggcccatgccctgccagccctcggccacccccacactgccccactggcccgcagccccctcactggcccgccccccaggtctacgtgttgaagcgtcctcacgtggatgagttcctgcagcgaatgggcgagctctttgaatgtgtgctgttcactgctagcctcgccaaggtgagccccacaggggtcccggggcaaccctgccctcctacctacctcccgcatgcagcccaatgaacctgcgggccccaggatgacccacctcctgctcccagtacgcagacccagtagctgacctgctggacaaatggggggccttccgggcccggctgtttcgagagtcctgcgtcttccaccgggggaactacgtgaaggacctgagccggttgggtcgagacctgcggcgggtgctcatcctggacaattcacctgcctcctatgtcttccatccagacaatgctgtgagtgcgggctggactgggactgggacaggagctgagacccaggaaggggtcagtccattcaggccaccttggcctcttggatccccagttggggggtgggtgccctcccagtccttcctgcattcattgcctgtgcctgccgcccactcccctcatccacctgccctgtagccatatggtcttttcccctcgcacaaagcagagcatctgccatgcacaggggcccccacagggcaacggagtttggaaagtttcaatttttcgaattgccagttgtgacctactgatggcccacagaattaatttagtgggttctgattgggaattttaacaaaatgaaatagaatagaaaatatccggtcgggtgcagtggctcatgcctgtaatcccagcactttgggaagctgaggtgggcaggtagctgagcccagtagttcaagaccagcctcggcaacatagtgaaaccttatgtctacaaaaaatacaaaaactagccaggcgtggtggcgcatgcctggagtcccggctatgcagaaggctgaggtaggagtatcacttgagccctggaggcagaggctgtggtgagccaagattgtgccactgcactctagcctgggcaacagagcaagaccctgcctcaaaaaaaaaaaaaagtatccgagtgcttcgcacagataaggttaggaattgtgaagcttttgcattgttacgttataaatgtgttttcctggggattgctgtcaaaaaagtttgaacactgtgggtgaggggttttcagaaactgcatgatctgagtagtggctacatagggctggcctggaaattctgcacccaggaccacctgcccccctcatcttcctacacccacttccccaggtaccggtggcctcgtggtttgacaacatgagtgacacagagctccacgacctcctccccttcttcgagcaactcagccgtgtggacgacgtgtactcagtgctcaggcagccacggccagggagctagtgagggtgatggggccaggacctgcccctgaccaatgatacccacacctcctcccaggaagactgcccaggcctttgttaggaaaacccatgggccgccgccacactcagtgccatggggaagcgggcgtctcccccaccagccccaccaggcggtgtaggggcagcaggctgcactgaggaccgtgagctccaggccccgtgtcagtgccttcaaacctcctcccctattctcaggggacctggggggccctgcctgctgctccctttttctgtctctgtccatgctgccatgtttctctgctgccaaattgggccccttggccccttccggttctgcttcctgggggcagggttcctgccttggacccccagtctgggaacggtggacatcaagtgccttgcatagagccccctcttccccgcccagctttcccaggggcacagctctaggctgggaggggagaaccagcccctccccctgccccacctcctcccttgggactgagagggcccctaccaacctttgcctctgccttggagggaggggaggtctgttaccactggggaaggcagcaggagtctgtccttcaggccccacagtgcagcttctccagggccgacagctgagggctgctccctgcatcatccaagcaatgacctcagacttctgccttaaccagccccggggcttggctcccccagctctgagcgtgggggcataggcaggaccccccttgtggtgccatataaatatgtacatgtgtatatagatttttaggggaaggagagagggaagggtcagggtagagacacccctcccttgcccctttcctgggcccagaagttggggggagggagggaaaggatttttacattttttaaactgctattttctgaatggaacaagctgggccaaggggcccaggccctgtcctctgtccctcacacccctttgctccgttcattcattcaaaaaaacatttcttgagcaccttctgtgcccagcatatgctaggcccaccagctaagtgtgtgtggggggtctctacgccagctcatcagtgcctccttgcccatccttcaccggtgcctttgggggatctgtaggaggtgggaccttctgtggggtttggggatctccaggaagcccgaccaagctgtccccttcccctgtgccaacccatctcctacagccccctgcctgatcccctgctggctgggggcagctcccaggatatcctgccttccaactgtttctgaagcccctcctcctaacatggcgattccggaggtcaaggccttgggctctccccagggtctaacggttaaggggacccacataccagtgccaagggggatgtcaagtggtgatgtcgttgtgctcccctcccccagagcgggtgggcggggggtgaatatggttggcctgcatcaggtggccttcc

SEQ ID NO: 238 - DNA, 11687 bp, Homo sapiens
acgaacatgtagatgactattacaatcgttgtatcatctaagacttgatctcctgtgtgatcaaaccacttctgaggaattgccagtttaccaacacattgctgtatcagtcttggacccacgtaaaacattaatacaacatactgcatgattcagctagatgacattctggaaaaggcaaatctatggagacagtaaaaagatcagtggttgctaggggtcagggtaaggaggggatgaatagtggagggcagaggatttttagggcagtgaaacttaactgtatgatactgtaatggtggatgcatgttattatacattagtccaaacccatagaatgtataacaccaagagtgaactctaacataaaactctgctagggaatgttgatggcaaagtaggttatacgtgcatggggacaagcgtatatgggtaatctctgtaccttctgctcaatgttgctgtgaacttaaagctgctctaaaatataaagcctactttaaaaaaataacataatgagctaacaaagaccacaattctaggtcttcctcagaagctttataaatatgcattaaaaaattattttttgggtatactctggcagaaatacaagaaaaacaaaggcccagaatttttccaggagaatagatccagagcgaacatgaacttacttcacacccagattgagtttcccatgaacatgactcgttctcctgagggagaacccctctttggaaagcatgttcacccaggcatgtttgacacaaggaagactcgaagtctggctcccctggagggatgtgcaccatggaggagccggtgtacttcaggctgggactctgatgcttgtccacactgaccattgggctcttgatccaccttcgtacctgcaatgtgcaaaaggaaagaaaaaacaaatgtgtttgactccctttgatgtttattggggatttggtgggaaatctggtgggatgggagctcatgaaaggagaactcggtctcacaacctgtctatctttcaaactcaacacaattcgaattggtcaatgctgttcagtctctttcctagagtatgcattacatggctggtcatttcatcttgctgagtctgtctccgcatttttttttcacattatttttttcttttctttttcctcctgcttccagtggggttagaatttttttctttttagagataggggggtttcactctgttgcccaggctggtcttggtgttaaaagatcctcctggaccagcctgccaacatgatgaaaccccatctctactaaaaataccaaaattagccaggcctggtggtacacgcctataatctcagctgcttgggagaatcgcttgaacctgggaagcggaggttgcagtgagctgagatagccccgctgcactccagcctgggtgacagagcaagactgtctccaaccacaacaacaacacaacaacaacaaaccctcaaaacccaaaaacaaacaaaaacaattaccctggccaggcgagatggtttatatctaaatagcactttgggaggccaaggcaggaggactgctttagcccaggagtttgagaccagcctgggcaaaatagcgaaactttgtctctacgaaaaaaataacttttttttttttttaaagaaaaagatccttttgcctcttaaagtgttgggatcacaggtataagtcactgtgcccagcctgtctcctcatttgtaagattcaggtaataatatttcctcccaagctgtgaaaatgctaccatgttttacaatgttcaagtactttgcctggcacatgtttggtgcccaatagatagtgactattttactttgacccttattattatgattatgatgacagaaatttagttcacacatttctaaggtgaattactagttattcttacaagggaaaatactaatctcatagtttacaatctaatccattgctaagcaaatacatattcactattattattgttattgagacaggatcttcctctgtcacccaggatggaatgcagtggcctaatcatggctcactgcagtcttgaactgctgggctcaagcaatcctctcacctcagcctctggagtagctgagaccacaggctcgcaccatcacactactaatttttttttttttttgtagagatgaggtctcactaagttgcgcaggctggtatcaaactcctgggctcaagtgatcctcccgcctcccaaagtgttgggattacaggcatgagccactgaatccggcccatatatactactgcacaactttgattataaaagaaattgcttctggctaagaaattagctcaagtttgtttttaaagttctaaaactcaccacttgtcttgcttgcttgtaaaatccctataagatacagaaagaagtataaagctattctaatattaacaggcatggtatttatacagcatttcaaaaatcaaggcactttttaaagtgtttgatgtgtatagtttttaatcctcagaacaggcagggtgaggtggctcacacctgtaatcccagcactttaaactttgggaggctaaggcaggcaggtcacttgaggccaggattttgggaccagcctagccaacatagcaaaaccccatctctacaaaagaaaataaataagtaaatgaagaataaaaaattaattaattagtcctcagaaaagttttataagaaaggtactattttcaatcccattatacagatggaaaaacaaacgcatagagatgtgaagcaaatttccccagggcacagtgttgttatggagtaaaggcgggatccaggcaccttgaatccagagtttataaacatgcaattttcttttctttctttttttttttttttgagacagagtctcgctctgttgcccctggctggagtacagtggcgcgatctcagctcactgcaagctctgcctcctgggttcacgccattctcctgcctcagcctcccgagtagctgggactacaggcacctgccaccatgcctggctaattttttgtatttttagtagagaccgggtttcatcgtgttagccaggatggtctcgatctcctgacctcatgatccgcccaccttggcctcccatagtgctggtattacaggcttgagccactgcgcctggccatgagcatgcaattttctaagaagcactgaagtgttgttaagacttatggtcactggtgcttgaaatttattttgatttactatttcactttcatgctcttcaaaactcctgaggattcttttatattcaaccaattagtgaaattagcctatagcaaaaggacaaagaagtaaaatcacagtactgaattttagttagtgatgctacaattattattattattatttttgttgttgttgttgttaaagggtcttgttttgttccccagattggagtgcattggcacgatgacagctcactgcagccttaacctcctaggctcaagcgatcctcccacctcagccctcccaagtagctgggactacaggcgtgcaccaccatgactggctaattatttttaaattgttttgtagagacagggtcttgctatattgcccagactggtcttaaactcctggccttaggcgatcctcccactttggcttcccaaagtgttgggattacaagtgtgagccaccatgcccagcctgcaattaactttttaaaaaacactgaggataaactaaaattgcaatagcaataatgtttaagcaatttattatattacttgatagaatattttgctatcactaaaattaagtattatgaagactgtgaaaatatgaaaaatatttagaacataattatatgagaaaagccaaatacaaaactgtttaattgctataatcacaaatgtaaaaacatatgtactaactataggccgggtgcagtggctcacgcctgtaatcccagcactttgggaggtcgaggcaggcagatcacctgagcccaggagttcaagaccagcctggtcaacatgacaaaaccccatctctacaaaaaacacaaaaattagctgggtgtagtgttgggcacctgtaatcccagctactcaggaggctgaggcaggagaatcgcttgacccctggaggtggaggttgtggtgaaccaagatcatgccattgcactccagcctgggcaacaagagtgaaaactctgtctcaaaaaacaaacaaacaaacaaacaaaaaaaatatatatatacacatatatattttatatatacatatatattttatatacacatatatattttatatatatacatatatatttatacatatacatatatacatatacatatatattttatatatatacatatatatatatacatatatatatacacagaaacactatagacataaagtaggagagttaagaggcaaaatagaaactgctgtgtttattgttagtatcatgggtgttttatctgtttttacaactcttcgtactttaacttttaaaagaataatattttatcagaatcataaatgtatatatatatatacatttctttaaaaaatagagtctcaccatgttggtcaagccaagctggttagaactcctgggctcaagtgttcccctcccagctcagcctcccaaaatgctgggattacaggcgtgagctaccacatccagccacaagtgtcttttaattgctttatttatttatttctttattcatttatttatatttattaagatggagtctctgattgtcacccaggctggagtgcagtggcgcgatctcagctcactgcagcctcctcctccctggttcaagtgattctcctccctcagcctcctgagtggctggaattacaggcaccgtgcccccacgcccagctaatttttgtatttttagtagagacggggttttgctatgttggccaggccggtcttgaactcctgatctcgggtgatccacccacctcagcctcccaaagggctggtaatacaggcgtgagcaactgcacctggcctatatgtactcttttcaatagccatttaaaatatctttgtgaggccggttgtggtggctcacacctgtaatcccagcactttgggtttgggaggctgaggcgtgtggatcacctgatctcaggagttcaagaccagcctgaccaacatggtgaaaccctgactctcctaaaaatacaaaaattagctgggcgtggtggtgcacacccgtaaccccagctgctccagaggctgaagcagaagaacggcttgaacctcggaggcagaggttgcagtgagcctgagatcatggcactgcattccagcctgggtgaaagaaggagactctgtctcaaaaaaaataaaatatctttttgagtttactatcctaaagttaaaattttgggtttccttaaatatttctgtcactatagggccccttaagcatgttagtaggtatattaagaatgtttcgctgattcattaatggaagtctaaatgaaactttaaaagtttgagactccaatagaatgtatcttcttaatgttagtactaaatgtgtttttgatcagtctaaaaagtgttcaatttcattagagatggataatgttttttattattcttattcagatagttttgggcttgaagtctggtaactgttcttgctttgtctccaacgttgtagtttaaaatcaatctttttactctggcttactttcaatgtctcttttgccaagtagatttaactttagggttactgtgaacaggatttaaacagatgataaatctattcaaatatatttgtaagttgtatgcctggactaagaatctttgtatcttgaaatgtatatctcccctgactccctgaacacccgcactctagagcttgagttatggccaacaaaataaaattttttttaaatattcttttttcatgttatttttatttctttttgttttttatttttatattttctttttcttttttttaatatgttacagtctgaatatgttcatagtgacttttctgtttgtttggttggttttttttacagagatacagtctcactctattccctttgttggagggctgtggcacgatcatagctcacttcaaccaagagctcctaggctcaagctatcctctcgcctcagcctcccagttacctgggactacagatgcgcgccaccacgttcggctatttattttttggagagacggtgtctcattatgttgcccaggctggtcttgaactcctggtctcaagtgatcctcctgccttggcatcccaaagctctgggattacagacatgagccattacacctggccagaataaaattattaaagggacatactatttatttaataaaataagtaaactataagtaagaaggaaaataaagcatatgaatgatcaggatcattgcgggtggagggctcaattttaaacagtatgagccaggatactatcggatactccctctctgtccacacagaatgtagcaagggatatggagaaatactccctttctccagaagcatcagagaaaaagtgttacttacaaaaatgaatccagcaacacatttctaaccggactgttgctgaattttactgcatgctttgtcttaaaaaggttttgtctccattggcttagtccttatactggcttcaacgtgtcccttctttatgactccttgacacttttcaccagctttgaagcctcacaagtgatttttacaggcccaattaaggacagagtttacgatgtttgcttgctcttgagagagtggctggaccgacccagtgaatgcacaggagttaggcaaggtgcccttcaaaactgctgagtagagaaatcctcccacggcccctcggggaattcaagctacaactggcccattgtgtttcctcaggctgcggattgctttactggagggagtagctgactgtgagtggctttgggagcccttcataacaatggctggaggagagctgcagcagctgtgtgtgcgagaaacacgaatgcccggatgccagcggcagcctgggctcctgggcctcctgggccacctgggccctagttttattcagagctacacaactgtttgtgaagcgcattgtaaacaaacatagacggggtgagacatcctctttatcctgaataaatcaagaattcccaggccgggcgctgtggctcatgcctgtaatcccagtactttgggaggaggcgggcggatcacgaggtcagtagatcgagaccatcctggctaacacggtgaaaccccgtctctactaaaaatacaaaaaaaattgccgggcgtagtggagggtgcctgtagtcccagctactcgggaggctgaggcaggagaatggcgtgaacccgggaggcggagcttgcagtgagctgagatcgcgccactgcactccagcctgggcgacagagcgagactctgtctcaaaaaaaaaaaaaaaaaaaattccctcacttggggtttataggagactgttctccaaaccacaccagacttttagaagcaactacctctacagataccggggtgaaccagtaaggcccttcatttaactagacagaaactgagtgaacagtgggtaaacaaaatattcaaccaaattctttgctaaatccagtccaccttggttttattaatgtctttacttggaaaaaaaaaaaaaaaaagccatccaaaagcaatccctcagtctagaaaattgccagatgtgattaaagagattggctggcttctagggattttccacttgtggttttttcctattatctaagagcaaacagatattactattaatttaaaatagtttagctgataatgatatcaaccgatacaggaaaattatagagagtttaggtacttaggtgtgaactcaggtggcaacacctactctcattggcccccgtccttttagggggaagagctgactctcttaaaaagccaagagagcttgaagttgccttctgtaatttccaaacaggcattttttttttttaattatagagaactgactttgcttacttgacgcctcaataactttcaatttcgagagagtcagcccagttttctagtgaaattacttggataggtcaatagattataaaaagggaggccaggtgaggtggaggccgaggcaggtggatcatttgaggccaggtgttaaagaccaggctggccaacatggtgaaaccccgtttctactgaaaacacaaaaattagccaccatggtggcgtccacctgtaatcccagctactagggaggctgaggcaggagaatcccttgaacccaggagccggaggtggcagtgagccaagatcgtgccactgcactccagcctggatgaaagagtgagactctgtctcaaaaaaaaaaaaaaagagagagagaaagtaagagacctgcatgcctatgcctctcccagagggtgcatgctagcaggttagttacggcatgagtgtaatttaggagaaggctcctggaagcaaattcatctcacactgatactggagcctgaagctgcttcatagcatgtctcctaaaatataacagtgctgtaatattcagtaatattaatcagatatcttcaccccagctatatgtcatcatcatgtatctgtcttttctctctctcttttttttttttgagacggagttgtacttttgttgaccaggctggagcgcaatggcgcgatctcagctcactgcaacctccgcctcccgggttcaagcaattctcctgcttcagcctcccgagtagctgggattacagacgtgtgtcaccacatccagctagttttgtatttttagtagagacagggtttctccatgttcgtcaggctgatctcgaactcctgacctcaggtgatccatccaccttggcctcccaatcccaagcctgttgggattacaggcgtgagccaccgcaccaggcctattactgtcttttctctagtgtttgtagtgtttattgcttgtataaaacaacaggacttttatgctaactggtcttgatattaagcctatgtcacctttccaactggatcataagcatgagaatagcttcttaggccttaggaaaaaaaaaaattccagaggctagtgtatgggcttacaaacaaactaggtaataaaaataggaatctcttgattgcttttaatatttacttatagatctcaacaagttttgctaacatcctccatcaaggtaatacagattttctatttaaatatttctctttaacacgcaagacctatcctggagcaggcaccctgagaagatggagtgacttttagaattccctgaccttctatgctgttgtccttgggatctcccagtcctttcctctcaccttgacctagttgcatcctcttctagattctcaggggccaacctgtgtctccaggcctagtccggaggatggagtggtggggaggactctggggaagtgggaaaacggagacgcaatgcgtccatgtaccctatttaatgttgctgctcacagcaggcagcaccccagctccgtctcttcagaggacagtgcttgcctgttcttctagctcagtaagtataaagtctccctcctcatcctccccattgaggaatccaccccaccctgtcccaccccaccccaccctacactgccaagtgttaaatagataaagtgcaggaattcatcaacgtacgtttttctttggaaatacaggtgaagtttttctcatttctttaaattgtgggactctgccaggtgcggtggctcatgcctgtcgtcccagtgctttgggaggccgaggcaggcagatcacctaaggtcaggagtttgagaccagtctggccaacatatagtgaaactccatctctactaaaaatacaaaaattagtcgggcgcgggggcacatgcctgtaattccagctacttgggagactgaggcaggagaatcacttgaacctaggtggcggaggttgcagtgagccgagattgcaccactagactccagtctgcagagtgaaactgtctcaaaaaaaaaaaaaaattgtgggactcattcttttcgtttgaatttgtctttcctcgatatgtactttttttagatataaaaaattgttttaaaaagagaaagtaggaaaattattttaggtactatctctacgggacagtgtatgttatttgcttttggaaattaaggctcagggaaaatagaaatgctggtgtaatcagtggagaagaacctggctatcctgtccgtcaaaatccactgagctttggaaacaacttcctcccctctttcctccaagaaatccccttttccagtgttttttttgtttgtttattttaggttcaagggtacatgtgaaggtttgttacacaggtaagctcatgacaccgggatttgttgtacagattatttcatcacccaggaattaagcctagtacccaatagttatcttttgtgctcttctccctcctcccactcttcaccctccagtagaccccagtatctgttgtttccttctttgtattcatgtaagttctcattccagtgtttttctgtttgtttgtttttttgagatggagtcttgctctgttgcctaggctggagtgcagtgatgcgatcttggctcactgcaacctccacctcccaggttcaagcaattctcctgcctcagcctcccgagtaactaggactacaggcacacaccaccacacccagctgagttttgtatttttagtagagacagggtttcaccatgttgaccaggctggtctcgaactcctgacctcaggcaatctgcctgcctcgacctcccaaagtgctgggattacaggcatgagccaccgtgcccagccttttttttttttttcttgagacggactcttgctctgttgcccaggctggagtgcagtagtatgatctcagctcaccgcaacctcccgttcctgggttcaaggaattctcctgcctcagtctcctgagtaactgggatcacaagtgtgcaccaccatgaccagctaattttttttttttttttttgtatttttagtagagatggggtttcaccatgttgaccaggctggtctcaaacttctgacctcaggttatctgcccaccttggcctcccagagtgctgggattacaggcgtgagccactgcgcctggcctcattccagtgttgttgttgtttttttaactgtctctctctctctaggctactgtctctcagcatattaaacaccttgttcttgcaatatctctaaaagctagcgaacagactgcaagcaaaacatcctctttacacccacaaactcttcctttttcccgcagccacctttcaccaccacccaactcttctctcttagccgagcttcatgaaaaaataatctccatttcctcatctcacattttctcctcaacccatttgctcattaaatggcaatttgttcattaaatggtatttatggattgcttaatatttgcaaggactaaagcgaagaacataataacaaaagtctcatttcataaaatgaagcttgcacaaagatgccaataaacctcattgtcaaatccaatagacatttctctgtgcttacttcatttgcatatactctgcagcatttaaaagctttcacaaaggttcaacaactatttgcctggca

SEQ ID NO: 239 - DNA, 11728 bp, Homo sapiens
agtgctgataggaaagatgttagtgatgagagatgttagatttcagcgatgttccagatgggggccaaggggagagcctgataaccttatctaaagccactgggggatttctgggccaccactctgtgcctggcctcctattaggctctaggggggaaagatgtcccctgtcttcagcagctggggaaggggctcctcctcggagctttagtcccagggactgtgatgatggcaggaatgtttggaaaaggccctggggcaggtcttgacagtcactctctccaccccaagcttcccaaatctgtggggttggctttccactgtttgggagtggtttgtcacgtgctggacaaactctggacggctccattgggccagttagggctaagcaggcatctgagagactgagaggtgctctgccacatccagcttaccctggcccccttgcaggacttggtagaatgggggatcggctcccctgccagaagtgcaagctcttagatgaggtcagaccccagggcccctttaacactggcagccatcaccctggtcctctgccaggcatggggtcagcggagctgccttattttaccccctgcccttggcgagtttctaatataatacaagtaatactaacctaatcacagtctggtccttcaaagggtggccttggccagcagtagaactttgtagtctgggtccctagcagacaaggtccccacccctagtgacacccctggattcccttcggcaggaccattctccaggctggggtgcagtggcactatcacctctcattacagccttgacctcccaggctcaggtgatcctcttgcctcagcctcctgagtagctggaaccacagttgtgtgctaccacacctgggtaattaaaaaaaaattatctgtagagacagggtctccctatgttgtccaggctgatctcaaactcctggcccaagtgatcctcctgcctgggcctcccaaagtgctgggattacgggtgtgagtcactgcacctagacaggcccactcttaagacttcccaacagccgaggacagcagttcctgggtgaccctgctgtagccaagggacgtttcccacctgactggtccttggtcctcagtatttccgtcctgatgtatttccatcctgatgtacttccctcttagcctgggaagtggggtaggaagctgagggagggaggctccccccaccccagctccattctcccatgggcccccgttcaggtgggctggagaacaaggagtgggttgctgagaccttgaggttggagctgcggcagcctcttgtcccagggcggtctctgtaaggacaggggccactggttctggctccggctccgaacagccctgttccttcaggtggtgatctgtatctacccaaggtgatcaccctcttccctggcctcgctgcctctcctcttaggtaagggcaccactgcttcttgttgggggatggtggccctgaagagaaaaaacaaaaactcaactccagcctaataaccgccccacagagagcccggctcaggtctgtaatttgtctggctcgtcacgggaccggccacattgatagaagcactgatacctttctgccgagattaatgatgtcccggcggtggtaggcgggaggcctgagacttttattttttgtgccattaaatgacatccagagacttccactcaggacctgaaaagccctcgttccatcacatccaattactccgggaggagatttgctgagtggctgatactgcgggctccagaggctttcgggtagtggggggcactttgactttggcaggagtgagagggaggggatgccagcagagtttcggggtggtgaggggtgacctgcgtctcctctggagagaggacccaggagggctgaagagtggaagctggttctaattatccagccagtgcatcccctaggcctcctcctcccttctgcagctggggttggggcaggaaagggatcaggaggatgggagacttcaagctgccagtttagcttccagtgataaattccaatatttggtagtggcaacaattggctggagtttggggtagaatctgggggcttatctgtgtggtttcttcacgatgtgttcaacattgcttgggatggctgatgttcggctggactgggacttgcttcttgaggaggtccgcctggggctcatggagatttcaggcagttcccagcctgggtgcctgtctgagtgttgcccgggatggccccagctgggtggctgccaggcccccagttctacccgctcggccaggtgggtggggccctttggaggaagagcgcctcctgccacaagcccacacagtgatcaggggctgggccctgggggatgctggggctgggccaggtgaaccaccatgggaggtcacgagggtgggctgagtgtgtttgtgtctgtctgtgtgtgcgctggtggggggcagtctgagggcgggggctggtctccaggcagggccccctttcctctcaggcctcttccctccatgcttcctgacaccatgtgctgctgtgttctgctactaggctggtggatttcctcccagcctcatccctctgcagcaacatctcctactcttgaagctgcgtggggctctgctgcccttggccccatgattccccttctttctcacccaccgaggcctgcatgccttcagatgccacaagcaagacttcaaccccctatgtggcaagtccctgcccgtctctcctctctgacccctgtgggtgggtggttccacctctgagctgccgaatttgggtgcctgtggtgctagggagcggcttatggctgcctggcccaggactcccattttgcagtgagcaagtttcccctctgagggccctgaggctgccctggaggtggtgacccaagcctctcttgcccgttagtttccagcacgttgacaccatcctgggcgctcggccttggagtggcttctggagcaagctgtggcatgtcctctcgtggggcagagaggggatttcccctgctcgcttgcaagaggagtgtgaggctggcttgtgacacctctgggtgaggtgaccgaggtgtggtgtggcacagaccgcagctccccaggattctgaggctcagccacagccagggagggggtgtgtgcgtggaccattctgggcagctgctgctggccaaggaggcctgggacagcaggatgcaactgtgctctgtctgtatccccactggggcccagaagtctgggtcaggagagcggggatgtaggcaaggcggtggcaggtgcaaacagcccttccctggaagtcagaagaaagtcaaatggctgttaactgtggacgcccttggtaagtcatgccactcactgtttcaggctttgctttcctcgtttgccctggggtaggggtgatggccactgtcctgcccccttgacatgggtggcaaggggaaggccagggaggggcagggtggctggtggagaggctggtggagaggcagccctgcctgcctgggattgggacagggaggacgtcgatcaatgcagagactgtcacttgtgggcatggtactcacagaggtggctgccttctcaggtgctgaggcaagctgacgtgtgtttgcaaatgtgggggtgtgagaacgtgcagatccatgtgtgtgaatggcttgtggatgtgcatatgtgggtgtgtctcacacacagacacactcattaactgaaagccaacagtgggctgggcacagggacaggtgggagaagggaaagaaggcagaggtgagcgcttctctcaaggaactgatagtctcatggtggaaggggggccgccacgagtggcaagtgatttagaaatacaaaagagatcaaagcagatgtctggggaggcacaacaaatgctgtgtgagtggagaagacgatagagactagagatgccaacagcaggttgggggaagcctggctcagcggatcagccttgtggggttgttctagaggatgtgatggagggccagcagccgggactggtgcttggaaagtgggcaaggcattgcgggtctgggaaggggagaatgagacgcccagatgggcagtggtgggcaggcagatgtgagcaaagaagtagttcagggacgtctggcagtgtgccgcacacaagggcaatggtacaaggtgcaaatgaaatctgcctggaaggaaagatgtccccctcagaggggtgttcacttagaatcagagggagacagcccagcatgtcacaggcctgagataatggcatctgcaaatctggaaaggcaaagtgtggcctttgggacaagcgtcacatagctgtcctgtgacgctggccggccagcccttgtcagaggcaccagttaaggctgtttagatttcaggggtctctctgttcctcctatcttggggaccagttatgcttgtgctgtttgaatatctcccctgactctctcagtgagcaccccctatccatagagctacaccagggtgactccacacatgcatgagagcagggacaccatcacatggtgacttcttacagcacccaaaacagcgccaagtatacactaggcatctggcatcagctgagcgaatgcagaaggcattactgagttatgccaggcgtggtttgaaagtggccagagaggaaggagctgtgcaaaggtaggaggagtggggtggcacggcagggtttcatcagctagaagtggggtagctctaagcccctccacgacccttgctgtgctcctggcctcgtggggtctgatgcaagacctctactaggaagtatcagggctggctgggaaagtcgagcctcatcagttggtccctgcatttatttggcagaacagggaggccaggacattccgggaagctgggagcaaatcaatttcaggtcattcaattgcagatcaactagtctaaccctgtatcttgatgaggtcaaaattgagacccagggaggggaggtcacctggccaaggtcaaacgatcagagtcgggacatcaagatctcatttgctgaccacatgtacattgtcctgtggtcacagtaaaaagaggaatcctggggagggtttcacctccttgggtctgaacaatgccatccccacatccccctacatagtcatgacaggctctactagaatcatctcaagcctccttcttcaccctaagcctgtcatttacccataagatccagggagggaagaggcctgaacaggatggggttcagtggcccgtctgccatagacgcccctctacctggctcctgtaggctgacctttcccctcgagtctctagaagcttttcctgcctgttcacccaggggacacaagcagctggttataccacactgcccccctcccaacccctgacaccctgcttcctccacggattctctcccctggagagaaatctagatcaaggcaagtcctgggacctgtgttcattggcaggaccccatgctctggcctcccaagcactggtccagccctgggctccgtaagtccccaggcaccgtccaggtgcttcagagagcaccaggccctgagtgtttcaacatcgtgcaaggacctggggtttctgcttttgcaatcgcccctgggttcatccacacctcactgcctcatgtctcgacccctctggtggtgtcctgtcctctcattctggtcagttctgcctgcccctccaggttcgtcgtctccaaagagtgacttttgagtgttgcttctctggtaaataatttctaacggcttcccagagtcaacctgcaaaagccactcctctgccggacttctgagaaccttgtttttccccttcccctccattttctcacttaaaaaaaaaaaatctatggtttctccaacccagagctccctcttccttcactcaaggattcagatctcctccttctctagggcccagccctgctccaacctcctccccatggcctcagggccagagaaatttgtagatcatctggagccaaccccttattttctagattaggaaactgaggcccagcgaggttcattgattggcctcaaagtgaaactactaactagagagaggggagtccagattgcctcactctacaataaaacacctttatatcctctctggctggagagagcacagtgttctggagggaaaggtatgacaggaagggaagagatctatccctgagtccacagacttccaattgtccttacagttagaatcacacaattaagtgtttaattacaacctgctttgcattgttgtttaattgtttccaaagtagactgtaagccacttggggacagggaaaattcctggtgcccttgattgtgtctcctctgaagttcccagcacagcgctgggcacatggaaggcatcacatggcaagactgggaccttggctggggctttcatctgggagggccatttttttttttttgtttttttgagacggagtctctctctgtccccaggctggagtgtagtggcgcgatctcagctcactacaagctccgcctcccaggttcatgctgttctcctgcctcagcctccggagtagctgggactataggcgcccaccgccacgctgggctaatttttttttttttttgtatttttagtagagacagggtttcaccatgttagccaggatggtctcaatctcctgacctcgtgatccgcccacctcagtctcccaaagtgctgggattataggtgtgagccaccgcgcccagcctgggagggccattttaaaccctgtacagatgcaagtccagtttctaagttccccatggacaaaaggtgggtcaaggggtggggtggggaagtacacaagaccaaacaacgcgtttcaggcccagcgcgttttggcttccttgcctggtcaccaacatcttgggaggggtgggtcaggcctctgctggtccctcaggccactgtggtttctggaggacaggctgtggtcgagcctcaggagccccagcacgcagagtagggaagcgtctttggtgtatgcagctcccttcctctcccttgtctgtccctcctcatggcatctcccgatgctctatccttccctccatcctgccttcagaaagcacttcacccccgagagactcccgccctgggcataggcatggtgatcccggagtctcatggtggggctcagaggcactgcttcattttatgagaaccccatgggtgggagaatgtcataggctgaggtcccgacatctttggtgagatcggtagccagggtgctggagacagtttttcttggtctgggcaagatacataattttgtttccttctctctgcatctaaacttaaaagtatgtctttggcaaagccgtttaaacagattcacggattggcaaggtgctgagggcacctggggaaggttcactggtggtaagtttgcaccagctccactcccagggtggcctggagccctctgtgataggtgggccctgctcggcacatctgaagggccctgtcgctcaacctgtgcctttctgggctccatgttcctctcctgtggggcctccggcatcgcggttgtagcaatacctgtgccagcttcctagtgggtggatgtttggtcgaggtcactgggtgagaggaaatggctgacgacacccaccctcccacttgccttcctgccagcctgggggatgtgcttcttgcacttccagatggcattgttcagtctctattgtcttcccttccctaaaattggggagctgagagtgcaggggtggctttatttcccattttctgcaagagaaatctaaggctcagatggcgggtgggggagtcgggggcatggctcacactgggtcaggtgagacacttgtggcatgctgcagtggccaagtggccaccgctcctgctccctggccctggtggcaggaggaccgaggccaagcaggcggggttcgccattaggaggctatagggagttggtctgctccagaagccaaggagggctgctcagagaagctagtggaggggggatggtgggggacatcttcccctcatcactgagatggcacagccgacccagtaattagcaacccatgaggatagactggcagggtggcattccagggccctcttgcccagatcagactcaattacagagcacaatgacttgccaaagttcaggggcagctgcctgcacatgccatgcaaagtttcggggtactcttctccctggctgcagtcacctgctttgagaccctgccttacataccaacccacccaactggagcctctacactggtctgtgggacttacttctcaagggagaccacacctgatgccaacatctttagggcactccttccagttcactcccaagaaacaccagccttcgaccccagtctccaaggctcatgagtgggggtcaaggccccaatttccccgtaaatgcctgaagcgtttgttccaccccagaattcaccccggtggtggctggaaggatggggaggtcttacctcgagttttgttttccttgggaaggagagagatgacttttccttcctgaagatagacaaagaactggtagcgatggaagccactgtgtgccggtggggagggagcctggtaggctataggtagaagcaggagagaggtgagcatcaacatcccatactaccgagggcagagctctctgccttcccatggtcctgctgacctccctggggccccagatcagcactcggccctgcaaaacattaggatttgtatttggcgggatctcagcttcagtattttcatttaagaagtacatattttggtgggggtgagagtgggggaggaggtggtccaagaggaaacaccctgagctggcttgaaggccttgggtgctggcgtggctcccaggcctttatgggccagtgggtgttggcattgtcctgtttttgctttagtctatcctgatggatttcctgcctcaagagaagcccatcttcctctgtgagtgtgtttggcagaggatttttatttattttttcggcatttgcttatgaactcaatccccaaagaagccaatttcttggctgcgtctggagggtctggaagtggttacgagggtgggtgggactgggttcaaaggtttgatcatgggagctgtaggagctgggtgctcggggcatcagggagaagttccctctcccagtccttctctctccctccaggaggctgagctctttttttggggcgggggaagtggggtggggacatccctcattctttccccaagtccatgcagagtcaaggtcctgctggcctggcctaggtctttcaaggtgggcctctttcccagagtgcttcaccccttcccactccccttcccgctctccatcttcctttccaaggaggagagccaggctggagccaagaatctttctgggtgggtgggaaagaagcatttgcaatgaggatgttggtgggagggagtattggtcctttatggccatctccccttctttcctctcctgatcattaaacaaaagcacgacttgctgcttggagcactggaagagtccctcactgtgcacttccggccactggtggcttccagcatgccaacaaccggggaattcctgacgattcatctttccctgcatttttggatcgcagatcagatatatgtgtgtgtgtgtgtgtgtgtgtgtgtgtgtgcacgcgcatgtgcactcagagtgagagcagagctgggtgtgctgagagccatgtgtgtggttggaggtcccactcggggtgggtgtgtgtacatgaacagccagtgtgcaaacgccccgatgctgttttggagggcctgtgtgtgtgtaaatgcaggtaaaggagcatttcttcctaaacaccgccagggctgagaaagacttctgagcacaggtgggtgccagggagtctcctcgtgtgcttaggtatggagggcagatgggacaagtcagtgtgggcaagatgtgtgggcatgtgggctgtggagtacactccaccgtgggcacacttgacgctgcccaaaactggtgacctcagttctgtgcggacaagtctgaagtgagaactcactggatttgtgcaatggagaatttatcctctatctcctcaagggagatagagactaatgcctctcactagggctttcctcaagaatcccctcttcaaaacctccaaaggcagagaattgaggcgtgaggaggaggggaaagggttcacacatgctagaccacttctccgggccaggccctgggctgtaggccttcacttatgacatctcctccatcttcccatttcctggaggcttgagaggtaaagccaggccaacagtgagtggtggtgctgggatttgaatccaggcctgcttggtgcccaagcccacgctgcttcacggaactgcagggctaagtttggtgcccagtgctgtgccagaggccagcccagtacctgagcatccctttcaaggtaggttgggggcatcctcctggggcagggatctgagagaggggagctgggggaaggatgggggtggacaggggttacaagcagcctccagtcagatggccccctgcactgtgaagctggctgcattctttactagccattcacatggcgcaggatggtctgtgcctcagtgttatcctcttaaaatggggacactgatggcagtgaccataaaaggcagttgtggagatgaaatcagggcatccaagaaaactctcaggctggtgctagcacacgacaaagcagcaccatgaggttttgattcctgtgatcgtcactgatgccctggctgggggaaggggtccctagggtcttactcacctgataactcctggccctgaatcttccctttcttcaggtcggcgccctgaaagaagagacaagcagggctgtaggttatgtcttgggcacacttcaggccacgtgggctctgcgggattgcttctctctctgcaggaggaggatgggagaggaaggaggatgggagaagaagtaggatgggagaggaggaaaatgggagagcaggaggatgtatggctgcttttgggagacagggcagtgagtggggttttggaatgggtacctcaggggatccagggaaagaggacagacacacgtattgctgaggggggcaaatggacaccttccctctagagaggccctgtaggacacttcccaaagagctgttccacgatccctattggtgcctgagactgggcgctacacatcacctgcagggtctggtcggatctaagggaggcgcttaggtctgcagttctctggatcttactaaggagcccatcttctctggagggaggactctgctccctttggagcctttagaatattaagcaatgggctcagagcaaccagcgggggaagggaaagcaggaggaggctacactgcctgattctgtggcagcttctccccaccctcagttaactcagcccacaaccctggggcagtttctttggccactgggacagcctcagtttccctcctctctttccctccctcctcccctccactcagtgtctatgggataatgaggtgaccccgggggtgggtgctaattactgtttgtgcaggactgggagatgctcagatgaaagagactggagccgggcccctgggtctgtgccatggctcaggggccccaggccatgccagggagccccaaggcccc

SEQ ID NO: 240 - DNA, 13437 bp, Homo sapiens
acaccctttacttgactttattgccatttccaaattcaaccacactgtgacatattttgtaattactcttgtgaaaatgaaacatcatttttactcagttacctacaattatatacaatttttgaccctaacttactgctgcttccacaactccaccaatgacactgcaggtcaaagtcacgagtgaatttaacttgtcctcatttttggtgcacttgacactatggcccattatatctatttgcttgaaactctcactttctctgtctctgtgacattgtgctgttctagttttctaccagttttctccttcctcttcctccactggatcccaatgtttctcagtactctttgtggcctctatgtgctcatcagcattcacaagttcaaagcacccctcttaagctgatgactcccccactatacttccaaccctaaccactcagccaggcttaattcctatatttttagctgcctataggatcattccatttgcctaaaaccaaattaatcatatcctccctacaaaacataatgtattcaaaacaaacaaaatagaaaaatctgcttccctttctagcttcctcattttagccaatagtgccaccattttccaagtttcaacacttgtctagacaagagtcatttttgactcctcctcctccttaccttgcacaacctctacttaaatccaatcactgaattttcagatctggaaagaactttcaagataatctagtttgtgctccttaaacataaataagagaccttggggctcagacatattggctgcttgcctcaagttcttccaaccctgattataagacactttctattaccaagacttatttaattgcatttttccaaaacttccacacaaatctttttttttttttttgagagggagttttgcactgtcaccagggctggagtgcagtggcgtgatctcagctcactgcaaaagagggttcaagcaattctcctgcctcagcctcccaagtagctgggactacaggtgcccaccaccacacccagctaattttttgtatctttggtagagatggggtttcaccatgttggccaggctggtctcgaattcctgacctcatgattcgcctgccttggcctcccaaagtgctgggattacaggcatgagccatcgcacctggcccacaaatctgttttctttgtagaatcagaagatctgggtttgaacccttaaaagctgactataagcaagtgaatagtaactgctagtttaaaaactgcctcctgatttagaatttatgatagaaatcagattaaatttaaactcctcaggcaggtattcaaaccctctcccactcctcctcctaacccaaactggctgactttagtatcaagcatggtttctcactgaacaaattctgtttcagttggcaggtcttcttcccatctttatctttctcattcctggttcttgacttccactcagttgtttccccagcctagaagagccttacacctcagcagacacttcctttaaggcccagattgaccagcattcccagcatgggtctttctttttttttcaatctccacagcatctcaactctactgcaaaatcttacacaatatatctttcacttatctgcatagtgttctccaaactaaggagctaaataatattaaacactcaaatttataataaaggcttgcaaatttgttcttacaacgaaacactggattctgctttttagaaagtattaaatttgatttacattcaattttactaggccaaaattaacaaacaagggttatttttttcacagtgactataccaatacagtttttcaacagtgaatagaatgcgtgatgccctcgaggagctcataatctagtgttaataaagctagatatgcagacagagaaggttaaagaacacaacataacatataccatcttactcatcagcttacttatgtcattatttcaacatcaatccacagccaaaaacctggaaataaaactgttatcatgctgggtgcggtggctcatgcctgtaatccaagcactttgggaggccgaggcgggcagatcacctgaggtcaggagttcaagaccagcctggtaaacacagtgaaaccctgtctctactaaaaatacaaaaactatccgggcgtgatggcgggctactcgggaggcagaggcagggagaagtgcttgaacccgggaggcggaggttgcagtgagccaagacgcgccactgcactccagcctgggtgacagaatgagactctgtctcaaaaacaaacaaacaaacaaaaaaaccatcctcggctgggcgcagtggctcatgcctgtaatcccagcactttgggaggccgaggtgggaggatcacgaggtcaggagatcgagaccatcctggctaacacagtgaaaccccgtatctactgaaaatacaaaaaaaaaaaaattagctgggcgtggtggcgggcacctgtagtcccagctactcaggaggctgaggcaggagaatggcgtgaacccgggaggcggagcttgcagtgagccgagatcgcgccactgcactccagcctgggcaacagagtgagactccgtctcaaaaaaacaaacaaacaaacaaacaaaaaactatcctcatcagacacacaaaacctccacagcaataaaatagcaaagagccatggtatttgtaccttttatccacaggagtggctcacttatactctgtctccacatgctcagttacatggttttcttcagggtttgtctgattagaaggtgcaaattctaaaaggaggctaattctaaaaacttgccaacaagggaggaaaaaaactacagaactaaacaatcaaaatgggttcactcaacaaacactgagtacatccttactgaatacaaagatgaagactacaagatttaaatatgatattttcacccggagattagtaaagatttttttaatgaaaatcccagtactggaatcaagggaattgggtccctcaaacactttgaggggcaagggggaatattctggaggacaacgtggtagtatgcatcaaacgctttgctgtgcctgccctctgaattagcaattatgctccaggaatacaggctatgaaaatcagaagcagcaatacagacctatgacaagtaggcttatcaccacattaattgtagtgtgatcataaatataatgtatcttccaggatgaacatttatatgacaaaatacaatgcagtcattaaaagctgccacccagaagtctgaaggatataaagaaatacagatgaaaacgtcataaaacaggccaggcgcggtggctcatgcctataatcccaacactttgggaagccaaggtgtgtggatcacctgaggtcaaagttcaagaccagcctggctaacagggtgaaatgccatctctactaaaaatacaaaattagccaggcatagtggcgcacattggtagtcccagctacttgggagggtgtggcaggagaatcgcttgaacccaagaggtagaggttgcagtgagctgagatcacgccatcgccattgcactccagcctgggcgacagagtaagactctgtcccaaaaaaaaaaaaaaaaaaaaaaaaaagaaaagaaaaagtgataaaaccatatataacgtataatcccaatttttaaaatgaccatattatatatataatatatatttgtaataaatatataaatcctggcccttctacgtacaagcttataaagttgaagttttttactaagtttcattttcctttttgtgaaatgatgacaataataatacctacttcataaggataaaagagcaatccctgttgtgggattctgttccgaacaggacattgacaatgtcaaaacctcccaaaaggagcttcaaacttccaagcactaaccactgcatgtataagttacaacagctttctaactggtctcctttttcatctttcctcacactgatgcatccaacactaccaccaaatcaatattcctaaaatcctaatttcatgtcatttccttgctttaaaaatctgtaatggcctcaagatgagattctccttaggccaacataacttgaccctattttacctgcactgggaagtattgacagtagtgtgaaatcaggttgttctaatttgaagcctgagtacaccacttattagctgtgtgaccctaggcaagtaagttaacccctctaacacttcctcagcttctcatctctaaaatgtggctagtattcatcatatgggtgtttttacagagtgaaaattcatataaagtgcttacttagcactttacatgtatgcctggcactggagatgcatcctttaaatgtgagctgttactacttccctaaactgtctactccacctgggctgctcttccagatcatttctaacacacattgcccaacttaggcctttggctggtggtgttctcacccatgaggcaccattccatcacaatcaccaccatcaacaaagagtatgtgttcaacatttacactatatattcaaggtgtaggctggaaatacagaggaaaaaaaaaaaaaaaacagtcccaaacctcagagctcatagtctaataatgaaagagagacagaggaagaggtccaataattaggggtgacaaaggaagcacttcctggaggcaagggagatgcttacactgactccagaaagctgcgtgggtgaatcaggcagtgtgggtgcatgtagagtaagagcatccagtacagcaatcacagtcactgtattgagtctggcactgctggagtactaaggctaagggagagcagaggctagatcagtgaggtcaggaagtgttggcactttattctgcaggccagcagcagccactgaataatattaagtagggtacacctgtctaggactctagaaaagcttacactgtgctgtccaacacggaagccacatacaactactgactggaaatgtggctagtgtgacagaaattaaattttaattaatgtaaacttggtaactgatagcaattcagttatcaaaaaccttttatgtatgtttggaacaattaaagagtatgtaggccgggcgcggtggctcacgcctgtaatcacagcactttgggaggccgagacaggtggatcacaaggtcaggagatcgagaccatcctggctaacatggtgaaaccccgtctctactaaaaaatacaaaaaattagccgggcgtggtggcgggtgccctgcccatagtcctaaaaatacaaaaattagccaggtgaggtggtacacacctatagtcccagctactcaggaggctgaggtgcaagaatcgcttgaacctgggaggcagaggttgcagtgagccgtgattgcaccactgcactccagtctgggcaacagaacaagactctgtctcaaaaaaaaaaaatgtatttaatgaactttaaatacagatcaattatttctgatgaaaatttaatgtccaaatttaaatgtgcagtaagtgtaaaatatgtatcagatttagaagacttagtacaaaagtaaaatatctcatcaataatctttaatcacatgttgaatattttgaatgtattagagattacattagaattaatttcacctgttcctttatattttactgcggctactagaaaatgtaaaatgacatacatggctggcattatacttctattggacagcaatgatccaatagatcccaggacagctgaaagaggaaatgagaccagaagcaggaagaacaattaaaaagactctgataagcatccaggtaagagagacaggcctgattatctaaattctgcccatcttcaaaacctaattcaagatacactactgcctccaaaagctctcctaatcctaacaattcccaaggagttacctttctctgaactcctgaggcacttatctgtagcattcacttcaacactcattcatttgccacctgtcatttctatttaattttggggtaatttgtttctcagattagaccagaagctcctaggctaagggccataatttaggcacctttaatttttgcatgctgtgtaatgcatttttgatacttttaataaacacaggtacatgactccccaaaaatctggatacaccttcatgggtgactttacctttccacagcagaaggaactgagaatctcttttccttcaagaaccttaaagataggagctaaaatgatgtaaaaatcaatcaaaactccctccaagccaatgttccgataaagtagtgatatttaatcagtgagcaagcattagtagactgtataggataccatcaagaaaaaaaaatgccaagacagaagaatttaggcttttgacaaattccataaaaagtcaaacaaaaaatttctgatcatctctgatctctaccgccagagataacctttgccaacctaagcattaagaactttcaatcaaggaaaaaacatctattttaaaaattaacccctaaatcaatccttctaataaatatcacattttctaggtagggatacacatattaccagtaaatttacaactcagcattttcccatctaaattagagtaaggtgaagaaaaaaaactttccagggaaatattaagaagtagtataaatgtattttactgcataatcgataaagtatttcacctaaaataccatttaaattttctacaacacttgactatacaacggccagcttgcaccactacagaaataggaagctagcagcaactagtaaaaagcaagggacattctgtggtgatcagtactgacctgggaactttgcagttttcagatttttcatgtttgacatttaaaacagaaaactgacaagtttctaataagaaactaaaagttacatcagaattgatcttcttgcatgtgtttaatggctacgaagtggatattacaaagtgcagttgaagactctatctccaaagaaacaatcgagcaatcaaagatgagctaggatagcttgtaagggaacagaaggcagtcctttctattctgaaaggcagaagaaataggagaaacctgtcaaacaacctggatgaaatcaaggagttaacaagcaacactcatttcctttagcactgtgagaaaattccggttgctaatagaaagctgaggaaagtttggtttggcttgtttcattttgttttccttccaaatcatcactgagtatgaacgactgctttcctctcctcacattactcagtaaaaactcccccattgaattgtcttccggtgccctgctccccagcctcccagaacggcccccgcccccgcctccctcccagcaaacgtgctcagacgcctctgggcttgttgtggtctcgccagtctgcggacaagcgctccaaactcaatggacaatggagctcacccccgtcaacgcgaactacaaagctcaggagggccatttcccttttcctgcccagatgctgttttcgctccttcgaagcaagatcccatgctcgactagacggccagtgtgcgccaggacccgcgtgtctccttccccacctgcagagctgctgagcccctcggcccccaaataaattgtaccgcagcacacaggccaaaaagggccccccaccaccaggggcttggctggggacagtggcttcacggtccaggtagggatggagggaacgtctcttgacgcttggtcatggccctcaagactaagccgtctccactgttccccctccccagctccaacttgcctcccctccccccactgcgagaagacctaggaggtgcgggcaggcagcaccgccacctcttcctccggtggagcgctcggccgacactcaccctttcaccacaaagaaggggtcctccatggacatggcgtcccggccccggccgccttcacctcctccgcgcacagggcgcccgtgcctcccggtctccctccgcccaccccgcctgttcccgcagctgcccgcgccttagtctgggtgaagccgagcagcgggcacgcgcacaggccaggtgcacaggacggccgctggtccagcactcgctcagcaccactggccgaatcccggactcgggcgccggccccctcggcagcctccagtcccggctcctcccgaagcgtcggagggcctgaccccacccccgggaccctcggccgcggccaatcacgaacgccgcctgaaacacgacttccgcaccccgctcacgtgaccagggcatatatctctctctctctctctctctcctctctctcctctctctcctctctctcctctctctcctctctctcctctctctcctctctctctctctctctctctctctctctctctctctctccccccccccccagtgggcggggcttacgcctgcgtccctcggccctggaggcggagccctcggggcggtggaggtgggcgggcttctacagccctctcctcaagcttgagggtgaggagtggcttgttccctcagaactaggcagtcggcttttcaggataagctgtagttgtacctgatttgcaaaatcctcttacctttcctctacttttaatacttaattttgacagtatgtaatttataaatctatctggtcctcgacttaaaatgaagcatagtatctgattataatgttacacagatcctttaagtaggtcttgctttgtgttggacagtgtgctaaaggttgtgtatgcatcatctcagtatcctttgggggaaagtattattcccccctccccctttttggggggcagggtctctctctgtcaccctggctggagtgtagtggcacaatcacagctcactgcacccttgacctcctgggctcaagcgatcctccggcctcagcctcccgagtagctgggactacaggtgagcgccaccacgcccggctaatttttaaattttttatagagatggggctctcagtatatttcctaggctggccttgaacacctgagctcacatgatcctcctgcctctgcctcccaaagtggtgggattatgggcgtgagccaccacaccatccatttttctcattttgtagataagaaaataagttcagagaggcttgaagacttcctgtagtcacacagcctggacagggcagaactgcagattctgtgcactttccaccagatggggtgtactttctgttgctgtacattctgcaaataaccatgtaaagtaatttttcatacagcatatggtgcttcccaggagagcacaccttcgaggaataaagaaggggccaggtatgacaacttcctctcactgtggttcaagagctattcgagaaaacattttgcccagaaccattaaccaactcatatgctagatatgctatgaaatttgtggatggggattgtggactttgattgctgaaaatcattgagcacttactgtgtgtgtgtgtcaggcaggatgttaagtgttatctcagttgctcttacaatgtgataattactgctatcatgcccattttataaatgagaaatctgagactcggaggttaagtgacttgcccaaggtcaccagtctggagctggcacagtccttggagcaacacaaaccccgtttaaaccttggctctatcattcagttcctcatctataaaacataaataataatagctagttcatgggttgttgtgatggttaaataaaaatgtgtgtaaacctcaagatcccaaaggactaagttactgaagtcaggaaaaccagtaaggacgctgctaaagtcatgtggcctgaagggatgaggtccagaccaggatgacagcgattgagaacagagaaggagtgaatctgacagatgtttcaaaaggaaaacaagactaaacacctagacatgatgaggggctgaatgggtttcaggaggggagagaagagaggggtgaaagccaaaatccctggaggagcgaatgatggaaggcagatgtggggaaaggaagcagtgtccaatactagtgattgctaatgtttattgggagagaactgtttaatttacttagctggggaggtgaaaacgtgtcatcgttcattcattcaacaagcacatgtaaattgaggggtaggtgagcatggtgttgaagaccatccttggagtctgattgcttgagttctgctgcttcctgactgttgcatctcaggcaagccgcttcatctctcactatcctcaactgtgaaatagacaccgtaataacagcttccttatagagtgtcatgaggtgatgtgtgaaaagtgcttaaaacagtgcctgacacatgttgtgctcctactgtgtgctaagcactgagacacaggcatgaacaaggcttggttcttgccttcaaggaactgtcagactggtgggagagacagactggtgggagagacacacagtgagagaagggcacaggttgccatagaaacacagcgacaagataccagtatatttgtgtgttttcggggctggggcagggggttcctaagcagtgactagaagcagccaggagaagggggccatgttgctggagtagaaggaaaaggatgggggcagcaggagctaagcctggaggtggacagggtcagattatcagggcccttgtttgtaatgttcagaatagtggacgcttcctatggacagttccccatggggactgagggaattgacagggtcagattggcatttgagacagatgcttcagtggctaggaggttatggtccagaggagggatgagggtatcctgagctgggcttgtgacaactaaggtggagaagagtgatgcatttgagacatactttagaggcaaagttagtatacttggtgactgattggttcagggtatgggggaattgatgaaagaagagggaggaaggcttctggggttgtaaatgggtagtgttggttccaaccatcaagaaagagaacacaagaggaggatttgatttagggtgaatgtaaattagctgttagcatgtcatttatccccaccaaacagtaaactcctggagggacaggatactatgttaatgttattatcacctaagtgcctgacacggcctcttattatctgttccatgaatttcttaattggaccacatatgacaggccagagttttataagtagtaatagaagatagaggacagaggcttgggttcccataattaggggattagaaaaagcaccaacaatggagatagtggagtgtcaagatataaaatgtgtgtatgtgtgtgtgtgtgtgtaggtgttcctttctttaatgtgtcaccctcctttaccctctctcaaactagaccttggcctccactgcccacaaggaaagggaagctatggctaaaatgcaaggagaaacaaaggaggttctttctttctttcttttttttttttttcatttaataggacccacgtcctggcataaacaataggttgggaagaatactcagcaaaaacccatctcttcccacacccccacccctaccccacccccaacccaaaagaataatttaaatttctcagggaataaaaaatcaaaacagtggttgtcttgggggacagagtttgactgggaagggaaactttcttgggtactagaaatgctctgtatcttgacggagtgtgtgttacatgagagtatcatttgtcagaattcctcaaaccgaaactcttaattggacttaacttctgttcatttttctgggggaggttgacatgccaactctgagctttctgtagagttctgagtgggcagccaggagaacctctggttcctgagtgagtctccaaagttaggagagtgaatgaggaagggagcacactgggtcctgcaatgcatcttctgcagaaataaggagatggcaacacagagaataaggcacaggcagccaaatgagctgaggatcagaaaggagccaaccatatcactggggatgccaggatagacctgagagggattgcagtgggtagccaccccctgcccctggaagctgcgggaatgccatgacacccctacaaggggatctcccctactctgaaataatgacattcagcctgctccttcactagcctgttataaggaacaactggatcatatatgggaataattttttattttttaaattttttattttttaaatttatgaggccggacatggtggctcacacctgtaatcccagcactttgggaggccaaggcgggcagatcacaaggtcaagagatcgagaccatcctggccaacatggtgaaaccccatctctactaaaaatacaaaaattagctgggcttggtggtgcgtgcctgtagtcccagctacttgggaggccgaggcaggagaatcacttgaacccaggaggcaggggttgcagtgagccaagatcacgccactgccctccagcctggcgacagagcgagactccatctcaaaaaaaaaaaaaaatttaattgtggtaaaatacacataacataaaatttaccatcttaaccatatttaagtgtacaattcagtagtgttaaatatatttgccttgttgtgcaaccaatgtccagaactcttttcatcttgcagaactgaaactctatacccattaaacaactccccattctcccccaacaatctctggcaaccaccattctactgtgtgtctctatgaattttactactctgggtacctcacataagtggaatcatacaggatctgtctttttatgatttgcttctttcagttagcatgatatcttcaaggttcattcattcattctacatattgcagaatttccttcctttgtaagcctaatattccattgtatatataccacattgtgcttgtccattcatccatcagtggacgacacttggctttctttcatcttttggctataatgaataatgctgctatgaacgctggtgtacaaatatctctttgagaccctgctttccattattttggatatatacccagaagtggaactgctggatatggtaattctattttaaatttttttgaagaacagtcatattgttttccattttacattcctgctaaaagacacacgcattccaatttcttcatatcttcatcaacacttgttattttctgggttttcttttcccttatagcagttgtactaataggtgtgaggtggtatctcattatggttttgattcacatttctttaataattagtgatgttaagcacctattcgtgtgcttattggccatttgtatatcttttttggggggtggggagaaatgtctattcaagtcctttgcccatttttgattgagttgttttgtttttgttgagttcaccctaaatccttcttgaaacaaggtaaagaaagggagaaaagtgttaacatagatataggatatcatactcttcatcattatccaaccttttagaaaccctgatatacatgtacatattcc

SEQ ID NO: 241 - DNA, 13530 bp, Homo sapiens
gaaccattactcttccacatgaattataacttttaaaataattttttagtgtgcatttaaaagctatgttgggcaaaatagtaacaataaaaatcaaatagaaaccctagagataaagaatacaataactgaactaaagtgtttgacagaaagctacaatagtagacttgatcaagcagaagaaagaatcagtgaacacaaagataggaattttgaaattatccagtcagacaagcaaaaagaaaagaaaaataaaggtctatgggaattatgggacaacatcaagagactaacctatgcaaaataggagtccttgaaggagagacaaaaaggcccagaaagtatatttaatgaactaatggctgaaaagttttcaaatctggggaaagatgacaacgtccaggtactgaaagctaagaggctgtcaatgaaatccaatccaacagttcaccaaaatacatcataatcaaattatcaaaaatcaaaaacaaagaaagaatactgaaaacagtaagagcgaaaaaacatatcacagtcaagagagttccaatacagctgtcagtggatttcttggcagaaaccctgcaggccaggagagggtagaatgatatattcaaagtgctgaagggaaaaagaccctgctatccaagaatattttccttcagaagtaagacagaagtaactttcccagacaaacaaaggtgagggatttgatcaccactaggcttgcactaggcttggaattgctaaaggaagttatttaagctgaaatgaaaggctactacctaataacataaaacatatgaaagtaaaaactcaatggcataagtaatacatagtcatattcaaaatactgtaagtgtggtgtgaaaagcaattgtatctctattatgaaggttaaaagacaaaactattgcaaacaactgtagctataataaattgttaagggacccaaattagaaaaaagggtaaattttaacacaaaaaatcataaaagatgttggggggagtgaaagtgtagagtttttgtttgcaatcaaagttgttatcagcttaaaatagcctgttttaattataagatttttatataaatgctaggatttgaatgtgccacccaaaagttcatgtgttggaaatgtaatccctctgccctcatgaatggattaatgtcactatcatgagactggctttattacaaaagcagctctctctggctttcttgattttggtctcttgccatgtgatgccttccattatgtcatgactcagcaagaaggctctcatcagatgccaacaccatgctcttggacttcttagcctccagaactgtgagataaataaacttctattgtttataaattacccagtttgtggtattctggtataaaaacagaaaagggactaagccaataggtcttatggtaaccacaaagcatgaacgtatagtagatgtaaaaaatataaaaagaagggattcaaagcagaccaacacaggaaaccaccaaatcacaaaggaagacaccaagggaggaagaaacaaataatctatgaaacaaccagaaaacaaattacaaaattgcagcagtaagtccttacctatcaatatttgactggaatgtaaatgaatcaaattgttcaatcagaagacactgggtgggtgaatggatttttttaaaaaacaggaaacaactatacactgcctacaagagactcactttactagtaaggacacacagagtgaaagtgaagggatggaaaaaaatattcaacacggatggaaaccaaaagagagcaggagtagttatactaatataacataaaatcaactttaagtcaaaaacgataaaaagagaaaaagaaggtcattatataatggtaaaggactcaattcattaagaggaaataataattgtaaatatacacacacccaacattggggcatctaaatacacaacgtgattattaagtgacctgaagggaaagatagacttgatacaataatagtattttacagtaatacactaccccactttcaacaatgaacagatcatatagatggaacattaataaggaaacactggattgaattacactttagaccacttggacctagcagacttatgcagaacatttcactcaacagcaacataatacactttcttctcaagtgcacacagaacattcttctggatagatcctatgttaggtctaggccacacaacaagtcttaacaaacttaagaactgaaaatatatcaagtatttttttgggtcacaaaggcatgaaactagaaatcataatgagaaatcttggaaaattcacaaatatgtggaaattaaacaacatgttcctaaacaaccaacaaatcatagaagaaattacaaagggaatttaaaaagcccttgagacaaacaatgaaaacacagcataccaaaacttatgggatgcaccaaaagcagtcctaaaagggaaatttatagcaagaaatgcttatggcaaaaaagagaaaagattttaaataaacattctaattgaaatggtttggatatctgtcccttccaaatctcatgttgaaatgtgatcctcagtgttggaggtggggattggtgggaggagattggatcacgtgggcagatccctcatgaatggtttagcagcattcccttggtaataagtgagttcatgctcagttagttcacatgagatctggtttttcaaaagcctgggactccctcctctctcccctgctctcaccatgtgacacgcttgctccccttcaccttctaccatgactggaagcttcctgaggccctcactaaaagcagatgctggtgctatgcttcctatacagcctgaataatagtaagccaattcaaaaaacctcttttccttatgaattacccagtctccagtatttctttatagtgatgcaaaaatggcctaacacactaatgctacacattgaggaactagaaaaagaaaaaactaagcccaaagctagcagaaggaaggtcataataaatactagagcagaataaataaaattgtgactagaaaaacaatagaacaaaataaataaaactaacagctagttttttgaaaagatgaacaaaactgacaaacccttactagactagaaaaagaaagaaaagactcatatatcagaaaggaaagtggtggcataacaactgatatcacagaagtaaaaaggatcacaagaaactactataaacaattgtataccaaaaattggatatctagaagaaatgaatacattcttagacacataaaaccttccaagactgaatcatgaagaaatagaaaacctgaacaaaccaataacaactaaagtgattgaatcaataataaagttcttccatcaaagaaaagcccaggatttaatggcttcatggctaagttttatcaaaaatttaaagaaaaagcaacatcaatccctctgaaactcttccaaaaaattaaagaagaggcaacacttccaaactcattttatgaggccagtattactgtaatactaaagccagacaaaggtattacaagaaagggaaattacagatgaacagatacaaatacaaatatccctgatgaatatggatacaaaagtccttaacaaaattctagcaaaccaaattcaacagcacattaaaaagatcattcactatgatcaagtaggatttatctctgaaatgcaagcatggttcaatataggcaaatcaataaatgtgattcatcacagcaacaaaatgaaggatgaaaccatatgattatctcaatagacgcagaaaaagcatttcataaaattcaataccttttttattcttgagatggagtctcgctctgtttcccaggctggagtgcagtggtgcaatctcagctcactgcatcctctgcctcctgggctcaagaaattctcctgcctcagcctcccaagtagctgggattacaggaatgcgccaccacacctggataatttttgtatttctagtagagatggggtttcaccatgtttgccaggctggtcttgaactcctgacctcaggtgatccacccacctcagcctcccaaagtgctgggattacaggtgtaagccaccatgcccagcctaaaattcaataccttttatgataaacattgttaacagaataggtatacatgcaatatacctgaacacaataaaagccatatatgacaaatgtatagctaacattatattcaatagtgaaagttgaaagcttttcctctaaaatcagggacaagacaaggatgcctactttcattactttttttcaacatagttctggaaatcctaaccagagcaattaggcaagacaagaaaataaaagatatcctaactggaaaggaaaaagtgaaattgtctctgttgatgacatgatattatacaaagaaaatcctaaagactccaccaaaaagctgttagaactgataaattcagtaaagttgtaggaaacaaaatcaatatttaaaaattagtggcatttttatacactaataacaagctatctgaaaaagaaattaagaaaacaattccatttacaatagcaacaataacaaaatacttattttattgtctgtttatattcatattttgttatcaaatacttctttataggacttgtatactaaaaactgtaaaacccttgtgaaagaaattgaagaaaatacaaataaatgtaaagatatcccacgttaacggagtaaaagaattaacattattaaaatgtctgtactactcaaagcaatctacagattcaatgcaattcatatcaacattccaatgtcatttttcatagaaaatgtcatagaaaaaataatccttaaattcatatggaaccacaaaagacctcaaattgtcaaaacaatcttgagcaaaaagaacaaagctagaggcatcgtactacctgacttcaaaatatattatgaagcaatcaaaacagaatgatcctggccaaaacaaaacaaaaccaaccaaacaaacaaacaaaaaacaacagaatcactgaccaatagaatctgatagaaagccaagaaataagcctgtgcatttatagtcaattgatttttgacaaagacgcttagaacatacattggagaaaggacagactattcaataaatgatgctgggaaaactggttatcctcatgcagaagaataaaattagaccctcatcttacatcctgcacaaaactcaactcaaaacgggttaaagacttagacctaaaactataaacctaccagaagaaaacatagggaaaaacttcacaatattggcttaggcaaggaatctttggatatgaccccaaaggctcaggcaacaaaagaaaaatagacaaatggaattgcattgtattagtccgtttttatgctgctgataaagacatacttgagactgggtaatttatagagaaaaagagttttaatggactcacagttcacgtggctggggaggcctcacaatcatggaggaaggcaagggggagcaagtcatatcttacatggtggcaagcaagagagaatgagaaccaagtgaaaggggtttcctcttataaagccatcagatctcatgagacttattcaccaccatgagaacagtacaggggaaactgcccccatgactcaattatctaccactggagtccctcccacaacacatgggaattatgggagctacaattcaagatgagatttgagtggggacacagccaaaccatatcattccacccctgggccctcccaaatctcatgttctcacatttcaaagccaatcatgccttcctaacagtcccctaaagtcttaactcatttcagcattaactaaaaagtccacagtccaaaatctcatgcaagacaaggtaagtcccttctgcctatgaacctgtaaaatcaaaagcaagttagttacttcctagatacaatgggggtacaggcattgaataaatacacccattccaaatgggagaaatgggccaaaacaaaggggctaaaggccccatgcaagtcagaaatccagcggggcagtcaaatcttaaagctccaaaataatctcctttgactccatgcctcatatttaggtcatgctgatgcaagaggtgggttcccatggtcttgggcagctctgctctgtggatttgcagggtacagcatccctcctggctgctttcacaggctggccttgagtgactgcagcttttccaggtgaacagtgcaaggtgtcggtggatctaccattctggggtctggaggacagtggccctcttctcacagctccactaggcagtgccccagtgggggctctgtgtgggggcttcaaccccacatttcccttctgcactgccctagcagaggctctcaatgagggccccacccctgctgcaaacttctgcctgaatatccaggcgtttccatacatactgcgaaatctaggcggaagtccccaaacctcagttcttgacttgtgtgcacccacaggctcaacaccatgtagaagctgccaaggcttggggcttgcaccctctgcagccatggcctgagctgtacctttgtccctttcagccatggctagagcagctggaatgcagggcaccaagtccctaggctgcacacagcatgggggccctgggactggcccaagaaaccattttttcctcctaggcctccaggcctgtgatgagaggggctgtgagaaagctctttgacatgccctggagagacattttccctgttgtcttggccattaacatttgtttcctcattacttatgcaaatttctgcagccagtttgaatttctcctcagaaaatgggtttttctttttctatcacatcatcaggctacaaattttccaaacttttatgctctgtttcccttttaaaactgaatgcttttaacagcacccacgtcacctcttgatgctttgctgcttagatattttttccaccagatatgctaaatcatctccctcaagtttaaagttccacaaatctctacagcaggggcaaaatgctgccagtctctttgataaaacatggcaagcattacctttactccagtccttatctccatctgagaccacctcagcctggatttcattgtccatatcattatcagcattttggtcaaagccattcaacaagtctctaggaaattccaaactttcccatattttcctgtcttcttctgagccctctaaactgttgcaacctctgcctgttacccagttccaaagttgcctcctggcagggaaattgttttgggatgattcaagcatattacatttattgtccactttatttctattattattacattgtaatatatcatgaaataattatacaactcaccataatgtagaatcaatgggataaattttagtagatataaatgaaggcttaatgaattttttttttttttttttttgagacagagacttgctctgtcacccaggctggagtgcagtggtgtgatctcggctcactgcaacctctgcctctcaggttcaagcgattctcctgtctcagcctcccaaggaaccaggatttcagttgcacgccaccacacctagccaatttttgtattttcagtagagacagggtttcgccacattggccagtctagtctcaaactcctgacctcaagtgatccatctgcctcaccctcccaaagtgctggcattatggtgtgagccacggtgcccagcctatttctttttcttttctttctttttttttttttttttgatagctgggtggcagatgtataaattgtcattgacctaacagaattaagctgggccatggagaaaactgagaacatcacgattcaaaacacagaattctcaaatggaccagtgtgtttagacctgactgtggaatggaatgccacacctaggcatatgaggtatggttggggcactgtcacatgtccagcttgggagccatcatgtgcccaggtcgggagaggtaaatccacgagacacagacatgtgctgggggtgcagtcgcatgtccaggtcaggtgccctcacttgctgggagtgccatctgctagtgggagccagtcacatgttggggtgcaaccacctgttgggggcgcaatcctgtgctggagacacagtcacatgtcgggagctagtcacccgctgggggcgctgcctcgagcctcatggctgcccctgcttccgtcatgggcccactcgggccctctgccctgggccttctgctgctgctcctggtggtggcccctccccgggtcgcagcattggtccacagacagccagagaaccagggaatctccctaactggcagcgtgggtaggccctgccccaggggcggatgggcggctggagacagtgcccttggggcgtctgtcggtgctgggcctcctcccccatgtcgcctgcccatcccttcccctcccccatgtcccctgccttcccttcctcctgtgtcccctgcccctcccccacgtcccctgcctgccctacctctcccgtggccccagcatggctccaccgtcagctccgttctccctgcagcctgtggtcggcccagcatggaggggaaaatcctgggcggcgtccctgcgcccgagaggaagtggccgtggcaggtcagcgtgcactacgcaggcctccacgtctgcggcggctccatcctcaatgagtactgggtgctgtcagctgcgcactgctttcacaggtaagcgggcgccggcctgggatggtgtgggtagctgggcctgcacggagtgcccacagcggcttggatggaccccacgcaagcctcccccatcaccattgtcgactcccttcaccactgtcgacccgcgcaaggccaggtccccaccagtgaggctggtccccaaacacacagctgggtccccattcttgaggctggtcccccaagtgcacagccaggtcctcaagagtgatgctggtccccaagatcacagccaggtcctcatatgcaaggctgatcccctaagtgtacagttaggttcccatgagctaggttggtcctcaaatgcacagcctggtccccatgtgcaaggctggtcccctaagtgcacgaccaggtccccacgagtgaggctggtcctcaagggcacagccagattcccacaagtgaggctggtcctcaagggcacagccagattcccacaagtgaggctggtcctcaagtgcacagccaggtcccacaaaagtgaggctgctcctcaagtgcacagccaggtcctcataagcaaggctggtctctaagcacctggccttcccgattgctcctccaacagccccattcaccacagctgccccgcacagcaggcacgcctctcctgtggccatctggcctccagagggatgtgtgcaaccaggttgtcagtaagagtcagagcaggtctcacatgcatgggctgctggcctgtacagctggtggtcgtgtacagacttgggtccccagagcctccatgggccaagtcgactctttagggggcaactcttccagacagccagataggtccctactatgctgcaggaagaaactggcttttcaatcccaccgagtgagtgccagccccttgcgcttggcctccccaggcctgtgggctgaccacacaggaagctgcgggcattgtacctctgttctcacccccacagggacaagaatatcaaaatctatgacatgtacgtaggcctcgtaaacctcagggtggccggcaaccacacccagtggtatgaggtgaacagggtgatcctgcaccccacatatgagatgtaccaccccatcggaggtgacgtggccctggtgcagctgaagacccgcattgtgttttctgagtccgtgctcccggtttgccttgcaactccagaagtgaaccttaccagtgccaattgctgggctacgggatggggactagtctcaaaacaaggtaggaatacagtgcagggctttgtgggcaggatgaaggcttctcttccaccacagggaagaaaatgctctgccagctaagggggtccaggtgtttggggactggaatccccacctgtcaatcaacatttatttgtttgtcagtgtggatattttgttgttttgttttatttctgactggctttgttgtatgcagaaaaatacagctactttgatgtgaagttggtatgcagtatatcaagaacacaaatttaaaagcagttttccttaagattgtaaacggaatttagaaatctcttttagcttatctaaaaaccgtttgttattaaacttttctccagaaaggcctgtgcattctttctagatttatacctgggcactttacaatatttaggtctattcaaaagagatttttaaaattgcatttgctaattagtcacagctaattagctgtgactatgtgtgatttttgcacattgatcttatatccagtcatcttatagaatttatttttagtagtttatcaactgattattttgacagttctagacaaaagataatattttcttctagtaaagactattttatcactctcttcccatattttatcttttatttatttttcttgtcttcttacaatggttggaacctccagtagaaatgatgccagatcttgtcttggttttggtttgattggaaatgcttataatggttcactatagcatttgtggccaggcctggagatttcaggttgatatattacaccagattaagaaagttaccttttatagctgatttacttaatttttaaaaaattatagaaaattattgattttattgaaatgtttgcggcaactcttgagaggatcatatagttctgctcttttaatctattgatgccaagaataggcatttaagctgggtgcagtggctcacacctgtaaatcccagcactttgggaggctgaggtgggaggatcgcttgagcccaggagtttgagaccagcctgggcaacatagtgagatcctgtctctacaaaaaatgctgacttagctgggcttgacggcatgtgcctgtagtcccagctactcaggaggctaacgtggaaagatctcttgatcccagaaggtcaaggctgcagtgagccaaaactgcatatctgcaccaaagcctgggcaacagtgagaccttctctcaaaaaaaaaaaaaaaaaaaaaaaacgtatttaatgtgagatgggtctagaattttttttcttagctgattttatctttggcatgagtgtactgctgactttgtagaatgaatcaaaactttcccatctatttgtattctctgcaatagtttctattaaagtaaagattagctatttcttgaaggtttgatgtggccataaaacactctgatcctagtaccttttgcgggtataaatgattactctgtcttactctctgttatggctactggttcattccaattttaaaatttattcttaggccaattttgatggattatatttttctagaaagttgttcattttattccagattttgaatataatgatattgtgtaagactgtaattcatgtgctcttattattacttttctgacttctcttaattccttatcatagttgccaaaattgtctattctattgccttttttatataaaactacctgctacagattttgcattggtgtatgtggggagatggtggtgcatgggactttatatgttgggtgctttgctattcactcctatagccatctattcattcgttaaactttttatactctaagtttgcttaaccaaacttttctaattttttgagctgaaaatacaaaagattcaacatttcatactttttctatgaataaattgaagattatagctttcaaagtctcctttggtcatgttacaggctttgaattcttacatatttgttattcgtttctcaaaagtatgtgcaccctattttgattttgtctatatccaaaagtataggacaaaatttttcatatctacaaaaaaggccattggaattttataggaattgcattgaatattcagaccatgttgagtaatgttgacattttaacaatattaaacctgcctatccataaacatggaatgtatttccatttatttgagtctttaatttctttcagcaatgatttatagattcgagtatgcaagtttttcacctccttcattaaatttatttccaaggtatgttattattttagatgctattgtaaatgaaattgctttcataactatcttttttggattgttctttgggggtgtataggaacacaactgatttttggccgggtgcagtggctcacgcctgtaatcccagcactttgggaggccaaggcgggcggttcacaaggtcaagagattgagactatcctggccaacatggtgaaaccccgtctctactaaaaatataaaaattagctgggtgtggtggcacttgcctgtaatcccagctacttgggaggctgaggtaagagaatcacttgaacccaggaggtggaggttgcagtgagctgagatcacgccattgcactccagcctgggcaacaagagtgaaactccatctcaaaaaaaaaaaaaaaaaaaaaaaagcaacacaactgatttttttatgtgttggccttataccctgcaactttactgaatttgtttattatatgtagtagttttgttttttttttaaagattaattgggattttctatgtataggatcatgtcatctatgaatagagattgttttacttctttgtttccaatttgaatggctgttatttcttttccttgtctaaattatttgtctagaatttctagtacaaattaaatagcagtgatcaaagtggaaatccttgttttgtttctgatctcatgggaaatgctttcagtctttaaccattgaatatgatgttagctgtcagtttttaaaaaaatgccttaatgttgatgaagtttttctacatcaattgagatgatcctatgttgtcttttttcgtttattctattaatgtatattacattgattgatgttcttatgttgaattacacttgtatttcttggataaatctcgctttgtcatggttttatatgctgttggttacagtttgctaatattttgctgagggtttttacatctatattcttaaaggtatgatctgtagttatattttcttatggtgtctttggctttggcatcaggataattcttgtctcatagaatgaattatgaagtgttgcttcctcttctatttttttggtggagtgtgataaagattgattaattcttctttaaatatttggtagaatttaccagtgaagccatctggtcctgtacttttctttgttgggagattcttattgttgaatcaatctctttacttgttatagatcttttcagatttcctatttcttctgtgtaagtttagataattcatacgtttgtagaaatttgtctatttcatccaagttatctcatttgcaagataagttatttcacaaatttataatcatttttgtgcatttgttttttgaat

SEQ ID NO: 242 - DNA, 13833 bp, Homo sapiens
gaatgaattcttgaataactgacagtgaaagaacaaagttagagaagcattccaaagggccagagacataatatatcctgggaaacaggattatcctagagctagggcataagtgatatgaagaaaaaataaggctatggaggctggtagaggtggggttatagtcttataaaaaatgttgtcctggccgggcgcagtggctcacgcctgtaatcgcagcactttgcaggctgaggcgggcggatcacgaggtcaggagatcgagaccatcctggctaacatggtgaaaccctgtctctactaaaaataccaaaaattagctgggcgtggtggcgggcgcctgtagtcccagctactcggaaggctgaggcaggagaatggggtgaacccaggaggaggggcttgcagtgagccgagattgcaccactgcactccagcctgggcaacagagcgagactctgtctccaaaaaaaaaaaaaaaaaaaaaaagtggtcctataggcccgagggcccaagattaccaacttttttttttttttttttgagacagagagtcgctcttgttgcccaggctggagtgcagtgatgcgatctcagctcatggcaacctccacctcccaggttcaagcgattctcctgccttagcctcccaagtagctgggattacaggcatgcaccaccatgcctggctaattttttttttttcttttccgagacagagtctcgctctgtcgcccaggctggagtgcagtggcgcaagctcggctcactacaagctctgcctcccgggttcacgccattctcctgcctcagcctcccgagtagctgggactacaggcgcccgccaccatgcccggttaattttttaaaaaatatttttagtagagaccgtgtttcaccgtgttagtcaggatggtcttgatctcctgatctcgtgatcctcccgcctcggcctcccaaagtgttgggattacaggcaggagccaccgcgcccagccgctaattttgtattttagtagagatggggtttctccatattgttaaggttggtctcgaactcctgacctcaggtgatccacccaccttgacctcccaaggtgctgggattacaggcgcgagtcaccgtacccggcctctaaccttttatttttttagagatgagtctcactatgttgcccaggctggagtgcagtggctaatcacagtgaagatcatagagcactgcagtgttcaactcctaggctctggccatccttctgcctcaggctcccaagtagctgggactataggcagtgacaatgctctgggcttaatcttttgattctacagactttttttttctttttttgagacggagtctcgctctgtctccaggccagagtgcagtggcgtgatctcagctcactgcaacctccgcctcctgggttcaagctattctcctgcctcagcctcctgagtagctgggactacaggtacatgctaccacgcccagctaattttgtattttgagtagagatggggtttcacagtgttaaccaggagggtcttgatctcttgaccttgtgatctacctgcctcggcctcccaaagtgctgggattacaggtgtgagccaccgcgcccagctcaaacttcttttttaatgtcaaaaactgtacagattaccatgtgatagtaattataagtttagtacatattgattttttttttttttgagacgaagtttgctcttgttgcccaggctggagcgcaatggcgcgatctcagcttactgtaacctctgcctctcaggttcaagcaattctcctgcctcagcctcctgagtagctgggattacaggtgcctgccaccacacccggctaaattttgtatttttagtagagacggggtttcaccatgttgaccaggctcgtcttgaacgcctgacctcaggtggtccacctgcctcaggcctcccaaagtgctgggattacaggcgtgagccatcgcgcccggccagtatctactgattttaaaaatacacaatgaaaaaggttaaagtggattcactagtaattttacttagtttttttttagagacagggtcttgctctgtctcttatgttaaagtgcagtggcttgatcacggcccactgcagcctcaaactcctgggctcaagggatcctcccaactcagcctcccaagtaactgggagtacaggcatacaccatcacactctgctaatttttaaattgttttgtagagatggggtcttgctatgttgcttagactggtctccaactccctgccttaagtgatcctcccacctcggcttcccaaagtgttgggattacaggcatgagccacttcgccctgctatttcttttgagacaggatcttgccctgttacccaagctggagtgcagtagtgtggtcaaggttcactgcagccttgaactcctggactcaagagatccaccaacctcagcctcccaagtagctgggactacaggcatgtgctaccatacctggctaatttttaaaatttgttggtagagatggggtcttgctatgttgcccagaccagtcttgaactcctggcctcaagtgatcctcctgccttggtgctccaaagtgctgctatcacatgcatgagccaccataaccagctcaattttaagtaaaattttattcaacacaatttcaaactcttttttaaagtaatgagattttgtagacattaatttttctgtacatggacaaaagttagtgaaaatatagtgaacatttatgacctcctacaaactgagaaccactgctgtaatagtagccagagtagcaacatttagtgaatacttgataagtgccagttctaaacactgtgcacttattaattaataaaacaaccatgtgagataggctttattattatcctcatagatttcagagttgttttttggttttggtttgtctctttgtacctttcttctcttttcctttactaaagatctgaattttcaactggggacactgctgctctgctgtagcactgtatttccttgcctccttaatgtctacgatgactctgtgactaaatgaaaaatgagtagaaatgtgtatttggagaagtcttcttaaaaattgggggagggtgtacccttcctcttttttttttttttttttttttgagacagtctcgctctgtcaccaggctggagtgcagtggctcgatcttggctcactgcaacctctgcctcctgggttcaagagattctcctgcctcagtcttctgagtagctgggactataggcgtgtgccaccacacccagccaatttttgtatttttagtacagacagggtttcaccatgctggccaggatggtctccatctcttgaccttgtgatccgcccgcctcagcctcccaaagtgctggaattacaggcgtgagccactgtgcctggcccttttttgttttttgagacagtatcttgctctgtggcccaggctgggcagtccttctccctcagtctcccaaacagcttgaactacaggtgtgtaccaccacccctgctttttaaatttttttgtagagacaaggtcttactatgttgcccaggctggtctcaaactcctgagctcaagcaatcctcctgcctcagcctcccaaagtgctgggattccaagcatgagacaccatgcctggccctttctgcttcctgcatcaagaatgtcatggctggaagtgaacatgagggcaacactgtagggatgattgagcagtgaactcaaaggagcctgccgtgtcaatcctgaatggccggcttctggatttatgtgtgagagaagaaaatcctatcttgtttatttttatttatttattttcctgttacatggcaccaaacttaatcctaactgatttgccattttggaaacaagaaaactaaggttaagtaccttgcccgatgttacaaaattagtaaaagtgaagagacgactttcagcccatgaattcttactccagagcccaccttactcttacagtatattgcctcatgctacacaactataggaaatggatttgtcatagggaaataacacatgtgttctgttgaccagtattggatggggggctggggtatttcctttatgaagcagccctctttagctgaggcaattctgaaggtggctgactgatcactgagaggtgtctgctgacagcactcccagcagctgggggaatatgtcattcattcctgaagagggatctgggtggcacaccacagcatccattacccatgctggatatcatactcccttcctgtgcctgtggctgaactataaatcgactacagtttgctttatcaataagtccggatatattttcctaatcttttttaaatgcaccaatccaggcattgtttgtttgtttgcttgtttctgagatggagtcttgctctgttgcccaggttggagtgcagtggcactatctcggttcactgaaacctctgccacccaggttcaagcgattctcctgcctcagcctcccgagtagctgggataacaggcgcctgtcaccatgcccagctgattttcgtatttatagtagagacgggatttcaccatgttggccaggcaggtctcgaactcctgaccttgtgatccactcgcctcagcctcccaaagtgttgggattacaggcgtgagccatcacgcccagcccaggcattgttactaattgattgcagtttggcctttccctttcgttatccaaaacctggttggtgtgggagtataaaggcctgagcccttccaacccaggacaattctgaagggtcaccacagcttcagagttctacgtggagctggccgaagctttcactgaaacttcccagcagcccaacttcaccctctgctcatcctgttttcctctctttctttcccttcccttctgcaggtggtgatctcaagaacactccctaaaaaaacttcctattactaatctccatctcatagtctgttttctggataacccaacccatgacaccatggctttattcacacattaactgttcctaattggaaggaaagtacttaatacatctcaagaaaaagaaaactcagttgtaattaacgttatttattttggtctacccaatacactgtttcatagtaacatactgcccactggccagagaggagtgtcctatgctgggccaatcataaaatttcaccttcctgaacacagtaatgggtacaaggggtgggcacatgaccagccttggacaatcaaaatccttccctgaggatttttgtactgaaatctagaagacaaacctccctttcttctcagatcagagaaatgtcaagatattactctatggatgctggggccatatttgctgcctacaaggaaaaggaccatctgaagtagtgaataaagccaagcagaggggagaaacagaaagagttagaggtcctggaagcatcaaatcccctgtaggtactccagttcctactgctacaccaatagtagtactgtgaactatcctagtatcattctaataatttttttctttttcttttttgagacggagtctcgctgtcactcaggctggagtgcagtggtgcgatattggctcactgcaacctccacctcctgggttcaagcaattctcctgcctcagcctcccgagtagctgggattacaggcgtgtgccaccacacctggctaatttttgtatttttaatagagatggcgtttcaccatgttggccaggctgatctcaagctcctgacctcatgatctgcctgcctcagcctccccaagtgctgggattacaggcatgagccaccacacccggccataatttcttttcttaagctagttttaagttaggtttttttgattagcaatagaagaaatcttgcctacatatctgtgtatttcttatttctatgagctgccatcttctctaacctagtcctaccaaatgtccaaaatattgaggaacaaactataaaataatccacttttctacccaattccagcatgtcaaactttttatgggtcaaaatatactgaagacaatgtacgtgaaattgtgttgtgggcttaagaaagggggtcagaaggattatgttaagagaaatacaagacataatttttgcctttatttatttatttttgagacagagtctcgctttgtcaccaggctggagtgcagtggtgcggtctcggctcactgcaacctccacctcctgggttcaagtgattctcctgcttcagcctcctgagtagctgggaccacaggtgcatgcccccatgcctagctaatttttgtatttttagtaaatatggggtttcactatgttggccaggatggtctcaatctcttgacctcatgatccgcccacctcggcctcccaaagtgctgggattacaggcgtgagccactgcgcccagccgatttttgcctttaaagatgacttcatccaaacacaaaattcctacacctgctaccctataacagatgcttatccccaaactaaatctatataattatttaattaatgtatttattcttgacacagggtctcactccatcacccaggctggagtgcactggtgcgatcacagctcaccaaacctccacctcccagactcaaatgatcctcccacctcatcctcctgagtagctgggacacctggcctcccaattaaaccttaaaacattatatgttggccgggtgcggcggttcacgcctgtaatcccagcactttgtgaggccgaggtgggtggatcacgaggtcaggagtttgagaccagcctggctagcatggtgagacccccatctctactaaaaaaaaacaaaacaaaaaaatacaaaaaattagccgggcatggtggcatgcgcctgtaatcccagctacttgggaggctgaggcaggaaaactgcttgaacccaggaggcggaggttgcagtgaggtgagatcacgccactgcattccagcctgggtgagagtgagactccatctcccctcaaaaaaaaaaaaagaaaagaaaagaaagaaaaaaaaaacccatgatttgtctatgattggccgggcatggtggttcatgccttaatcccagcactttgggaggcccaggcagcaggattacctgaactcaggagttcagaatcagcctgggcaacatggcaaaaccctgtctgtacaaaaaatacaaaaattagctgcacgtggggcgggcacctgtagtcctagctacttccgggatcgaggccggaggatcacttgagctggggaggtcaagactgcagtgagctgagatccgaaatcgagccactgcactccagcctgggtgacagggcaagaccccatcttttaaaaaacaaaataaaacaaacaaaaaaaccacaagaaacattatttatctatgattacactgcctttacagttacatcatatttatgtctatacttgataacatattctaaaagacaggaatggactttttaaaaataattttttagcagctttagatctacagaaaaattgtgaaaatagtagagttcccatatatcccacaccgtttcccctgcattagtatggtgcatttgtcacaattaatgaatcagtactgatatattattattaactaacatccatactttattcagatttccttagtttttacctaatgtccttttcgtgttccaggatcccatccaggatacatttaatcatcatgtctccttaagcttctcttggccatgaaagattttccaattttccttgtttttgatgaccttgacaagtttgaggaatactggtcaagtattttttagaatgtccttccactgagatttgtcagatgtttttctcatgagtagactagggttatgagtctttgtgaagaagaccacacagagtgctacaatcatcatattgtatcaccaatacatactatcaacaggacatcactgttgatgttaactttgattacctggtttaaggaattgacttttaccttaatttgtttaatgtctaactcagaactacatatgggagggcacttaaacactgtcttaatatctggtttgtattcagtaggaggaacagcttgatgagacaaccatcaaaatggaaaaggccgggcgcggtggctcacgtctgtaatcccagcactttgggaggccgaggcgggcggatcacgaggtcaggagatcgagcccatcctggctaacacggtgaaaccccgtctttactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaaggaaaaaaaaatcctctggggaagagtggaaagaggattggtcatctcggccatttactacataaatgactttcggcaagttacctctgcacctgtaaaatggaataatggtacccaatagttctattaaacatctgttgaggaaatgtatgtgtatgtgttttgtacaatatttatacttttagatttgcctatgtaaaaatgaaaacactcgtgggaacagtaaatcttaagtagttaacataactttatagaataatttttttttctcttcagacggagtctcactctgttgcccaaggtggggtgcaatggcacgatctcggctcactgcaacctctgcctcaccgattcaagtgattctcctgcctcagcctcccgagtagctgaggctacaggggtgagccaccgcgcccggcctagaataattttcgattgctggttgagcagagcaaggccaatatgagttgaggaaagcagagatggaaaggctctttatagttaatgatttctcatttttgctttgcttccttttgccaaagtcggcttgtcatctgagagtggagaggatttgttagatcttatgaagccagagctcacttctgatgtgaaccaagtattaataattttggtggtggttttctgtactgcatctgagagagtaatcattgttctttgaagatgcaataattctacgctactacgggacttagggaaataatttttgaggataggaagcacagaataattaagatgacaagtcttcctgcctcaaaatcatatcactctgattcgaataaaaaataccaaggtttttccttcttgaggttttatactcatggaagttcttcaacctgaggtctgaaaaataaggcaaccccatcctctccttaaacaggttagagccagtacctttttatttctctatgcacggacaaaataattatgcaaaaaaaaaaaagaggcaggttttgtttttttttttgcactactgaaattcacacttaacatataaacaatctgctatatgcagacagcactggtgtttagagttcaatgatctggattcaagcctatttaaaaccagataagagaaagttcccaaacatctatgtgtcttggattcttcatctgtaaaattgcgttgttgagaagataatatgagactaggcgcgcaaaacaatttgttagagctattatttctaacccggaatgtgttcgctggcagtaacagtgcattagttacgattcatcgagggcagcttctggactttctgtttggaagcccagctgaggcaaaagcagcagtgcgtttaaaaattggagctcgccacattctgaaattctttcggttcgtgaaagcagtaacctaggaaacgagactggcaccacccctttcagtcctaaagcttggtttctcccgcttttctccattatgtttagggcatcgctattttacagtctttttgttttttctttccacatcattagcacaaaagagaaattccccttctacagaagcaagtacaaaacctttctagtcgctcctttttggcagcagctcacctactatttttttctattccgcggtcgcagccccagacgtcctcaaagacaaatattttcgcgagggccagtgtagggcaggaactccctaggccttgaatcaagggaatccagtagataacaacagaaaggactccgacccaggtacctgagacatctgagaccgccaaaattaacacaacaccctacgcgacagagaaaactctgggcggggagagagaaagagagcgagcgagcgagagagagagagagcgagagagagagagagagagagagagagagagagagagagagagagaaagagagcgagcgagagagagcgagagagcgagagagcgagagagcgagagagcgagagagagagagagagagagagagagagagagagagagagagagagagagagagagacgagaggaagcaacgttctcgcgacaagaggggtgtcgacggaaactcggaaatggtcccctagacgacccggccccagctagtgggtggggccagggtacatccgcccctttccggtttttttccccgcctcccaaccgtgaggtgttgggtttgggggacgctggcagctgggttctcccggttcccttgggcaggtgcagggtcgggttcaaagcctccggaacgcgttttggcctgatttgaggaggggggcggggagggacctgcggcttgcggccccgcccccttctccggctcgcagccgaccggtaagcccgcctcctccctcggccggccctggggccgtgtccgccgggcaactccagccgaggcctgggcttctgcctgcaggtgtctgcggcgaggcccctagggtacagcccgatttggccccatggtgggtttcggggccaaccggcgggctggccgcctgccctctctcgtgctggtggtgctgctggtggtgatcgtcgtcctcgccttcaactactggagcatctcctcccgccacgtcctgcttcaggaggaggtggccgagctgcagggccaggtccagcgcaccgaagtggcccgcgggcggctggaaaagcgcaattcggacctcttgctgttggtggacacgcacaagaaacagatcgaccagaaggaggccgactacggccgcctcagcagccggctgcaggccagagagggcctcgggaagagatgcgaggatgacaaggtaaggacgacccttttctcttcaaaccccatggtttcttttctccccggggtctggggcgggatgttaatccgctagctgttgtcttatgccttccagtatttcagtcctgaaggctcctttcacccccaacaaccctgtttctgtcagacttttcccagtttatcagtgccacgttctctggtccctgccagaaaaaaatgactgtaaattctggttctcaagagtggactgtgtgcagatgctgcctattctctaagctcagctggtgagttggcagtagtaatcatctggcctgtgtggcccccttaccttcaaagacacacaaatctggcgactgccaggtttggtgtggttattgtctcatttttattccgtgcacactgatcaatattaatttcgttatttaaagaacgaagccgcctctgactcctctacttatggtagtcatcatatattttttaagctgtgtgacttttaaaatctctatagggtgatgtattgaataactaaataatcagctatgactgcctttttgtgatcaaaatgttatgatagatgggccctcgagctatatgtgagacacacttgtgtcttggacatagttgatccatcattatctactcaatttgaattgttaatgaaatcagccaaaagattagaatctgaaaataaattttaagcagtggaatgtcatgtcagtgtcttcattgaaagaaaatagaatgaaattttgtatagctaagttgctattagggttggtgttttatgcagatggaaaactatacaaagttttaaatataaaaagtttaaaattgaactgtaatcatacttgctactaaataatccttgttttcattagctcattggtaactatattaatagtttatgacttagcaacttctgtaggtatagtagagttatgaaaatttctgggcaggatagtagatgcctttctatacacttctttggtaatcttcacatttttgtgtgtaaatgcccattataattacaagttttactttgcatatcaaaatcacttaagggtaagtcattatgaattaaactgtctgtgagcttctaactttcctgttgacagcctctacctggctttcttatttcatgaagattaaggccctcagctaagtgcttccctataaccccctcctcttcaccataacatagacatgctatgatagggtcaaggaatcagtacatttatatgtgcgctgcatgcttaactctaaagactgaaaaactctcgggcagagtaggtagaaatccatgaaagtttggagtattaaagtaaggtcttcctacttggcatggttgagcattacaattcacattcttctctctggtctcaaaggaaagtctcttgttgtaattaatactcttgattccattctttcatccattggactttttgttgttgtcgttgttgttgttgttgttgttttttgagacggagttttgtttttgttgcccaggcaggagtgcaatggcgtgatctcagctcactgcaacctccgcccccccggggttcaagcaattctcctgcttcagcctcctgagtagctgggattacaggcatgcaccaccacgcctggctaattttgtatttttagtagagaaggggtttctcaatgttggtcaggctggtcttgaactaccaacctcaggtgatccgcccgcctcagcctcccaaagtgctgggattacaggtgtgagccaccatgcccagcctctttttttttttttttttttaaagagacagggtctcattgtgttgcccaggctggagtgcagtagctgttacacaggcatgatgcactatagcattgaaatcctgagctcaagtgatcctcctgcttcagcctctgagtagctgggactgcaggtgtgcaccaccttgcccagctctactgaactgtctctttcagtttgtttcactttttaccttcaacagtatgtgggtgtcccctgttctcagtaaaggaaaaaaaatctgtatattcctttctcccaaccaacccatttgttttttcactttcattgctaaagtcaaattattgatggtctacaaatgttccatctacctattttttcataaccatcctaatcttaaaatgtctgccatctttctttcctccccttttttgaaactattctcttgaaggtcacaaatggcagtcttcctagtcaaaaccaaagaatatttttattcttactgtatttgacctcccagtagtttgatcctgttgattgtctctagctatttggaaactattttctttcttgcttctgttatactggactctccagtcttatcttcttcactatattctttgctggatttattttttctttccagtcacctagtaagggactctgttattgagcctttgctctcccataagagcagtattccccaaagtagtgttaaacagaatacccttcttgtaatatttcttaggtggtgaggagaaaaaaatgaaaaccttttttggagggaaatgttagtgtatcctcctcttggaattcataatgcctgctggaatataaaagctctgagaaatccattaataaagaaggctattcaattttgtttaactcagtcttgtttagtttatttgatcacaggtta

SEQ ID NO: 243 - DNA, 15073 bp, Homo sapiens
aaaaagattttgaggtcattttcaaataaaacagattttttaaaggtatattatatactaggctgaattattccttctgtttagatatcaaaatgtttttatacttaatttttaaaatacaagattagccaaacttgttttaaagactatcctttagtttattttgatgtgaatgacactccatgtttaatcatctattgtttgtggcccttgtctttctgatagttatttccaaattgacaaaaggaattgcattttaaaaaatttcatgggtagcagcaatcttctgagtacatacttggacacagcaaaaggtgctagtaggaaatagagaactagttaagacgtgatttgctccctcactgcaccctccaccctcaagttgcagtgaagttgtatgctttttgtgcttcttggctgtagtgtgttaacctttatatgattattcatttttatttcacagcaaaaaagaaaaagaaaaaaaggttttgatgttagatggaaattactgatttaactcaataaccccttaagatgctattgactttattttttataggttgaagttacattatgcatcttatgaaccgactataagggtgttacatgagaaacaccacactttactgaaggagaaaatgctgacctccttggaaagagacaaagtagttgggcaggtaaagatatagtcaaagctaacttaaaatgatcttttaatcatttttttaataatacaagtagaaatactgattttgtttctgagattaattttaaaacattttcaaccaactttcatgtaaaagagatccatttggaaacattcagaaaaagtatttctccatttaactacctataaagattattataaaattaggccaggggcagtggctcatgcctgtaatcccagcactttgggagaccaaggtaggtggatcatttgcggccaggagtttgagaccagcctggccaatatggtgaaaacctgtctctactaaaaatacaaaaaaaaaaaaacaaaaaacaaatagccgggtgtggtggcacaggcctgtaatccctgctacgtgggaggctgaggcatgagaatcatttgaacccgggagtggaggttgcagtgagccgagatggccccataccactgcactctagcctaggcaacagagtgagacagtgtctcaaaaaaattaaattaaatatcatttaattgagacataaatttatagcagattattaaattatagttagaagaaaaaacttagccattgtggtcaaacttgggtttaaatgccagctttgacagctataaacattaaccttaggagagtcatttaaacaaattggagctcagatttctcatatataaaatgtagctgcaaagaccaaagacataccatttaagattgctgtgaaacttatatgagatattttaataaataaaaactccctcataggtactgactcaagtttttggttatttttgctaatgcttgacatccttttagggtttttgtgtaggcttaggcctagggtagtgggtgagatacctttggcataaaaatttaagaaaaagaaacaaaatgtttatatgccactttaaaaccatttatcagtttttttagaatatataaaactgcaactatgcttaacattctattattgttttctggagattttcatttttggccaaactttgagaagctacaaaagcttacatgatgataatactcttttgaataattttatttgtcaagacatgctttaatcaagtttattttgtcttttgagtgaaattcttagcttcgaaaatgcaaaacatcattgtcttgatgccccttgtgcttgaatttaattttgtgttttgaatgtttgaattttaagtaatattggatacaatgataatatgatttggctgtgtccccatccaaatctcaccttgaattgtaatcatccccacgtgtcaagggcgggaccaggtggaggtaactgaatcatgggggtggtttctcccatgctattctcatgataattgagtgagtctcaagagatctggtggttgtataagcgtctggcatttcttttgcttgcactcactctctttcctgccaccctctgaagaggtttctaccatggttgtaaatttcatgaggactccccagccatgtggaacttgagccaattaaacctctagtctttttttttttttaatatatttttaccctaaaacctctattctttataaaatacccagtctcgggtatttcctcatagtggtgtgagaatgaactaatacaaatgagtttaacaataatttaaattttatggcattataatcaaaccttcagaatttcatacccttgcttcttttcatctaatctgtcttccccagtctcctaacaaaaggctttctttattctatatcctgaggtattaggagctagattcagatctcttcctatttcctattccagatgggccaagcttaagcttttgctacccatcttactctctttagtcctcctggtctcatgcttatctcccatataccatgtacaatatttgtgtttcaagttgctccttgatggtttagtggaaagagctaagaactgggaatggctggtatgaattccagttgtgttgtaaaacacccaagtgaggattcaggttatttaaatatttctttttactcacttattaaatagggataaattatttgccttatgattgatatgtgtacaagattaaaacatgtttaaaaagttaaaatcatttgatctatgagttagagttgaattttgcacactactgttcagatgtgcaaagaaatatatctttattatctgcaactggttttgtctttgaactcctactcctgctgaagacaaaagaaaagataacctgcatattaaagactatcccaatctttgtgagttaaaccagtctctttgggtttaacacagggtgtttgaatattatattaactgaatgtttagctaaaacatagttattagtgctcattttcttccttcaaatggcatgccctttttattcttccccagatggttcctagtaaaaaagttacttgtctatccgtatagcttaaagtctacaggctatattcactctccagtgtactgtgacttgtttgattaggttggtgtccaggtacatgaaacctggatagttctggatagctcctggatagttcctgggtagttcttttgtatgtgaacccaacacaccttgctaaatccatggcctctgccacaatatctgtgaactcctttatatctgtggcctcattatcctaaccctagctttttttctgctccagtacatcaaatattaacatttccatgtaccccactgaggtggttgaggcttctgatttctctatattggaaatacaagccatgagcaatttgaaaaccagttagggtccatctacacagatatacctttttcagtccattttcaacatgacctggagagtagtgtgtttttctagcacaatgtaaaatatgaaggactctttaaggggttgtcaattttcctaggctattgcctgaaaagctaacagcaagtatacttatattcctggagtatccctagagtatctggctttatttgcccttcatttccaactggccccacttgcatttttcacttggtagataaagtaggactcatgtctgacctgttgttacctcgtccctcaggcatctcgtccctcaggcacagaactcttttcacttctttgttctattggatggaatatcttcctatcttctttcatgttacaggatgctctatgtcctcatttgttacagcaatcctgatttacacctatttgcacaggggaatttttaataaattccactttcaccctaaaaatatcccaatttagaaaatctttattaatgggaaaattctatttttttatactttaagttctagggtacatgtgcacaacgtacaggtttgttacataggtttacaagtgccatgttggtttgctacacccatcgtcatttacattaggtatttctcttaatgctatccctgtcccagccccacaccccatgataggccctggtgtgtgacgctccctgccctgtgtccatgtgttctcattgttcgtttcccacctatgagtgagaacatgcggtgtttggttttctgtacctgtgatagtttgctgagaatgatggtttccagcttcatccatgttcatgtcaaaggacatgaactcatccttttttatggcagcatagtattccatgatgtatatgtgccacactttcttaatccagtctatcattgatggacatttgggttggttccaagtccttgctattgtgaacggtgccgcaataaacatacatgtgcatgtatctttatcgtagcatcatttataataatttgggtatataccccgtaatgggattgctgggtcaaatggtatttctggttctagatccttgaggaatcaccacactgtcttccacagtggttgaactaatttacactcccaccaacagtgtaaaatcattcctatttctccacatcctctccagcatctgttgtttcctgactttttaatgatcgccattgcaactggtatgagatggtatctcattgtggtttttatttgcatttctctgatgaccaatgatgatgagcattttttcacgtttctgttggctgcataaatgtcttcttttgagaagtatctgttcatatactttgtttttttcttgtaaatttgttgaagttatttgtagattctgaatattagctctttgtcagatgggtagatggcaaaaattttctcccattgtgtaggttacctgttcactctgatggtagtttcttttgctgtgcagaagctctttagtttagttagatcccatttgtcaatttttgcttttgttgccattgcttttggtgttttagtcacaaagtctttgcccatgcctatgtcctaaatggtattgcctaggttctgttctagggtttttatggttttaggccttacatttaagtatttaatccatcgtgaattaatttttgtataaggtgtaaagaagggatccagtttcagttttctgcatatggctagccagttttcccagcaccatttatcaaatagggaatcctttccccatttcttgtttttgtcaggtttgtcaaagatcagatggttgtagatgtgtggtgttatttctgaggcctctgttctgttccactggtctatatatctgttttggtactggtaccatgctattttggttattgtagccttgtagtatagtttgaagtcaggtagcctgatgcttccagctttgttctttttgcttaggattgtcttggctatgcaggctcttttttggttccatatgaactttaaagtagttttctctaactctgtgaagaaagtcattggtagcttgatggggaaggcattgaatctataaattaccttgggcagtatggccattttcaagatattgattgttcctatccgtgagcatggaatgttcttccatttgtttgtgtcctcttttatttcattgagcagtggtttttagttctccttgaagacgtcctttacatcccttgtaagttggattcctaggtattttattctctttgaagcaattgtgaatgggatttcactcatgatttggccctctgtttgtctgttattggtgtataggaatgcttgtgattgttgcacattgattttgtatcctgagattttgctgaagttgcttatcagcttaaggagattttgggctgagatgatggggttttctaaacatacaatcatgtcatctgcacgcagggacaatttgactccctctttttctaatcgaatcccctttatttctttctcttgcctgattgccctggccagaactgccaacttccaactatgttgaattggagtggtgagagagggcatcgttgtcttgtgccagttttcaaagggaatgcttccagtttttgcccattcagtatgatattggctgtgggtttgtcataaatagctcttattattttgaggtattttcgatcaatacctagtttattgagagattttagcatgaagtgatgttgaattttgtcaaaggccttttctggtggataagctttttgatgtgctgctggattcggtttgccagtattttaatgaggattttcatcgatgttcatcagggatattggtctaaaattctctttttttgttgtgtctctgccaggctttggtatcaggatgatgctggcctcataaaatgagttagggaggattccctctttctctattgattggaatagtttcagaaggaatggtaccagctcctctttgtacctctggcagaatttggctgtgaatctgtctgatcttggactttatttggttggtaggttattaattattgccgcaatttcagagcctgtgattggtcaattcagagattcaacttcttcctagtttattcttgtgagagagtgtgtgtccaggaatttatccatttattctaaattttctagtttatttgcatagaggtgtttatagtattctctgatggtagtttgtatttctatgggatcggtggggatatcccctttatcatttttttattgcatctatttgattcttctctcctttcttctttattagtcttgttagtggtctgtcaatattgttgatctttcaaaaagccagctcctggctactttgattttttgaagggtgtttttgtgtccctgtctccttcagttctgttctgatcttagttatttcttgccttctgctagcttttgaatgtgtttgttcttgcttctctagttctttttattgtgatgttagggtgttgattttagatctttcctgctttctcttgcgggtatttagtgctctaaattttcctctacacactgctttaaatgtgtcccagagattctggtatgttgtgtctttgttctcattgatttcaaagaacgtctttatttctgccttaatttcgttatgtacccagtagtcattcaggagcaggttcttcagtttccatgtagttgtgtggttttgagtgagtttcttaatcctgagttccaatttgattgcactgtggtctgtggtctgagagacagtttgttgtgatttgtattcttttacatttgctgaggagtgctttacttccaattatatggtcaattttagaataagcgcgatatggtgccaagcagaatgtatattcttttgatttggggtagagagttctgtagatgtctgttaggtctgcttggtgaagagctgagttgaagtcctggatatccttgttaaccttctgtctcgttgatctgtctaatattgacagtagggtgttaaagtctcccattattattgtgtgggagtctaagtctctttataggtctctaaggacttcctttatgaatatgggttctcttgctttgggtgcatatatatttaggatagttggctcttcttgttgaattgatccctttaccattatgtaatggccttctttgtctcttttgatatttgttggttttaaagtcgttttatcagagactaggattgcaacccctgcttttttttgctttccatttgcttggtagctcttccttcatccctttattttgagcctatgtgtgtctctgcacatgagatgggtctcctgaatacagcacactgatgggtcttgactgttaatccagtttgccagtctgtgtcttttaattggggcatttagcccatttacatttaaggttaatattgttatgtgtgaattcaatcctgtcattatgatgttcgctggttattttgcccattaattgatgcagtttcttcatagcattgatggtctttacaatttggcatgtttttgcagtggctggtactggttgttcctttccatgtttagtgcttccttcaggagctcttgtaaggcaggcctggtagtaacaaaaccccttagcatttgcttgtctgtgaaggattttatttctccttcacttatgaaacttagtttggctagatatgaaattctgggttgaaaattctttcctttaagagtgtcgaatattggcccccactctcttctggcttgtagggtttctgccgagagatctgctgttagtctgatgagcttccccttttatgtaacctgccctctctctctggcggcccttaacattttttccttcatttcaaccttggtgaatctgacgattatgtgtcttagggttactcttcttggggagtacctttatggtgttctctgtatttcctgaatttgaatgttggcctgccttgctaggttggggaagttctcctggataatatcctgaagagtgttttctaacttggttccattctccccatcactttcaggtacaccaatcaaatgtagatttggtcttttcacatagtgccatatttcttggaggctttgttcatttctttttactctttttctctaatcttgtcttctcactttatttcattaagtcgatcttcaatcactgatatcctttcttccacttgattgaattggttactgaagcttgtgcatgcatcacaacgttttcgtgctgtggttttcagctccatcaggtcatttaaggtcttctctgtactgtttattatagttagccattcatctaaccttttttcaaggtttttagcttccttgcgatgggttagaccacgctcctttagcttggagaagtttgttattaccgaccttctgaagcctacttttgtcaactcatcaaagtcattctccatccagttttgttccattgctggtgaggagttgtgatcctttggaggagaagaggcactctggtttttagaattttccacttttctgctcttgtttctctccatctttgtggttttatctacctttggtgtttgatgttagtgaccttcagatggggttttgatgtgggtgtcctttttttgaagtttatgctatttctgtttgttagttttccttctaacagtcaggccccttagctgcaggtctgttggggtttgctggaggtccactccagaccctgtttgcctcgctatcaccagcagaggctgtagaacagcaaatattgcagagcagcaaatattgctgcctgatccttcttctagaagctttgtcccagaggggcacctgcctatatgaggtatcagtcggcccctactgggaggtgtctcccagtcaggctgcatggggatcagggacccacttgaggaggcagtccatccattctcagagctcgaatgccatgctgggagaaccactgctttcttcagagctgtcagacatggggtttaagtctgcagaagtttctgctgccttttgttcagctatgccctgcccacagagatggagtctatagaggcagtaggccttgctgagctgcggtgggctcctccagtttgagcttcccagctgctttgtttacctactgaagcctcagcaatggcagacgcccctcctcccaccaggctgcagcctcgcaggtcaatctcagactacagtgctagcagtgagcaaggctctgtgggcgtcggacctgctgagccaggcacgggagaaaatctcctggtctgccagttgctaagaccatgggaaaagtgcagtatttggacagaagtgcctcgtttttccaggtacagtctgttatggcttcccttggctaggaaaggcaaatcccccaaccccttgcactcctgggtgaggcaacgccctgccctgcttcagcttgccctccgtgggctgcacccactgtccaaccactcccaatgggatgaaccagcacctcagttggaaatgcagaaatctgtcttctgtgttgatcacactgggagctgcagacgggagctgttcctattcagccatcttggaaacgaccttaatttgaaaattctaaagagctaatttcttgatatctaatatggaacagttagtcccactcttaagataacattgaaaaaaataaataaaatggagaagttaggatttataaatagcttttctctctcaaccaaatctgctgttgaaggtggtagattcactacaatttgagaaagtcaaatttaaataggaggtgctattgctgccactgagctgtcaccacaggttttaccatggacaatgctaatactgaatacttgatactctttcagaattttgttatacttgtcaatggaaactggatgtggcagccaccattctcaggataaattccaaattctacattgttccttatatcactaaattttgttcagaatccaaaatgggtacacaggattgatggagccaatgcaagtcctagttataggacaagctgtgtaaatatctgatatctattgcaaaaggtggaagacacatgattctctaaacccaaactgctaagtggccaaagcgactgtcaaatatccattatacaagtctaaaccaaggctcaattaacctactctccaaattagggcacagaatatagtcctagtcctgtcagctctccaggtgtgtccttgtggaacaagtcaaggttaccacttaaagaatggaaactgtttgtgtacccttcttacaaagaatgatttattgccaaccaatcctttctttctgttgtagcatactaatcaggtatatcctgggtgtacaggcatagattagcctttgaaattgaacatattagtagtgtgtcatggagctatagaatgaatttattcaaagtatgtgtacagagaaaatatcttaaaatatgtgaaatgtttctctataatgtaaaatagaagataggttacttttgtgcttatattttgaatatttctttatttcaacgtttgatgcagttacgctttgagaattcatttccaaccaaactttaggatgtgagttaagagcagtaagacatcttatgttttctagctggattcctgattgttacttccttaaaaactttatcttaatgagcatttagcttactgtgtttctccttaaacctataccttgcataaagaaggattgtataataatttaaaatttttgattattatctagtttgcatatgaaagagtgaaaacacactgtgggatgacaaaaatccgataggaaatacatgttttcaaatttctttagtagatactagacagtgaatcaacatttatttaaaatgtaatgaaaaacctataactttgtttttggttttaagaaattattgaaaatagtgttcagaattttgaattagagctccatgacccaagaaaaggtgaaatagaattgatttgtaggtatctatgtatactaaattatattttatcttttttagatcatgggattctaactcagaatatgtatgtatgtgtgtgtgtgtgtatatatatatatatgtatactaaaaactaaatctaaatatatatatatattttaggtctgtctgcttggagagtctagaagtagtgacactccaccagtaatgaacatatccagtgttaggatcttgatttctaatatcactctgtaataaaaggaaaggaaacagggttctttggagaagtgtctgattctagagctgggcagataaaatactagataggcctggagcacttgggacattttcttgtgctagaaaggaaggaaatgctcaaaaagtagaacagaaaagaaaaaaaaactcaacataataatgggatatgtcaagttatgacaaaggaactgtagtgggcacctgcagaggttggtggatccccaactaaatttgatttggatattcagactgataatgccacacacacacacacacacacacacacacacacacacacagaggctgtgaataaattcactacttgtggaactgaatttgctgaggagagctgcacattacctcccaagcatttctgaaatggcttgagagagcaagtaagggagactggcttggggtttttattgcggttgggggttagggccagggtgagaattctcatatgtgaggtgaggcttgagtcatttgaatctcccatcagtaccagacaagggagtacccaggcattcttgtccagttgcccagatgttgggcacaagggaagaaggaggaggtaaaacttaaaggctgttgacactcaaacatcaaacaataaagtcaggttcctcattataggaatccaacctgaaagagcttccagtgatcaaaccttctgaaacaatttgagcaacaaaataatgtagtgtttgattataacccaaaatataaaataaatatctttgattccttaatggtataaatataaatgattagtaaggacatgtgagagagtagacaaatctcccatacagaagaatctcgagtaatatatgttgataatccttccctcaagtaggtggagcttaacaactcagctgttgagtgttggctgcactttgtaaataatgacttgcatccagaaatgcaagggaaatagggaagaaagtaactttacagtggggaaacctgtcaaccttctcatcatgtaaccaaaggatcaaggtgaacatcatcagttttaagtactgttggtagcatgaacctatgatgtaatatgctaataatggcactcccctgtgatcttcttgcaaatccataactttagtctaaccatggggaaaatatcagacaacctcaaatctagggctattctgtaaaatactgtcagactaatgctccccaaaattgtcaaggacattaaaatcagggaaaatctgtgtattagtccatcttgtgttgctataaaggaatacccgagactgggtaatttataaggaaaagaggtttatttggcgcatggttctgcaggctgtagaagaagtatagcaccagcatctgcagagagatctgcctccatgacccaaacacttccccctaggccccacctccaacactggggatcacttttcaacaagagatttggagaggacaaatatccaaactatatcagtctgagaaactgtctcagtccagaggaggcttaggagacctaaaaactagttgtaaggtgatattctggatgcgattttgaaacataaaaaggatattatggaaaaattaataaaactaaaaatatggcctgtagttcataataatatatcaatattggttcattatttgtgaaaaatgtatcattacaatgtatgatgttaatgggggaaaaagggtatgggataaaacaggaattctcagtactacattagcaactctcctgttaatcttatgctattctaaataaaaagtttatttttgaaatttataattcttttggcttctaggaatagatagtaatcttttacttttttttaacctaggcatttcatgagcactcatctataggttataattaataaattatgttattttctattaataaagaaatattactattcagtgatagtagaaaaaagtgtgtatctgtatgtaattgaacagatggtattttgtgttggtataatcatatacaatgcaagatgaaatagcttttcaaggtcaaattttaaattaagtatttttcaggaatacaggtaaatcatgacaccaaagctaacaaaagttcttagttataagacatgtttaataaaatagagaatatatgtgggtggaaaatgagctaagagttgggggaataaaaacaacctcttcatattttacattccaagtgataattaccttgtattttataaatataaagatgatagttattgtgaaacaatttgaacagaggaaaaacctctctcaaaatagagaattgaataattattaaagtgtacaatgagtattcttaattcaggaaactatgccgtgaaataaatgtttcagatgcttacctaaaataagtaattaataattagctggtggaattatattttaacttaaaattctgtttttcttttgttaaaatttatgttttattaaaaaaggtataaatttaaaagagattaatattttttatattttacaatggatatttaaatattgtgttttatgtaacctttttaaaagtcatttagtgtataatttcatttctttgaattttactttttagatttctggacttcaagaaacattgaagaaactgcaaagaggacatagttaccatggtcctcaaattaaaggtaaatgtaaaatgtgatgaagctctcatttaatatagtttggtgatttctcaaccttatcagtgattaatattctagagatatttaaaggtgagtaagtggtggctatttcacaaattaaaattttaataaaaagattaagaagaaatatagatatcatactgtatggattaattatagagaaaaacaagtcaactataatggaaggacttctgcttctggtcattatacctggtaccagactagccttctctgtgtaaataactctaaagctaagctgtaagatcagacaactacttttaggcagtagaaaacagacagctcaagtaacagaaggcaattgacagaaggaaaatttataaggtgagctctgccatcaccatggctttgggtctgtggaaagttccaaactgagctttgtggagatggaagccaataagagcatgacaatcctgataattggaaatgtcagagaccctagttcacagcttttgaagccactggaatctgtagggaaagacaccagagaagagagctgcaatgaggagtggctcagtttgtgagggagtttactatgagtccttagctgaggctgcaatactatacataacaacactacctgacacttacaagagagatacaattatataggatcaagaggaggccagagattgtagaagttaagtagtgatgcgaaacattgcaaatctggccatgcctgggtggaaagacctctttcacaccttgttaacaacacagtaacattcagcatcccatatccgccttataaaaccaggaacaaagcttacacagcattcttagagaggacacagaatttggagtttgagtcttgccaagttatagggccttgagaaacatttagggctttccatgga

SEQ ID NO: 244 - DNA, 15229 bp, Homo sapiens
aaaaagttgattctggcaaaccaacctcatttatttttgaagttagcccaacattgatccctcgtcagatagttgagcctcttccatacaacctcccaatatggtacatcaccaaactagcctctggggccacaagtaatacattcagtccaaatacagtccaaaaaaaaaaaaaatcacaaagttttcttacttgcatctaaccaagtttgccaagtaaaatgagaagaaagagtatctcagccattagggagctttgttccccagtatttgtcattcagttgtaccaacaaattgcgtaagtgtagccacaacccccatcatcctttttcctgttgtggttgagacagggtctcactgtcaaccaggctggagtgcagtggtgcaatcacagctcactgtaatctcgaattcctgggttcaaaggattcttccgtctcagcctcccaagttgctaggactacaggtgcacactaccacgccaagctaattttttttatttattgtagaaacagggtctcgctgttgcccaggctgatctcaaactcctggcctcaagtgatcctcctgccttggcctcccccttcatcgttttgatttatcctttcttctttgcccatgctggcagactctgaattggcatgttctagttatcgtggttgtttaacaatgaccccaaaatttagtggtgtaaaacaaccatttatcatgtcatggagtctgtagatcaggaatcagacacagcagagctgacttgtccctgttccacaatgtctgggacctcagctgaaaatattaaacaggctggggctgtaaaggcatcacatctctctatctctccacagtctgcacacatgctctaacagagtggcttcaatgtaactggacttgttacatgttagctcagggtagcctatacttgtgttccaagatgaaagatgcagatggaaggtatagtggttgtcttttatgacttaagcttcaggagtcaagcagcgtcacttctgcttcaatctgctagtcaaagcagtttataaaggtctgcccaggttcaaaggaagggaatacaaactccagtttgataaaagaatgccagcttcacaatttaataaaaacaaacagccgggcgtggtggctcacgcctgtaatcccagcactttgggaagccgaggtgggtggatcaccaggtcaggagttcgagaccagcctggccaatacagtcaaaccgtctctactaaaaatacaaaaattagccgggtgtggtggcatgcacctgtaaacccagctactcagaaggctgaggcagaagaatcgcttgaacccaggaggcgaaggttgcagtaagccgagattgcaccactgcactccagcttgggagacagagcaagactccatctcaaaaaaaaaaaagaaaaaaaaagaaagaaaagcaacacaggacagaacatttattggtgcagccatcaatggaaaaaatacaatctgccacaactcttttatctgggacagcacctactctgcaagtctttacagagggatccccatttcatcaatacagtaaaagaggctagtcaaggctgaaagtttccattctagtaatgaaacatgaaaaattcaggttgagtgagcctctgcaacacatcagactcccactcctcactcttctccaactggttcctgccccataccccacaaacctggtttcaccactcatctctccagaaagagaggaactctttttattgcttgacttctacattcacatcgtttgtatttgaaaggaaacacatgcacaccctttacttgactttattgccatttccaaattcaaccacactgtgacatattttgtaattactcttgtgaaaatgaaacatcatttttactcagttacctacaattatatacaatttttgaccctaacttactgctgcttccacaactccaccaatgacactgcaggtcaaagtcacgagtgaatttaacttgtcctcatttttggtgcacttgacactatggcccattatatctatttgcttgaaactctcactttctctgtctctgtgacattgtgctgttctagttttctaccagttttctccttcctcttcctccactggatcccaatgtttctcagtactctttgtggcctctatgtgctcatcagcattcacaagttcaaagcacccctcttaagctgatgactcccccactatacttccaaccctaaccactcagccaggcttaattcctatatttttagctgcctataggatcattccatttgcctaaaaccaaattaatcatatcctccctacaaaacataatgtattcaaaacaaacaaaatagaaaaatctgcttccctttctagcttcctcattttagccaatagtgccaccattttccaagtttcaacacttgtctagacaagagtcatttttgactcctcctcctccttaccttgcacaacctctacttaaatccaatcactgaattttcagatctggaaagaactttcaagataatctagtttgtgctccttaaacataaataagagaccttggggctcagacatattggctgcttgcctcaagttcttccaaccctgattataagacactttctattaccaagacttatttaattgcatttttccaaaacttccacacaaatctttttttttttttttgagagggagttttgcactgtcaccagggctggagtgcagtggcgtgatctcagctcactgcaaaagagggttcaagcaattctcctgcctcagcctcccaagtagctgggactacaggtgcccaccaccacacccagctaattttttgtatctttggtagagatggggtttcaccatgttggccaggctggtctcgaattcctgacctcatgattcgcctgccttggcctcccaaagtgctgggattacaggcatgagccatcgcacctggcccacaaatctgttttctttgtagaatcagaagatctgggtttgaacccttaaaagctgactataagcaagtgaatagtaactgctagtttaaaaactgcctcctgatttagaatttatgatagaaatcagattaaatttaaactcctcaggcaggtattcaaaccctctcccactcctcctcctaacccaaactggctgactttagtatcaagcatggtttctcactgaacaaattctgtttcagttggcaggtcttcttcccatctttatctttctcattcctggttcttgacttccactcagttgtttccccagcctagaagagccttacacctcagcagacacttcctttaaggcccagattgaccagcattcccagcatgggtctttctttttttttcaatctccacagcatctcaactctactgcaaaatcttacacaatatatctttcacttatctgcatagtgttctccaaactaaggagctaaataatattaaacactcaaatttataataaaggcttgcaaatttgttcttacaacgaaacactggattctgctttttagaaagtattaaatttgatttacattcaattttactaggccaaaattaacaaacaagggttatttttttcacagtgactataccaatacagtttttcaacagtgaatagaatgcgtgatgccctcgaggagctcataatctagtgttaataaagctagatatgcagacagagaaggttaaagaacacaacataacatataccatcttactcatcagcttacttatgtcattatttcaacatcaatccacagccaaaaacctggaaataaaactgttatcatgctgggtgcggtggctcatgcctgtaatccaagcactttgggaggccgaggcgggcagatcacctgaggtcaggagttcaagaccagcctggtaaacacagtgaaaccctgtctctactaaaaatacaaaaactatccgggcgtgatggcgggctactcgggaggcagaggcagggagaagtgcttgaacccgggaggcggaggttgcagtgagccaagacgcgccactgcactccagcctgggtgacagaatgagactctgtctcaaaaacaaacaaacaaacaaaaaaaccatcctcggctgggcgcagtggctcatgcctgtaatcccagcactttgggaggccgaggtgggaggatcacgaggtcaggagatcgagaccatcctggctaacacagtgaaaccccgtatctactgaaaatacaaaaaaaaaaaaattagctgggcgtggtggcgggcacctgtagtcccagctactcaggaggctgaggcaggagaatggcgtgaacccgggaggcggagcttgcagtgagccgagatcgcgccactgcactccagcctgggcaacagagtgagactccgtctcaaaaaaacaaacaaacaaacaaacaaaaaactatcctcatcagacacacaaaacctccacagcaataaaatagcaaagagccatggtatttgtaccttttatccacaggagtggctcacttatactctgtctccacatgctcagttacatggttttcttcagggtttgtctgattagaaggtgcaaattctaaaaggaggctaattctaaaaacttgccaacaagggaggaaaaaaactacagaactaaacaatcaaaatgggttcactcaacaaacactgagtacatccttactgaatacaaagatgaagactacaagatttaaatatgatattttcacccggagattagtaaagatttttttaatgaaaatcccagtactggaatcaagggaattgggtccctcaaacactttgaggggcaagggggaatattctggaggacaacgtggtagtatgcatcaaacgctttgctgtgcctgccctctgaattagcaattatgctccaggaatacaggctatgaaaatcagaagcagcaatacagacctatgacaagtaggcttatcaccacattaattgtagtgtgatcataaatataatgtatcttccaggatgaacatttatatgacaaaatacaatgcagtcattaaaagctgccacccagaagtctgaaggatataaagaaatacagatgaaaacgtcataaaacaggccaggcgcggtggctcatgcctataatcccaacactttgggaagccaaggtgtgtggatcacctgaggtcaaagttcaagaccagcctggctaacagggtgaaatgccatctctactaaaaatacaaaattagccaggcatagtggcgcacattggtagtcccagctacttgggagggtgtggcaggagaatcgcttgaacccaagaggtagaggttgcagtgagctgagatcacgccatcgccattgcactccagcctgggcgacagagtaagactctgtcccaaaaaaaaaaaaaaaaaaaaaaaaaagaaaagaaaaagtgataaaaccatatataacgtataatcccaatttttaaaatgaccatattatatatataatatatatttgtaataaatatataaatcctggcccttctacgtacaagcttataaagttgaagttttttactaagtttcattttcctttttgtgaaatgatgacaataataatacctacttcataaggataaaagagcaatccctgttgtgggattctgttccgaacaggacattgacaatgtcaaaacctcccaaaaggagcttcaaacttccaagcactaaccactgcatgtataagttacaacagctttctaactggtctcctttttcatctttcctcacactgatgcatccaacactaccaccaaatcaatattcctaaaatcctaatttcatgtcatttccttgctttaaaaatctgtaatggcctcaagatgagattctccttaggccaacataacttgaccctattttacctgcactgggaagtattgacagtagtgtgaaatcaggttgttctaatttgaagcctgagtacaccacttattagctgtgtgaccctaggcaagtaagttaacccctctaacacttcctcagcttctcatctctaaaatgtggctagtattcatcatatgggtgtttttacagagtgaaaattcatataaagtgcttacttagcactttacatgtatgcctggcactggagatgcatcctttaaatgtgagctgttactacttccctaaactgtctactccacctgggctgctcttccagatcatttctaacacacattgcccaacttaggcctttggctggtggtgttctcacccatgaggcaccattccatcacaatcaccaccatcaacaaagagtatgtgttcaacatttacactatatattcaaggtgtaggctggaaatacagaggaaaaaaaaaaaaaaaacagtcccaaacctcagagctcatagtctaataatgaaagagagacagaggaagaggtccaataattaggggtgacaaaggaagcacttcctggaggcaagggagatgcttacactgactccagaaagctgcgtgggtgaatcaggcagtgtgggtgcatgtagagtaagagcatccagtacagcaatcacagtcactgtattgagtctggcactgctggagtactaaggctaagggagagcagaggctagatcagtgaggtcaggaagtgttggcactttattctgcaggccagcagcagccactgaataatattaagtagggtacacctgtctaggactctagaaaagcttacactgtgctgtccaacacggaagccacatacaactactgactggaaatgtggctagtgtgacagaaattaaattttaattaatgtaaacttggtaactgatagcaattcagttatcaaaaaccttttatgtatgtttggaacaattaaagagtatgtaggccgggcgcggtggctcacgcctgtaatcacagcactttgggaggccgagacaggtggatcacaaggtcaggagatcgagaccatcctggctaacatggtgaaaccccgtctctactaaaaaatacaaaaaattagccgggcgtggtggcgggtgccctgcccatagtcctaaaaatacaaaaattagccaggtgaggtggtacacacctatagtcccagctactcaggaggctgaggtgcaagaatcgcttgaacctgggaggcagaggttgcagtgagccgtgattgcaccactgcactccagtctgggcaacagaacaagactctgtctcaaaaaaaaaaaatgtatttaatgaactttaaatacagatcaattatttctgatgaaaatttaatgtccaaatttaaatgtgcagtaagtgtaaaatatgtatcagatttagaagacttagtacaaaagtaaaatatctcatcaataatctttaatcacatgttgaatattttgaatgtattagagattacattagaattaatttcacctgttcctttatattttactgcggctactagaaaatgtaaaatgacatacatggctggcattatacttctattggacagcaatgatccaatagatcccaggacagctgaaagaggaaatgagaccagaagcaggaagaacaattaaaaagactctgataagcatccaggtaagagagacaggcctgattatctaaattctgcccatcttcaaaacctaattcaagatacactactgcctccaaaagctctcctaatcctaacaattcccaaggagttacctttctctgaactcctgaggcacttatctgtagcattcacttcaacactcattcatttgccacctgtcatttctatttaattttggggtaatttgtttctcagattagaccagaagctcctaggctaagggccataatttaggcacctttaatttttgcatgctgtgtaatgcatttttgatacttttaataaacacaggtacatgactccccaaaaatctggatacaccttcatgggtgactttacctttccacagcagaaggaactgagaatctcttttccttcaagaaccttaaagataggagctaaaatgatgtaaaaatcaatcaaaactccctccaagccaatgttccgataaagtagtgatatttaatcagtgagcaagcattagtagactgtataggataccatcaagaaaaaaaaatgccaagacagaagaatttaggcttttgacaaattccataaaaagtcaaacaaaaaatttctgatcatctctgatctctaccgccagagataacctttgccaacctaagcattaagaactttcaatcaaggaaaaaacatctattttaaaaattaacccctaaatcaatccttctaataaatatcacattttctaggtagggatacacatattaccagtaaatttacaactcagcattttcccatctaaattagagtaaggtgaagaaaaaaaactttccagggaaatattaagaagtagtataaatgtattttactgcataatcgataaagtatttcacctaaaataccatttaaattttctacaacacttgactatacaacggccagcttgcaccactacagaaataggaagctagcagcaactagtaaaaagcaagggacattctgtggtgatcagtactgacctgggaactttgcagttttcagatttttcatgtttgacatttaaaacagaaaactgacaagtttctaataagaaactaaaagttacatcagaattgatcttcttgcatgtgtttaatggctacgaagtggatattacaaagtgcagttgaagactctatctccaaagaaacaatcgagcaatcaaagatgagctaggatagcttgtaagggaacagaaggcagtcctttctattctgaaaggcagaagaaataggagaaacctgtcaaacaacctggatgaaatcaaggagttaacaagcaacactcatttcctttagcactgtgagaaaattccggttgctaatagaaagctgaggaaagtttggtttggcttgtttcattttgttttccttccaaatcatcactgagtatgaacgactgctttcctctcctcacattactcagtaaaaactcccccattgaattgtcttccggtgccctgctccccagcctcccagaacggcccccgcccccgcctccctcccagcaaacgtgctcagacgcctctgggcttgttgtggtctcgccagtctgcggacaagcgctccaaactcaatggacaatggagctcacccccgtcaacgcgaactacaaagctcaggagggccatttcccttttcctgcccagatgctgttttcgctccttcgaagcaagatcccatgctcgactagacggccagtgtgcgccaggacccgcgtgtctccttccccacctgcagagctgctgagcccctcggcccccaaataaattgtaccgcagcacacaggccaaaaagggccccccaccaccaggggcttggctggggacagtggcttcacggtccaggtagggatggagggaacgtctcttgacgcttggtcatggccctcaagactaagccgtctccactgttccccctccccagctccaacttgcctcccctccccccactgcgagaagacctaggaggtgcgggcaggcagcaccgccacctcttcctccggtggagcgctcggccgacactcaccctttcaccacaaagaaggggtcctccatggacatggcgtcccggccccggccgccttcacctcctccgcgcacagggcgcccgtgcctcccggtctccctccgcccaccccgcctgttcccgcagctgcccgcgccttagtctgggtgaagccgagcagcgggcacgcgcacaggccaggtgcacaggacggccgctggtccagcactcgctcagcaccactggccgaatcccggactcgggcgccggccccctcggcagcctccagtcccggctcctcccgaagcgtcggagggcctgaccccacccccgggaccctcggccgcggccaatcacgaacgccgcctgaaacacgacttccgcaccccgctcacgtgaccagggcatatatctctctctctctctctctctcctctctctcctctctctcctctctctcctctctctcctctctctcctctctctcctctctctctctctctctctctctctctctctctctctctccccccccccccagtgggcggggcttacgcctgcgtccctcggccctggaggcggagccctcggggcggtggaggtgggcgggcttctacagccctctcctcaagcttgagggtgaggagtggcttgttccctcagaactaggcagtcggcttttcaggataagctgtagttgtacctgatttgcaaaatcctcttacctttcctctacttttaatacttaattttgacagtatgtaatttataaatctatctggtcctcgacttaaaatgaagcatagtatctgattataatgttacacagatcctttaagtaggtcttgctttgtgttggacagtgtgctaaaggttgtgtatgcatcatctcagtatcctttgggggaaagtattattcccccctccccctttttggggggcagggtctctctctgtcaccctggctggagtgtagtggcacaatcacagctcactgcacccttgacctcctgggctcaagcgatcctccggcctcagcctcccgagtagctgggactacaggtgagcgccaccacgcccggctaatttttaaattttttatagagatggggctctcagtatatttcctaggctggccttgaacacctgagctcacatgatcctcctgcctctgcctcccaaagtggtgggattatgggcgtgagccaccacaccatccatttttctcattttgtagataagaaaataagttcagagaggcttgaagacttcctgtagtcacacagcctggacagggcagaactgcagattctgtgcactttccaccagatggggtgtactttctgttgctgtacattctgcaaataaccatgtaaagtaatttttcatacagcatatggtgcttcccaggagagcacaccttcgaggaataaagaaggggccaggtatgacaacttcctctcactgtggttcaagagctattcgagaaaacattttgcccagaaccattaaccaactcatatgctagatatgctatgaaatttgtggatggggattgtggactttgattgctgaaaatcattgagcacttactgtgtgtgtgtgtcaggcaggatgttaagtgttatctcagttgctcttacaatgtgataattactgctatcatgcccattttataaatgagaaatctgagactcggaggttaagtgacttgcccaaggtcaccagtctggagctggcacagtccttggagcaacacaaaccccgtttaaaccttggctctatcattcagttcctcatctataaaacataaataataatagctagttcatgggttgttgtgatggttaaataaaaatgtgtgtaaacctcaagatcccaaaggactaagttactgaagtcaggaaaaccagtaaggacgctgctaaagtcatgtggcctgaagggatgaggtccagaccaggatgacagcgattgagaacagagaaggagtgaatctgacagatgtttcaaaaggaaaacaagactaaacacctagacatgatgaggggctgaatgggtttcaggaggggagagaagagaggggtgaaagccaaaatccctggaggagcgaatgatggaaggcagatgtggggaaaggaagcagtgtccaatactagtgattgctaatgtttattgggagagaactgtttaatttacttagctggggaggtgaaaacgtgtcatcgttcattcattcaacaagcacatgtaaattgaggggtaggtgagcatggtgttgaagaccatccttggagtctgattgcttgagttctgctgcttcctgactgttgcatctcaggcaagccgcttcatctctcactatcctcaactgtgaaatagacaccgtaataacagcttccttatagagtgtcatgaggtgatgtgtgaaaagtgcttaaaacagtgcctgacacatgttgtgctcctactgtgtgctaagcactgagacacaggcatgaacaaggcttggttcttgccttcaaggaactgtcagactggtgggagagacagactggtgggagagacacacagtgagagaagggcacaggttgccatagaaacacagcgacaagataccagtatatttgtgtgttttcggggctggggcagggggttcctaagcagtgactagaagcagccaggagaagggggccatgttgctggagtagaaggaaaaggatgggggcagcaggagctaagcctggaggtggacagggtcagattatcagggcccttgtttgtaatgttcagaatagtggacgcttcctatggacagttccccatggggactgagggaattgacagggtcagattggcatttgagacagatgcttcagtggctaggaggttatggtccagaggagggatgagggtatcctgagctgggcttgtgacaactaaggtggagaagagtgatgcatttgagacatactttagaggcaaagttagtatacttggtgactgattggttcagggtatgggggaattgatgaaagaagagggaggaaggcttctggggttgtaaatgggtagtgttggttccaaccatcaagaaagagaacacaagaggaggatttgatttagggtgaatgtaaattagctgttagcatgtcatttatccccaccaaacagtaaactcctggagggacaggatactatgttaatgttattatcacctaagtgcctgacacggcctcttattatctgttccatgaatttcttaattggaccacatatgacaggccagagttttataagtagtaatagaagatagaggacagaggcttgggttcccataattaggggattagaaaaagcaccaacaatggagatagtggagtgtcaagatataaaatgtgtgtatgtgtgtgtgtgtgtgtaggtgttcctttctttaatgtgtcaccctcctttaccctctctcaaactagaccttggcctccactgcccacaaggaaagggaagctatggctaaaatgcaaggagaaacaaaggaggttctttctttctttcttttttttttttttcatttaataggacccacgtcctggcataaacaataggttgggaagaatactcagcaaaaacccatctcttcccacacccccacccctaccccacccccaacccaaaagaataatttaaatttctcagggaataaaaaatcaaaacagtggttgtcttgggggacagagtttgactgggaagggaaactttcttgggtactagaaatgctctgtatcttgacggagtgtgtgttacatgagagtatcatttgtcagaattcctcaaaccgaaactcttaattggacttaacttctgttcatttttctgggggaggttgacatgccaactctgagctttctgtagagttctgagtgggcagccaggagaacctctggttcctgagtgagtctccaaagttaggagagtgaatgaggaagggagcacactgggtcctgcaatgcatcttctgcagaaataaggagatggcaacacagagaataaggcacaggcagccaaatgagctgaggatcagaaaggagccaaccatatcactggggatgccaggatagacctgagagggattgcagtgggtagccaccccctgcccctggaagctgcgggaatgccatgacacccctacaaggggatctcccctactctgaaataatgacattcagcctgctccttcactagcctgttataaggaacaactggatcatatatgggaataattttttattttttaaattttttattttttaaatttatgaggccggacatggtggctcacacctgtaatcccagcactttgggaggccaaggcgggcagatcacaaggtcaagagatcgagaccatcctggccaacatggtgaaaccccatctctactaaaaatacaaaaattagctgggcttggtggtgcgtgcctgtagtcccagctacttgggaggccgaggcaggagaatcacttgaacccaggaggcaggggttgcagtgagccaagatcacgccactgccctccagcctggcgacagagcgagactccatctcaaaaaaaaaaaaaaatttaattgtggtaaaatacacataacataaaatttaccatcttaaccatatttaagtgtacaattcagtagtgttaaatatatttgccttgttgtgcaaccaatgtccagaactcttttcatcttgcagaactgaaactctatacccattaaacaactccccattctcccccaacaatctctggcaaccaccattctactgtgtgtctctatgaattttactactctgggtacctcacataagtggaatcatacaggatctgtctttttatgatttgcttctttcagttagcatgatatcttcaaggttcattcattcattctacatattgcagaatttccttcctttgtaagcctaatattccattgtatatataccacattgtgcttgtccattcatccatcagtggacgacacttggctttctttcatcttttggctataatgaataatgctgctatgaacgctggtgtacaaatatctctttgagaccctgctttccattattttggatatatacccagaagtggaactgctggatatggtaattctattttaaatttttttgaagaacagtcatattgttttccattttacattcctgctaaaagacacacgcattccaatttcttcatatcttcatcaacacttgttattttctgggttttcttttcccttatagcagttgtactaataggtgtgaggtggtatctcattatggttttgattcacatttctttaataattagtgatgttaagcacctattcgtgtgcttattggccatttgtatatcttttttggggggtggggagaaatgtctattcaagtcctttgcccatttttgattgagttgttttgtttttgttgagttcaccctaaatccttcttgaaacaaggtaaagaaagggagaaaagtgttaacatagatataggatatcatactcttcatcattatccaaccttttagaaaccctgatatacatgtacatattcc

SEQ ID NO: 245 - DNA, 16185 bp, Homo sapiens
actccaaatttcagtgaagaacatgaagtgcataaaggaatcacctgagtaaagatatgaaatcaataattcacacaaaagtactctgtttccaaagaaattactgaaatgctatattttaaattgtttttatataataaaatgtcaaaagagttaaaatattttattatgatttgtaagatgatagatgcaaataaaaagcagactgaaaaagatcaggaaacaagtgaactagaaaacagaaataaaagcttttgattgctcttcccctacccaacacacaaatagaataaacataattgagagttataaagaacagatattaaaaatgaaaaaaataagaattgtagagaaaatattaaacgtaaaggcaaattagacaaaaaaggacatagtgtttctaaacaaaataaatggactaaattgaggagaaagagaaaaaaaagtcacaggggaagaaactttcctggaataataaaagtctaggcataataggtggacctttccattagggtatgctgtgctaaaatttctgaacttcagtatttgggaaagaaactgtaagggctcttgggtgtaaacagcaaacgaaccccaaagaaggttggatgggagattggagagactagactgacctcagactttgcagtactctaacagtgaattgtttctccacaaacatttgaggaggtcaggtgacccaagaaattataaccagcgaaactgctgttgaagtactgaataatcattaaactgtataaaagtatggatgcagaggattaatttaaacatatattaaacactaggaagatggggaaggagggacgctgagtttgagctttgtgattacagatcaaaatatgtgatgatttttgatattctaaatttaacaataagatttttttaaatttcagaggtgagtaaaaagaaagtgggaggaacataaatacgttattttccttttttcactatactttttataaatgaaatgttattaaaataatatactttaatatttttcttaatgttatcttttagatagtgatagatcttgtcttgtagtaagaaagtatctacgtgactttcagcaatgcctttagttatacttattttattgttaaatttcatataatttaataatttaccattttaatataataggaataaaattcttaatttttatctctctctttttctctcccacctcacctctctgtctctccatagagctataactacagtaattatactaatatttaaagatgattatttcaagatagtgggctttggaatagaaacttaaaaaatgttcatacttacatttttagattcattaaaaatagcaggtaaaatttgtacataaaacagtaattttttaaaagaaaataacttattctgtaagttttggcactctcctcaaaaaagattaaatgtcataagtaaaacccaagtatactcgtaaatattctaatatattggtatacttcttgggtcagcaaacttttcttcaaagggctatgaattaaatatttttgatttgtggaccatattatctctgttgtggctatgcaactctgttactgtaatgggaaagcagcaatagacaatatgtaaacagactggcatattccaataaaactttatttacaaaaataagcagtcagttctgggtcgtggtttgttgacccctggtatacacatcatcaactttagtgattaaaatattatcagcctatctgtgaaatactgaggtaaggaaactaatacaaaatattcctgatgtattgattttatattcttgctccaaatacttattactgtaatacttagctttgatgagaaagggaagtgttgctaaataatttacatacatattcatatacatgcaaattttcatatcttttgatgtctcaaaaatgctgacatttaagaaaggaagggcatattttgcttcttacagttcatatgtgctgtactcaagctgacttcttccttcccattttacatttctaactttgatctcagaatgtaggagctggacaggatcaccgagtgcatcaggtaaataatttcattcacacaagaagaaaatttacggccactaaagttaaacggttaccatgctagttcttgccaaagtcaggactggaattcagtctcctggctcccattgcagagttttgcccactacactatattattgtacatggcttggttcaagccacagaggaactaatcaaagattaactatctgatttatacatatgtatatatatacttacttatatatatatatttttatacttacatatatatatatatatatatatatatatatttttttttttttttttttttcctcgagagggcatctcgctctgtcacccagtctggagtgcagtggtgtgatctctgctcactgcaacctctgcctcccagattcaagcgattctcctgcttcagcctcccgagtagctgggattacaggcatatgccgccacgtcaggctaatttttgtatttttagtagagatggggtttcaccatgttggtcaggctggtctcgaacacctgacttcaggtggtctcctgcctcggcctcccaaagtggttggattactgacttgagccacaatgcctgggccaactgactgattattatattaggaatgcatttatattgactcctctgttctgagtacttactagttatcctgattctatttgttctctattttaaaagtaggtttataaataaagttatttaagagcaatcagtcattacacatgaggagtggtattgctctatgtatactccgtttcattgagaaacagccttttcgtaaaatggcaaaaaaaacacagctgcagttatccctttcttctgggtcatttctaatagtttagatcagtggttctcaaactttaacatgtatcagaatcacttgaagagcttgctaaaacacagattgctggggcctcctccagagtttctgattcaataggtttgggatgacgcctgagaatttgcatttcagacacgtttccaagtgacagtgatactgctagtctgggtaaaaaattttaaaaaccactgggtttaaattctcagccctaaaggcatattataattaccaggagaggcattaatccactaattaattcccaggctccatcatcaattggcatagaatgtctagggcttgagactgggtatgagtattttgtcttttttttttttttttggtttaagtaattaatcggtgcattaataattgtacatatggggtacaatttgatgtttcaatacatatctgtggtgtagagagatccaatcagggtagtgactgtatccatcacttcatgcatttaccacttctttgtggcgagaactttcaaaagcgtttcttctagctgttttgtaatatacaatattttaatgttaaccatagtcaccctactgtgcaacaggacaccaaaatttattcctcctatctaattgtaactttgtacccactgaccagtctctccctattctcccgtctcttttccctcccccagtctctggtagccactgaagtgcctcaggtgattctaatatataaccaagtcggagaagcaattaagaaaagtaatgactgaaaaagtttattttgtctgatgaattagtgcaaaattttttaaacatattcctctattatgtggggataatttttatactgtcatttcatggtaaagtataaatgagatagtataaagatgactttaccaagtgattccataaattgaaggtaatttgagtgtagttttatgctactaatcgtataaagtgctgagaatataaggtagctatagaattttacttttaaaatgttgttattgtaaaatttttgccattaataaaattatttcatgcctcagttccttaaattatttttattagcattgtatagacagcatagatactaactcctaaaattcttaatttctctctttatagtgaaagatgcagatgtactttgtatggacatacagattctgtgaacagcattgagttttttcctttctccaatactcttctcacaagctctgcagacaagaccctgtctatatgggatgcaagaacagtaagcaaatcattcactttttttcccagcttttgataagtctgattactctcggtcattctttgggtatggaatatgacttaaaaagtgattgtgcaagggcattcagggcaaaagaacagtaaaaagttcataattacaagatcctttctatgcacttgtatccattctgccttccaaatgtgatcaggtaaaaataatatgattatctcattaagcattatttcaacaattatttattgcgatagaagctctgctggttcatgggatacaaaagggaaatacacactgtgccccctccttaaggatcttttagctaggtaaaggaagagaaacgagagattattttgatgaaatgagacatgcgttaataaaatggaagactatctaaatacagggggaaagcaaggaggaggattcatatctgctggaagagtgtggatggctttcaaaggagcctaggcttgagctaagatctggagggtaagtaggatatataggtcatctggagaggggtagatttaggagagggcaatacatgctcaaagccatagagatgtgaggctgcaatggcatgttctgacagtaatgatataaatggaaagagcttaaggaaaaagaggcatgataggcaagaatgtacagagacaaaacaagatcatgacgtatttgattaaagtcttaaactatttccgagagaattaaagagcattaagcaaacagggtgacataatcggatttaccttgtcaactgaagagtgacaaggttcataaatttggaaaataaattcctcataaggggttacagtctgcagggtggccattcggacaagctggaaagcatagcctccagccagaagccagaaatagatacttcgagggaggagcaaagggaacaggaatttatgctgagttgggtatgtgaatatttcataagcttgaggaggagtcatgactatttatgaaaggtgaatcatgcacatgcacagtatacattcatgccccttcatgggtcccatgtaccaaaaatggcagttttagcatgatccaaggctggagttttcagccgcctaacatcggaaggtgaagtggaggacatgaaaacccttactgcacatgttccatggactggccagacccacttcatggtcagtggtctcttatcaggctaaaagaggaagggcagtatcaggtggctggttgatatcagtattgaggtcttttgaaagggctggtttcggctgggtgcagtggctcacgcctgtaatcccaccactttgggaggctaaggcaggtggatcactggaggtcaggagttccagaccagcctgtccaacatggtgaaaccccatctctactgaaaatacaaaattggctgggtgcggtggtgcatgcctgtaatcccagctacttgggaggctgaggcaggagaatcgcttgtatccaggaggcggaagttgcagtgagccgaaatcatgccattgcactctagcctgggcaacaagggcaaaactccatctcagaaaaaaaaaaaaatcaaagaaagaaagggctggtttctgtttagcacttagggaagcaaggctaatggtcattttggagggagggagtatgaggaggcttgtctgaacaccatcctgtcctggctgagagctcagttttcaaggttactctggggtcctgttggctaagagatgttccattcagttggctgggggagggccttagaattttgcttttatttgtcccctttttagaagatgattttgataaggaagtaagagagtcagtcatgtgaggaatctaatataacaggctatgagtggatgagaatttgagctaggaaacagcgtagatgaaaaggagagaatgcattaagcataggaagtttatccaaatttggagagtgattggaggtgaagattatgtggggaggaggaggagttcagggtgagaaacttttccaatttgtctaggaatgagggttttcctgagtcatgagattttcagagctaaaattggacagaactggattactggtaggttcaagagtgaatttgattttaataaaagtgttttagtctgttctcaccctgctgataaagacatacccaaggctgggtaatttataaaggaagaggtttaatgaactcacagttccttatacctgtggaggcctcacagcatggtgaaaagtgaatgaggaagcaaagtcacgtcatacatggcagcatgcaagagagcatgtgccggggaactcacctttataaaaccatcagagctcgtgagacttattcactatcacgagaacagcatgggaaaaactcacccctgattcagttacttcccaccaggtccctcccatgacatgtggggattattacaattcagggtgagatttgggtggggaacaaaaagccaagccatatcacaaagtaaacaacatgtagggactacactttcaaacagtttggctgtgaagatgaataggagaaaagattgtagctctaagatcaaataaaggatcctcctttgttcagataggagacagcatgtttatttgcttatgggtaagatcggggagatgaaatgaaaatgtaggaaagagaaaagataacagagtttattgtgcacagattttcataacttgaagaatgccaatatgtgtaaaacaaggcctccatattcttcttagtgatattttataaagatcacaagagaaacaatgactacagttgactctataagaaaagaataaatattcataatttctggttcctgggtcaataagaaagagaaatgtaatttctcccattttatttcccatatacaaaacatgattgatataaataaaggaatatggtaatggacatgcagatggtgttaggagggatgcaagttcagtatgtgaagccctgtttagacctctgaggccaatttatttaggatatatgaagaacaaaatatgctcagcaccacacattatagaaaaaactaaggtagagctacccatgtcttggtgaccaacttcacatgttgcagagatttaaacttctgaggaagcagaagtcaagggggcattgtggaaagagtgcatcaggcgtgacttaaaaataaaatcaggatgattttttgttaggtacaaaggtccgacaatctcctccttgctttaaaatagcttctcagacattgatgcagtggagtttgctcctgctaatggagcgtcaatggaaaagtaagattttcaatatattttgaactaaaaacttagatgtgaagtttgtataaaagtgattggtagaggaatatccatagagaaaatattaatttagcagtgacctaaattctattgacttcaaggtttttttctctctctctcaagtgctataactgagtgttctaggaaagtctatatcttatttactttctcttatgtgaaaaacagaagcactaatgcttagaagtaaaactgctctaattttaaaaagtttcctctcatatatatctgccttgaatgcatacagctgtttattgatggtgaccttcctccctccctgaggttctgagctctttctgtgctatccttattccctgaagtatcaggagaaaaagagggattcagcacagcacagtaccttcagcatagtgcaattgcatatgcattgaatgtaaaagcatagaagggtttgcaagtcccatttgcatgactttaatcaacataaatatttttaagttgacttaatggcaaattaaaatgtatatcactacaattattattgctattttgttactattatgcatgctagctttatattaattaatactagaaaaaaggctctaaaatattttggtttaaatgaaatatgattcctaaatgtatcataaatgcatcattaattagaaataaagttcatttaatgggtttattttctaaaaatattttcaaaccaagtagaaaaaaatttaaattgatagctatgtactgtaaaaaactggcatataatgcaaaggaaactcattcaacttattaattactagataatataaattgttaacgaaaatattgatataaaattctacaagtgaaatacgataatccaaaaattaaacagaatcattccactaacattgcattaggcaactgtggcgacttcatttcagatatagctaatttattaaaaaacaaaacaaaacaaaaaaactttaaatcacccaggttttaaaaaatttatactgttatatacattgtttttaaaagacaaagacacgtgttatatgttgtctgtataatatggaattgttagttgttttttatcccagtggttcataaacaagttaaaataaatttacatttttagttaaatagtaagagattttgaaaagggtaaccagattagctaaagtttttttctatgttgtaatgataagaacagtataacatattgatatggatgacattatttgatttgcaacatcaactgaatccatggtatactggcatgcttcttctttataatttttaaaatatgttaattccttgatacatgataaattgtcaggttatcctgaaggtctggacctaaaaggagattaatgactttcttctattagtgaagcagtaatggtacattttgtcacctcaatgtgatcagttactattgagacaccctctgaaatattttttgatgaaatgtgaaaatgaccagtggattatattcctataaattagttttaaacctccttctcccactctcaaacatatactcgttttaaatcattaatatgatctaacacctttattatcaaagataattaacgtggaggcctaagtcagtttccaagtcaactggacatatcagctctgaattttgtagaggatgaaaaaagggatataaatctctataattaccaaatggaggctacaaaataacttgcagtttggaaactcatgaaattgctcagttttacaggactgcatgtatttttcttcaaagttgaagactattttattaaaattgaaagataagattgctttattgtcagaaagtgatatatcacatagcaaactgaatgagaaattataaggcctacctaaaggcagtaagaaaaggctcaatgtacatacagtgatttggaagcctgtttaaaataaatgcaatgagattgttagtcatccacaaacccagtgaaaatattaaggctttttttttaaagaaaagaatgttttcaatatacagtaaaacacagaatgagaatgagatgagtaatacatctatgagttgtgtcagagctgggctggcaacagtcagagttgctgacattttgtctcttgccatgagtcagacacagagggttcatgacctggactgcctttagtggccattccttgctccttagactaactgcgggcacttgtccagcttacagcattctcctgacttagctttggccaaaagatccagtaacttgtcactgcgagtttctataaagtggataaacaaggaactcacaaaaagagttaacctgttggctcctgtttggtgccagacccatgtctgctctacagttcatcctgcaccctgcataggcctgttggttttcatagataggatctggtgaactctaagaggagcctaatattcagaatccagaatgtggaaacaaagggaagcttgtacctctctcttttatccctcagccatatttgatttagtaatgtttactggagatctatgtgctaggcaacatcctaggttctcgagaggtgactgtgacagaatccctgccctcaatgaacacacagactctcagggacaatgtataaagataaattatcttaaaataatgtagtaattgctatatattctatataactatagctttggtttttctgtgccaaagctcactgtctcaagagctgattgatggttaacacttattgaatatgtaatttgtgccatcattttacctataaaatctacatagcttactggaatctgattgggtgggtaccattattatctttatttcacaactgagaaagtggagcctgaggaagtaagttgcgcaagaacagcccagtggtcagtgacagggtgagaacgcaggctgcctctccaacctcggtcttccttcttccatgcccttggccatttccatgcctctattaatctacttagtcccttcgagtttctaccacagtagtctccaaactattttttataaaaatgttttaagcaattactactgtgctggtattttatgtatgtaatactttatatatacacctgaaataaaaataatgacagaaaggtacaattagcaatatttaaaattccatgtttcttttatagcctctaattttgtttgtttctgaccaaaaaataacaatgacacaaaaatgacagttcagtaagaaaagatgactcaatatgcttatattttcaaggaattctgatttaataattttaattaatgactgtaattcagtgattcacaagtatgatctatgattggatttagcagctatcagaactgcaaatgatcccttgacaaaaaatacaaaactcctaaaggaaaaaatgtatgatgatctgtacttaccaatgtgcaggctgaactttcaaattcatccactaattatgcaaaggaatttttgttaaaattttgttagggtttcctcttgttctgaggtcaatcagttggttttgcaaactaatcagaagttttcaaacattttaatactatgtggaaaattctttttctacatgtcttaaaggttcagatacaaggacttttaaaggttactgcccttatgtagatttggtagaggaaacactaaaaatatgtgttatcaaatgttctatatcataagtttctttcgaaaatggtgccttttttgtttattgttaaaatgtcacctttattttgataggatgattaatcatattattttcaaaattatctgcttacagttcactgttggcaaatgcctattatcacaaaaaaggtcaacaaattaggaatatttgtgttttggggagaaaaagcataacacatatttaaggtcaacttttcttttaaacactttgctaaaaaattgtgaaatttaaattttgtgggagtagaaaacatttttttggtcactctgactttttacaaaatattataaagatcctaatcatcaaaggactagtgtattaatctgttttcacgctgctgataaagacatacccaagactgggcaatgtatgaaagaatgaagtttattggactcacagtttcaggtggctgaggaggcctcacaatcatggcggaaggcaaaaagtacttcttacacagtggtggcaagaaagagacgcttgtgcagggaaactcccgtttttaaaaccatcagatctcatgagacccattcactgtcatgagagcagcacagaaaagacctgcccccataattcaatcacctcccattggttccctgccacaacacctgggaattatgggagctacaagatgagatttgggtggggacacagagccaaaccttatcaactagttaacctaaaattaaccaacttataaatatgcaaagtgcttgaaagtgcaataatacaatacaaaatttaaaataaacctcactgcattgattttatatactgtgttacaccttgctttgaacaccttggttcaaagaccttcatgttgcacaaatcctgtgtagagacttactgctttctcactaaataaacatctactaccatcagttattaaatacatgatgtcctaaccgtgtgaagttaacaaacatataacatgatctttcctctgaaaaagctttccctttactatttcatctgcctgacacaccttttcccctcatcacctaaagaatttgcatccatccttaaaggttcacttcaccttccctccaaagctccccatgcttgttcctctggattaggcatcccaagaggcaaccaagagaactttgtaccccgtagaattttgctaattatttctttgtaaagtgttttaaaatgttgaacttggcgaatgagacatttttttctccataaaaagacaagccttaccaattagctaacatttcgtgtaattactaatggcttcaggaatgggctacaagaagatatgcttgaaaaaaatcaatgtacgtaattgcatttttatagaactctggacttatatcctatattatcttgtatttacatcagaccatatagcacgataggaacatgcagccattctgcctggattcaaacccaaaatttgctgcttatttacagtgtgtccttgggcatattgtataaaatatttttcccacaatttcctcatttgtaaaatgtgcatagtagtactacttatcacataaggataaaatgggtattaaatgatcaatcatatgatgtgcctagaaaagtgacagatgagaactcagtatcttttagatattcttacagcagttgtcatgccatataattgtttagttatattttgctctcatgaaactcggagctttcttctctattttcacaatggttggataataggtgcttaacagatgttaaaggaagtgagggaacaatggagggtgaaaaagaagtgaaggagggaagggaggaaaaaaaagaatctgtcttaccatggtgtttcttctaactcaagaacttgtgtcatgttcttcagatataccctatttcacttttatttcttttcctttctttccatttatattaacaccaagccatagtacagaattgttactaaatatttaagaaatacataaattatgcaattttgtttctccaagttattgccaaattctatcctcttccttctttcctgataatgacatagccttccttctttgctactacaatttgatgacatgaatctcattagacatttcaagttatctttcaatcagtccctgacagtgcatctgacataatttaatattccccgttctcaattatcccattttattatgccttttatttcagataaaccttctcttttcccctcatgttttctctgggtatctctgtagcttgcagtaggtaatcacttatgttcaacaggcctttgttttccaagtaacttctctcacttcattaaaaatgtagtagaagctgtgttctgagaaaagtcacactgattaagatggatgttatggttttttcagagtaatattaacaacaaaagtaaaaaatactgattttccaccaaaatgactgactggtttggctttcacatctttccctagaggagtagtatttgagtggctatcaattgcttcctaaggcattcattaaaaaaaaaagaaaaaaatactttatgtgttttctaaaatgcataagattttcagaacttacagtcatatcatttacatttgtcattaacttaaggtataagtacataggttttaagttattacagactataaatcagatgttttgcttttaggtagaaaagcattttactcaaataatccaattgtttgaaaattaaaactaagtatttttaatacacagtaaaaacattgtatcttaaatagtagatcaatttaatatgctataaggctttcaaagattgttacttaactttgctaaaactattgtgtatctcatactttccatataaaacctttgcatacacatcacaaatatcattcctttcttcttttccttgcagttactataaatggtattacactggccagtagcgggaagactagatttttgtatatcggtatcagcctttgaaaaaatatcatattcaataatggcattaaataatttaattaattgaattaattataatgactatgtccattgaaaaataaatatagattagctttatgagattattttaattctgtaagaggtaaaaataatttctttatacttcatgcagtttatttagattccattcaataaagatggaatgtagagatatggtgttggatgagataaaagtaagtaaaattcccaatcaattatttagaataaaatattcttaatactcctgtcatagttgagacaccatgttgtactgtttttttatgctgaattttctgatttggaatgaattctaggattggaaggaacaagccaaaagaaaataccagatacaaaaattcatcttttgagtagaagtaatatgggctaaatcatctcaaaaacttttctccacgtgcttacccaactgatttttattcattactgaaatggcttctttgtaataattttagagtattttattaggacagagattatgatctagaagggtatgaaatttagatatagtaaatatagatgatttaattccttttgtattccttaataatatctgtagtgaacacaaaatagtttaaatgatatctaaaatgaaaattgagatcaattattttcttagggaagaataagataaatgaattgtaaaacataattacttaattcaatatttttgtaaaagttatataatacattctaaacttaaagatatttgtttattccttcttttgaataatatcagtgagtatttcttccttttattcagattgatgtgaaattatatgaatagaaggttgatagagagctaaaaccaaagattgatggaaagttgaaactaaaggaaaagcatgcatctaccttttcaggtgtggtagaatctagatctcttagaaaaactatgtttttttgacttatttgaattaaataaggaataggattgtcacatataaatattgaaggtaacttaatcatagaatatatttgaccaacaggaaaccccagtggattgcctccagtcttttctgccttgagcataataatgtagaaaaattacagattctgaagtcagatagattagagtcttgagtccaagattttttaaagttcttttacctcctggttgtgaattttgaggcacaatatttaatacctgtaaaattcagcattctcttttaaaatgggaataataataattaaatcacagtattagcactgggagtatttatttggaaatcaaaaagggtcagttacgtttttctatttttggtagctgagaatgctagagacaagtcttctcatgatttgtagttctgtctctttggttgatgggttaaatgatgcttaatgagattgaataattccattgcaaattgctttacccagtgttttgtgtgttgctgtcactttcaagaactaagtgactacaattcattgcatcagtttgtaattccacagtatgtatagtgtttatttgacctatcttacttgtagcctcttaattttacttcaacatatagaaattactaggaataagcttgtcactgttattcattcttttatacattcaacccattaaaacttcaatagtgatggcttggctgtacttcaagatagtcttaacttcaaattcactgtagtaccacatgttaattataatttttagataccgttgatgaaactagaaattaaatgcaacatttgtggcaagtgtttccggcattctgctgtggttgctattgtgatccgtgtaaggtaaaacaacacctcttgttatatagatttatagcaccagaaaattattagcaattcattaaattacatttaaattggataaccattgatgcaccatataatcatggtgactttttttcaaccatttagtatactcaggcatttcattcaataaagaaaatactgtaaaagaagacaagctgccttgcataccctactgttatgacacttgtgcattctatatataaggacaaaaaccttaaatttaatgatataacaaaattaaactgtaaacttctgtaaaagatttactaagatggtcatttgttgtttatttgactacccagcatccaagaaatattcttttgaagggaaattgacaatgtaagaaatgtggtaagaggcagggctgaagaaatatcagcaaatagaaaataataaagattaaagcataatttaacagtggaaaaaaagtagaatttgtttgtccaaaaacagtttctttagaaaagctaa

SEQ ID NO: 246 - DNA, 18904 bp, Homo sapiens
acaccctttacttgactttattgccatttccaaattcaaccacactgtgacatattttgtaattactcttgtgaaaatgaaacatcatttttactcagttacctacaattatatacaatttttgaccctaacttactgctgcttccacaactccaccaatgacactgcaggtcaaagtcacgagtgaatttaacttgtcctcatttttggtgcacttgacactatggcccattatatctatttgcttgaaactctcactttctctgtctctgtgacattgtgctgttctagttttctaccagttttctccttcctcttcctccactggatcccaatgtttctcagtactctttgtggcctctatgtgctcatcagcattcacaagttcaaagcacccctcttaagctgatgactcccccactatacttccaaccctaaccactcagccaggcttaattcctatatttttagctgcctataggatcattccatttgcctaaaaccaaattaatcatatcctccctacaaaacataatgtattcaaaacaaacaaaatagaaaaatctgcttccctttctagcttcctcattttagccaatagtgccaccattttccaagtttcaacacttgtctagacaagagtcatttttgactcctcctcctccttaccttgcacaacctctacttaaatccaatcactgaattttcagatctggaaagaactttcaagataatctagtttgtgctccttaaacataaataagagaccttggggctcagacatattggctgcttgcctcaagttcttccaaccctgattataagacactttctattaccaagacttatttaattgcatttttccaaaacttccacacaaatctttttttttttttttgagagggagttttgcactgtcaccagggctggagtgcagtggcgtgatctcagctcactgcaaaagagggttcaagcaattctcctgcctcagcctcccaagtagctgggactacaggtgcccaccaccacacccagctaattttttgtatctttggtagagatggggtttcaccatgttggccaggctggtctcgaattcctgacctcatgattcgcctgccttggcctcccaaagtgctgggattacaggcatgagccatcgcacctggcccacaaatctgttttctttgtagaatcagaagatctgggtttgaacccttaaaagctgactataagcaagtgaatagtaactgctagtttaaaaactgcctcctgatttagaatttatgatagaaatcagattaaatttaaactcctcaggcaggtattcaaaccctctcccactcctcctcctaacccaaactggctgactttagtatcaagcatggtttctcactgaacaaattctgtttcagttggcaggtcttcttcccatctttatctttctcattcctggttcttgacttccactcagttgtttccccagcctagaagagccttacacctcagcagacacttcctttaaggcccagattgaccagcattcccagcatgggtctttctttttttttcaatctccacagcatctcaactctactgcaaaatcttacacaatatatctttcacttatctgcatagtgttctccaaactaaggagctaaataatattaaacactcaaatttataataaaggcttgcaaatttgttcttacaacgaaacactggattctgctttttagaaagtattaaatttgatttacattcaattttactaggccaaaattaacaaacaagggttatttttttcacagtgactataccaatacagtttttcaacagtgaatagaatgcgtgatgccctcgaggagctcataatctagtgttaataaagctagatatgcagacagagaaggttaaagaacacaacataacatataccatcttactcatcagcttacttatgtcattatttcaacatcaatccacagccaaaaacctggaaataaaactgttatcatgctgggtgcggtggctcatgcctgtaatccaagcactttgggaggccgaggcgggcagatcacctgaggtcaggagttcaagaccagcctggtaaacacagtgaaaccctgtctctactaaaaatacaaaaactatccgggcgtgatggcgggctactcgggaggcagaggcagggagaagtgcttgaacccgggaggcggaggttgcagtgagccaagacgcgccactgcactccagcctgggtgacagaatgagactctgtctcaaaaacaaacaaacaaacaaaaaaaccatcctcggctgggcgcagtggctcatgcctgtaatcccagcactttgggaggccgaggtgggaggatcacgaggtcaggagatcgagaccatcctggctaacacagtgaaaccccgtatctactgaaaatacaaaaaaaaaaaaattagctgggcgtggtggcgggcacctgtagtcccagctactcaggaggctgaggcaggagaatggcgtgaacccgggaggcggagcttgcagtgagccgagatcgcgccactgcactccagcctgggcaacagagtgagactccgtctcaaaaaaacaaacaaacaaacaaacaaaaaactatcctcatcagacacacaaaacctccacagcaataaaatagcaaagagccatggtatttgtaccttttatccacaggagtggctcacttatactctgtctccacatgctcagttacatggttttcttcagggtttgtctgattagaaggtgcaaattctaaaaggaggctaattctaaaaacttgccaacaagggaggaaaaaaactacagaactaaacaatcaaaatgggttcactcaacaaacactgagtacatccttactgaatacaaagatgaagactacaagatttaaatatgatattttcacccggagattagtaaagatttttttaatgaaaatcccagtactggaatcaagggaattgggtccctcaaacactttgaggggcaagggggaatattctggaggacaacgtggtagtatgcatcaaacgctttgctgtgcctgccctctgaattagcaattatgctccaggaatacaggctatgaaaatcagaagcagcaatacagacctatgacaagtaggcttatcaccacattaattgtagtgtgatcataaatataatgtatcttccaggatgaacatttatatgacaaaatacaatgcagtcattaaaagctgccacccagaagtctgaaggatataaagaaatacagatgaaaacgtcataaaacaggccaggcgcggtggctcatgcctataatcccaacactttgggaagccaaggtgtgtggatcacctgaggtcaaagttcaagaccagcctggctaacagggtgaaatgccatctctactaaaaatacaaaattagccaggcatagtggcgcacattggtagtcccagctacttgggagggtgtggcaggagaatcgcttgaacccaagaggtagaggttgcagtgagctgagatcacgccatcgccattgcactccagcctgggcgacagagtaagactctgtcccaaaaaaaaaaaaaaaaaaaaaaaaaagaaaagaaaaagtgataaaaccatatataacgtataatcccaatttttaaaatgaccatattatatatataatatatatttgtaataaatatataaatcctggcccttctacgtacaagcttataaagttgaagttttttactaagtttcattttcctttttgtgaaatgatgacaataataatacctacttcataaggataaaagagcaatccctgttgtgggattctgttccgaacaggacattgacaatgtcaaaacctcccaaaaggagcttcaaacttccaagcactaaccactgcatgtataagttacaacagctttctaactggtctcctttttcatctttcctcacactgatgcatccaacactaccaccaaatcaatattcctaaaatcctaatttcatgtcatttccttgctttaaaaatctgtaatggcctcaagatgagattctccttaggccaacataacttgaccctattttacctgcactgggaagtattgacagtagtgtgaaatcaggttgttctaatttgaagcctgagtacaccacttattagctgtgtgaccctaggcaagtaagttaacccctctaacacttcctcagcttctcatctctaaaatgtggctagtattcatcatatgggtgtttttacagagtgaaaattcatataaagtgcttacttagcactttacatgtatgcctggcactggagatgcatcctttaaatgtgagctgttactacttccctaaactgtctactccacctgggctgctcttccagatcatttctaacacacattgcccaacttaggcctttggctggtggtgttctcacccatgaggcaccattccatcacaatcaccaccatcaacaaagagtatgtgttcaacatttacactatatattcaaggtgtaggctggaaatacagaggaaaaaaaaaaaaaaaacagtcccaaacctcagagctcatagtctaataatgaaagagagacagaggaagaggtccaataattaggggtgacaaaggaagcacttcctggaggcaagggagatgcttacactgactccagaaagctgcgtgggtgaatcaggcagtgtgggtgcatgtagagtaagagcatccagtacagcaatcacagtcactgtattgagtctggcactgctggagtactaaggctaagggagagcagaggctagatcagtgaggtcaggaagtgttggcactttattctgcaggccagcagcagccactgaataatattaagtagggtacacctgtctaggactctagaaaagcttacactgtgctgtccaacacggaagccacatacaactactgactggaaatgtggctagtgtgacagaaattaaattttaattaatgtaaacttggtaactgatagcaattcagttatcaaaaaccttttatgtatgtttggaacaattaaagagtatgtaggccgggcgcggtggctcacgcctgtaatcacagcactttgggaggccgagacaggtggatcacaaggtcaggagatcgagaccatcctggctaacatggtgaaaccccgtctctactaaaaaatacaaaaaattagccgggcgtggtggcgggtgccctgcccatagtcctaaaaatacaaaaattagccaggtgaggtggtacacacctatagtcccagctactcaggaggctgaggtgcaagaatcgcttgaacctgggaggcagaggttgcagtgagccgtgattgcaccactgcactccagtctgggcaacagaacaagactctgtctcaaaaaaaaaaaatgtatttaatgaactttaaatacagatcaattatttctgatgaaaatttaatgtccaaatttaaatgtgcagtaagtgtaaaatatgtatcagatttagaagacttagtacaaaagtaaaatatctcatcaataatctttaatcacatgttgaatattttgaatgtattagagattacattagaattaatttcacctgttcctttatattttactgcggctactagaaaatgtaaaatgacatacatggctggcattatacttctattggacagcaatgatccaatagatcccaggacagctgaaagaggaaatgagaccagaagcaggaagaacaattaaaaagactctgataagcatccaggtaagagagacaggcctgattatctaaattctgcccatcttcaaaacctaattcaagatacactactgcctccaaaagctctcctaatcctaacaattcccaaggagttacctttctctgaactcctgaggcacttatctgtagcattcacttcaacactcattcatttgccacctgtcatttctatttaattttggggtaatttgtttctcagattagaccagaagctcctaggctaagggccataatttaggcacctttaatttttgcatgctgtgtaatgcatttttgatacttttaataaacacaggtacatgactccccaaaaatctggatacaccttcatgggtgactttacctttccacagcagaaggaactgagaatctcttttccttcaagaaccttaaagataggagctaaaatgatgtaaaaatcaatcaaaactccctccaagccaatgttccgataaagtagtgatatttaatcagtgagcaagcattagtagactgtataggataccatcaagaaaaaaaaatgccaagacagaagaatttaggcttttgacaaattccataaaaagtcaaacaaaaaatttctgatcatctctgatctctaccgccagagataacctttgccaacctaagcattaagaactttcaatcaaggaaaaaacatctattttaaaaattaacccctaaatcaatccttctaataaatatcacattttctaggtagggatacacatattaccagtaaatttacaactcagcattttcccatctaaattagagtaaggtgaagaaaaaaaactttccagggaaatattaagaagtagtataaatgtattttactgcataatcgataaagtatttcacctaaaataccatttaaattttctacaacacttgactatacaacggccagcttgcaccactacagaaataggaagctagcagcaactagtaaaaagcaagggacattctgtggtgatcagtactgacctgggaactttgcagttttcagatttttcatgtttgacatttaaaacagaaaactgacaagtttctaataagaaactaaaagttacatcagaattgatcttcttgcatgtgtttaatggctacgaagtggatattacaaagtgcagttgaagactctatctccaaagaaacaatcgagcaatcaaagatgagctaggatagcttgtaagggaacagaaggcagtcctttctattctgaaaggcagaagaaataggagaaacctgtcaaacaacctggatgaaatcaaggagttaacaagcaacactcatttcctttagcactgtgagaaaattccggttgctaatagaaagctgaggaaagtttggtttggcttgtttcattttgttttccttccaaatcatcactgagtatgaacgactgctttcctctcctcacattactcagtaaaaactcccccattgaattgtcttccggtgccctgctccccagcctcccagaacggcccccgcccccgcctccctcccagcaaacgtgctcagacgcctctgggcttgttgtggtctcgccagtctgcggacaagcgctccaaactcaatggacaatggagctcacccccgtcaacgcgaactacaaagctcaggagggccatttcccttttcctgcccagatgctgttttcgctccttcgaagcaagatcccatgctcgactagacggccagtgtgcgccaggacccgcgtgtctccttccccacctgcagagctgctgagcccctcggcccccaaataaattgtaccgcagcacacaggccaaaaagggccccccaccaccaggggcttggctggggacagtggcttcacggtccaggtagggatggagggaacgtctcttgacgcttggtcatggccctcaagactaagccgtctccactgttccccctccccagctccaacttgcctcccctccccccactgcgagaagacctaggaggtgcgggcaggcagcaccgccacctcttcctccggtggagcgctcggccgacactcaccctttcaccacaaagaaggggtcctccatggacatggcgtcccggccccggccgccttcacctcctccgcgcacagggcgcccgtgcctcccggtctccctccgcccaccccgcctgttcccgcagctgcccgcgccttagtctgggtgaagccgagcagcgggcacgcgcacaggccaggtgcacaggacggccgctggtccagcactcgctcagcaccactggccgaatcccggactcgggcgccggccccctcggcagcctccagtcccggctcctcccgaagcgtcggagggcctgaccccacccccgggaccctcggccgcggccaatcacgaacgccgcctgaaacacgacttccgcaccccgctcacgtgaccagggcatatatctctctctctctctctctctcctctctctcctctctctcctctctctcctctctctcctctctctcctctctctcctctctctctctctctctctctctctctctctctctctctccccccccccccagtgggcggggcttacgcctgcgtccctcggccctggaggcggagccctcggggcggtggaggtgggcgggcttctacagccctctcctcaagcttgagggtgaggagtggcttgttccctcagaactaggcagtcggcttttcaggataagctgtagttgtacctgatttgcaaaatcctcttacctttcctctacttttaatacttaattttgacagtatgtaatttataaatctatctggtcctcgacttaaaatgaagcatagtatctgattataatgttacacagatcctttaagtaggtcttgctttgtgttggacagtgtgctaaaggttgtgtatgcatcatctcagtatcctttgggggaaagtattattcccccctccccctttttggggggcagggtctctctctgtcaccctggctggagtgtagtggcacaatcacagctcactgcacccttgacctcctgggctcaagcgatcctccggcctcagcctcccgagtagctgggactacaggtgagcgccaccacgcccggctaatttttaaattttttatagagatggggctctcagtatatttcctaggctggccttgaacacctgagctcacatgatcctcctgcctctgcctcccaaagtggtgggattatgggcgtgagccaccacaccatccatttttctcattttgtagataagaaaataagttcagagaggcttgaagacttcctgtagtcacacagcctggacagggcagaactgcagattctgtgcactttccaccagatggggtgtactttctgttgctgtacattctgcaaataaccatgtaaagtaatttttcatacagcatatggtgcttcccaggagagcacaccttcgaggaataaagaaggggccaggtatgacaacttcctctcactgtggttcaagagctattcgagaaaacattttgcccagaaccattaaccaactcatatgctagatatgctatgaaatttgtggatggggattgtggactttgattgctgaaaatcattgagcacttactgtgtgtgtgtgtcaggcaggatgttaagtgttatctcagttgctcttacaatgtgataattactgctatcatgcccattttataaatgagaaatctgagactcggaggttaagtgacttgcccaaggtcaccagtctggagctggcacagtccttggagcaacacaaaccccgtttaaaccttggctctatcattcagttcctcatctataaaacataaataataatagctagttcatgggttgttgtgatggttaaataaaaatgtgtgtaaacctcaagatcccaaaggactaagttactgaagtcaggaaaaccagtaaggacgctgctaaagtcatgtggcctgaagggatgaggtccagaccaggatgacagcgattgagaacagagaaggagtgaatctgacagatgtttcaaaaggaaaacaagactaaacacctagacatgatgaggggctgaatgggtttcaggaggggagagaagagaggggtgaaagccaaaatccctggaggagcgaatgatggaaggcagatgtggggaaaggaagcagtgtccaatactagtgattgctaatgtttattgggagagaactgtttaatttacttagctggggaggtgaaaacgtgtcatcgttcattcattcaacaagcacatgtaaattgaggggtaggtgagcatggtgttgaagaccatccttggagtctgattgcttgagttctgctgcttcctgactgttgcatctcaggcaagccgcttcatctctcactatcctcaactgtgaaatagacaccgtaataacagcttccttatagagtgtcatgaggtgatgtgtgaaaagtgcttaaaacagtgcctgacacatgttgtgctcctactgtgtgctaagcactgagacacaggcatgaacaaggcttggttcttgccttcaaggaactgtcagactggtgggagagacagactggtgggagagacacacagtgagagaagggcacaggttgccatagaaacacagcgacaagataccagtatatttgtgtgttttcggggctggggcagggggttcctaagcagtgactagaagcagccaggagaagggggccatgttgctggagtagaaggaaaaggatgggggcagcaggagctaagcctggaggtggacagggtcagattatcagggcccttgtttgtaatgttcagaatagtggacgcttcctatggacagttccccatggggactgagggaattgacagggtcagattggcatttgagacagatgcttcagtggctaggaggttatggtccagaggagggatgagggtatcctgagctgggcttgtgacaactaaggtggagaagagtgatgcatttgagacatactttagaggcaaagttagtatacttggtgactgattggttcagggtatgggggaattgatgaaagaagagggaggaaggcttctggggttgtaaatgggtagtgttggttccaaccatcaagaaagagaacacaagaggaggatttgatttagggtgaatgtaaattagctgttagcatgtcatttatccccaccaaacagtaaactcctggagggacaggatactatgttaatgttattatcacctaagtgcctgacacggcctcttattatctgttccatgaatttcttaattggaccacatatgacaggccagagttttataagtagtaatagaagatagaggacagaggcttgggttcccataattaggggattagaaaaagcaccaacaatggagatagtggagtgtcaagatataaaatgtgtgtatgtgtgtgtgtgtgtgtaggtgttcctttctttaatgtgtcaccctcctttaccctctctcaaactagaccttggcctccactgcccacaaggaaagggaagctatggctaaaatgcaaggagaaacaaaggaggttctttctttctttcttttttttttttttcatttaataggacccacgtcctggcataaacaataggttgggaagaatactcagcaaaaacccatctcttcccacacccccacccctaccccacccccaacccaaaagaataatttaaatttctcagggaataaaaaatcaaaacagtggttgtcttgggggacagagtttgactgggaagggaaactttcttgggtactagaaatgctctgtatcttgacggagtgtgtgttacatgagagtatcatttgtcagaattcctcaaaccgaaactcttaattggacttaacttctgttcatttttctgggggaggttgacatgccaactctgagctttctgtagagttctgagtgggcagccaggagaacctctggttcctgagtgagtctccaaagttaggagagtgaatgaggaagggagcacactgggtcctgcaatgcatcttctgcagaaataaggagatggcaacacagagaataaggcacaggcagccaaatgagctgaggatcagaaaggagccaaccatatcactggggatgccaggatagacctgagagggattgcagtgggtagccaccccctgcccctggaagctgcgggaatgccatgacacccctacaaggggatctcccctactctgaaataatgacattcagcctgctccttcactagcctgttataaggaacaactggatcatatatgggaataattttttattttttaaattttttattttttaaatttatgaggccggacatggtggctcacacctgtaatcccagcactttgggaggccaaggcgggcagatcacaaggtcaagagatcgagaccatcctggccaacatggtgaaaccccatctctactaaaaatacaaaaattagctgggcttggtggtgcgtgcctgtagtcccagctacttgggaggccgaggcaggagaatcacttgaacccaggaggcaggggttgcagtgagccaagatcacgccactgccctccagcctggcgacagagcgagactccatctcaaaaaaaaaaaaaaatttaattgtggtaaaatacacataacataaaatttaccatcttaaccatatttaagtgtacaattcagtagtgttaaatatatttgccttgttgtgcaaccaatgtccagaactcttttcatcttgcagaactgaaactctatacccattaaacaactccccattctcccccaacaatctctggcaaccaccattctactgtgtgtctctatgaattttactactctgggtacctcacataagtggaatcatacaggatctgtctttttatgatttgcttctttcagttagcatgatatcttcaaggttcattcattcattctacatattgcagaatttccttcctttgtaagcctaatattccattgtatatataccacattgtgcttgtccattcatccatcagtggacgacacttggctttctttcatcttttggctataatgaataatgctgctatgaacgctggtgtacaaatatctctttgagaccctgctttccattattttggatatatacccagaagtggaactgctggatatggtaattctattttaaatttttttgaagaacagtcatattgttttccattttacattcctgctaaaagacacacgcattccaatttcttcatatcttcatcaacacttgttattttctgggttttcttttcccttatagcagttgtactaataggtgtgaggtggtatctcattatggttttgattcacatttctttaataattagtgatgttaagcacctattcgtgtgcttattggccatttgtatatcttttttggggggtggggagaaatgtctattcaagtcctttgcccatttttgattgagttgttttgtttttgttgagttcaccctaaatccttcttgaaacaaggtaaagaaagggagaaaagtgttaacatagatataggatatcatactcttcatcattatccaaccttttagaaaccctgatatacatgtacatattccagaacattccacttatgttaagttccattgatctggctatgactgtctatgtttcctacctccaaccacagaaaatatccatacacatatccaaaacacactggccatgatttatttcctcttcctgtttgttaccaacacctccaccactgtcaccctctacacactgatttaaaataaacaaggaggaattccagtcaatttacatattcagcactaaggaatgatggagaatttgtggaacatccatttggtggtcattagaaatgttgtttaaaagtatgtaatgacataggaatggcttgagtaaaaacagcaagacacaaaattatacatatgatacaatttcagctctgttctttcttatacattaaaatgttttggtacatagaaaatttttacacgtaggaaaaaagaaatctatttaaagtttgtcaactactacagtgaaatatttacttggatagtcagaaatccaaaaagttttttaaaaagaagagaaaaagtaataaaagagaagtgaaaagccaagtgaccacatacgaaaaagtacatcaaaagttagcagttttcagcctgagcaacatggcaaaaccccatctctacaaaaaaaaaatacaaaaattagccaagtgtagtggcttatgcctatggtcccagctactcgtgagggtgaggtgggaggatcacttgagccaggaggcagaagttgtagtgagccatattcacgccactgcactccagcctaggcgacagtgagaccctgtctcaaaaaaataaataaataaataaataaataacagttttaaatcctgtttagaataaggcaagttaggagggtctgaatgaatggaaattggtgagtactaaaaagctgaaatacgttattggaattcagtgaatttcttgacaagacggtggatttgaaccactataggaaggggaggtatgttctttaccatcctttatgaatgtgactgtgtataaggaaagaaaaatcaatctgtgttggtaaactggctcattgcaataatagtactagtgattgctaatatttacatactatgtaccaggcattgtgctaagtgaccgatgtggttgggctgtgtacccaaccaaatctcatcttgaattctcatgtgttgtggtgggagggacctggtgggaggtaattgaataatggaggtaggtctttcccgtgctgttctcatgatagcgaataagtctcatgaaatctggcagtattataaggtggagtttccctacacaagctcctgtctgcctgctgccatccacataagatgtggcttactcttccttgccttcagccatgattgtgaggcctccccagctatgtggaactgtaagtccaataaacctctttcttttgtaaattgcccagtcttgggtatgtatttgtcagcagtgtgaaaacaaatacagtgacacacatgcattatcttcagaagctccagaatccccatatggggcaggttttagaatgtaatttggttggacagcagggctaggggacttgatgtggcatgggagacccctgtcttttctttttttttttttgagatggagtctcactctgtcgcccatgctagagtgcagtggtgcgatctctgctcactgcaagctctgcctcccaggttcacaccattctcctgcctcagcctcccgagtagctgggactacaggcgaccaccaccacgcccggctaattttttgtatttttagtagagacggggtttcaccatgttatccaggctggtctcgatctcctgacctcatgatctgcccaccttggcctcccaaagtgctgggattacaggcgtgagccactgcgcctggcctcttttcttaaattataggtttatttgggattacttaagacagctgatggccattatgcgtgtgtagtaaaagtactctaatgccccaacaagtgacaagtcacttcttggttccaccactgctgatttcattgaatcctcacaataatcctgtaaggcagaattggttattacctccattttctatgagaaatcccagacttagagaagttaataatttggtcaaaggtcacataggtaggaaatgtcagagcctcatttgaaaataagtttgactcctgaacccatgttctttgctacagtattctactcccatttgtacaaggactagccttggccaaaaattggcaaatggattttacctacccacagaaaagggctcaaatcaaactcgacacagacacagacacagacacacacacacacacacacacacacacacacacttctactgaattaaaaaagaaatagccaaggggaaactactgattaaatataataaaatatattatgttgaaaacaacattatttaacaaacaagacccttttgctaacttgataattcatcatttggtttttaaggatgaattgcactaactgcaaatgagtcagattcctcagaggggccttaaaatacatataataaatcaggtattaaaaagccaaacacataaagggatttataatgaacaggataagcacaacccactctgaaaagtgcggcctgagatttaagtttagactattgctcagaggtgaggcttgtttttccacaaagagaatgcgagggattctccctacctcagtgcctcccagcttagtggggcagtcttacctgtccttgaagatcttggcataattgaatctattaaaaattttaaggactattaaagctatgctattaaaaactgcatattaatattggaaaatataaatttgaaaagaatttacaaaatactattaggacgtaaaacccttttttggtaaaatgaacaaataaaggtatgcttatatgcagacatatgtagtcagcaaaaccactgaaaagaaatacactaaaatatgttaacagcaaattttttcctttcttcctccctccttctctctctccttccttccttccttcccttctttctttctgttgccatggttgtagtacagtggcgtctcagctcactgcagccttgacctccctggctcaagcaatcctcccacctcagccacctaagtagctgagactacaggcgcatgcaccacacctggctaattttttgtatttttagtacagataggggtttcaccatgttgcccaggctggtcttgaactcctgggctcaagcaatttgcccacgtcagcctcccaaagttgggattacaggtgtgagccaccatgcccggccaacagcaattttttctgatgggtgatttttatcttatcactctctgggttttttatatgtatttgccctgtactctggattaaatttactaatttgcaattagaatacaatgacttaaaaaatgaaagacatcggtcaggtgtggtggctcacgcctgtaatcccagcactttgggaggccaaggtgggtggatcctgaggtcaggagttcaagaccagcctggccaacatgggaaaaccccatctctactaaaaagacaaaaattagctgggtgtgtaatcccagctactcaggaggctgagtcaggagaattgcttgaacctgggaggcggaggttgcagtgagccgagatggcaccactgcacttcagcctaggcgacagagtgagactctgtctcaaaaaaaagaaagacatcgttgacatacctacatttttttttttttttgagatggagccttgctctgtcacccaggctggagtgcagtggcacaatctcagctcactgcaacctctacctcctgggttcacaccattctcctgcctcagcctcccgagtagctgggactacaggcactcaccaccacgcctggctaattttttgtatttttagtagagacagggtttcaccatgttccaggatggtctcgatctcctgacctcgtgatctgcccgcctcggcctcccaaagtgctgggattacaggcgtgagccaccgcgcccggcctcatacctactttttaatgtcagtacagcaggttatggtatggaatgcattttggaacaagatattaacaaaaattcaaaggaaaaaatacatggccatggaattccagtgctgagagacatttgggaatattgggggagttttccaaaagagaaatccaggtgactgtatttgttaaatgagtaacaaaaggaaaaacaatgtaaagaaacagaaaggaaaggaagagagaaatacaaagatctgagaagagaaggtgccaggggccgctgagagattgccaaatgttaatttcattatttggcttcttattttattctgggtaaaggtagacctattagtttcctgttgctgctataacaaattaccaccaacttagtggcctcgaacaatgcaaatttattctttcaaagttctggaggacagaagtccaaaaatgtgtcctatcagctgaaatcaaagtgttgtgttccttctggaggctctaaggagaatctgttccttctcttttctagttctagaggccatctgcgttccttggctcatgtccttctttcagcaatggcatcatcactctgacctttgcttccattgtcacatctccttgactctgacccttttgcctccctctaataaggcccctctgattacactgggtccaccagataatccaggatagctctctgtctcaagatccttaatttaatcatatctgccaagggttttgttttgttttattttgtttttgccatttaaggtaatatatccacaggttctggcaattaggttgtggacatctttggggcgacaattctcaacctaccatacaaccggtacataaggttctactacctactaaatgcatcataaacagaacttctgatccttcaacaactctgtgaaatatatgacaggatttgcttttaaagttgaagaaatcaggccttggtgcaatttgggattctgcccatggtcaaatagtggggaggcaaacccaggtccctgaacccagctcaagcctgcctgcctcatggccatgcctccattcacctctccccttcatgtctacttcctctttcctgtctgggcctgttccctagctccctggacaagcttaagctgctgttttccagcttgtcatgtgctccttatgacagtgtagccacagcttgatcttggggattgctgattgagcaagctgagtggctgcccctcagaatcttctgtaggcctttctcttgccttcttttattcagtaagtgttttgagcttattgtgctgggtgctagagtagcagggaggacagacctaagttgaagattacgggacaatctaagtgacacctgctatctcagacagagacttcagcatcatagggagccagagcagggagttccaagccgtgggaactgtgactctttcttactgacccttaagcaaaattctaagctccagggaagcagaggcagcagcttgagctcc

SEQ ID NO: 247 - DNA, 21660 bp, Homo sapiens
ctaatggtgtggtgtcaaaacaaaatcacagcctacctcatactatcttataatgtggtcctgcagaaaaacatctaccagctgggtgtggtggctcacgcctgtaattccaaaactttgggaggccaaggcgggtggatcacgatgttgggagatcaagaccatcatggccaacatggtgaaaccccgtctctactaaaaatacaaaaaattagttgggcatggtggtgcgcatctgtagtcccagctactcaggaggctaaggcaggagaattgcttgaacccaggaggcagaggttgcagtgagccgagattgtgccactgcactccagcctgggcaacagagcaagactccatctcaaaaaaaaaaaatctaccaaaagtctactgtagagtcagcaaaataaactgctacaatagaaaactagaggacatcatgcaggcacagtaagatagtggtcacttccatcacttgggagcagcagggcatgggagctgttgaaaaatgttctcaaggaggaaactgaatacagtgttcccctggttgggcactggtaaaggaggaagagactggaagcttcaggaggacctttctatttctgctgtatcctccgcacttcctctcacctacaacactatagattgtcacatggcaggcacacagtaaatatttgagtaattaattaatttgttaattacttaatgcatgcaccatgatataaatccttgaacaaagtaggcttccaataacaatgccatgatgatgaattttttaaaatttcactgaaaagtattactcagctggacacagtggctcacatctgtaatcccagccctttggtaggctgagacaggaggattgcttacggccaggagttcaagaccagcttgggcaatatagtgagatcctgtctttacaaaaaaatatttttttaaattagcttgggaggctgaggcaggaggatcgcttgagcctaagagttcgaggctgaagtgagctatgactgcaccactgcagtacagcctgagtgacagagtgagaccctgtttcaaaaaaagccaacaaaaaattactgttacaacttcaaattatattaatagtatagttttgattgtgtacctatgtgagaaatttgtatcatttttattaagaatgaattcttgaataactgacagtgaaagaacaaagttagagaagcattccaaagggccagagacataatatatcctgggaaacaggattatcctagagctagggcataagtgatatgaagaaaaaataaggctatggaggctggtagaggtggggttatagtcttataaaaaatgttgtcctggccgggcgcagtggctcacgcctgtaatcgcagcactttgcaggctgaggcgggcggatcacgaggtcaggagatcgagaccatcctggctaacatggtgaaaccctgtctctactaaaaataccaaaaattagctgggcgtggtggcgggcgcctgtagtcccagctactcggaaggctgaggcaggagaatggggtgaacccaggaggaggggcttgcagtgagccgagattgcaccactgcactccagcctgggcaacagagcgagactctgtctccaaaaaaaaaaaaaaaaaaaaaaagtggtcctataggcccgagggcccaagattaccaacttttttttttttttttttgagacagagagtcgctcttgttgcccaggctggagtgcagtgatgcgatctcagctcatggcaacctccacctcccaggttcaagcgattctcctgccttagcctcccaagtagctgggattacaggcatgcaccaccatgcctggctaattttttttttttcttttccgagacagagtctcgctctgtcgcccaggctggagtgcagtggcgcaagctcggctcactacaagctctgcctcccgggttcacgccattctcctgcctcagcctcccgagtagctgggactacaggcgcccgccaccatgcccggttaattttttaaaaaatatttttagtagagaccgtgtttcaccgtgttagtcaggatggtcttgatctcctgatctcgtgatcctcccgcctcggcctcccaaagtgttgggattacaggcaggagccaccgcgcccagccgctaattttgtattttagtagagatggggtttctccatattgttaaggttggtctcgaactcctgacctcaggtgatccacccaccttgacctcccaaggtgctgggattacaggcgcgagtcaccgtacccggcctctaaccttttatttttttagagatgagtctcactatgttgcccaggctggagtgcagtggctaatcacagtgaagatcatagagcactgcagtgttcaactcctaggctctggccatccttctgcctcaggctcccaagtagctgggactataggcagtgacaatgctctgggcttaatcttttgattctacagactttttttttctttttttgagacggagtctcgctctgtctccaggccagagtgcagtggcgtgatctcagctcactgcaacctccgcctcctgggttcaagctattctcctgcctcagcctcctgagtagctgggactacaggtacatgctaccacgcccagctaattttgtattttgagtagagatggggtttcacagtgttaaccaggagggtcttgatctcttgaccttgtgatctacctgcctcggcctcccaaagtgctgggattacaggtgtgagccaccgcgcccagctcaaacttcttttttaatgtcaaaaactgtacagattaccatgtgatagtaattataagtttagtacatattgattttttttttttttgagacgaagtttgctcttgttgcccaggctggagcgcaatggcgcgatctcagcttactgtaacctctgcctctcaggttcaagcaattctcctgcctcagcctcctgagtagctgggattacaggtgcctgccaccacacccggctaaattttgtatttttagtagagacggggtttcaccatgttgaccaggctcgtcttgaacgcctgacctcaggtggtccacctgcctcaggcctcccaaagtgctgggattacaggcgtgagccatcgcgcccggccagtatctactgattttaaaaatacacaatgaaaaaggttaaagtggattcactagtaattttacttagtttttttttagagacagggtcttgctctgtctcttatgttaaagtgcagtggcttgatcacggcccactgcagcctcaaactcctgggctcaagggatcctcccaactcagcctcccaagtaactgggagtacaggcatacaccatcacactctgctaatttttaaattgttttgtagagatggggtcttgctatgttgcttagactggtctccaactccctgccttaagtgatcctcccacctcggcttcccaaagtgttgggattacaggcatgagccacttcgccctgctatttcttttgagacaggatcttgccctgttacccaagctggagtgcagtagtgtggtcaaggttcactgcagccttgaactcctggactcaagagatccaccaacctcagcctcccaagtagctgggactacaggcatgtgctaccatacctggctaatttttaaaatttgttggtagagatggggtcttgctatgttgcccagaccagtcttgaactcctggcctcaagtgatcctcctgccttggtgctccaaagtgctgctatcacatgcatgagccaccataaccagctcaattttaagtaaaattttattcaacacaatttcaaactcttttttaaagtaatgagattttgtagacattaatttttctgtacatggacaaaagttagtgaaaatatagtgaacatttatgacctcctacaaactgagaaccactgctgtaatagtagccagagtagcaacatttagtgaatacttgataagtgccagttctaaacactgtgcacttattaattaataaaacaaccatgtgagataggctttattattatcctcatagatttcagagttgttttttggttttggtttgtctctttgtacctttcttctcttttcctttactaaagatctgaattttcaactggggacactgctgctctgctgtagcactgtatttccttgcctccttaatgtctacgatgactctgtgactaaatgaaaaatgagtagaaatgtgtatttggagaagtcttcttaaaaattgggggagggtgtacccttcctcttttttttttttttttttttttgagacagtctcgctctgtcaccaggctggagtgcagtggctcgatcttggctcactgcaacctctgcctcctgggttcaagagattctcctgcctcagtcttctgagtagctgggactataggcgtgtgccaccacacccagccaatttttgtatttttagtacagacagggtttcaccatgctggccaggatggtctccatctcttgaccttgtgatccgcccgcctcagcctcccaaagtgctggaattacaggcgtgagccactgtgcctggcccttttttgttttttgagacagtatcttgctctgtggcccaggctgggcagtccttctccctcagtctcccaaacagcttgaactacaggtgtgtaccaccacccctgctttttaaatttttttgtagagacaaggtcttactatgttgcccaggctggtctcaaactcctgagctcaagcaatcctcctgcctcagcctcccaaagtgctgggattccaagcatgagacaccatgcctggccctttctgcttcctgcatcaagaatgtcatggctggaagtgaacatgagggcaacactgtagggatgattgagcagtgaactcaaaggagcctgccgtgtcaatcctgaatggccggcttctggatttatgtgtgagagaagaaaatcctatcttgtttatttttatttatttattttcctgttacatggcaccaaacttaatcctaactgatttgccattttggaaacaagaaaactaaggttaagtaccttgcccgatgttacaaaattagtaaaagtgaagagacgactttcagcccatgaattcttactccagagcccaccttactcttacagtatattgcctcatgctacacaactataggaaatggatttgtcatagggaaataacacatgtgttctgttgaccagtattggatggggggctggggtatttcctttatgaagcagccctctttagctgaggcaattctgaaggtggctgactgatcactgagaggtgtctgctgacagcactcccagcagctgggggaatatgtcattcattcctgaagagggatctgggtggcacaccacagcatccattacccatgctggatatcatactcccttcctgtgcctgtggctgaactataaatcgactacagtttgctttatcaataagtccggatatattttcctaatcttttttaaatgcaccaatccaggcattgtttgtttgtttgcttgtttctgagatggagtcttgctctgttgcccaggttggagtgcagtggcactatctcggttcactgaaacctctgccacccaggttcaagcgattctcctgcctcagcctcccgagtagctgggataacaggcgcctgtcaccatgcccagctgattttcgtatttatagtagagacgggatttcaccatgttggccaggcaggtctcgaactcctgaccttgtgatccactcgcctcagcctcccaaagtgttgggattacaggcgtgagccatcacgcccagcccaggcattgttactaattgattgcagtttggcctttccctttcgttatccaaaacctggttggtgtgggagtataaaggcctgagcccttccaacccaggacaattctgaagggtcaccacagcttcagagttctacgtggagctggccgaagctttcactgaaacttcccagcagcccaacttcaccctctgctcatcctgttttcctctctttctttcccttcccttctgcaggtggtgatctcaagaacactccctaaaaaaacttcctattactaatctccatctcatagtctgttttctggataacccaacccatgacaccatggctttattcacacattaactgttcctaattggaaggaaagtacttaatacatctcaagaaaaagaaaactcagttgtaattaacgttatttattttggtctacccaatacactgtttcatagtaacatactgcccactggccagagaggagtgtcctatgctgggccaatcataaaatttcaccttcctgaacacagtaatgggtacaaggggtgggcacatgaccagccttggacaatcaaaatccttccctgaggatttttgtactgaaatctagaagacaaacctccctttcttctcagatcagagaaatgtcaagatattactctatggatgctggggccatatttgctgcctacaaggaaaaggaccatctgaagtagtgaataaagccaagcagaggggagaaacagaaagagttagaggtcctggaagcatcaaatcccctgtaggtactccagttcctactgctacaccaatagtagtactgtgaactatcctagtatcattctaataatttttttctttttcttttttgagacggagtctcgctgtcactcaggctggagtgcagtggtgcgatattggctcactgcaacctccacctcctgggttcaagcaattctcctgcctcagcctcccgagtagctgggattacaggcgtgtgccaccacacctggctaatttttgtatttttaatagagatggcgtttcaccatgttggccaggctgatctcaagctcctgacctcatgatctgcctgcctcagcctccccaagtgctgggattacaggcatgagccaccacacccggccataatttcttttcttaagctagttttaagttaggtttttttgattagcaatagaagaaatcttgcctacatatctgtgtatttcttatttctatgagctgccatcttctctaacctagtcctaccaaatgtccaaaatattgaggaacaaactataaaataatccacttttctacccaattccagcatgtcaaactttttatgggtcaaaatatactgaagacaatgtacgtgaaattgtgttgtgggcttaagaaagggggtcagaaggattatgttaagagaaatacaagacataatttttgcctttatttatttatttttgagacagagtctcgctttgtcaccaggctggagtgcagtggtgcggtctcggctcactgcaacctccacctcctgggttcaagtgattctcctgcttcagcctcctgagtagctgggaccacaggtgcatgcccccatgcctagctaatttttgtatttttagtaaatatggggtttcactatgttggccaggatggtctcaatctcttgacctcatgatccgcccacctcggcctcccaaagtgctgggattacaggcgtgagccactgcgcccagccgatttttgcctttaaagatgacttcatccaaacacaaaattcctacacctgctaccctataacagatgcttatccccaaactaaatctatataattatttaattaatgtatttattcttgacacagggtctcactccatcacccaggctggagtgcactggtgcgatcacagctcaccaaacctccacctcccagactcaaatgatcctcccacctcatcctcctgagtagctgggacacctggcctcccaattaaaccttaaaacattatatgttggccgggtgcggcggttcacgcctgtaatcccagcactttgtgaggccgaggtgggtggatcacgaggtcaggagtttgagaccagcctggctagcatggtgagacccccatctctactaaaaaaaaacaaaacaaaaaaatacaaaaaattagccgggcatggtggcatgcgcctgtaatcccagctacttgggaggctgaggcaggaaaactgcttgaacccaggaggcggaggttgcagtgaggtgagatcacgccactgcattccagcctgggtgagagtgagactccatctcccctcaaaaaaaaaaaaagaaaagaaaagaaagaaaaaaaaaacccatgatttgtctatgattggccgggcatggtggttcatgccttaatcccagcactttgggaggcccaggcagcaggattacctgaactcaggagttcagaatcagcctgggcaacatggcaaaaccctgtctgtacaaaaaatacaaaaattagctgcacgtggggcgggcacctgtagtcctagctacttccgggatcgaggccggaggatcacttgagctggggaggtcaagactgcagtgagctgagatccgaaatcgagccactgcactccagcctgggtgacagggcaagaccccatcttttaaaaaacaaaataaaacaaacaaaaaaaccacaagaaacattatttatctatgattacactgcctttacagttacatcatatttatgtctatacttgataacatattctaaaagacaggaatggactttttaaaaataattttttagcagctttagatctacagaaaaattgtgaaaatagtagagttcccatatatcccacaccgtttcccctgcattagtatggtgcatttgtcacaattaatgaatcagtactgatatattattattaactaacatccatactttattcagatttccttagtttttacctaatgtccttttcgtgttccaggatcccatccaggatacatttaatcatcatgtctccttaagcttctcttggccatgaaagattttccaattttccttgtttttgatgaccttgacaagtttgaggaatactggtcaagtattttttagaatgtccttccactgagatttgtcagatgtttttctcatgagtagactagggttatgagtctttgtgaagaagaccacacagagtgctacaatcatcatattgtatcaccaatacatactatcaacaggacatcactgttgatgttaactttgattacctggtttaaggaattgacttttaccttaatttgtttaatgtctaactcagaactacatatgggagggcacttaaacactgtcttaatatctggtttgtattcagtaggaggaacagcttgatgagacaaccatcaaaatggaaaaggccgggcgcggtggctcacgtctgtaatcccagcactttgggaggccgaggcgggcggatcacgaggtcaggagatcgagcccatcctggctaacacggtgaaaccccgtctttactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaaggaaaaaaaaatcctctggggaagagtggaaagaggattggtcatctcggccatttactacataaatgactttcggcaagttacctctgcacctgtaaaatggaataatggtacccaatagttctattaaacatctgttgaggaaatgtatgtgtatgtgttttgtacaatatttatacttttagatttgcctatgtaaaaatgaaaacactcgtgggaacagtaaatcttaagtagttaacataactttatagaataatttttttttctcttcagacggagtctcactctgttgcccaaggtggggtgcaatggcacgatctcggctcactgcaacctctgcctcaccgattcaagtgattctcctgcctcagcctcccgagtagctgaggctacaggggtgagccaccgcgcccggcctagaataattttcgattgctggttgagcagagcaaggccaatatgagttgaggaaagcagagatggaaaggctctttatagttaatgatttctcatttttgctttgcttccttttgccaaagtcggcttgtcatctgagagtggagaggatttgttagatcttatgaagccagagctcacttctgatgtgaaccaagtattaataattttggtggtggttttctgtactgcatctgagagagtaatcattgttctttgaagatgcaataattctacgctactacgggacttagggaaataatttttgaggataggaagcacagaataattaagatgacaagtcttcctgcctcaaaatcatatcactctgattcgaataaaaaataccaaggtttttccttcttgaggttttatactcatggaagttcttcaacctgaggtctgaaaaataaggcaaccccatcctctccttaaacaggttagagccagtacctttttatttctctatgcacggacaaaataattatgcaaaaaaaaaaaagaggcaggttttgtttttttttttgcactactgaaattcacacttaacatataaacaatctgctatatgcagacagcactggtgtttagagttcaatgatctggattcaagcctatttaaaaccagataagagaaagttcccaaacatctatgtgtcttggattcttcatctgtaaaattgcgttgttgagaagataatatgagactaggcgcgcaaaacaatttgttagagctattatttctaacccggaatgtgttcgctggcagtaacagtgcattagttacgattcatcgagggcagcttctggactttctgtttggaagcccagctgaggcaaaagcagcagtgcgtttaaaaattggagctcgccacattctgaaattctttcggttcgtgaaagcagtaacctaggaaacgagactggcaccacccctttcagtcctaaagcttggtttctcccgcttttctccattatgtttagggcatcgctattttacagtctttttgttttttctttccacatcattagcacaaaagagaaattccccttctacagaagcaagtacaaaacctttctagtcgctcctttttggcagcagctcacctactatttttttctattccgcggtcgcagccccagacgtcctcaaagacaaatattttcgcgagggccagtgtagggcaggaactccctaggccttgaatcaagggaatccagtagataacaacagaaaggactccgacccaggtacctgagacatctgagaccgccaaaattaacacaacaccctacgcgacagagaaaactctgggcggggagagagaaagagagcgagcgagcgagagagagagagagcgagagagagagagagagagagagagagagagagagagagagagagaaagagagcgagcgagagagagcgagagagcgagagagcgagagagcgagagagcgagagagagagagagagagagagagagagagagagagagagagagagagagagagagacgagaggaagcaacgttctcgcgacaagaggggtgtcgacggaaactcggaaatggtcccctagacgacccggccccagctagtgggtggggccagggtacatccgcccctttccggtttttttccccgcctcccaaccgtgaggtgttgggtttgggggacgctggcagctgggttctcccggttcccttgggcaggtgcagggtcgggttcaaagcctccggaacgcgttttggcctgatttgaggaggggggcggggagggacctgcggcttgcggccccgcccccttctccggctcgcagccgaccggtaagcccgcctcctccctcggccggccctggggccgtgtccgccgggcaactccagccgaggcctgggcttctgcctgcaggtgtctgcggcgaggcccctagggtacagcccgatttggccccatggtgggtttcggggccaaccggcgggctggccgcctgccctctctcgtgctggtggtgctgctggtggtgatcgtcgtcctcgccttcaactactggagcatctcctcccgccacgtcctgcttcaggaggaggtggccgagctgcagggccaggtccagcgcaccgaagtggcccgcgggcggctggaaaagcgcaattcggacctcttgctgttggtggacacgcacaagaaacagatcgaccagaaggaggccgactacggccgcctcagcagccggctgcaggccagagagggcctcgggaagagatgcgaggatgacaaggtaaggacgacccttttctcttcaaaccccatggtttcttttctccccggggtctggggcgggatgttaatccgctagctgttgtcttatgccttccagtatttcagtcctgaaggctcctttcacccccaacaaccctgtttctgtcagacttttcccagtttatcagtgccacgttctctggtccctgccagaaaaaaatgactgtaaattctggttctcaagagtggactgtgtgcagatgctgcctattctctaagctcagctggtgagttggcagtagtaatcatctggcctgtgtggcccccttaccttcaaagacacacaaatctggcgactgccaggtttggtgtggttattgtctcatttttattccgtgcacactgatcaatattaatttcgttatttaaagaacgaagccgcctctgactcctctacttatggtagtcatcatatattttttaagctgtgtgacttttaaaatctctatagggtgatgtattgaataactaaataatcagctatgactgcctttttgtgatcaaaatgttatgatagatgggccctcgagctatatgtgagacacacttgtgtcttggacatagttgatccatcattatctactcaatttgaattgttaatgaaatcagccaaaagattagaatctgaaaataaattttaagcagtggaatgtcatgtcagtgtcttcattgaaagaaaatagaatgaaattttgtatagctaagttgctattagggttggtgttttatgcagatggaaaactatacaaagttttaaatataaaaagtttaaaattgaactgtaatcatacttgctactaaataatccttgttttcattagctcattggtaactatattaatagtttatgacttagcaacttctgtaggtatagtagagttatgaaaatttctgggcaggatagtagatgcctttctatacacttctttggtaatcttcacatttttgtgtgtaaatgcccattataattacaagttttactttgcatatcaaaatcacttaagggtaagtcattatgaattaaactgtctgtgagcttctaactttcctgttgacagcctctacctggctttcttatttcatgaagattaaggccctcagctaagtgcttccctataaccccctcctcttcaccataacatagacatgctatgatagggtcaaggaatcagtacatttatatgtgcgctgcatgcttaactctaaagactgaaaaactctcgggcagagtaggtagaaatccatgaaagtttggagtattaaagtaaggtcttcctacttggcatggttgagcattacaattcacattcttctctctggtctcaaaggaaagtctcttgttgtaattaatactcttgattccattctttcatccattggactttttgttgttgtcgttgttgttgttgttgttgttttttgagacggagttttgtttttgttgcccaggcaggagtgcaatggcgtgatctcagctcactgcaacctccgcccccccggggttcaagcaattctcctgcttcagcctcctgagtagctgggattacaggcatgcaccaccacgcctggctaattttgtatttttagtagagaaggggtttctcaatgttggtcaggctggtcttgaactaccaacctcaggtgatccgcccgcctcagcctcccaaagtgctgggattacaggtgtgagccaccatgcccagcctctttttttttttttttttttaaagagacagggtctcattgtgttgcccaggctggagtgcagtagctgttacacaggcatgatgcactatagcattgaaatcctgagctcaagtgatcctcctgcttcagcctctgagtagctgggactgcaggtgtgcaccaccttgcccagctctactgaactgtctctttcagtttgtttcactttttaccttcaacagtatgtgggtgtcccctgttctcagtaaaggaaaaaaaatctgtatattcctttctcccaaccaacccatttgttttttcactttcattgctaaagtcaaattattgatggtctacaaatgttccatctacctattttttcataaccatcctaatcttaaaatgtctgccatctttctttcctccccttttttgaaactattctcttgaaggtcacaaatggcagtcttcctagtcaaaaccaaagaatatttttattcttactgtatttgacctcccagtagtttgatcctgttgattgtctctagctatttggaaactattttctttcttgcttctgttatactggactctccagtcttatcttcttcactatattctttgctggatttattttttctttccagtcacctagtaagggactctgttattgagcctttgctctcccataagagcagtattccccaaagtagtgttaaacagaatacccttcttgtaatatttcttaggtggtgaggagaaaaaaatgaaaaccttttttggagggaaatgttagtgtatcctcctcttggaattcataatgcctgctggaatataaaagctctgagaaatccattaataaagaaggctattcaattttgtttaactcagtcttgtttagtttatttgatcacaggttactattttcatggcctacctattatggcacagaataatatagcaaagcccactagtttgggaaatattgccctgggtatcttaactacttttaagtgtttggctaatattttatgcagctggctcacaagactgtatctcttattgaatgtcagttctgtgtgtgtatatgtgtatacatacatatatatatatatatatttttttttttttttagacagagtctcgctcggttaagcaggctggagtacagtggtgtgatctcggctcactgcaagctccgcctcctgggttcacgccattctctgcttcagcctcctgagtagctgggactacaggcgcccacctccatgcccggctaattttttgtatttttagtagagatggggtttcaccatgttagccaagatggtctcgatctcctgacctcgtgatccaccagccttggcctcccaaagtgctgagattacaggcgtgagccaccgcacccggctagttctgtatatttttaaaagttttttctttttttagttttgtagagatagggtgttgctatgttgcccaggctgctttcaaactcctggctccaagtgatcttgccttgggctcacaaagtgctgggattctaggtgtgtgccacagcacttggtgtgccacttctgtattttgagctggctataacaactttcttgggctgcttgtgaatgtctgttcttggggttaatgaggactctctgagctgcttagtagaaagggtagtcttggtctctgtattttaaacttaacagtttttcagggttttttttattgttattgttgtttgtttgttttgagacagggtcttgctctgtcacccaggctggagagcagtggtgcgatcatagtttactacagcctcaaactcctgggctcaagcgatcctcccacctcggcctcccaagtagctgggactataggtgcatgccaccatgatggtctaattttttattttttggtagagatgagggtcttattatcttgtccaggctggtctccagttcctggcctgaagtgatcctcctgccttggccttctaaagtgctgggtgtgagccaccatacttggccacttaacagttttagatctggaaaattattggaaaattagatctggaaaactaaacaagtgatcctcctgccttggccttctaaagtgccaggtgtgagctaccatacctggccacttaacagttttagatctggaaaattattgcaaagatagtacagggagtttttatataccccacacccagtcttccctattattaacatcttaacataagtatgatgcatttgtcacaattaatgaaccagtattgatatcttattatgaaagtccgtactttattcagatttcttcagttttcgcctgctgtccttttttaattccaggatctcatccagagttacgttacatttagacattatgtcttctgaagcttcttttcagcctttccttgttttttagaccttttcttgtttttgataatcttgacaattttaaggattactgattaggtgttttatatagaatgtccctcaattgggaattgtctgagtcttttctcaggattagactggagttgtgggttttcggacaaagaccacagaagtaaagtaccaatctcaacacatcataacatgggtatgtttttcaaaatgatttatcactacttatgttaacctctatcacctggcgtgagatagtgcttgtcaggtttctccactataatgtactcttaaaaaaaatctgtttccatactgtacactttggaagaaagtatgttcaccctcacttaatgagtgggtagttatgtttttcctccttaaggacagagtatcaacataaactatatggaattcttctgcaaaggagatttgtctcttctccctcatttattaacttaataatttacttgtatcggtatggactcatggatatttattttgtactttggcttataatccaatattagtttatttttttgttgctcaaattgttctggctctggctgttggagagctccttcattaactcctgtatccccttcttacttttatagtgccagaaagtacagagaatttccacataccctacacccagtttcattgtgacatacccctttcttactttttggtacttttagatgctctaggcctatctatacgtttcctactccagccctagagtcaaccatttctccaaggaaccttggttccttttattggagaatggcattagaaaccaaggtctgcagctgggcacggtggctcacgcctgtagtcccaacactttgggaggctgaggctagtggatttcttgaggtcaggagttcaagaccaccctgactaacatggtgaaaccccatctctacttaaaaatacaaaaattgggccagacacggtggctcacgcctgtaatcccagcactttgggaggccgaggtgggcagatcacaaggtcaggagttcgagaccagcctggctagcatggtgaaactccgtctctactaaaaatacaaaaaattagtcgggtatggtggtgcgcacctgtagtcccagctacttgggaggctgaggcaggagaattgcttgaacccggcaggcagaggttgcagtgagctgagatcacgccattgcactccagcctggaggacagcgagactccatctcaaaaaaaaaaaaaaaaacaccaccaccacaaaaaaaaacaaaaattaaccgggcatggtggggggcgcctgtaatcccagctacttgggaggagtatcgtttgaactgggaagcagaggttgcagtgagccaagattgtgccactgcactccagcctgggcaacagagtaagactctgtctcacaaaaaaaaaaaaagaaaccaaggtctgcttggcagatatgctcgttgctactataaggttatctttggaaatcaaggaatcctttctccagaggaatcagaaaggtgatatttggtttctttcacattattatgccattctgtcacttccagtctgttacctgggttactaaacacataaattcctttttttttttttttctgagatggagcctcactctgtcacccaggctggagcgcagtggcgcagtctcagctcacttcaacctccacccgccgggctgaagtgattctcctgcctcatcctcctgagtagctgagactacaggtgcatgccaccatgcctggctaatttttgattttttagtagagacagggtttcaccatgttggccaggctggtctttaactcctgacctcaagtgatctgcccaccttggcctcccaaagtgctggattacaggcatgacccaccacatccggccttgaacatggaaattctttaagggagctttaagttgctcctgtcttgtccaaagaagtgagaaacaacccccacttctctgagattccctcaaactttctgattttttaaacttccctctaaagggtttcagcctggaggggtgtattagtttgctagggctgccataacaaaatgccacagactaggtggcttaaacagcagaaatttattttctcacatttttgaaggttggaagtctaagaccaaggtgccagcagggttgtttttctctgaacttctctccttggcttgcagatggcaaccttcttgctgctttattgtgacatgatagtccctctgtatgcacacatccttggtgtcttttcctcttcttaaaaggatacgagtcatattggattagacccactgtaacttaagcactttaaagaccttgtctccaaatacagttacattctgagatcctggaggctgggacttcaacatgtgaatttgggggaaacacagttcatcttagaacaagggagatccaccacacatacacacacacacacacacacacacacacacagacacccttttatttcctcttttatcagaaaagtccttatttctctttcctcagtacagggcatgtctcttaactttgattattattctctctctctttgtcttttaaagagatggggtcttactacattgcccaggctagaatgcagtagctattcataggtgtgatcatagcacaccacagccaggaactcctggtctcaagtgaaggtcctcctgtttaagccttctgagtagctgaaactacaggtgtgcaccactgtgcttggctcctaaacttggattcttgcaaactgtagctcatactaaagctatgtggtccagctgtggcacgtcaagctcttgataaataaaaggagctgttagaatgtagaaaaagtcctcaaaattgtcgttttattacacacatacacacacatacacacacatcagttttgaggtttgaagctgaatagtaaatgaccttttttccctttaacaaccataattttccttgaggcagcctatgcctttagttgaatggggaaaaggtcatatgtcagaaaggaggatgagaagcgtattacaaaaaaatgctttttgggggaaaattttggaatataatagtagtctctcttattcttgagaggtttgagtaaattgattaaaattcttaaaacagtgcctactacattgttattctacagctacttccttatttcttttctgccttttttccaggatgggactctgtctgtgttcctgcccaagatctggtcccagccctagcctacctgcctcaccctttgctcctgaatgtctgactgtttttgttatttgcttgttttcagtttcctggttcatttccagttaggcttagttggctcctcccataggtgtcttagctgactccctagagcttgcctgttcttctgtaatttgagtatcaaccttctacagttctaatatgctgcacatgataattcctgcctttgcctctgcctcaccagccataatctggccaacttttaactgtaatttctacctcaaattattcataaaccaatcaaaactgataactcttccaaacgatatccctttcctaccttcttggttcctataaatgatgcccatgcaactgttatttaagactgaggttagaaatttggtgttgtctttgattccttcagtgtatcatattgagtgcttcaacatgcagaggagttacttgatcgaattaaaaaaaacgtcattctgactgcagaatagagaacttggcagatccctaactagtcccctttccttggtctccatttctttttgtcagttctcctgtgaagccagcctgaacttcctcaaaccttattttcagagtggctgtatgactcactgactacatcaggttagaattctgctgtctcatctttaaggtcttccatagaatggctctagctacctttgtctcccactatctcctgacccaaattgtatttcaggctgattgttttgcttacttttgccttcccacctgcctttctgtgtcatgttaattcctgtttctgtgcctttgttcctgctgtttgactcttagtttcttgcctcttttctgtatatttattataccaatttttttttgtttttttttttttaattgaggcagagtcttgctctgtcgcccaggctggagtgcagtggtgtgatcttggctcactgcaagctccgcctcccgggttcacaccattctcctgcctcagcctcctgagtagctaggactacaggcacccgccaccaggcccagctaaattttttgtattttgagtagagaaggggtttcaccatgttagtcaggatggtctccatcttgatctcctgacctcatgatccacccgccttggcctcccaaagtgttgggattacaggtgtgagccaccgcacctggccttttttttttttttttttgagatggagtcttgctctgttgcccaggctgcagtacagtgacgcaatcttggctcattgcaacctccgcctcccgggtttaagcgactctcctgcctcagcctcctgagtagctgggattacaggcacgcaccaccaggcctggctaaatttttttgtatttttaatagagatggggtttcaccatgttggccaagctggtctcgaactcctgaccttgtgaaccgtccaccttgacctcccaaagtgctgggattacaggcatgagccaccacacctggcctattctaccaatcttttatccagcttctgatccatgtccactatgaagccccctgggacttctgacctggaatatgcttttccttcttttctttttctttttttttttttttgagatggagttttgctcttgtcgcccaggttggagtgcaatggcgcgatctcagcttactgcaacctccgcctcccaggttcaagtgattctctagcctcagcctcccaagtagctgggattataggcacccaccaccatggccggctaatttttttttttttttttgtatttttagtaaagatggggttttaccacattggccaggctggtctcgaactcctaacctcaggtgatccacccacctgggcctcccaaagtgctgggattacaggtgtgagccactgctcccagccatgcttttccttctttatacaccatttacatttattgtttgagcttcattaacttattttgttcattttttactaatagcttattgtttgtgaacttcgttttc

SEQ ID NO: 248 - DNA, 22557 bp, Homo sapiens
atggtcagaaaaactttaaggtctaatacttcagtcaattcctatgctttgtttcctgggacgagcacaaataggcttctaatgtatatttaaaaagtgaattgatgcaatgctgcacatttatggttctgcttaagaaattttgcagcgttatttcttaaagtatttttaacatgttgtgggtttacatttcacataagataaaaataagctcatttatgtaattcaagtgactgaaattaagacaatttagtatactcaaaatagacgttcacaaaattttaaattcattttttaaaagatacacagtgttactaatattcacatatcctaatatttttggttgattagaagatatttacttactggcacactccttattgtaggaagataaatttagcgcttagaagaattgtgtgtgtctgttttactatactgaatagcagtattatgaaatgatgatgatgattatgagtacagaaacatttattgagtaatttagtatttgctatgtgcaagactatgtaagccactttactaaaatatttaattgaatacgctttgaagctcattatatgtccattttggaggtgctaaatttgatatttacagaggttatatagcttgacaaggtcacattgcaatgaagaatttcctatattgaatatgatattattatcatattagcattactccaatgaagtaaccatatctgttagctgattataaagacataatactggatttttatctatggttctaaaacaaatatagtattattttttagataaactcattcaacttgacatgctttagagctaacttgttttgatagcccgctcaggatattctgtacaacttttttttaaaaatacagggttaaaatgaatgttctaagatcttattcattattctttttgcaaattatttgaagagattcattgatcctttttcaaaacaatttatctcttctacacacagcctttctctatacttctaattgaaaatggaatcattttctaaatgagaattcaagtgaggttcttgtgctttcacaataaagtatcaactcaatcatttacttattttccattcactttacttaaattctctcctcctcttcacttagtactcagtaaggatgatgccaaacagtctgccatctcagggagatggcagagagtttctctctttttagtccatattcactagggaggtcttgtgtacctgagccttaggaatgaggacttttcctgtctctttgtccatcctctgtgttatggccaaactctgccttctatctgtagttggtctttgtaggagtttcatactgctacctcaggagtaggatacttctacttgctgtgatggaatattaaggcctaagatggttacctgttgattggtttggctgtgtccccacccaaatctcatcttgaattcccacgtgttgagggagggacctggtgggaggtaattgaatcatgggggcaggtctttccaatgctgttctcctgatagggaataataagtctcacgagatctgatggttttagaaaggggagtttccctgcacaagctctccttttttttgcctgccaccatccatgtaagatgtggcttgctctttttgtcttgcaccatgatagtgaggcctccccagccaagtggaactgtaagtccattaaacctctttttcttcccagtctcaggtatgtctttatcagcagtgtgaaaatggattaatacagtaaattggtaccagtatagtgggcattgctgaaaagataccagaaaatgtgaaagtgactttagaactgggtaacaggcagaggttggaacagtttggagggctcagaagcagacaggaaaatttgggaaagtttggacctccctagagacttgttgaatggcgttgcccaaagtgctgataatgatatggacaaagaaatccaggctgagatgatctcagatggagatgaggaacttgttgggaactggagcaaaggtgactcttgttatgttttagcaaagagactggtgatattttgcccctgtcctagagatttgtggaactttgcacttgagagagatgatttaggttattatctggtggaagaaattgctaagcatcaaagcgttcaagaggtgacttgggtgctgttaaaggcattcagtttcaaaagggaaacagagcataaaagtttggaaaatttgcagcttgatgatgtggtagagaaggaaatcccattttctggggagaaattcaagccagctgcagaaatttgcataagtaatgaggagctgaatgttaatcaccaagacaatggggaaaatgtctccagggcatgtcagagacctttgcgacaacccctgccatcacaagcccagaggcttaggaggaaaaaatagttctatgggctgggcctagggtccctctgctgtgtgcattctagggacttggtgccttgcatctcagctactccagccatgactaaaaggggccaaggtacagctcaggctgttgcttcagaggatcgaaacccaaagccttggcagcttccatgtgatgttgagcctgcaggtgcatggaagtcaagaattgaggtgtgtggcctctgcctagattttaaaagatgtatggaaacgcctggatgcccaggcagaagtttgcggcaggggtggggctctcatggagaacctctgctaaggcagtgcggaagggaaatatggggtgggagcccccacacagagtccctactggagcattgcctagtggagctgtgagaagagggccactatccgttataccccagaatgatggatccaccgacagcttgcactgtgcacctggaaaagccacagacactaaacaccagcccatgaaagcacccaggagggagggtgtaccttgtaaagccacaggggtggagcttcccaagaccacaggagcctacctcttgtatcagcgtgacctggatgtgagacatggagtcaaaggagatcattttggagctttaagatttgactaccctgctggattttgcacttgcatggggcttgtagtccctttgtttgggccaatttctcccatttggaatggctgtatttacccaatgcctgtagccccgttgtatctaggaagtaactaacttgcttttgattttacaggctcataggtggaagggacttgctttgtctcagataagactttggactgtggacttttgagttaatgctgaaaagagttaagattttgggggactgttgggaaggcattattgtgttttgcaatgtaaaacatgagatttgagaggggccaggtgtgcaatatggttggcccacccaaatctcatcttgaattcccatgtgttgtgggagggacccagtgggaggtaattgaatcatgggggcaggtctttctcgtgctgttcttgtgacagcaaataatcctcatgagatttgatggttttaaaaaggggagtttacctgcacaagctcacttttttttgcctgctgccatccatgtaagatgtgtttgctcctccttgccttcctccatgattgtgaggcctcccctgccatgtggaactgttaagtccattaaacctctttttcttcccagtctcaagtatgtctatgcacagtgtgaaaatggactaatacacctctccatctatcaggggtagagagtttttcttttacttttccttcacctgcaaagtatctttgcctgtgcctgtgtgttgccctttccccaggggcctcagaagtaggcactggtttgtgccttttctgcagcatgcctgggtcctgaggcccccattccaggcctgagctcccacataacatttctagacactttctgggctaaaagggaccccactgccttgaagggaagaacctgatcttggcaggatttaccgtcataagaatgtcattatttaatgatagagcagtcagttcagcaagaggatataacaattgtaaatatatatgcacccaacactggagcacccagatatataaagcaaatattattagagctaaagagagggagagatcgcaatacagtaatagctggagtcttcaacatcccattttcagtattggacaggtattccagacagaaaatcaacaaacatcagacttaatctgcaccatagaacaaatggacttgatagatatttccattctcaatgatagactatatgttaggttacagaacaagttttaaaacattcaaaaattgaaataatatcaaacatcttctctgaccacgatggaataaaactataaatcaacaagaagaggaattttggaaaccatatgaacatgtagaaatttaacagtatgctcctgaatgaccagtggatcagtgaaggaattaagaagaaaactgaaaaatttcttggaacaaatgatagtggaaacacaacataccataatctatgggatacagtgaaagcagtactaagaggggaatttataggcacttacataagtgcctttttcttcaaaaaagaagaaaaacttcaaataaattacctaatgattcatcttaaaaagctagcaaagcaagagcaaacctaacccaagattagtataaaaaataaataaaaaggaacagaatagaaataaatgaatttgaaatgaagaaagcaatacaaaagtcaaggaaacaaaaaatgttattcttttgaaaagataaacaaaatcaacaagtccttaggcagattaaagcacaaaaaaggaaaagacccaaataagtaaaatcagatggaaaaggaaacattacaactgggattgcagaatttcaaaggatcatcagtagctactatgaccaactacatgccaataaattggaaaatctaggggaaatggataaattcctagttagatacaagctaccagaattaaaccatgaagaaatacaaaatatgaatagaccaataacaataaacaagattgaagctgtaatatgaagtctcccagtaaagaaaataacaggacctgatggcttcactgcttaatcgtgccaagcatttaaagaactaacaccagtgttactcaaacaattccgaaaaatacaggaagagggaatcttttccaaactcatttacaagacccatattaccctgatacccaaaccaaagacacatctaaaaataaaaccacaggccagtatctctgatgttgattcaaaaatcaacaaaaataccagccagcggaattcaacaatatattaaaaagataattcatcatgaccaagtgggaattattccagggatgcaaggatgattcaacatatgcaagttaatcagtgtgatacattacatcaaaagaatgaacaacaaaaaccatatgttcatttcaattcatgctgagaaaaatttaatacaattcaacatccctttatgataaaaactctcaaaaaatttggtatggaaggaacatacctgaacacaataaacactatatttgtcatgccaccgtgtcatactgaatagggaaaacttaaaatcctttcctctaagatctgaaacatgaaaaggatgcccattgtcaccactattattcaatgtagtagtggaagtccaagcaatcagacaagagaaggaaataaatggcatataattggaaaggaaaaagtcaaattatccttgtttgcagatgatatgatcttatatttggaaaaacctaaagtatccaccaaaaaaatgatgagaactgataaattcagcaaggtttcaaggtacaacatcaacatacaaaaatcagtagcatttctgtatactaacagtgaataatctgaaaaagaaattagaaagtaatccaacttacaatagccatggataaaattagataggaagtaacaagcaaataaatgaaatatctctacaatgaaaactataaaacactgatgaaagaaattgaagaggacacagcaacatggaaagacattacatgtttatgggttctaagaatcaatattgttaaaatgtccatactaccctaagcaacctacaaattcagtgtgacccctatcaaaatacccatgagattcttcacagaaatagaaaatacaatcctaaaatttatgtagaatcacaaaagatccagaataggcaaagctatcctaagcaaagagaacaaaaccggaggaatcacattacctgacttcaaattatactacagaaatatagtaaccaaaacaacatggtactgacataaaaccaaacacatagaccaatggaacagaatagagaaccagaaacaaaaccacatacctacagtgaacacatttttgacataagtgccaagaacatacactgtggaaaaggcagtctcttcaataaatggtgctgggaaaactggatatctatatgaagaagaatcaaactggaatactatgtctcatcatgtgcaaaaatcaaatcaaaatgaaattcctaagagaaaactaaaagaaactctcaatgacattggtctaggcagaaatttcttgagtaataccctacaagcacaggcatccaaagaaaataatggacaaatggcatcacatcaagttaaaaagcttctgcatagaaaagggaataatcaacaaagtgaagagacaaacccatagaatgggagaaaatatttgcaaacgactcatctgataagattaataaccagaatatataagaaactctataggaaaaaagtctaatactccaattaaaaaaatggacaaaaaatttgaacagacttttctctaaagacatacaaatggcaaacaggtatatgagaaggtgttcaacatcattgatcatcaggcaaatatcagtcaaaactatgatgagctgtcatctcaccccagttaaaatggcttttatccaaaagacaggtaataatgctggcgaggatatggagaaaagggaacccttgtacgctgttggtgggattgtaaattagtacaaccactgtgaagaacagttcgcagttcctcaaaaatctaaaaatagatctaccatatgatccagcaatcttactgctgggtgtatatacccaaaagaaaggaaatcagtatatcaaagagatatctgcactcccatgtttgttgcagcactgttcacaatagccaggatttgaaagcaacctaagtgtctatcagcagatgaatggataaaggaaatgtagtacatatatgtaatggagaactgttcaaccgtaaaaatgaatgagattctgtcatttgcaacatggtggaactgaaggtcgttatgttaagtgaaataacccaggcatggaaagacaaatttcacatgttctcatttatctgtggaatctagaaatcaaaacaattgaactaatggagatagagagtagaaggatggttgccagagactgggaagggtagtgtgtgtgtgtgggtgagccagggatggttaatgggtacagaaaaaattagaatgaataagacctagtatttgttagcacaatagggtcactgtagtcataacttaattgtacatttaaaaataaccgaaagtaaaattcgattttttgtaacaggataaatgcttgaggggatggatgctctattttccatgattattacacatgcatgcctgtttcaaaatatctcatatactccatgaatatatacatctactatgtacccacaaaaattttaaaaagtaataattaaaaattatattttcatttagcaatatagataaatggttaaaactagaagtttgtaatattttggaagagatgaaagcatgcaaataacaagacaattcaaaaaggttgtcacaaacataatgaactgttcccaaagaatctcataatgaacttgagaaaattacatccctatctacaatctaaaaattggaagatggacatgtattcctattttaaatacaggctttattgttgttgaaatgcaaaactgtcctaaattgcactatcttttttgttaaagtgagtatatgtaactgttacactaaaaaatacactatatatatttaaaggaaaataaccattaatttttgtttttacaacagagacatcttgaccagaagcaatacaataacaaattagaaaagataaaaagcacttcattcaatatcagtatctatattatttctcaatttatgttgtcagcttatgttatttgtcaaattatattcttgatatacgcaaatgggttaaaatcagaaaagaataaattgtttatctaatcattcatatattcctcagatgatttttcaagactgaatgttcgaatcaataatttcttgcacgtataagattgttggcatgaaaatgaggttgaggtttaggtggagaaagttcaccatgagtattgtgagtcacctgaacattgtttatttacgtgtaatgaaaactacaaaattggcagtaaaataacagtagaggtcatttttaaaaaaatagggtgtgctgggaggtggggagaaagaaacttagggggtgagagtagccaagtttaccaaatagaaacagctccactctgtggctcccaccaagaaggatgaaaacagccagtgaattctgaatcttcagttgaggtaccaagcttttctcattgggactgactaggtggttggcgcaacccagggagagcaaagaagagcatcgagggcccacccaagagctgtgtgggcaaaggaagctttctcccccagccaaaggaggcggtgagggattgtgctacccctccctgaaaaccttgcttttgtcatggatccttgcaacctgcggatcaggagttccccttgcgagcccacgccaccagggccttgggtcccaagcacagaactgtaaagacatggcagctgcttgggtggctggccatttcagcaggcaccaagacacagtatttgcatactccagctctgggaactcccatgaggcaggatatctgtccactcctgtgggaagggggctgaagccagggggccaagtggcctcacttccacagaaccccacaagctaaaacacactggcttggaatccctgccagccaacgcagcaggtcagagactgcctaggaagacttaattccgagggcaggagggttggccaccatcactgcggctccagttggccattgtcccctgctgtaggtgccagtgagactgggtggtctggactaggagcaattccccacagcgcagcacagcagctgtgtcagttcatggctagactgcttccttaagtagaacactgatccattttttctcactgggtgaggcctctctgtgggaatttcagcatccctagacaggagtttatgaacagaactttgatatccctgagaggagccactaggaggggcagctacggtatcatggatcagtggtctttgtcttttctgcctgctggctctggagagtcaggggagcccagatgagggtgcagcacacccgctccaccaaggggcagccagactgcttatttaagcaggtgcctgatcccactcctgctgactaggtgagacctcccaacaggagtccacagataactcatatgggagaattccaactggcatcaggttggtgcccctctgggacacagcttccagaggaaggagctggcttccatctgtgctggtctgtagcctctgctggtgatacctccaggggtgggagggacccaggcaaatagggtctagagtggacctccagcaaactgcaacatccctgtagaagagggggcctgactgctaaaagaaaaacagaaaacaacaacaacatcaatgaaaaggaccccacaaaaacccatccaaaggtcagcaacctcaaagatcaaaggtagataaactcatgacgatgagaaagaatcaacacaaaaatcctgaaaactcaaaaagccagagtgcctcttctcctccaaatgattgcaacatgtctccagcaaaggcacagaactgggctgaggctgagatggatgaattgacagaagtaggcttcagaagatgggtaataatgaacttcactgagctaaagaattatgttctaactcattgcaaagaagctaagaaccatgataaaacattacaggagctgtttaccaacataactagtatagagaggaatataaattacctgatcaagctgagaaacacaacacgagaacttcacagtgcaataacaagcatcaatagccaaagagacgaagcagaagaaagggtatcagagcttgaagactatcttgctgaaataagacaggcagacaagaggagagaaaaaaagaatgaaaaggaatgaaaaaaacctctgagaactgtgtgattatgttaaaaaaccaaacctatgactgataggagtatctgaaagagacggagagaatggaaccaagttggaaaacacacttcaggatatcatccagaatttcctcaacctagcaagacaggccagtgttcaaattcaggaaacccagacaaccctagtaagatactacatgagaagatcaagcaaaagacacataatcatcagattctccagggctgaaataaaggaaaaaatgttaagggcagccagagagaaagtccaggtcacctataaagggaagcccatcagactaacagtggatctctgcagaaaccctacaagccagaagatagtgggggccaatattcgacactcttaaaagaatttccaacctagagtttcatatctggtcaaactcagcttcataagtgaaggagaaataaaatctttttcagacaagcaaatgctgagggaattcatcaccaccaggcctgccttgcaagcactcctgaaggaagcactaaatatggaagggaaaaaccattaccagccactacaaaaacacactgaagtacacagaccagtgacaatatgaggcaactacgcaaacaagtctacaaaataaccagctagcatcatagtgacaggatcaaattgatacataaaatattaaccttaaatgtaaatggactaaatgccccaattaaaagatgcagagtggcaagctggatagaggcaagattcattggtgtgctgtattcaagagacctatctcacatgcaaagacacacatagacttaatcccattactgggtatatacccaaaggaatataaatcattctgttacaaagacacatgcatgtgtatgttcattgcagcactatttacgatcacaaagacatggaatcaacccagatgcccatcaatgatagactggataaagaaaatgtggcacatatacaccatgaaatactatgcagccataaaaaggaatgggaccatgtcctttgtagcgacatggatggagttggaagccattatcctcagcaaactaatgcagtaacagaaaaccaaacactgcatgttctcacttataagtgggagctgaacaatcaaaacacatggacacaggaaagggaaccacacacactggcgcctgtcagggggtggagtatgtggttgggggaggtggagcattaggaaaaatagcgaacgtatgctgcgcttaatagctaggtgatgggttgataggtgcagtaaaccaccgtggcacatgtttacctatgtaacaaaccttcacaacttgcacctgtgccccagaacttaaaaaaaaaaaaaagaaaagaagaaagaaacttggaagaatggatcagagaccttgcaccatatgcctcatgtaatttgatcttcatcaagaagtcgttaatcaacatatgcttcattgagagccttactttatctcataaacatctttggtagcatcccatacgctgatcctcagtgattgacttctgacaccgcttaaagcagaaatctgttcgtgtgcatttattttatgtgaatcaaaattttgaaataattgtgacccagagaagtagatttcttctgtttcaatcctaatatgaggtatcagtccatttttcagaatggaaatgtgacagtgtcaatgctgtagcactttgtcagttatctgaggctgagaactactttttcattataaattatatttcacattattgtattgaaactaatatattatggaggtaagtgaaacattctcattaaatgttcacatagaacctgggattagaaagaatcctttagcttgctttatgccagaggtttgcagaagatatatcaagttgaaaaatttttctgtattacagcactgatattgaagaccattctcatcaagctatgaattatgtagtaatcagatccactgatgatatatatttattttataccatgaaatcttggttttctagaatttatatgctttcttttcccaattatcagaactgaataatctagtatattctctttaactttacattctaggaagttcagagttaaattccataaagtctttatttttaataattttgaattgtcatgtttcatatatttcaattttccaagccaaaaaggttctctttggaaatagatggtttatactttggacatgttctggcagcatacctttaattttcatttacttagatgaaatgtagatgaatcatatttttggaactacaggttttgccctttcatccttcacccccatacctaatatgaccttatacaaattatgtttgatgagaatcttcgatgagaattatagcaaaatatttgttttcctattatcttttgaatggcacaatactggatttgaactcaagactaaataatttttcgaaaaagaattagcagtgatttataaagttactatttttttttcagcaaagctagagaagatttgctgaaaattcagaaagaacgtgattttcatcgaatgcatcataagcgaatagtccaggaaaaaaacaaattaattaatgacctcaaagggtaagcttatacttgttggcatatttattaaagagttatttaatacatgttaagtaatttgattatgacaaagttttagacaaagttattaattccacggttattgagcataagatgagtaagttgcgacccttgctgtcaagggtctcagaaaatacttgtgtgtgtgaagtgggaggagttaagcagaaatatactgaaatacactgcattgttgctatgccacccaagagggccatcatcccaatacgactggagtgtgagagggctcaaggatttatttccacaggaattaaattctcaagtatgagtaagagtagacagtgaggaagtggggtccgcacagtgctctttgcagatagtacatcctctgcaaatgcaccaagacatgaaaaaacatgttacgttcatcaaattgtgtacatagagagtaaagtgcagctgtggtattgcagggataggggacatatctctaaatgactatgaatttgtaagtcttttagaaattattttgaaggcattattgagatttactttctctccttctttaccttcctcccctacaaaaacaagaaaataaatttacaatccttaaataaaattatattttgcttgctctaaggcagtgctatccaacagaactttttgtgatgatataaatactctgtatctgtactgtccaatacaatagcccctaaccatttatatttaaaaatataccatacttgttcaaattcctaatatgtttaaagaatacttttcacataaaattcatcattttagattacatgtttttttcgtatttcattatttcaggcaccctggtaaagaagcacacattactttgtaatacagctacacttggtgtatactcagatagcctttatttcttcatttaatcattaagaaaaacatctccatttaacaatctggatgaatcactaaagctcattttataaagacctaaaacaaaacttcaatgatgccatcaagtcacaaaactgggtatcaagttaatcagtcaaacacagtgaatactttgcccgatagctgcgcgattgcataataaatcagctataggacagagtgttttgatgccaggcaaagttggggtctgaaatctcttatgtcacattttacccaaatacattaatagtgtatccatatttcctttcattgtaaaccattaaatgtttaccttatttttctgtaaatttttcaactagtttgataataaattttacagtatttctttgtttgttgttttgttttgctttttagagtcagactctcattctgtcgcccattttagaatgcagtggtgagattaaggcatcctgtagccccaactcctgggttcaagcagtccttccgcctcagccttctgagtagctgggtctacaggtgcatgccaccatacccagctaaatttttttgttttaatttttttgtagtgatgggggtctcactttgttgatcaggttggttttgaactcctgggcaccagtgatcctctcagatcggcctcccaaagtgttggaattacaggcatgagtgaccaagcctggccagtatttcccatttaacacaagtatcttattatgaacgtgcttattttcagaattatctatagctaatattagaacttgcaaacagatgaattatgaagtacttatggactttataaaatagacacaccctttaaaatagattaaacagagtttttctagatgttgtttccttgttatattccagtgaaattctatgtgttgttaattcttttaacagaagatagtcaagccatatctcatgaatgagttaaattccaaagttagtaaaaaaagggaaattttgccatcaatattttctttaaaattcttcaaccatccacagattacagtatatatagttttgtgtatacaattctatatctgtgtgttgtatgtatttatgaatatgtaatgtttatggagattatagtatgcagcaaagtgtatatatattacatacatatgtatatatatatgacatatgtgtatatatatgttacatatatgtgtatatatatattacatatatgtatatatatattacatatatatgtattatatatatatataaacacacactaagctaatcagaaaggaggatagaactgtacatactacctaaatttttatttttgttactttttctgagtgtcatattaatacacattaaatgtatatataatgcaactgcactttaatacttaatttctattgctatcatcaatgaggtataatgtgatatccaaattaatgacgtttataaatactgctatgaaaatatagaaaataaaaagctctgttttaattattaatggaataaaatattattcttttggaggacttttggggaatttctgctttgggctatgtcattgtaaatagtatagaattagctctccaactggtactggactagctccccaaatgtaaggaactacatgactggacaaaatacatgaggcagttttttttttaagatggtggaaaattggcaaagcaggaccgtgatgcctaagagaagacaaacacaaaatgagcaggatgatcaacccacatatcttcctgaaggtacttttcagcccacagtttgaccagatataacccaagcagagcatggtggctttcagagctgaggaggcagagatcagagttcagggctgcagaggtagctggaacttgcagcatggtgtacacagaaggaaggaggtacatgaaatgtagcttaagaaatatctgtaatggttctcttcagtctttggccacgtaactaacttgtggaagtataggatgagagaacatgaagcctggcaggaaacagcacctgggaaactctgagcaaaatagagattccagaggttgcacagtgctgggagatgcaggagttctgaccagccataagggaagtaacctcactgaatactctgagcatttacttaatatcctccacaagccatgccacagaagcagacctagttggtcctagacaaagtgttgctttagaatttttctccaaaaagcttaaaggtaagctttgaaaaactcgagctgattcactgggaaattaactgtctgtcagaaaataactctttaaaggaagaaaacaaaattcagacaagtgtatgtccaacatacaataaataaataaagtttatacgtattgatttatctatagatatatctagaagcaggaagacatgtcctataatcaggaaaaagcagaaccagacacagagaaaagaaaattacagaattagcaggcagggactttacaacagttattatgaaatgcttagagttttaaagaaaatggtgactgtaaggagtgataaacagaattaaactgaaatttgagaactgaaaaaaacataatatgcaaatgaaaaatttactaataggtcttagaagattggacattgccaatggaaagatcaatgaacatgaagacaggaagatggaaaatgatccaactggtgcacaaagagaaaaaagctgaaaagaaatgagcagggactcaaagaaaaaagactgaaaaaacataaatagaacctctggagcaatattaaatagtccatcataggtgtgtatttgaaatccaagaagaggctgggcataaccttccctattctgctagcttattccaattgttaagtatacaaattcaaattatttactcaggaagactggagttgatcactgggtgcttacatgaaccaaatatgctgtgagcagactttagccaggactgtacttattttctgttcccctgtagactcccattctaacagaggggtcatgattctgctttaggtttctgaatttgaatgaccacttcttaaaatatctttccccagtacatagtcactcaattaaatagccaggggtaatttgcagaaaaattgaggctatttataacagtatataattgctatggtgttacggagtgcttcctctactgtctgccagggtagctccagcatttccacttcacagcgttggctatctttttccaagttttgaaggaccaccctagaagtgaatcaaccttattcactggagtttttttcttttttttttgtattttaagttttagggtacatgtgcacagcgtgcaggtttgttacatatgtatacatgtgccatgttggtgtgctgcacccattaactcatcagttaacattaggtatatctcctaatgctatccctctccacttcccacaccccacaacaggccccggtatgtgatgttccccttcctgtgtccatgtgttctcattgttcagttcccacctatgagtgagaacatgcggtgtttggttttttgtccttgcaatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacataacgtgtgcatgtgtatttatagcagcatgatttataatcctttgggtatatacccagtaatgggatcgctgggtcaaatggtatttctagttcaagatccctgaggaatcaccacactgacttccacaatggttgaactagtttacagtcccatcaacagtgtaaaagtgttcctatttctccacatcctctccagcacctgttgtttcctgactttttaatgattgccattctaactggtgtgagatggtatctcattgtggttttgatttgcatttctctgatggccagtgtgatgagcattttttcatgtgtctgttggctgcataaatgtcttcttttgagaagtgtctgttcatatccttcgcccacttgttgatggggttgtttgtttttttcttgtaaattggtttgagttctttgtagattctggatattagccctttgtcagatgagtagattgcaaaaattttctcccattctgtaggttgcctgttcactctgacggtagtttcttttgctgtgcagaagctcttcagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtgaggaagggatccagtttcagctttctacatatggctagccagttttcccagcaccacttattaaatagggaatcctttccccattgcttgtttttgtcaggtttgtcaaagatcagatagttgtagatgtgtggcattatttctgagggctctgttctgttccattggtctatatctctgttttggtaccagtaccgtgctgttttggttactgtagccttgtagtgtagtttgaagtcaggtagcgtgatgcttccagctttgttctttttgcttaggattgacttagcaatgcaggctcttttttggatccatatgaactttaaagtagttttttccagttctgtgaagaaagtcatgggtagcctgatagggatggcattgaatctataaattaccttgggcagtatggccattttcacgatattgattcttcctacccatgagcatggaatgttcttccatttgtttgtatcctcttttatttccttgagcagtggtttttagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagaccttgctgaagttgcctatcagcttaaggagattttgggctgagacagtggggttttctagatatacaatcatgtcatctgcaagcagggacaatttgacttcctcttttcctaattgaatacgctttatttccttctcctgcctgattgccctggccagaacttccaacaccgtgctgaataggagtgatgaggcaggacatccctgtcttgtgccagttttcaaagggaatgcttccagtttttgcccattcagtatgatattggctgtgggtttgtcatagatagctcttattattttgagatacgtcccatcaatacctcatttattgagagtttttagcatgaaggttgttcaattttgtcaaaggccttttctgctctaatgagataatcctatgttttttgtcattggctctgtttatatgctggattatgtttattgatttgcatatgttgaaccagccttgcatcccagggatgaagcccacttgatcatgatggataagctttttgatgtgctgctggattcggtttgccagtattttattgaggatttttgcatcgatgttcatcagggatattggtctaaaattctctttttttttttgttgtgtctctgccaggctttggtatcaggatgatgctggcctcataaaatgagttaggaaggtattccttctttttctattgattggaatagttttagaaggaatggtaccagctcctccttgtacctctggtagaattcggctgtgaatccttctggtcctggactttttttggttggtaagctattaattattgcctcaatttcagagcctgcaattggtctattcagagattcaacttcttcctggtttagtcttgggagggtgtatatgtcgaggaatttatccatttcttctagattttctagtttatttgcatagaggtgtttatagtattctctgatggtagtttgtatttctgtgggatcggtggtgatatcccctttatcattttttattgtgtctatttgattcttctctcttttcttctttattagtcttgctagtggtctctcaattttgttgatcttttcaaaaaatcagctcctggattcattgatattttgaagggttttttgtgtctctatttccttcagttctgctctgatcttagttatttcttgccttctgccagcttttgaatgtgtttgctcttgcttctcttgttcttttaattgtgatgttagggtgtcaattttagatctttcctgctttctcttgtgggcatttagtgctataaattttcctctacacactgctttaaatgtgtcccagagattctggtatgttgtatctttgttctcattggtttcaaagaacatctttatttctgccttcatttcgttatgtacccagtagtcattcaggagcaggttgttcagtttccatgtagttgagcggttttcagtgagtttcttaatcctgagttctagtttgactgcactgtggtctgagagatagtttgttataatttctgttcttttacatttgatgaggagtgctttacttccaactgtgtggtcagttttggaataagtacggtgtggtgctgaaaagattgtatattctgttgatttggggtggagagttctgtagatgtctattaggtctgcttggtgtggagctgagttcaattcctggatatccttgttaactttctgtctcgttgatctgtctaatgttgacagtggggtgttaaaatctcccattatgattgtgtgggagtctaagtctttttgtaggtctctaaggacttgctttaagaatctgggtgctcctgtattaggtgcacatatatttaggatagttagctcttgtcaaattgatccctttaccattatgtaatggccttctttgtctcttctgatctttgttggtttaaagtctgttttatcagagactaggattgcaacccctgcttttttttgttttgcttggtagatcttcctccatcccttgattttgagcctatgtgtgtctctgcatgtgagatgggtttcctgaatgcaacacaatgatgggtcttgactccttatccagtttgccagtctgtgtcttttaacgggagcatttagcccatttacatttaaggttaatattcttatgtgtgaatttgatcctgtcattgtgatgttagctggttattttgctcattagttgatgcagtttcttcctagcctcgatggtctttacaagttggcatgtttttgcagtggctgttaccggttgttcctttccatgtttagtgcttccttcaggagctcttttagggcaggcctggtggtgacaaaatctctcagcatttgcttgtctgtaaaggattttatttctccttcacttatgaaggttagtttggctggatatgaaattctgggttgaaaattcttttctttcagaatgttgaatattggcccccactctcttctggctggtagagtttctgccaggagatcagctgttagtctgatgggcttccctttgtgactaacccgacctttctctctggctgcccttaacattttttccttcatttcaactttggtgaatctgacaattatgtgtcctggagttgctcttcttgaggagtatctttgtggcattctctgtatttccttctactttgctctttccagtgcacatggaattgtcactaaaatagatcgtatactgagccataaaacaagtctctatacatttcaaaggatggatgtcatacatagaatattttctgaccacaaccaaattaaattagaaatcaatttttaaaaatctcaggggatttctcaaatatttggaaattaagtagtatactttaaataatccatgaggcaaagaagaaaattacagaatattttgcgctgaatgattaaaaatgcagcatattgaaatgcagccaatgcggcttaaattgaaattgatggctttaaatgcttattttagaaaataaagttttaaaaccaatgatgtcatcttagaagcttaaaaagagcaaattacaaccaagaaacatgaagaaatgaaaaataagagctgaaatcaataaaatagcaaatggacaaacaaaaaatcaacaaagtcagatgttggttaatggaaaatgtaataaaactgacaaatttgataataagatggataaactcttaatagactgatatcaccagaggctggcaataatgtagggtacccaggactgtcatatagggttgttggaagtataaattataacccagcaattaaactcctgggtgtttatctaaaataaatgaagatatatgaccaaaaatattacatgacttatataaaaatgtttaaagaggccttattcatgatagcccaaactaaaatccactcaagttttcatcagcaaaatattggataaccacattgtggaatatacatacatacaagggaatactactcacagtaaaaaggagtgaagtattgctatgtaaagtaatgtggaataatctaaagaaacattacactgagtgaaataaactagttaaaaaagagaacatgttatatgataccaaataaatgaagttctagaattttctggggtgttagacatgcttcatattttgataatgtatactacttgggtgtgcatttctcaaaactctgaactgtaacgcttaagagctgtatgttttatccatgtaaattacacttcaata

SEQ ID NO: 249 - DNA, 23614 bp, Homo sapiens
acaccctttacttgactttattgccatttccaaattcaaccacactgtgacatattttgtaattactcttgtgaaaatgaaacatcatttttactcagttacctacaattatatacaatttttgaccctaacttactgctgcttccacaactccaccaatgacactgcaggtcaaagtcacgagtgaatttaacttgtcctcatttttggtgcacttgacactatggcccattatatctatttgcttgaaactctcactttctctgtctctgtgacattgtgctgttctagttttctaccagttttctccttcctcttcctccactggatcccaatgtttctcagtactctttgtggcctctatgtgctcatcagcattcacaagttcaaagcacccctcttaagctgatgactcccccactatacttccaaccctaaccactcagccaggcttaattcctatatttttagctgcctataggatcattccatttgcctaaaaccaaattaatcatatcctccctacaaaacataatgtattcaaaacaaacaaaatagaaaaatctgcttccctttctagcttcctcattttagccaatagtgccaccattttccaagtttcaacacttgtctagacaagagtcatttttgactcctcctcctccttaccttgcacaacctctacttaaatccaatcactgaattttcagatctggaaagaactttcaagataatctagtttgtgctccttaaacataaataagagaccttggggctcagacatattggctgcttgcctcaagttcttccaaccctgattataagacactttctattaccaagacttatttaattgcatttttccaaaacttccacacaaatctttttttttttttttgagagggagttttgcactgtcaccagggctggagtgcagtggcgtgatctcagctcactgcaaaagagggttcaagcaattctcctgcctcagcctcccaagtagctgggactacaggtgcccaccaccacacccagctaattttttgtatctttggtagagatggggtttcaccatgttggccaggctggtctcgaattcctgacctcatgattcgcctgccttggcctcccaaagtgctgggattacaggcatgagccatcgcacctggcccacaaatctgttttctttgtagaatcagaagatctgggtttgaacccttaaaagctgactataagcaagtgaatagtaactgctagtttaaaaactgcctcctgatttagaatttatgatagaaatcagattaaatttaaactcctcaggcaggtattcaaaccctctcccactcctcctcctaacccaaactggctgactttagtatcaagcatggtttctcactgaacaaattctgtttcagttggcaggtcttcttcccatctttatctttctcattcctggttcttgacttccactcagttgtttccccagcctagaagagccttacacctcagcagacacttcctttaaggcccagattgaccagcattcccagcatgggtctttctttttttttcaatctccacagcatctcaactctactgcaaaatcttacacaatatatctttcacttatctgcatagtgttctccaaactaaggagctaaataatattaaacactcaaatttataataaaggcttgcaaatttgttcttacaacgaaacactggattctgctttttagaaagtattaaatttgatttacattcaattttactaggccaaaattaacaaacaagggttatttttttcacagtgactataccaatacagtttttcaacagtgaatagaatgcgtgatgccctcgaggagctcataatctagtgttaataaagctagatatgcagacagagaaggttaaagaacacaacataacatataccatcttactcatcagcttacttatgtcattatttcaacatcaatccacagccaaaaacctggaaataaaactgttatcatgctgggtgcggtggctcatgcctgtaatccaagcactttgggaggccgaggcgggcagatcacctgaggtcaggagttcaagaccagcctggtaaacacagtgaaaccctgtctctactaaaaatacaaaaactatccgggcgtgatggcgggctactcgggaggcagaggcagggagaagtgcttgaacccgggaggcggaggttgcagtgagccaagacgcgccactgcactccagcctgggtgacagaatgagactctgtctcaaaaacaaacaaacaaacaaaaaaaccatcctcggctgggcgcagtggctcatgcctgtaatcccagcactttgggaggccgaggtgggaggatcacgaggtcaggagatcgagaccatcctggctaacacagtgaaaccccgtatctactgaaaatacaaaaaaaaaaaaattagctgggcgtggtggcgggcacctgtagtcccagctactcaggaggctgaggcaggagaatggcgtgaacccgggaggcggagcttgcagtgagccgagatcgcgccactgcactccagcctgggcaacagagtgagactccgtctcaaaaaaacaaacaaacaaacaaacaaaaaactatcctcatcagacacacaaaacctccacagcaataaaatagcaaagagccatggtatttgtaccttttatccacaggagtggctcacttatactctgtctccacatgctcagttacatggttttcttcagggtttgtctgattagaaggtgcaaattctaaaaggaggctaattctaaaaacttgccaacaagggaggaaaaaaactacagaactaaacaatcaaaatgggttcactcaacaaacactgagtacatccttactgaatacaaagatgaagactacaagatttaaatatgatattttcacccggagattagtaaagatttttttaatgaaaatcccagtactggaatcaagggaattgggtccctcaaacactttgaggggcaagggggaatattctggaggacaacgtggtagtatgcatcaaacgctttgctgtgcctgccctctgaattagcaattatgctccaggaatacaggctatgaaaatcagaagcagcaatacagacctatgacaagtaggcttatcaccacattaattgtagtgtgatcataaatataatgtatcttccaggatgaacatttatatgacaaaatacaatgcagtcattaaaagctgccacccagaagtctgaaggatataaagaaatacagatgaaaacgtcataaaacaggccaggcgcggtggctcatgcctataatcccaacactttgggaagccaaggtgtgtggatcacctgaggtcaaagttcaagaccagcctggctaacagggtgaaatgccatctctactaaaaatacaaaattagccaggcatagtggcgcacattggtagtcccagctacttgggagggtgtggcaggagaatcgcttgaacccaagaggtagaggttgcagtgagctgagatcacgccatcgccattgcactccagcctgggcgacagagtaagactctgtcccaaaaaaaaaaaaaaaaaaaaaaaaaagaaaagaaaaagtgataaaaccatatataacgtataatcccaatttttaaaatgaccatattatatatataatatatatttgtaataaatatataaatcctggcccttctacgtacaagcttataaagttgaagttttttactaagtttcattttcctttttgtgaaatgatgacaataataatacctacttcataaggataaaagagcaatccctgttgtgggattctgttccgaacaggacattgacaatgtcaaaacctcccaaaaggagcttcaaacttccaagcactaaccactgcatgtataagttacaacagctttctaactggtctcctttttcatctttcctcacactgatgcatccaacactaccaccaaatcaatattcctaaaatcctaatttcatgtcatttccttgctttaaaaatctgtaatggcctcaagatgagattctccttaggccaacataacttgaccctattttacctgcactgggaagtattgacagtagtgtgaaatcaggttgttctaatttgaagcctgagtacaccacttattagctgtgtgaccctaggcaagtaagttaacccctctaacacttcctcagcttctcatctctaaaatgtggctagtattcatcatatgggtgtttttacagagtgaaaattcatataaagtgcttacttagcactttacatgtatgcctggcactggagatgcatcctttaaatgtgagctgttactacttccctaaactgtctactccacctgggctgctcttccagatcatttctaacacacattgcccaacttaggcctttggctggtggtgttctcacccatgaggcaccattccatcacaatcaccaccatcaacaaagagtatgtgttcaacatttacactatatattcaaggtgtaggctggaaatacagaggaaaaaaaaaaaaaaaacagtcccaaacctcagagctcatagtctaataatgaaagagagacagaggaagaggtccaataattaggggtgacaaaggaagcacttcctggaggcaagggagatgcttacactgactccagaaagctgcgtgggtgaatcaggcagtgtgggtgcatgtagagtaagagcatccagtacagcaatcacagtcactgtattgagtctggcactgctggagtactaaggctaagggagagcagaggctagatcagtgaggtcaggaagtgttggcactttattctgcaggccagcagcagccactgaataatattaagtagggtacacctgtctaggactctagaaaagcttacactgtgctgtccaacacggaagccacatacaactactgactggaaatgtggctagtgtgacagaaattaaattttaattaatgtaaacttggtaactgatagcaattcagttatcaaaaaccttttatgtatgtttggaacaattaaagagtatgtaggccgggcgcggtggctcacgcctgtaatcacagcactttgggaggccgagacaggtggatcacaaggtcaggagatcgagaccatcctggctaacatggtgaaaccccgtctctactaaaaaatacaaaaaattagccgggcgtggtggcgggtgccctgcccatagtcctaaaaatacaaaaattagccaggtgaggtggtacacacctatagtcccagctactcaggaggctgaggtgcaagaatcgcttgaacctgggaggcagaggttgcagtgagccgtgattgcaccactgcactccagtctgggcaacagaacaagactctgtctcaaaaaaaaaaaatgtatttaatgaactttaaatacagatcaattatttctgatgaaaatttaatgtccaaatttaaatgtgcagtaagtgtaaaatatgtatcagatttagaagacttagtacaaaagtaaaatatctcatcaataatctttaatcacatgttgaatattttgaatgtattagagattacattagaattaatttcacctgttcctttatattttactgcggctactagaaaatgtaaaatgacatacatggctggcattatacttctattggacagcaatgatccaatagatcccaggacagctgaaagaggaaatgagaccagaagcaggaagaacaattaaaaagactctgataagcatccaggtaagagagacaggcctgattatctaaattctgcccatcttcaaaacctaattcaagatacactactgcctccaaaagctctcctaatcctaacaattcccaaggagttacctttctctgaactcctgaggcacttatctgtagcattcacttcaacactcattcatttgccacctgtcatttctatttaattttggggtaatttgtttctcagattagaccagaagctcctaggctaagggccataatttaggcacctttaatttttgcatgctgtgtaatgcatttttgatacttttaataaacacaggtacatgactccccaaaaatctggatacaccttcatgggtgactttacctttccacagcagaaggaactgagaatctcttttccttcaagaaccttaaagataggagctaaaatgatgtaaaaatcaatcaaaactccctccaagccaatgttccgataaagtagtgatatttaatcagtgagcaagcattagtagactgtataggataccatcaagaaaaaaaaatgccaagacagaagaatttaggcttttgacaaattccataaaaagtcaaacaaaaaatttctgatcatctctgatctctaccgccagagataacctttgccaacctaagcattaagaactttcaatcaaggaaaaaacatctattttaaaaattaacccctaaatcaatccttctaataaatatcacattttctaggtagggatacacatattaccagtaaatttacaactcagcattttcccatctaaattagagtaaggtgaagaaaaaaaactttccagggaaatattaagaagtagtataaatgtattttactgcataatcgataaagtatttcacctaaaataccatttaaattttctacaacacttgactatacaacggccagcttgcaccactacagaaataggaagctagcagcaactagtaaaaagcaagggacattctgtggtgatcagtactgacctgggaactttgcagttttcagatttttcatgtttgacatttaaaacagaaaactgacaagtttctaataagaaactaaaagttacatcagaattgatcttcttgcatgtgtttaatggctacgaagtggatattacaaagtgcagttgaagactctatctccaaagaaacaatcgagcaatcaaagatgagctaggatagcttgtaagggaacagaaggcagtcctttctattctgaaaggcagaagaaataggagaaacctgtcaaacaacctggatgaaatcaaggagttaacaagcaacactcatttcctttagcactgtgagaaaattccggttgctaatagaaagctgaggaaagtttggtttggcttgtttcattttgttttccttccaaatcatcactgagtatgaacgactgctttcctctcctcacattactcagtaaaaactcccccattgaattgtcttccggtgccctgctccccagcctcccagaacggcccccgcccccgcctccctcccagcaaacgtgctcagacgcctctgggcttgttgtggtctcgccagtctgcggacaagcgctccaaactcaatggacaatggagctcacccccgtcaacgcgaactacaaagctcaggagggccatttcccttttcctgcccagatgctgttttcgctccttcgaagcaagatcccatgctcgactagacggccagtgtgcgccaggacccgcgtgtctccttccccacctgcagagctgctgagcccctcggcccccaaataaattgtaccgcagcacacaggccaaaaagggccccccaccaccaggggcttggctggggacagtggcttcacggtccaggtagggatggagggaacgtctcttgacgcttggtcatggccctcaagactaagccgtctccactgttccccctccccagctccaacttgcctcccctccccccactgcgagaagacctaggaggtgcgggcaggcagcaccgccacctcttcctccggtggagcgctcggccgacactcaccctttcaccacaaagaaggggtcctccatggacatggcgtcccggccccggccgccttcacctcctccgcgcacagggcgcccgtgcctcccggtctccctccgcccaccccgcctgttcccgcagctgcccgcgccttagtctgggtgaagccgagcagcgggcacgcgcacaggccaggtgcacaggacggccgctggtccagcactcgctcagcaccactggccgaatcccggactcgggcgccggccccctcggcagcctccagtcccggctcctcccgaagcgtcggagggcctgaccccacccccgggaccctcggccgcggccaatcacgaacgccgcctgaaacacgacttccgcaccccgctcacgtgaccagggcatatatctctctctctctctctctctcctctctctcctctctctcctctctctcctctctctcctctctctcctctctctcctctctctctctctctctctctctctctctctctctctctccccccccccccagtgggcggggcttacgcctgcgtccctcggccctggaggcggagccctcggggcggtggaggtgggcgggcttctacagccctctcctcaagcttgagggtgaggagtggcttgttccctcagaactaggcagtcggcttttcaggataagctgtagttgtacctgatttgcaaaatcctcttacctttcctctacttttaatacttaattttgacagtatgtaatttataaatctatctggtcctcgacttaaaatgaagcatagtatctgattataatgttacacagatcctttaagtaggtcttgctttgtgttggacagtgtgctaaaggttgtgtatgcatcatctcagtatcctttgggggaaagtattattcccccctccccctttttggggggcagggtctctctctgtcaccctggctggagtgtagtggcacaatcacagctcactgcacccttgacctcctgggctcaagcgatcctccggcctcagcctcccgagtagctgggactacaggtgagcgccaccacgcccggctaatttttaaattttttatagagatggggctctcagtatatttcctaggctggccttgaacacctgagctcacatgatcctcctgcctctgcctcccaaagtggtgggattatgggcgtgagccaccacaccatccatttttctcattttgtagataagaaaataagttcagagaggcttgaagacttcctgtagtcacacagcctggacagggcagaactgcagattctgtgcactttccaccagatggggtgtactttctgttgctgtacattctgcaaataaccatgtaaagtaatttttcatacagcatatggtgcttcccaggagagcacaccttcgaggaataaagaaggggccaggtatgacaacttcctctcactgtggttcaagagctattcgagaaaacattttgcccagaaccattaaccaactcatatgctagatatgctatgaaatttgtggatggggattgtggactttgattgctgaaaatcattgagcacttactgtgtgtgtgtgtcaggcaggatgttaagtgttatctcagttgctcttacaatgtgataattactgctatcatgcccattttataaatgagaaatctgagactcggaggttaagtgacttgcccaaggtcaccagtctggagctggcacagtccttggagcaacacaaaccccgtttaaaccttggctctatcattcagttcctcatctataaaacataaataataatagctagttcatgggttgttgtgatggttaaataaaaatgtgtgtaaacctcaagatcccaaaggactaagttactgaagtcaggaaaaccagtaaggacgctgctaaagtcatgtggcctgaagggatgaggtccagaccaggatgacagcgattgagaacagagaaggagtgaatctgacagatgtttcaaaaggaaaacaagactaaacacctagacatgatgaggggctgaatgggtttcaggaggggagagaagagaggggtgaaagccaaaatccctggaggagcgaatgatggaaggcagatgtggggaaaggaagcagtgtccaatactagtgattgctaatgtttattgggagagaactgtttaatttacttagctggggaggtgaaaacgtgtcatcgttcattcattcaacaagcacatgtaaattgaggggtaggtgagcatggtgttgaagaccatccttggagtctgattgcttgagttctgctgcttcctgactgttgcatctcaggcaagccgcttcatctctcactatcctcaactgtgaaatagacaccgtaataacagcttccttatagagtgtcatgaggtgatgtgtgaaaagtgcttaaaacagtgcctgacacatgttgtgctcctactgtgtgctaagcactgagacacaggcatgaacaaggcttggttcttgccttcaaggaactgtcagactggtgggagagacagactggtgggagagacacacagtgagagaagggcacaggttgccatagaaacacagcgacaagataccagtatatttgtgtgttttcggggctggggcagggggttcctaagcagtgactagaagcagccaggagaagggggccatgttgctggagtagaaggaaaaggatgggggcagcaggagctaagcctggaggtggacagggtcagattatcagggcccttgtttgtaatgttcagaatagtggacgcttcctatggacagttccccatggggactgagggaattgacagggtcagattggcatttgagacagatgcttcagtggctaggaggttatggtccagaggagggatgagggtatcctgagctgggcttgtgacaactaaggtggagaagagtgatgcatttgagacatactttagaggcaaagttagtatacttggtgactgattggttcagggtatgggggaattgatgaaagaagagggaggaaggcttctggggttgtaaatgggtagtgttggttccaaccatcaagaaagagaacacaagaggaggatttgatttagggtgaatgtaaattagctgttagcatgtcatttatccccaccaaacagtaaactcctggagggacaggatactatgttaatgttattatcacctaagtgcctgacacggcctcttattatctgttccatgaatttcttaattggaccacatatgacaggccagagttttataagtagtaatagaagatagaggacagaggcttgggttcccataattaggggattagaaaaagcaccaacaatggagatagtggagtgtcaagatataaaatgtgtgtatgtgtgtgtgtgtgtgtaggtgttcctttctttaatgtgtcaccctcctttaccctctctcaaactagaccttggcctccactgcccacaaggaaagggaagctatggctaaaatgcaaggagaaacaaaggaggttctttctttctttcttttttttttttttcatttaataggacccacgtcctggcataaacaataggttgggaagaatactcagcaaaaacccatctcttcccacacccccacccctaccccacccccaacccaaaagaataatttaaatttctcagggaataaaaaatcaaaacagtggttgtcttgggggacagagtttgactgggaagggaaactttcttgggtactagaaatgctctgtatcttgacggagtgtgtgttacatgagagtatcatttgtcagaattcctcaaaccgaaactcttaattggacttaacttctgttcatttttctgggggaggttgacatgccaactctgagctttctgtagagttctgagtgggcagccaggagaacctctggttcctgagtgagtctccaaagttaggagagtgaatgaggaagggagcacactgggtcctgcaatgcatcttctgcagaaataaggagatggcaacacagagaataaggcacaggcagccaaatgagctgaggatcagaaaggagccaaccatatcactggggatgccaggatagacctgagagggattgcagtgggtagccaccccctgcccctggaagctgcgggaatgccatgacacccctacaaggggatctcccctactctgaaataatgacattcagcctgctccttcactagcctgttataaggaacaactggatcatatatgggaataattttttattttttaaattttttattttttaaatttatgaggccggacatggtggctcacacctgtaatcccagcactttgggaggccaaggcgggcagatcacaaggtcaagagatcgagaccatcctggccaacatggtgaaaccccatctctactaaaaatacaaaaattagctgggcttggtggtgcgtgcctgtagtcccagctacttgggaggccgaggcaggagaatcacttgaacccaggaggcaggggttgcagtgagccaagatcacgccactgccctccagcctggcgacagagcgagactccatctcaaaaaaaaaaaaaaatttaattgtggtaaaatacacataacataaaatttaccatcttaaccatatttaagtgtacaattcagtagtgttaaatatatttgccttgttgtgcaaccaatgtccagaactcttttcatcttgcagaactgaaactctatacccattaaacaactccccattctcccccaacaatctctggcaaccaccattctactgtgtgtctctatgaattttactactctgggtacctcacataagtggaatcatacaggatctgtctttttatgatttgcttctttcagttagcatgatatcttcaaggttcattcattcattctacatattgcagaatttccttcctttgtaagcctaatattccattgtatatataccacattgtgcttgtccattcatccatcagtggacgacacttggctttctttcatcttttggctataatgaataatgctgctatgaacgctggtgtacaaatatctctttgagaccctgctttccattattttggatatatacccagaagtggaactgctggatatggtaattctattttaaatttttttgaagaacagtcatattgttttccattttacattcctgctaaaagacacacgcattccaatttcttcatatcttcatcaacacttgttattttctgggttttcttttcccttatagcagttgtactaataggtgtgaggtggtatctcattatggttttgattcacatttctttaataattagtgatgttaagcacctattcgtgtgcttattggccatttgtatatcttttttggggggtggggagaaatgtctattcaagtcctttgcccatttttgattgagttgttttgtttttgttgagttcaccctaaatccttcttgaaacaaggtaaagaaagggagaaaagtgttaacatagatataggatatcatactcttcatcattatccaaccttttagaaaccctgatatacatgtacatattccagaacattccacttatgttaagttccattgatctggctatgactgtctatgtttcctacctccaaccacagaaaatatccatacacatatccaaaacacactggccatgatttatttcctcttcctgtttgttaccaacacctccaccactgtcaccctctacacactgatttaaaataaacaaggaggaattccagtcaatttacatattcagcactaaggaatgatggagaatttgtggaacatccatttggtggtcattagaaatgttgtttaaaagtatgtaatgacataggaatggcttgagtaaaaacagcaagacacaaaattatacatatgatacaatttcagctctgttctttcttatacattaaaatgttttggtacatagaaaatttttacacgtaggaaaaaagaaatctatttaaagtttgtcaactactacagtgaaatatttacttggatagtcagaaatccaaaaagttttttaaaaagaagagaaaaagtaataaaagagaagtgaaaagccaagtgaccacatacgaaaaagtacatcaaaagttagcagttttcagcctgagcaacatggcaaaaccccatctctacaaaaaaaaaatacaaaaattagccaagtgtagtggcttatgcctatggtcccagctactcgtgagggtgaggtgggaggatcacttgagccaggaggcagaagttgtagtgagccatattcacgccactgcactccagcctaggcgacagtgagaccctgtctcaaaaaaataaataaataaataaataaataacagttttaaatcctgtttagaataaggcaagttaggagggtctgaatgaatggaaattggtgagtactaaaaagctgaaatacgttattggaattcagtgaatttcttgacaagacggtggatttgaaccactataggaaggggaggtatgttctttaccatcctttatgaatgtgactgtgtataaggaaagaaaaatcaatctgtgttggtaaactggctcattgcaataatagtactagtgattgctaatatttacatactatgtaccaggcattgtgctaagtgaccgatgtggttgggctgtgtacccaaccaaatctcatcttgaattctcatgtgttgtggtgggagggacctggtgggaggtaattgaataatggaggtaggtctttcccgtgctgttctcatgatagcgaataagtctcatgaaatctggcagtattataaggtggagtttccctacacaagctcctgtctgcctgctgccatccacataagatgtggcttactcttccttgccttcagccatgattgtgaggcctccccagctatgtggaactgtaagtccaataaacctctttcttttgtaaattgcccagtcttgggtatgtatttgtcagcagtgtgaaaacaaatacagtgacacacatgcattatcttcagaagctccagaatccccatatggggcaggttttagaatgtaatttggttggacagcagggctaggggacttgatgtggcatgggagacccctgtcttttctttttttttttttgagatggagtctcactctgtcgcccatgctagagtgcagtggtgcgatctctgctcactgcaagctctgcctcccaggttcacaccattctcctgcctcagcctcccgagtagctgggactacaggcgaccaccaccacgcccggctaattttttgtatttttagtagagacggggtttcaccatgttatccaggctggtctcgatctcctgacctcatgatctgcccaccttggcctcccaaagtgctgggattacaggcgtgagccactgcgcctggcctcttttcttaaattataggtttatttgggattacttaagacagctgatggccattatgcgtgtgtagtaaaagtactctaatgccccaacaagtgacaagtcacttcttggttccaccactgctgatttcattgaatcctcacaataatcctgtaaggcagaattggttattacctccattttctatgagaaatcccagacttagagaagttaataatttggtcaaaggtcacataggtaggaaatgtcagagcctcatttgaaaataagtttgactcctgaacccatgttctttgctacagtattctactcccatttgtacaaggactagccttggccaaaaattggcaaatggattttacctacccacagaaaagggctcaaatcaaactcgacacagacacagacacagacacacacacacacacacacacacacacacacacttctactgaattaaaaaagaaatagccaaggggaaactactgattaaatataataaaatatattatgttgaaaacaacattatttaacaaacaagacccttttgctaacttgataattcatcatttggtttttaaggatgaattgcactaactgcaaatgagtcagattcctcagaggggccttaaaatacatataataaatcaggtattaaaaagccaaacacataaagggatttataatgaacaggataagcacaacccactctgaaaagtgcggcctgagatttaagtttagactattgctcagaggtgaggcttgtttttccacaaagagaatgcgagggattctccctacctcagtgcctcccagcttagtggggcagtcttacctgtccttgaagatcttggcataattgaatctattaaaaattttaaggactattaaagctatgctattaaaaactgcatattaatattggaaaatataaatttgaaaagaatttacaaaatactattaggacgtaaaacccttttttggtaaaatgaacaaataaaggtatgcttatatgcagacatatgtagtcagcaaaaccactgaaaagaaatacactaaaatatgttaacagcaaattttttcctttcttcctccctccttctctctctccttccttccttccttcccttctttctttctgttgccatggttgtagtacagtggcgtctcagctcactgcagccttgacctccctggctcaagcaatcctcccacctcagccacctaagtagctgagactacaggcgcatgcaccacacctggctaattttttgtatttttagtacagataggggtttcaccatgttgcccaggctggtcttgaactcctgggctcaagcaatttgcccacgtcagcctcccaaagttgggattacaggtgtgagccaccatgcccggccaacagcaattttttctgatgggtgatttttatcttatcactctctgggttttttatatgtatttgccctgtactctggattaaatttactaatttgcaattagaatacaatgacttaaaaaatgaaagacatcggtcaggtgtggtggctcacgcctgtaatcccagcactttgggaggccaaggtgggtggatcctgaggtcaggagttcaagaccagcctggccaacatgggaaaaccccatctctactaaaaagacaaaaattagctgggtgtgtaatcccagctactcaggaggctgagtcaggagaattgcttgaacctgggaggcggaggttgcagtgagccgagatggcaccactgcacttcagcctaggcgacagagtgagactctgtctcaaaaaaaagaaagacatcgttgacatacctacatttttttttttttttgagatggagccttgctctgtcacccaggctggagtgcagtggcacaatctcagctcactgcaacctctacctcctgggttcacaccattctcctgcctcagcctcccgagtagctgggactacaggcactcaccaccacgcctggctaattttttgtatttttagtagagacagggtttcaccatgttccaggatggtctcgatctcctgacctcgtgatctgcccgcctcggcctcccaaagtgctgggattacaggcgtgagccaccgcgcccggcctcatacctactttttaatgtcagtacagcaggttatggtatggaatgcattttggaacaagatattaacaaaaattcaaaggaaaaaatacatggccatggaattccagtgctgagagacatttgggaatattgggggagttttccaaaagagaaatccaggtgactgtatttgttaaatgagtaacaaaaggaaaaacaatgtaaagaaacagaaaggaaaggaagagagaaatacaaagatctgagaagagaaggtgccaggggccgctgagagattgccaaatgttaatttcattatttggcttcttattttattctgggtaaaggtagacctattagtttcctgttgctgctataacaaattaccaccaacttagtggcctcgaacaatgcaaatttattctttcaaagttctggaggacagaagtccaaaaatgtgtcctatcagctgaaatcaaagtgttgtgttccttctggaggctctaaggagaatctgttccttctcttttctagttctagaggccatctgcgttccttggctcatgtccttctttcagcaatggcatcatcactctgacctttgcttccattgtcacatctccttgactctgacccttttgcctccctctaataaggcccctctgattacactgggtccaccagataatccaggatagctctctgtctcaagatccttaatttaatcatatctgccaagggttttgttttgttttattttgtttttgccatttaaggtaatatatccacaggttctggcaattaggttgtggacatctttggggcgacaattctcaacctaccatacaaccggtacataaggttctactacctactaaatgcatcataaacagaacttctgatccttcaacaactctgtgaaatatatgacaggatttgcttttaaagttgaagaaatcaggccttggtgcaatttgggattctgcccatggtcaaatagtggggaggcaaacccaggtccctgaacccagctcaagcctgcctgcctcatggccatgcctccattcacctctccccttcatgtctacttcctctttcctgtctgggcctgttccctagctccctggacaagcttaagctgctgttttccagcttgtcatgtgctccttatgacagtgtagccacagcttgatcttggggattgctgattgagcaagctgagtggctgcccctcagaatcttctgtaggcctttctcttgccttcttttattcagtaagtgttttgagcttattgtgctgggtgctagagtagcagggaggacagacctaagttgaagattacgggacaatctaagtgacacctgctatctcagacagagacttcagcatcatagggagccagagcagggagttccaagccgtgggaactgtgactctttcttactgacccttaagcaaaattctaagctccagggaagcagaggcagcagcttgagctccctgattgaccagatatgattaatctttgtttctctgtgctttgaacatgactatgctccataaatatttaaaaattgggaatagggtgaagatagatacaccaaaaggagcaagcagtgtctgaaaccagcaaagacttaaaagttaccgaagaaggtgttcatgctttcattttatcttttttttttaacctagcaactgatgacactgcatatcttcccctgttcttattgggagaaggccttgtgtgtcaccaagaggttctcagaagggacctgtcagtttttggttaaaagaacccggaaagagaaggactatgggggaactgatggcgttcctgttacctctcatcattgtgttaatggtgaagcacagcgattcccgtgagtatcccacgtcctcttctctcctaactccaaagtcgaggcagcctagaaggcacagcttttcttcctaaaacttgtggtgaaaaatatagaagccaggggcagaaacgtgtatgtattacactcagactccaggagcaatggattgcctgaacagtttcccagttcatatttgtaggattttgatgtcaccaccttctgagggagggggagccgttctagaaagactctggaacttcctcactttccctctgagcatggcctcctttcttttctgctcatattttttcttttacttttgtttctcctcttttctaacttccagagtctcatgaggatgtagtcagagtttcaggggcattaacagtggagtagatccattgttcaggtttatttatgtttttcctcaacacaagccctacctgtaataaaagatccaagaaagataaaaccatggctctgggtttgtttactgactgtgagaagtattaatcaagtagaagggagagtttttcattattcggggagctcaagtcactggggaagcaaatgccttctgttgcctcaaataggggaaagggcccatgggctagaaccaccaggcttctctgccctaatcacttgctccctgggctgaggactggtactggtgggcagtgtccagaacttagacttggccaccaccataggtgtgactgatgaacatgagaggaaggagttctttcaaatcacccatgcacatagagagtggaatgactgaccatggagatttggaagggcgaggggggtggatgattagaaattacttaatgggtacaatgtgtgttacttgggtgatggataccttaaagccccaacttgaccactacacaatctatgctataacaaaattgcatgtgtacatcataaatttatacaaataaaaaaattttaaatcatatggctgggagtggtggctcacacctgtaatcctagcacgttgagaggccgaggcagacggatcgcttgaggtcaggagtttgaaaccagcttggccatcatagtgaaaccccatctcactaaaaatacaaaaaattagctcggcacacccatctctactaaaaatacaaaaaattagctgtgcacagtgcgcacctgtgatcccagctactcgggagactgaggcaggagaatcacttgaacccaggaggcggaggttgcagtgagccgagatcatgccactgcactctagcctgggtgacagagtgagactccatctcaaaaaaaaaaaatccatatattaattgttcaaatattgattgatggcctactatgtgccaggcactttgggggatatggcagcgaacaagacaaacatagtctctgcttccatgaaaatttaatccagaaagtgtcatcatttatgggaaagattgggggtgagggtaagaggcagaagatgaaagaggaaaggaggagagaggcaaagggtgatatttttggaaataataaagcttatatattacctgcatgtgattctcaaagaactctccaataatatggaataatattccttaaacatattatctcctatgacaatctcactgactatttgtagtaggtgaagaaaatatccccatttaaagatgaggcctagatttttctctaggcctagagagtgaccacgctcacataaggagcaacctgaaggagactgcagatcttctggccctcggtccagggctgttccacaatgtcattgctcctttgggtgtgaagacttgtcactttgataattggggggacaggaaataaaacaagtaagttataaaggcaagggaaggtcacttggtgctggctgttctccttctgactccttagagtgcatccttctctgttctgttctgtgtccttgaggctgactgctagactgcatcacctagactctcttgcaagctgatttctgcttgggttcatacaatgggagacactgaaaggagagatgtcagagagcagggaggaaagagaggctgggatacatctttcttgctccttccccactttctgtgatgtctttggcagtagctatgttcttctgtaatgctgtcttccctgaataaccccttcttcatggttctagctcccattgggcttcagtaacggtatttgctattcttatctcttaagccctaggggtgataatggcttcccatagttgttagcctgcagatgcccatcatccttgtttgttccgttaaccttgaccatatctctgcaaggagtcccttcattaaggtctcctcacatgacccatctggcttgaaggctgtttcctgctaggaccctaactgaacattcctgggctttgagggatattggctggaaaaggatatgagattatgaaagaagactcagtctacttgatatttatgcctagtgctagccctgagtgggagctatataccagtaatagatggggaaacacggggaagagatactgcagggttgtgggtcattactccaggaaatgtcaacataactccaatatcactttcagtgtgttgctttcatcaactccacagcctgcagttgactcctccttcctttgtgctcccatggctcctgttcacagttctgtaattttccatttacaaaaatcttctctttgaggctctccttaaagacagaaagagatatcttcatttttttcttatttctctggtatacctagtgcccaacaggcacttagtaaatgtttgctgagtgaatttatgttcggaggtaatgtccctaagaaatcacagttatttgactgggagccatagagagctcgggcagtaataacgactgcaaattcaaaactgtggcttactgtagttgcaggatttgtattaaaaaggtgtttcatgcttttacaactcatcttgttcttcatttcagcctgtgtgaaactgtgaattggcgatatgggtgggtgtaatcagactgggggctggcatgagatttctcatgcattgccatatgtgatttgtatgtttcatctcgacataaccaaggtcagtctcttgatattactcataattttatggctgtataaatctgctatatcaatctacttcatgaatggtggagtccttcacaggcgaggtctgatgatggataagctccctaagctgccaactgggttactgttaaaaaacagacttgcatattatctgcttagaagtgaccttgagttcaaagagttaacatgagaaaatatgggctttttctttagactttattagatagacttcagtctgtttccatggagctgttgccaaggtatatgccatagaaatttctccaagacaatgtttcactcccctaaggccctcttcttaattggcattgaatctatctaaacttgagaaattcaactaatttgtagatttttcttttgactagttgaaatatctgtctattctcacttgaccccaatcctcttaccccacagtattgctaagagctggaggaaaggagcctaagttaaagatcaaacacatgactctttgaacacttattttagggaactcaaattgagaaagatgacaaaggatgttttttctgatgtatgaatttatatttatcggggaaaatctttcaagagtatacatattaagtcacattttgttataacttcaaaggatcattttagaaaaataaaatttataaaatcgggattttctgggaaacataagacatatagtcatcattgtgtacagagagtactgagggaaaaaagacaccagagctcattcattcgttttccaaaactccacatagtcctacagggctcactttcttactccattcacatctctgctcaaatgccacctgctgtggtccctctatctaaaagatcaggccttctcctctccacactctcttttctctgctttacttttcttcataatctttatctccacctgaccttgtattatatatgtatttattgccaatctcctgtctagaaattatctcacagggctgggactttcatgtgttcattgctctgtttccagcagctaggactgtgcttattggacattcagaaaagaatatacctatatgaagtgagacattggcaaccttcaaaagggtagcctcagaagagtagctcacaagccaaacttgtcacagtcgccacttttatgctctaagttcctgtagttagttagacatgtcattaggagaggggactaatggttcttgctgcacatagaaccatccatgaacatggcctgagatgtgtccaaaggtccccttaactaaaaatattgccacctacttctcccctcattcc

SEQ ID NO: 250 - DNA, 28247 bp, Homo sapiens
atcaatgatcaacactcgtaaaaggtcagggtgtctaatcaaagaccagatcatctatctctcaaggtaaagcgtacaacataatccagaaatgtggcgctgctggccatggagagtgagaaaatccaagggaaagagaaacttcagttccactttggtgaacaggaagaatgttctgctcatacaaaatgtgcagccagccttctgcgggcgatcctcagtggctcaggtgggcctgaaggggatgaacaaaggccacgctctgaagggggagcttctccaacatgctgggcttccaggttctgataaaaacattttagacttcaaaatgtcacagcaagtctatcacttgctctccaattcccgaaactcagtattttaaaaaataatatgtaaatataaatgcaccaacagcaaataacaaaaatcccaaactgctatcgaggtgttaaaatgaggagtgatacattttaacaaccagaatgaatacactaaaatgctaatagaactgagtagtggaaaagaaacaaaaagagagatcttgtttacccaatgtgggttctgtgcatatgcttgagtggagaggggagacaactgtgggatgggggcataagtatatcctgtgaaacagaacagaatactatcccaggaatcccgttcatatatctcatgaaatagaatcaaataatatctcatgtagcccatgaaacagaacaggattggaatgcacagctggatggctgcacatgccaaggattggaaaggttttcccaaaatacctatgtctaaccccaaagtgcttctgcctccaccacaccccagaccaatcaaaccagagtattaattttggcatttgtatttcttaaaacaaaaaacaaaagcctatgtgaatctcacatgaagacaggtttgagaaccactaactttaaagggagagaccctttttagggaagggaggtccttagagatgaggaacctccggtttcccaagggcacctctccttcttctgcagaaatacagctcgcctgtttatttctcttcctttttggcattagcagttccagttgttaaaggcaggaaaactggagtcattgtctctctctttttcatgatttatgactcagaagcaagacaggggcaggaggttggagggtaatgcttgcggctgtggttgctgttatttttattttgtatttttcttaaagaaaataaaagaaatatgcttttctgaaaaatcttgaagccttgaagccacctgcagggctgttgttttccaaggccttgcacttacgtaattgacatctacatagacacactcctggaacatatcgggggaggcaggcattctgcttgttctcatttgttctcaaattacatgataaaatacatgttttggaccttttaaaccaaagggagttattgagcccgcttacaaaatccataacatgttagcaggacttatctagctgcctccacagaatagccaagcaactctacacccgctttagcccccacaaaaacaagcggattgcactacaaataatttgcctatttggaaaatgaaagcttctctgtagtttgaggtcctattttttctttaagttgttacagtcttttcatggtccttgaggtctaggttaggtttttgtttggggtaatttttgtatcctatggatactatttaatctttagtattgagtcagtatttctcacttaggccttaggggaatactgcctgaagtatgtagggggcatgcggaattcagacgtggcttggaaactgcaccatgggttcacccaagaaacagaccagaggcaacacattctatcactaaaacgtgttctcagttacacttcccttccaaaggtaagcatcttaattcttcaactttttaagaggctaaacccagtgagggcccgtatgtccacaaatagatgacacacccatccaaagcacgcgtgtgtattaagggacagcgtgtcctcccacgttccagccgcccccctggctgccagccgcgggctcagcgcacgtacggtccctgtcacccgagcgtacctgtcccgttctggccttggagaacgcagtggctcacaagggcaccgctagcacgcgaggcgcggcgaagggagcggagggaagcggcgggctgtcgcgcaggtgcggccccacctgccgccggattggccgcggcggctgcggcgctccgcgggaggagggcggatgatggatggcctgtctgccggcccgggtccgagccgcgggggccgccgagggaaagacgggcgcgcgcgcgccgctccgtgcccagcgcagacagcgagatgcctgcacaaaaggatggggcttggaatgtttggattttgaagattagtttctattatatctctgtgggagaaaggaaaacgcgctatgggaaagtggagggcgaagaacccccgaataatttcggactgatgtttcacaaatcatttcgccagggaacaacccgcgagcctccccttcccaaatggcaaacagttcagaagtcttatttgtcatgtatgtgaatgatgccctatcagtatctgagaaacaacaggaaatcagacctgaacagttgcatccccttatctcgggcaatattaaacccattgaaaatgggttaaaaaggaggggcgtggacaatacactttagatattctacacaggctaaaaatataagataattggctagtaaacgctagtaaacttttttttcgaaaaagaaaaaaatagaaggatgtgcccgatatatatatatatatctatatatatatatatagcacattaggatatgcaacattttcataatttatctagcttttacttgtttaaaagtcatgagcaatttgaatatgttttgtttgcccttgcaaaaggatgacggtgcattgttttaggcaattctatttaagaagtgtcctttttaacactggttaggttgagagtgagggtcgaagcaggcagacggttagcaggagagaataagtcgtgaaccaccatagaaatggggctgatagagagctattgtgtcatccgggctcttctttggcgactgaaagacagacaggtccattcactgcaagcattcctcctgcgcaaaccgccacgctgaaggtaaagcatctcctgtcgaggaggcagtcagtcctgcaggtgctgattcatttacttctgagagtaaaatagtttagaaaaaaccagatttttttttctaggaggaaaatgattttctgcttaattgtgcttttgaattacaccatcttcctctgccatgtccactaccaccacgaagaaagtgaaagccatgtttaaaatagtaataaatgagatggaaacatatcaccaaggtatattttatataactgattgaaaagcgagtgggtggaaagagagagcttaagtacaagtgtttctctttcaaataccatatgaacagaacagtaactttagaaaaaagaaatgggaaaaggaaacataataatcccatcaggctaacagggacagcatataccaaaaaaatgcccatgtaaattaaatgtatgcatgcttcttactagaattgtttatatgtatgcttacatacttataaaagagtacatttgaattgtgggattatgtagtgattcacacagcattatgtcgaagggactttttaatattattagagaatatccatattaaccaattttaataactgcataatctttcattaattgtatatatggtttgctcaactattttcctgatgttggatatttaggttgcttttggatttcactagagtaaataacacagtaaggaacatcttgaggcaacatttccatgttttaaattattaatttcaaagaaatttattgaagtggaataaatgggccatacattaggaacattttcgtagtttttttacaatcattttcaagctaacttacaaaaaaaagtattgtaccgccccatcctgccagcaggaaaatcttgtattacatttttttcagctttgttgaagaaaaattgacaaataaaaattgtatatattcaaggtacacaatgtgacgttttgatatatgtctacattgtgaaatgtatcacattttaaaaaaaagtatgctccatgttattgagactatttggaaaagtatttggtaatgtagcaggtgggaattattttttgatattcattttctttagttattaatgaagtccttttgtttctttaaaaatttctttcctctcttttggattttggtttctgttcaatcattgaaatagctctgaagttggtatataaaaataaaatatagcatttttacaaatcactctttcatagtgttaattttgaactaggttgataaccctggttaaaatggttacagcaaaaaaattcttcacaaattgagcaaaggtgcagtttgaaatgactgatagaattcaggtttccaacaaacctctgctttccttccatggtggcacataaaatgatattatcctctgtgaaattaccccagaaacttaaggtacctgatagcaaatcgtattctctcattaagacatagaatcgttgatccttgcactagctttcttcctagtctgaagatgtatgctgttctcttaggctgtgatgtggtccttcaaaaatgcctttttgcgttccggcaccttccacaagtgcaccagtgcccagtaaataaagtagcagcccatgtcccttttagcaaaagctatatatctgttcagacttgtaatttgctccgtttatatcctttgcccttgaactctggttattaacgcaatgtttctccaaatgatgccatataactctgctccaagcacattcacggtgacaccacgcaaacattctgagggccagggccgggtgaggaagggaaaaaatgacggctgaattgtggaagttgcagtgcattactcaaaatggaagggctgtaaaactatgactgttaatattcaaattgcgacaaggccagggccagactttgactgcaaatattctgaggtctgcttggaaagcaatttagcaaagtagctttgattaaaaaagaaacaaccagaacacttctcccaagaaatgaactaaaaacctatcaaaggatttgagacaggtgtcctaattatacatcttaagaaattatttgtagtgggtttggaaaggaggtttgttcggttataaaatgtagattgtatgtgtaggagaaatatagaccaaattcctttgtgaaaactataatgaaatataccaatttttgcatcatatatattgtataagacaactgggcattgactgggtttactactgttttcattttttaaataaaaatttgctaattaatattgtgtaaaatcttggacagggagtgggactagtctccctttagaatatctgggaagggaatgcactgattaaccaaattaataatttaggtaagatcgcagaggctctgcacaacctactttgcaacggaaattgttcttctacattttagaaaagggcatttgcaaaagagcttctttcctttgaaatgaaaaagtcatacatttaaaataatatggccaagaaagagctcgtgcacattagcctatttcaaaatggtgtatttgtttcaaaataatgttttttaaaaaggtaattctctcaaacatctttattttcatagactcactttgaagtgacttcaggtcacaagttttgtgtttttttttttgcattttactttgaagcaaaatgttcgtggccatgggatttaatctatacacctccttccccaaatcctaggctatgcataatgcagttcatgcaaaaatgttgatgggaaggagaaaataatataccatccgataccgaatttcatgctgaaatgtaagctactgtgaaacttctaggcacatgtctgtattcttagtactctgactgtgtgcctttaaagagaagtaaagaaaagaaacactaataactatttcagttgactatactgttattttttcccagacacaacatgattggggtacatttgcatgtgcaaacacacttatatgagtattgccaatagaaaataaataagccataggtgccctagaacaccaaacacactcttcttaaagtgatagctgttcccatgtaagtattatttccagaggaaaatgaatgctaggcttcaagtaggttgtagtaagaatactttggaaaacagtcttttcatgaatatagagctacctattttcttcctattctctctttaatcaactgcacccaaattaaaggaggtgtttcacctttgatcaatgagattggtctagtgaccttaatttgaagacactttttggccaatgaaataaaaatgtagatgaaacatttttttaaattctaagaattctaggatctcatacttactagataagcagacttgacagacaccttgatgacgtcgctcatctctgaatgctcacaagctgagcatctgatgagttcccaaaatctacttattgaattaaatgcattaatggatgcaagtgaatgtttatcgttgtacaccattttgttgaaatataacacaatgctgggttgtacaatattaagtgattttaattaaagtaattcttgtgttatggtttcttatatccaaaaccacaaaatgtttatttttataaacttcattcataaacttatgaccccattgtgctagtaaaacaaagtttggagaacctggctcctacattctctcccgttgtcatggctaaataattgctgaaatgcacataaaaggggaacatcacactctggggactgttgtggggtggggggaggggggagggatagcgttgggagatatacctaatgctagatgacgagttagtgggtgcagcgcaccagcgtggcacatgtatacatatgtaactaacctgcacaatgtgcacatgtaccctaaaacttaaagtataataataaaagaaaaaataaataaataaaataatttttaaaataggaaaaaaaaagaataaaactgtgtatggtgttagatgtctattttctacaattgagaagggaagttatatattatttagtagagaacatgtgttttgtttgtgatagaataagagcattgcttattacaaatcgtgaacagtttgaactttgatgactgcagattaaactggattttctatctcggtctcctaaataaagtacctttacatatgttgcggattatatgtggcataattatatcaattatagtttctaacatttagctccaaaatatagcaaaacatattctttcactcacccatttcccttttccttttttttttttttttgacagagtcttgctctgtcatccaggccagagtgcaatggtgcaatcttggctcactgccacctccgcctcctgggttcaagcgattctcccacgtcagcctcctgactagctgggattacaggcgcacaccaccatgcccagctaattttttgtatttttaatagagatggggtttcccaatgttggccaggctggtctcgaactcctaatttcaagtgatctgcctgcctcagctttccaaagtgctgggaagccaccgtccccagccccattttctttttcccaaaggcaactacttccaacatttctattgtattctttcagaattcacttccctatcgatatggaacctgctggtcttcctcccattcttcttcttagcattattttagttttagaaatcatctcttgactttctactaaagatgaagacttgtctctctatactattcacagccccatttatacccacgttcttattttctgaagacagttatattgcaatttttgttaaattagtattcagtgtgtattatcactaataaatcttcctgagggctgtgctagggagtaaacagttatttattgacttattttgctaaatttcagttgtggtgttaacagttgatttgtttttagtcccttccccctaccttttactatctttaggtagttgcccctaagccatcgttacactctcggtcaatctctcaattccctcccaagatattttcatacatcagttacttcatgaagattttctaggaaaaatccttccagagctttccgtctaccttcttctagactaggtgtccttggtgtctgggcacagctgtcatcctgggctctctcttcacatctctcctgccatgagctcctgcagctgccttctatgctggggctcctattttctccagccttcatgtctctttcttgctttagcctctcctatgtggagcctgtcctccagcggctgctatgaaaaggtggggagatggtgcggtctaaaaatgttttgttttacacacacagtttacttggtaccctggcttggactagaatttctttttcttctgcgttttacaagcatttctccatttctacgtgttgccgctgagaagtatgaatttattctaattctgatccttttcatgtgatttcctcctatctgaaagtttaggataaactttttcactaaggtggacactggtgtcagtgtttgtccattgtgctaggcacttaggaggccccttgaatatggtatcctaccttgtgttttctgaacttctacagagttttgtgcttctcatataagtcttacaaatttctatgatttcttattttttaatttttgttcccatttttgtagtacttgtacagtttcaggttgccctgtcttccacttacctccctgaagatgttaagggttgttatttgacatttcgtttgcacattcttttttaagtagtttttttttttttaatttttgtttgtcttagtctccagttttcatgtaaaaaactttcctgacatatcaggcggtccttggtcatctgctcatatctacaataggaggatttgaaatgtgattgggagctctggttatatgggtggagcatatatgttacagttggaccatttctagccaagccattttactgacgaagcccagtttattcttttctattgatttcccagagaaggttctgaaggtaaaggcacagaccacagtgctttgctttccagtggaagaacacatttgtgtgtttcagtatctaccctactgatggtcatgtaatactgtcttcagtttgctacagctcagatgaaatagatgccatctgttttatcctcttcagagaataatttttcagtgttctattgtggtgggtgaagggcatttgccctgcaacatcaaagaacaaaggagatatggagctctaaaacaactttcaatgaacctcactttattttttttttttttttgagacagagtctcgctctgtcaccaggctggagtaccgtggcacgatctcggttcactgcgacttctgcctcccgggttcaagcgattctcctgcctcagtctcccgagtagctgggactacaggcgcacacccccacgcccagctaatttttgtatttttagtagagctggggtttcaccatgttggccagaatggtctcaatctcttgacctcatgatccatccacctcggcctcccaaagtgctgggattacaggcctgaacaaacacacccggcccaacctcacttctttttttattttattttatttttattattatactttaagttttaggatacatgtgcacaacatgcaggtttgttacatatgtatacatgtgccatgttagtgtgcggcacccattaactcgtcatttagcattaggtatatctcctaatgctatccctcccccctccccccaccccacaacagtgcccggtgtgtgatgttccccttcctgtgtccatgtgttctcattgttcaattcccacctatgagtgagaacatgcagtgtttgtttttttgtccttgtgatagtttgctgagaatgatggttttcagcttcatccatgtccctacaaaggacatgaactcatcattttttatggctgcatagcattccatggtgtatatgtgccacattttcttaatccattctatcattgttggacatttgggttggttccaagtctttgctattgtgaatagtgccccaataaacatacgtgtgcatgtgtctttatagcagcatgatttataatcctttgggtatatacctagtaatgggatggctgggtcgaatggtatttctagttctagatccctgaggaatcaccgcactgtcttccacaatggttgaacgagtttacagtcccaccaacagtgtaaaagtgttcctatttctccacatcctctccagcacctgttgtttcttgactttttaatgatcgccgttctaactggtgtgagatgatatctcattgtgattttgatttgcatttctctgatggccagtgatgatgagcattttttcatgtgtttttttgctgcataaatgtattcttttgagaagtgtctgttcatatccttcgcaacctcactgctttattgcaactcttccctttagcctgcccttacagaggtacctggaaccataagttcccttaggtgttaggttttccccatggtcagcttaggactcagtgttctcagattcaccaaatcagttaccaagcatgcttctgttttccagctttaggtttttttgtttgttcatttctgcttttctcttctctggtttttcggccagttgggaattatgccctaaaaataaaacagaaaacctttggtcttatgtaccagttttcacatgacagtgtgttcaattcaccatctttatccagagccagttgtatatatttatgtatgttacaaacagatgataatacagttaggatgatctgttaaaatggaacggaaaagcatatttttcagaagtgtttgattattttatttgtgattataaagcactttgcaaaaaaattagttagaaatactgaaatattataatttgtaatttcccactttttctagaagataattttttttttttgagacagagtcttgctctgttgcccaggttggagtgtactggcacgatctcggctcactgcaacctccacctcccaggttcaagcgactctcctacctcagcctcccgagtagctgggattacaggcacctgccatcacgcccagctaatttttgtatttttagtagatacagggttttgccatattggtctggctggcctcaaactcctgacctcaactgatccacccacctcagcctcccaaagtgctgggattacaagcatgagccaccaccctggccaagaagacactaattttgaatactataagtcccgatgtcttcttaaagttagctcaatatttatattgtttaaatactattttctaaagtaatgtattactaattatttcagcaactgattattccccacattagtagagaatggcagtaaatgcagcctatgagcagaactaactacaaatgcagcctacaggtagaacgaatgatgcagaactgagttctgcattggccaacagaggaaaaggtaccatacattaaataagattaatttatattaacagattattgaaggatgaaaattaaaataggaaaaatagattatagaagagttatattcaatgatataagatttaattaaagcaagttattttgaattcaacttatgtatacaaactctattaaactgagggctaggccttaaacatacttatataaaacattaaaataaaatgtgctactcagcatcaaaatattgagagaactattttggatatatgattctttgtattttgtttgagtaaaactttatatactaacagtgatttattgaattaacctcaataaattctaattaacaagaaaactattagatatctaagaatgttctataatattattgcttccagaattgcagatagtggagtaaaaattggagtgaatagaaaataagattaaacaaatattaccaactttaatatgattttcataagcttcccaagtccagggcaatatatttctggctgtgaaagtcaatacaaaatcacagactgaaatactcgacgtgacttgcaaaagtcatttttgggcaagctgtttcctgagaggtaaattaaactaaaacatatcttgtatcagacagtttttttttttttttttttttaaagaaactggatcgtggccttgttttccaaagaatatcactttatccctggttgtcaaatagatattaccattgtgagactgagtttgatggcaggcagcaaatactgattaagtgcaggccctgttgcttgaataaatgattttttaatcattggaaattaaacgcaaaggttttcctcacaatttgcaacttcttcctgaggttgtaattaaaagagggaagagtatttccggtgtttatcaacaaaagatttgagccagaaacagttgggttcaaatcccatgtctgccacttatgagcaaactatttaatctgttctgtggtgaccacgaacctcctgtgtaagtggagataatagtaaccagtgtttgtcagaattcaacaaggcatgtagcacagcgcctggttcggagggggcatgtgtatagctgagagtcattggtgctattgatgattttgtgtttggcctcatgtctctatcactgttagtagtagtaactttttctaccataattttggtggtgttggttttgtatattaaaaatattagagatgaagctccttaaatgacatattctgttaccaaatcaaactggtcctttatgcgtgtttctctggagttttgcccatgatgctgggcattttcaaagtgtgcaaatctcactgctctgagatttctctggataaatctgatttacagttgagcccttgccttttacccctgttggttaattgtttcccttctttgcctttgtagggtctgccatcattcctggtgaggaggagtcacctagagtttttgatgcggcccttatctggccatcatggctcataaaggcagtccctctggtactgtcagtttctttgtcacatgtcctgttattgagggagtcataaggagatggatgagctaaatctaatcaatcagtccttgccattttagccttccctcttcaggctaggtgtgtacttatgaggcacaaagtcaagggaagttttggtcacattttaataagttatttttcacttcattatttttctgaatgaagacgtcattccctgtcaacctcccaaaatgaccaataaagtttcttgtttttaagattttctttctttaaatgccactctgaactcacagacgtttatgtatttgattttttgtttgcttgtttgttgtttgtttgtttttgagatggagtcttgctctgttgcccaagctggagtgcaatggcaccatctctgctcactgcaacctccaaccctccggttcaagagattcttctgccccagccttccaagtagctgggattacaggcacatgccaccacacccagctaatttttagttttagtagagacagggtttcaccatgttagccaggctggtcttgaactcctgacctcaggtgatcctcccgccttggcttcccaaagtgctgggattccaggcatgagccaccgtgcccagtctgtatttgatgttttgatctaattatcagccaccagaaaaaaaaagaaaaaaaccaaagcgccttttgtcactaagcatagcacatacataaaaatgtctgatacaaatgtacagcttagtgaattggaaggcacatacctttggtatagaactttgccaaccactcccgatgtctgccacaggtccctgactccctagtgtaacagagagttttattttcattgtattcgtgtagaaagcaaaggtaggtactttaggccctcagaccttcaggtccaaatatttgaatgcatcttcagcggtgtgaaagtctcagggagtggaggtggaagaacttggaggagcagccctcgtgtccacacatgtgctggtgaggcgctccacgttgcggaaggagcaggaggtggtaagagaagctgaatggccaacagggcagaggtggggaccagctttccctctcctcccaacgtctagaggagaagatttcaagattcaaatgttctctttacatatccaataatggtgatagtcagtaatagtttttaaatagccttctttggaaaattaacatgttgacagtccactgtgttttttccatcactaattatttttgtttttcatattgttgtcactgtttcattaaatctccaaggtttacaatttgctaaacatacacttattgcctgcctgctaagtggtggatgctgttttctgagctgggcatcccaagctaagtacatagtccctgactctgcaggtcacctccatgagggcaaggcagtctatttctttgctctcctcttccccccagtgccagcactgtgcctcatgcatagtacatgttaaagaagcattgttttgaatgagctgataaaacgacctatgtcacatttttatacttcccttatcactactgggtatgttaacttatgtgataaaatacatttcccaaaaaagaaaaaacatactaatgattcagcacttatttttaggggcaaataagatggaaaagagggagggggaagggaaaaggcgtcctgtcctccttaccagctcttggccttgggcaagtcatttaacatcatggaagagaacacactggccttacacttctcagaatgtcacctctgagggtgaagatatatgtagcaacatttgggcagctgtcaatgccaggtatcattaaccctttaaataatagcagcttactcctagacagcacactttaatacccttgccatcttggacatccacacccactccaacaaaaactcccccctccaccaacacacacacacacacacacacacacacacacacacacacacacacaaatttattgaaggaaattatagcgaatatagcagacaaattgtatttattatttttagtaggtcagattgtttggactttgtgttgtgttatgtttacagccacatgccaagctcttccactcttacacaacatggagccctagttcaagttacctgaaggagctctcttgcattcaaatttggctaagactgtttacatataaaacatgtttatttgtttgtttgtttgtttgtttattcatgtttgttttttgagatggagtctagctatgccgcccaggctggagtgcagtgggcgtgatctcagctcactgcaacctctgcctcccaggttcaagcgattctcctgtctcagcctcccgagtagctgggactacgagcatgtactaccacgcctggctaagtttttgtattttttttcagtagagatgggttttcactgcattagccaggatggtctcaatctcctgacctcgtgatccgcctgcctcagcctcccaaagtgctggattacaggcatgagccactgcacctggccccatataaaaccttttttacctgaactgattaaaattcaactggttacctactacctgcctgattcaattaagttgtcaaaatgtttcttcatgcctaaaatgtgctttcctcctcccctaataaactcctacttgcctttaaaattttactatgaggaaacatttgtaacaacttgaagcaaagtattaatattctagtatacaatgttcttacaagtcaataaaaatcccatagaaaaatggacaaaacatgaattgtgaatccacaagaaaaaaagcaataaacgtataaaacactagttatcagataaaagcaattagagagactgttatcaattattacctccccctattgacagtaattagcagaatattgataaacaaagagtggcaacgatacacaatcatatatagttgataggagttggcaagaagttttgtcctatcaaatgtaaattggcccgccaatcctacttctagaaatgtattctaaataactattaccatgggtacagaaagatttatgcataagtattttcaaggcagacttgttcataacagtgaaacactggaaatagcctcgatgtctatcaagtgggtaagtgattccatacatctttgtgtagctgtgccataggactccaagtattccttaaacatgccttgcatggaaggacttctgaggcatgtcaagtgaaaaaaatgcaacaagcaatgctcatatgtttgtatgcaaaaaatgagcatgtatgtgtcaatgtgtgtgttgaaatttatcaaaaggggacttggaaggatgccatcaaattttagaaaattgatatttcctgggcataaaggaatgggggtaaggtagtagaggagaaattagaagaaaggactcagggaaaggttaaaggaggctctcacacgtgctattcttaccgttaatatttttaaaatagaatatattaggtattttacatttaatgacaaaagaagaaacttgtggccaggcgcggtggctcacgcctgtaatcccagcactttgggaggccgaggcgggcggatcacgaagtcaggagatcgagaccatcctagctaacacggtgaaaccccgtctctactaaaaatacgaaaaattagctgggcatggtggcgggcgcctgtagtcccagctactcgggaggctgaggcaggagaatgtcgtgaacccgggaggcagagcttgcagtgagccgagatcgtgccactgcactccagcctgggtgacagagcaagactctatctcaaaaaaaaaaaaaaaaaaaaccagaagaaacttgttatttcagttcaacataactcatcttacagagttatgttattttcttaatcatttatggtagttcttcatacattctgagtagtaatatttggttaagtatattatatttttctgaactggcccttgtgccttgtttcatggtgtcttttcttattcataaatgtgtaatacataagtcatcaatatgatggctcctaaggtttcgggttatatacacctgagattatacaaatactgtccacgattttattctagtgcttttatagtttcaatagagtcatgcactgcttagggatggggaaataattctgaaaaacacacccttagatgatttcatcattgtatgaacatcctagagtgcacttacacaaacctaggtgacgtagcctactacacacctcgaccacgtggtatagcctatttctcctactctataaacctgtacagcatgtaactatactgaatactacagggaactgtaacacaatggtaagtattttcgtgtctaaacctaaatgtagaaaagatacaggaaacatacagaattaaaatgttagtggaacaccattgtatacatagtccatccctgagcaaaatggtgttaggcagcacatgattacacgtacctctctggtacacttaagatgtttttctgtgctatgaagcacaggtttaacttaatttttttccataaggggttaatcacttattcaattccaaacttatgaaatgcttgttcttttcccactattttaaaatgtacatttttattataaataaatcacatatacataggtctgtgttggtattcgctcttctattgatatattttctctatgactttgtgagtaccacagtcttaattactgtaagtttgcagtgtgtcttacaatctaatataataaggtcccattattattcttttctaaacttccttgactacatttgtgtatttttctagagtcaacttgtcaagtgttattaaatatcctactgcaatttcgattttaactgtattctagatatatttataaaaattgatatctttctaatattaaattttctctctgacatacatctctccatttcacttaattaggtgttcatttatgttatctggcaaagtcctattttatttttttgctcacataggcatcatttatttccaattaaagttattcctagatataacattgacatttctagctataacatatttatgacaattacgaatggccttttttatttccattagattttctagttgattatttttttcttaagaaagcatattgctttcacagtattggtcttgtatctggccatcatcttatgaactatattactttcatccatatttttttccattttttacgtaaaaacttagtaaataattacattgtctctaaattatgaccttctgtcttttccattttaacatttacctctgtcatatttttctcatgttattacatgaaccggaatctctaacctagtgataaataccagcatgatagtcaggctccctgccccttttttgtgagttttgatgagaatgattctaatattccagtattaagtgtgatataaaaactgtatatttctggtagatatggttgagacatggctttcctgtctcagtttttatgttgtgctattgtcgtagtttacttccttcccatttaaatcaggaatgtcatttataacaaaggtaacataaggtgcagagggcacattttggagtcagaatcttacataacttgcatgtctccaccacttacatttttgtacctcaatgtattcatccaaaagtgaataaaatcataggacctactccactgagttattttaaaaattaaataaggtggggcgcagtggctcacacctgtaatcacagcactttgggaggccaaggtgggtggatcacttgaggccaggagttcgagaccagcctggccaacatggtgaagccccgtctctaccaaaaatataaaaaattagccgggcatggtggcaggtgcctgtaatcccagctacttgggaagttaaggcaggagaatggcttgaacccggggggcagaggctgcaatgagcggagatcatgccattgcattccagcctgggcaacaagagttgaaactccgtctcaaaaataaaaaaattaattaattaaaattcaaattaaataagatcatgggtgctaaagaactgtaaacagggctgagtacatactattcactaagaattaatagtactactataactattaaagaaattttcatttaattttcacctttgtgtaatatagtgattcatattaacacatttcttggtattgcaccatttttacatctctggaacaaactttgtgatcatgattcatttaacccactgctggattgtgttagctaatatttctatctgtttataactgatattttggtttacagttttctctctttgtaaatgagtgagtttgcttgtgtgtttatatgtgtgtgtgtctgcatgtgtgtgtttgacaattttggtgtcaagattatactagcaccatctaattagttggaaagccatccactgctttttgtgtctttgggcactttccataacatagattattatataaagtttctataattcagtctcaaaagcacggagtcatttttttaacaagcttttaggtttcttcaatgattattggtgtattcagattttcctggtcttgatagaaccttgatattttatgtctttctagaaaacagtttttttctctgatttctatttttggcaataaggagtaaacagtattctcatataattattttttaaatttcctccaaattgatggtatatctttatcttacttttaatgctgttttgatgttttattttgtaagccttttaaaaaaagtcttgcttgggtatgccacatgtttgtctattttcttggtctcagcagagactagtgtttagacgtattgtcatctatcttacattttagtgcaatataatctatttctattattattcattcattccttctacttttggggggattcatttgagatcgttgttcatagttattgaatagtgtgctgagatcatatatgtttaaagtgtcccatgctgccacatttcttcatttctccagttcatgcgtgagtgattttcgaacatccatgcaactagcatgaattgtgtgtccactgaatgtgtattaaaattgtttcccaagaatgatgccaagcatggagatacaaactcctagcttccagtaactcacaatgtgttgagaaagccaactttagagaggaaaaatgtatgtaggtaagaaagcaaacaagtagggaaggaagggagggaaggagggatggagggagggagggagaaagaaaaaaagaaaaaggaaaaaaatatatagtagagtaaaatagagatagactctaatgacatgcacaaggctctacgaaatgacaaatttgtaactgagggacaataataattgctctgcccaccaaaatggattgtgataagcaatgaatgaattaatgtataagaaaggattttgaaaaactgaacagaaatattaagtacaataggtcagatcagtgggacaaatcttcaatttccacatgcaatcaaggaggctgccattctcaatgccagctccatttctaactgggccacatactttaaaaaatgccatccaggaagttcctacttaatttctacctggtatttcatttgcattgcccttcctctatccaatgctaggttttaaaatatttttctttgcaataatatgtcgatatttctgttcgtggtacaactgcttagttatctatttcttcaggtatctctgttcaagccaacacccgctagcttatgctgagtctttttttcctgaagatactcctaaagaatactccatgatctcatcagtaacaccagcccatgtgaccgtaactctcactcaacggtacgtgacctctttgaaacacagtttcagtacttgagggatgtatggtttgtaaccggaaaaccattattctactttgacacatgttcattaaaggatattcacttcttttcacacatcttttcccaagtctcttccccatattattatgtattatctgatatttgatatttgggggatgctgccataaagacgtagtatagcatagacttcagatcacatgttcagggaacctatcaactgagctctctaaagtgttaaagcaaatttgttttcacctgcaatcttatttcctgtgacctaggagaatttggcgctttgtacctcaacatattttggagacattagtttctcagtgtgatctgcaattgttctcatactgatttaccagaaagtacaggacaggttctagtgtctgtacgcccactctttactttctccttttgcaaaagaaccacttatttgtaaaggcagactttcctctacccgctgccatgtggtttcaataggtgctgtcactcagataaactgctgccctagccacatgagtaaaactctgatctgaatgggccaatcagactgcttcacttttcttgccaaaatgatttggcttaaagagttgtgttaggcagaactatgacctcccaaggacagtcgcatcctgatcccaagaagctctgaatgtgttatgttacatggcaaaagggaattcaagtggcagatagaattgaagttgttaatcaactcactttaaaatagagagagtaccttggattacccaggtggacccaatgtaatcacaagcatacttaaaaatggaagaggtacacagaagagaagtttggatcaatatgatatgaaaactcaatctgctgttgttggctttgaacttggaggaagggggccatggacacaggaatgcaggtgacctctagaagctagaaaaccaaggagatgcattttcccttagagcctccagaaaggaataaagttctactggcatcttgattttggctcagagatcgatttcagacttccaaactgcagaaccataaggtaataaatttgtattgttaaaaccactaagtttgtcatattctgatatagcagcagtaagacacacatcaaagagtattcaaggaaaaccgacctagaccaaagagatatgtttccccaggaattttggaggcatagctgatagataaagtatgaggcaagcttggaattgccaggggaacctctgagaaagctggtttgcaagaaaaagctgagaagagctgaaatgaaaaatgagaaaatcctccagtcagccctcccttcttcatggctggggtatgcgggacaatatactcccctttcccatttgctgctttgagctgggatatttcatcacttgcaatgagaggtcttgaggaacccaggtgctaagtggctatgtatgagagattcccatcaaacacaggcacagaggggatggggcgataacacagcccagagcacttccaagccaaacatctcctatacatggtcacattttttaaaaaattagaaatatgcatgatctccaagcccacttctctgcatttttcttgagtaagtcaactcttggcttataaataattcaccatctttgaaactcacatttacatttgttaaattaaataagcaggaggccatcagcctgaggctgtctttgtactttgagtttctatgtaaggaactgcaacctcacagtatgtaaacgagccaaaaccgaacttaggagtctaatttctgtaatacaaagcagggtctcagccaatcacaagcagccatgtttcagccaatcacaggctgccaactgttcagactgtgtcccaaatagggcaaacccctaggtataaccaatcaagctatttcggtactttatttccctgttctgcctataaatactcactgtccagttttgcagacctgagttctttgaatctctggttctgagtgctatttgattcatgaactttttttttctcaaataaactgttaaatttaatttgtgaaaggttttaattcatatttcatagtgtagcagaatcacgtagttactcaaaaactatgcggacttgatatacattatttatgtttgtattaatttatttgatgtttctcatgggcttttgctccctctgtttcatggaggagcaagggacataaacttgagaataatctggtaacttctgtttaacagcatagtttgaaccatttccttagaaagtgtgatatttttttaagtaaaatgttcagtctttcagatacaccctcattctcctttcccttttctatgttagcatctggcatattagggacacttgttttatcctaaaggctcaaggagagatgaggtccctgagtcatcatagaatctctggcctctcctaccatgttgctgccctgggctgcttcctgcataggtgacattcagcataaaggccacaccccctagctgcagtctgcatttgggctaacttacagtttgccttagtcatcctcgtctgaaacttctggtggtccctaggcagcttcaagtcatctctctcagtacaaccagatcctctaagtcatcatgttattcatctgaccccagggctggtctgtgcacctggtggcttctactttgaagtcacactggctcctggtcccaatgggccccaaggcagcttggctgtgcctcactaagttacctttgtgcagatttccaggcatacacggacatttctctacattgggtccactccaggtgtaactgaagacatcatgagaaatgtaaaccatgccctccttctcactcttctacctccacaagttcactgtgatgtggtagcccctgagatggtgtgtgtgcaggccctgaggtcccaaacactgggctgaatgtaaggaactctgatcttgatattcccctcaatttatcaaataagcttatttcttttgaccaaaacctgacaaaaggaagattaggatacttgtgatcttctttccctctgacctgtctcttaccttctctttcttcccttaaaaggtcagacacttccttaaattccttcacgctgtttcctcctgtaacttgattgttgtctcaggctaaattgtcaccttgggacgtgtggggaggggagtagattgagactagtgtaactttcaacaatttttcactgattatgcatatttacaggacattttttattttaaattcacagaggaaattggattcaattatactgtacacaagattgggagaagatagtgacccttcttgtaaatatccataaaacataccacttagcattgttgtcaatgctctcccactttgctaatgcatgaccatagtgctagtcatgtgattacaaggtagtcacaacagggtagttaacacatcttacgctttactagtgtggatatttcaaggggtatgctaatttttatcttgacttatagtcccatagagtggtcaggaatatgagaagttggttctccagggaaaactgtttcccaaatgtcatcggaacatgaaggggaacagaaaattaatcaagacagtgacattttttaaggtggactacacagggaggagagaaagaaaatgcattgatggtttaagtgtgttgggaagtatactagagcgtacagaactaaggcttggaaattgatgcatcaaacactcaatgacatattggcggataaacaagcaaaatgattgctaagtgactgtctgattcatgtatctatagtgtgtaaaaatccagagatcctacacatgtgttgttggcagtttataggaacaagaacaaaaacttaggagaaaagtaaaagctctatggtctacctttgcatgcaaacgttgaacaggcgtaaaaattgcaacagattttcttgcttctaaagttgatttcccttctcacctttttctaaattttttgggataatatatgtaacagcaatttggtttctgacacaacatttctatctatagattttcttgtatgtatgtgttgggggaggggtgttgtttgttttgtttgtatttttacatctgaatatgttttaccgaagtcctcctgggcttctgtaacccttctgcagagtaagtctgctgccacagctttcccccacctgtcctaactgtatactttaagtgcccttaatctgcaacttagttctcatttggtgaaagtcgcacttcacttgatgatgttgactttctcagcaaagggcaatggcagttactgaagatgccctttgcagcaaaatctcatataatcaattctactaaggcgagctgacactccagtgtacactgggcatccgtggatgctattcctccagttcctttatgaggtctgcaacatttgggctgagatccaccaagcagttgtttgaagtgtgcaatggagtaggattctgcaagacagagacagaatcccaaccccaaacatggcagagtgatgaaaataccggagtccctagaacatggatgtgggactgggcctctactctgctacctgccacttccataactttgaggaagttccttatgccctaagcaactcagtgacctcatctggaaaatgaggagggaaacctcacactatcacgattaagtgagttcatatataaatcttatagagcccaatagtaactctgccatttattacttgcatgaactggcaaatgcttctttgagcctcagttagggttgccagatttagcaaataaaaatcccacatgtccagctaaaacaacaaacaatttttggtatgaaaaatgtctcatgtaaattggaatatactgtactccaaaaagtatttgtcatttatttgaaattcaaatttaaatggtcttcctggattttatctgtgaacccatgtattaattctcttgtctaataaatgagtatattcatgcttaccctagttaacttaagaggtgattatgaggatgacattaaaatataaaatatatatatatttttatgtcatcgtcataatatgtaaaagctttgtaaaatgtaacatgtgattcagacatgagggaatgctcaaattattagtgtagatattatggtcatcatgagttcacaaataggttgaggaatgtacagtgaaattcaatgagaggagatattgtaagttatagaccagttaacctgttcacctcttctgaggagccaggcacctctgggttacttgcaactgactgcttattctcattaatatgcatgtgtagatttcactggaaagtactttttgtacttggagagaggaggaaagaggaggagtatgaggaagattgtgaaggggactgccaacccttatacagggagggttatttcctttttaattaaatttctagacatgcaatttgccttttccgatatattaggtttttcatcagtttttttctcatatagtggcaaatcacgaatggctcattacaggaacaatcataggagggaccacttcggggcccactcataccaagcctgcattttaagcataaatacaccttcaacagagaattgcaagtgaaaagtcaaggtgctaaaaaaagacccaaggggatttttaactctcacacttcaggtgcattcaggaaagagaaacacccaaattctttcattttcaaagaaaataacataagatatttctatatcttctcatagctcagaactagatcccacaacaaatgggttcctgcataactcaatttctcaggatataataaataagaagaaaatgtgacttgtgcctctccaatgcccaatttattattctgtccttttcttaacatacataacccaggccggggtcacacctgtaatcccagcactttgggaggccgaggcgggcagatcacctgaagttgggagttccagaccagcctgaccaatatggtgaaaccccgtctctactaaaaatacaaaaattagccagacatcgtggcgtgtgcctgtaatcccagctactcaggaggctgaagctggagaatcacttgaacatgggaggcagaggttgcagtgagccgagattgtgccactgcactccagcctgggtgacagagggagaccctgcctcaaataataataataatgataataataataacccattgtgtcaaaaacacaatcacttcagtgagttggtaagatgcaattaaaggaagcttcagtggtataaatgaatttttattttgaaacgaattctgccagcttcacatacacaccacctcagagatgggcaatacatagagccaatagctaaagccaccaacttggcaatttcctccagcatatagagaaataaatctctagggcttccttggcctttgactttggaatacaagagccttggatgaagagaaaggtatgttgagcaccggctcctgtgcatacagattcggagctagtcccacctctgaatgaaaatggtgacttccccactctggactctgactctcagctggcaggcacaacagacaggataaggctttctgtgtatccacactctgggccatcgtgttttatggacacaaattgaagataagatctagtgatggagtctccagctacagcttgaaaccagcccatcaatgtcaggttccgttaaatacctgatgccgccactttgcggcagttctggtggataaaggttctgtcagggtcagtgtttcaagtgaggttcagactctcatttgccataaatgaagaggatgggaagtgagctgggagattgtcagactaatatttagataattgcaatttatctcttcttaaggatcaagctcattgaacccgagccgagttggagctaaactgtgtttataaggtctccttcctcaaagctagcagtctgaagaaagtggaaaagccagagctgggatttccggctgaccttggaacccggaatgaccaatcccaatagcaataatataatagcaagaataaacaatcatgaatattgcaaatgctgtctctccggtgctgagaaaaattaatttcctatttgaatcccattcacataaatactcataatgatgtatttaaatccagactctgttaaatcctaagcccacagtacctgagccaacagcatgagtctcgcatttaatcggttactgtaataaacatataaaatgttttttttcatgagaggacagagcagtggctacataaaaggacatcaaatgacacatcctccatctcccagcaaataaaaaagccatcagctcataacaaggcggtgataaaaggtgctgaggccagtaagattaagactttgtaataaggtccgggcgccaaaactgacagccattttcttttatatttatcatgtcctcacactggggtgagaagccatggctcggtcccattgctggctagaatttatagcagctccattattaggagattgcagtgaaatggggtagagg

SEQ ID NO: 251 - DNA, 29191 bp, Homo sapiens
gaaccattactcttccacatgaattataacttttaaaataattttttagtgtgcatttaaaagctatgttgggcaaaatagtaacaataaaaatcaaatagaaaccctagagataaagaatacaataactgaactaaagtgtttgacagaaagctacaatagtagacttgatcaagcagaagaaagaatcagtgaacacaaagataggaattttgaaattatccagtcagacaagcaaaaagaaaagaaaaataaaggtctatgggaattatgggacaacatcaagagactaacctatgcaaaataggagtccttgaaggagagacaaaaaggcccagaaagtatatttaatgaactaatggctgaaaagttttcaaatctggggaaagatgacaacgtccaggtactgaaagctaagaggctgtcaatgaaatccaatccaacagttcaccaaaatacatcataatcaaattatcaaaaatcaaaaacaaagaaagaatactgaaaacagtaagagcgaaaaaacatatcacagtcaagagagttccaatacagctgtcagtggatttcttggcagaaaccctgcaggccaggagagggtagaatgatatattcaaagtgctgaagggaaaaagaccctgctatccaagaatattttccttcagaagtaagacagaagtaactttcccagacaaacaaaggtgagggatttgatcaccactaggcttgcactaggcttggaattgctaaaggaagttatttaagctgaaatgaaaggctactacctaataacataaaacatatgaaagtaaaaactcaatggcataagtaatacatagtcatattcaaaatactgtaagtgtggtgtgaaaagcaattgtatctctattatgaaggttaaaagacaaaactattgcaaacaactgtagctataataaattgttaagggacccaaattagaaaaaagggtaaattttaacacaaaaaatcataaaagatgttggggggagtgaaagtgtagagtttttgtttgcaatcaaagttgttatcagcttaaaatagcctgttttaattataagatttttatataaatgctaggatttgaatgtgccacccaaaagttcatgtgttggaaatgtaatccctctgccctcatgaatggattaatgtcactatcatgagactggctttattacaaaagcagctctctctggctttcttgattttggtctcttgccatgtgatgccttccattatgtcatgactcagcaagaaggctctcatcagatgccaacaccatgctcttggacttcttagcctccagaactgtgagataaataaacttctattgtttataaattacccagtttgtggtattctggtataaaaacagaaaagggactaagccaataggtcttatggtaaccacaaagcatgaacgtatagtagatgtaaaaaatataaaaagaagggattcaaagcagaccaacacaggaaaccaccaaatcacaaaggaagacaccaagggaggaagaaacaaataatctatgaaacaaccagaaaacaaattacaaaattgcagcagtaagtccttacctatcaatatttgactggaatgtaaatgaatcaaattgttcaatcagaagacactgggtgggtgaatggatttttttaaaaaacaggaaacaactatacactgcctacaagagactcactttactagtaaggacacacagagtgaaagtgaagggatggaaaaaaatattcaacacggatggaaaccaaaagagagcaggagtagttatactaatataacataaaatcaactttaagtcaaaaacgataaaaagagaaaaagaaggtcattatataatggtaaaggactcaattcattaagaggaaataataattgtaaatatacacacacccaacattggggcatctaaatacacaacgtgattattaagtgacctgaagggaaagatagacttgatacaataatagtattttacagtaatacactaccccactttcaacaatgaacagatcatatagatggaacattaataaggaaacactggattgaattacactttagaccacttggacctagcagacttatgcagaacatttcactcaacagcaacataatacactttcttctcaagtgcacacagaacattcttctggatagatcctatgttaggtctaggccacacaacaagtcttaacaaacttaagaactgaaaatatatcaagtatttttttgggtcacaaaggcatgaaactagaaatcataatgagaaatcttggaaaattcacaaatatgtggaaattaaacaacatgttcctaaacaaccaacaaatcatagaagaaattacaaagggaatttaaaaagcccttgagacaaacaatgaaaacacagcataccaaaacttatgggatgcaccaaaagcagtcctaaaagggaaatttatagcaagaaatgcttatggcaaaaaagagaaaagattttaaataaacattctaattgaaatggtttggatatctgtcccttccaaatctcatgttgaaatgtgatcctcagtgttggaggtggggattggtgggaggagattggatcacgtgggcagatccctcatgaatggtttagcagcattcccttggtaataagtgagttcatgctcagttagttcacatgagatctggtttttcaaaagcctgggactccctcctctctcccctgctctcaccatgtgacacgcttgctccccttcaccttctaccatgactggaagcttcctgaggccctcactaaaagcagatgctggtgctatgcttcctatacagcctgaataatagtaagccaattcaaaaaacctcttttccttatgaattacccagtctccagtatttctttatagtgatgcaaaaatggcctaacacactaatgctacacattgaggaactagaaaaagaaaaaactaagcccaaagctagcagaaggaaggtcataataaatactagagcagaataaataaaattgtgactagaaaaacaatagaacaaaataaataaaactaacagctagttttttgaaaagatgaacaaaactgacaaacccttactagactagaaaaagaaagaaaagactcatatatcagaaaggaaagtggtggcataacaactgatatcacagaagtaaaaaggatcacaagaaactactataaacaattgtataccaaaaattggatatctagaagaaatgaatacattcttagacacataaaaccttccaagactgaatcatgaagaaatagaaaacctgaacaaaccaataacaactaaagtgattgaatcaataataaagttcttccatcaaagaaaagcccaggatttaatggcttcatggctaagttttatcaaaaatttaaagaaaaagcaacatcaatccctctgaaactcttccaaaaaattaaagaagaggcaacacttccaaactcattttatgaggccagtattactgtaatactaaagccagacaaaggtattacaagaaagggaaattacagatgaacagatacaaatacaaatatccctgatgaatatggatacaaaagtccttaacaaaattctagcaaaccaaattcaacagcacattaaaaagatcattcactatgatcaagtaggatttatctctgaaatgcaagcatggttcaatataggcaaatcaataaatgtgattcatcacagcaacaaaatgaaggatgaaaccatatgattatctcaatagacgcagaaaaagcatttcataaaattcaataccttttttattcttgagatggagtctcgctctgtttcccaggctggagtgcagtggtgcaatctcagctcactgcatcctctgcctcctgggctcaagaaattctcctgcctcagcctcccaagtagctgggattacaggaatgcgccaccacacctggataatttttgtatttctagtagagatggggtttcaccatgtttgccaggctggtcttgaactcctgacctcaggtgatccacccacctcagcctcccaaagtgctgggattacaggtgtaagccaccatgcccagcctaaaattcaataccttttatgataaacattgttaacagaataggtatacatgcaatatacctgaacacaataaaagccatatatgacaaatgtatagctaacattatattcaatagtgaaagttgaaagcttttcctctaaaatcagggacaagacaaggatgcctactttcattactttttttcaacatagttctggaaatcctaaccagagcaattaggcaagacaagaaaataaaagatatcctaactggaaaggaaaaagtgaaattgtctctgttgatgacatgatattatacaaagaaaatcctaaagactccaccaaaaagctgttagaactgataaattcagtaaagttgtaggaaacaaaatcaatatttaaaaattagtggcatttttatacactaataacaagctatctgaaaaagaaattaagaaaacaattccatttacaatagcaacaataacaaaatacttattttattgtctgtttatattcatattttgttatcaaatacttctttataggacttgtatactaaaaactgtaaaacccttgtgaaagaaattgaagaaaatacaaataaatgtaaagatatcccacgttaacggagtaaaagaattaacattattaaaatgtctgtactactcaaagcaatctacagattcaatgcaattcatatcaacattccaatgtcatttttcatagaaaatgtcatagaaaaaataatccttaaattcatatggaaccacaaaagacctcaaattgtcaaaacaatcttgagcaaaaagaacaaagctagaggcatcgtactacctgacttcaaaatatattatgaagcaatcaaaacagaatgatcctggccaaaacaaaacaaaaccaaccaaacaaacaaacaaaaaacaacagaatcactgaccaatagaatctgatagaaagccaagaaataagcctgtgcatttatagtcaattgatttttgacaaagacgcttagaacatacattggagaaaggacagactattcaataaatgatgctgggaaaactggttatcctcatgcagaagaataaaattagaccctcatcttacatcctgcacaaaactcaactcaaaacgggttaaagacttagacctaaaactataaacctaccagaagaaaacatagggaaaaacttcacaatattggcttaggcaaggaatctttggatatgaccccaaaggctcaggcaacaaaagaaaaatagacaaatggaattgcattgtattagtccgtttttatgctgctgataaagacatacttgagactgggtaatttatagagaaaaagagttttaatggactcacagttcacgtggctggggaggcctcacaatcatggaggaaggcaagggggagcaagtcatatcttacatggtggcaagcaagagagaatgagaaccaagtgaaaggggtttcctcttataaagccatcagatctcatgagacttattcaccaccatgagaacagtacaggggaaactgcccccatgactcaattatctaccactggagtccctcccacaacacatgggaattatgggagctacaattcaagatgagatttgagtggggacacagccaaaccatatcattccacccctgggccctcccaaatctcatgttctcacatttcaaagccaatcatgccttcctaacagtcccctaaagtcttaactcatttcagcattaactaaaaagtccacagtccaaaatctcatgcaagacaaggtaagtcccttctgcctatgaacctgtaaaatcaaaagcaagttagttacttcctagatacaatgggggtacaggcattgaataaatacacccattccaaatgggagaaatgggccaaaacaaaggggctaaaggccccatgcaagtcagaaatccagcggggcagtcaaatcttaaagctccaaaataatctcctttgactccatgcctcatatttaggtcatgctgatgcaagaggtgggttcccatggtcttgggcagctctgctctgtggatttgcagggtacagcatccctcctggctgctttcacaggctggccttgagtgactgcagcttttccaggtgaacagtgcaaggtgtcggtggatctaccattctggggtctggaggacagtggccctcttctcacagctccactaggcagtgccccagtgggggctctgtgtgggggcttcaaccccacatttcccttctgcactgccctagcagaggctctcaatgagggccccacccctgctgcaaacttctgcctgaatatccaggcgtttccatacatactgcgaaatctaggcggaagtccccaaacctcagttcttgacttgtgtgcacccacaggctcaacaccatgtagaagctgccaaggcttggggcttgcaccctctgcagccatggcctgagctgtacctttgtccctttcagccatggctagagcagctggaatgcagggcaccaagtccctaggctgcacacagcatgggggccctgggactggcccaagaaaccattttttcctcctaggcctccaggcctgtgatgagaggggctgtgagaaagctctttgacatgccctggagagacattttccctgttgtcttggccattaacatttgtttcctcattacttatgcaaatttctgcagccagtttgaatttctcctcagaaaatgggtttttctttttctatcacatcatcaggctacaaattttccaaacttttatgctctgtttcccttttaaaactgaatgcttttaacagcacccacgtcacctcttgatgctttgctgcttagatattttttccaccagatatgctaaatcatctccctcaagtttaaagttccacaaatctctacagcaggggcaaaatgctgccagtctctttgataaaacatggcaagcattacctttactccagtccttatctccatctgagaccacctcagcctggatttcattgtccatatcattatcagcattttggtcaaagccattcaacaagtctctaggaaattccaaactttcccatattttcctgtcttcttctgagccctctaaactgttgcaacctctgcctgttacccagttccaaagttgcctcctggcagggaaattgttttgggatgattcaagcatattacatttattgtccactttatttctattattattacattgtaatatatcatgaaataattatacaactcaccataatgtagaatcaatgggataaattttagtagatataaatgaaggcttaatgaattttttttttttttttttttgagacagagacttgctctgtcacccaggctggagtgcagtggtgtgatctcggctcactgcaacctctgcctctcaggttcaagcgattctcctgtctcagcctcccaaggaaccaggatttcagttgcacgccaccacacctagccaatttttgtattttcagtagagacagggtttcgccacattggccagtctagtctcaaactcctgacctcaagtgatccatctgcctcaccctcccaaagtgctggcattatggtgtgagccacggtgcccagcctatttctttttcttttctttctttttttttttttttttgatagctgggtggcagatgtataaattgtcattgacctaacagaattaagctgggccatggagaaaactgagaacatcacgattcaaaacacagaattctcaaatggaccagtgtgtttagacctgactgtggaatggaatgccacacctaggcatatgaggtatggttggggcactgtcacatgtccagcttgggagccatcatgtgcccaggtcgggagaggtaaatccacgagacacagacatgtgctgggggtgcagtcgcatgtccaggtcaggtgccctcacttgctgggagtgccatctgctagtgggagccagtcacatgttggggtgcaaccacctgttgggggcgcaatcctgtgctggagacacagtcacatgtcgggagctagtcacccgctgggggcgctgcctcgagcctcatggctgcccctgcttccgtcatgggcccactcgggccctctgccctgggccttctgctgctgctcctggtggtggcccctccccgggtcgcagcattggtccacagacagccagagaaccagggaatctccctaactggcagcgtgggtaggccctgccccaggggcggatgggcggctggagacagtgcccttggggcgtctgtcggtgctgggcctcctcccccatgtcgcctgcccatcccttcccctcccccatgtcccctgccttcccttcctcctgtgtcccctgcccctcccccacgtcccctgcctgccctacctctcccgtggccccagcatggctccaccgtcagctccgttctccctgcagcctgtggtcggcccagcatggaggggaaaatcctgggcggcgtccctgcgcccgagaggaagtggccgtggcaggtcagcgtgcactacgcaggcctccacgtctgcggcggctccatcctcaatgagtactgggtgctgtcagctgcgcactgctttcacaggtaagcgggcgccggcctgggatggtgtgggtagctgggcctgcacggagtgcccacagcggcttggatggaccccacgcaagcctcccccatcaccattgtcgactcccttcaccactgtcgacccgcgcaaggccaggtccccaccagtgaggctggtccccaaacacacagctgggtccccattcttgaggctggtcccccaagtgcacagccaggtcctcaagagtgatgctggtccccaagatcacagccaggtcctcatatgcaaggctgatcccctaagtgtacagttaggttcccatgagctaggttggtcctcaaatgcacagcctggtccccatgtgcaaggctggtcccctaagtgcacgaccaggtccccacgagtgaggctggtcctcaagggcacagccagattcccacaagtgaggctggtcctcaagggcacagccagattcccacaagtgaggctggtcctcaagtgcacagccaggtcccacaaaagtgaggctgctcctcaagtgcacagccaggtcctcataagcaaggctggtctctaagcacctggccttcccgattgctcctccaacagccccattcaccacagctgccccgcacagcaggcacgcctctcctgtggccatctggcctccagagggatgtgtgcaaccaggttgtcagtaagagtcagagcaggtctcacatgcatgggctgctggcctgtacagctggtggtcgtgtacagacttgggtccccagagcctccatgggccaagtcgactctttagggggcaactcttccagacagccagataggtccctactatgctgcaggaagaaactggcttttcaatcccaccgagtgagtgccagccccttgcgcttggcctccccaggcctgtgggctgaccacacaggaagctgcgggcattgtacctctgttctcacccccacagggacaagaatatcaaaatctatgacatgtacgtaggcctcgtaaacctcagggtggccggcaaccacacccagtggtatgaggtgaacagggtgatcctgcaccccacatatgagatgtaccaccccatcggaggtgacgtggccctggtgcagctgaagacccgcattgtgttttctgagtccgtgctcccggtttgccttgcaactccagaagtgaaccttaccagtgccaattgctgggctacgggatggggactagtctcaaaacaaggtaggaatacagtgcagggctttgtgggcaggatgaaggcttctcttccaccacagggaagaaaatgctctgccagctaagggggtccaggtgtttggggactggaatccccacctgtcaatcaacatttatttgtttgtcagtgtggatattttgttgttttgttttatttctgactggctttgttgtatgcagaaaaatacagctactttgatgtgaagttggtatgcagtatatcaagaacacaaatttaaaagcagttttccttaagattgtaaacggaatttagaaatctcttttagcttatctaaaaaccgtttgttattaaacttttctccagaaaggcctgtgcattctttctagatttatacctgggcactttacaatatttaggtctattcaaaagagatttttaaaattgcatttgctaattagtcacagctaattagctgtgactatgtgtgatttttgcacattgatcttatatccagtcatcttatagaatttatttttagtagtttatcaactgattattttgacagttctagacaaaagataatattttcttctagtaaagactattttatcactctcttcccatattttatcttttatttatttttcttgtcttcttacaatggttggaacctccagtagaaatgatgccagatcttgtcttggttttggtttgattggaaatgcttataatggttcactatagcatttgtggccaggcctggagatttcaggttgatatattacaccagattaagaaagttaccttttatagctgatttacttaatttttaaaaaattatagaaaattattgattttattgaaatgtttgcggcaactcttgagaggatcatatagttctgctcttttaatctattgatgccaagaataggcatttaagctgggtgcagtggctcacacctgtaaatcccagcactttgggaggctgaggtgggaggatcgcttgagcccaggagtttgagaccagcctgggcaacatagtgagatcctgtctctacaaaaaatgctgacttagctgggcttgacggcatgtgcctgtagtcccagctactcaggaggctaacgtggaaagatctcttgatcccagaaggtcaaggctgcagtgagccaaaactgcatatctgcaccaaagcctgggcaacagtgagaccttctctcaaaaaaaaaaaaaaaaaaaaaaaacgtatttaatgtgagatgggtctagaattttttttcttagctgattttatctttggcatgagtgtactgctgactttgtagaatgaatcaaaactttcccatctatttgtattctctgcaatagtttctattaaagtaaagattagctatttcttgaaggtttgatgtggccataaaacactctgatcctagtaccttttgcgggtataaatgattactctgtcttactctctgttatggctactggttcattccaattttaaaatttattcttaggccaattttgatggattatatttttctagaaagttgttcattttattccagattttgaatataatgatattgtgtaagactgtaattcatgtgctcttattattacttttctgacttctcttaattccttatcatagttgccaaaattgtctattctattgccttttttatataaaactacctgctacagattttgcattggtgtatgtggggagatggtggtgcatgggactttatatgttgggtgctttgctattcactcctatagccatctattcattcgttaaactttttatactctaagtttgcttaaccaaacttttctaattttttgagctgaaaatacaaaagattcaacatttcatactttttctatgaataaattgaagattatagctttcaaagtctcctttggtcatgttacaggctttgaattcttacatatttgttattcgtttctcaaaagtatgtgcaccctattttgattttgtctatatccaaaagtataggacaaaatttttcatatctacaaaaaaggccattggaattttataggaattgcattgaatattcagaccatgttgagtaatgttgacattttaacaatattaaacctgcctatccataaacatggaatgtatttccatttatttgagtctttaatttctttcagcaatgatttatagattcgagtatgcaagtttttcacctccttcattaaatttatttccaaggtatgttattattttagatgctattgtaaatgaaattgctttcataactatcttttttggattgttctttgggggtgtataggaacacaactgatttttggccgggtgcagtggctcacgcctgtaatcccagcactttgggaggccaaggcgggcggttcacaaggtcaagagattgagactatcctggccaacatggtgaaaccccgtctctactaaaaatataaaaattagctgggtgtggtggcacttgcctgtaatcccagctacttgggaggctgaggtaagagaatcacttgaacccaggaggtggaggttgcagtgagctgagatcacgccattgcactccagcctgggcaacaagagtgaaactccatctcaaaaaaaaaaaaaaaaaaaaaaaagcaacacaactgatttttttatgtgttggccttataccctgcaactttactgaatttgtttattatatgtagtagttttgttttttttttaaagattaattgggattttctatgtataggatcatgtcatctatgaatagagattgttttacttctttgtttccaatttgaatggctgttatttcttttccttgtctaaattatttgtctagaatttctagtacaaattaaatagcagtgatcaaagtggaaatccttgttttgtttctgatctcatgggaaatgctttcagtctttaaccattgaatatgatgttagctgtcagtttttaaaaaaatgccttaatgttgatgaagtttttctacatcaattgagatgatcctatgttgtcttttttcgtttattctattaatgtatattacattgattgatgttcttatgttgaattacacttgtatttcttggataaatctcgctttgtcatggttttatatgctgttggttacagtttgctaatattttgctgagggtttttacatctatattcttaaaggtatgatctgtagttatattttcttatggtgtctttggctttggcatcaggataattcttgtctcatagaatgaattatgaagtgttgcttcctcttctatttttttggtggagtgtgataaagattgattaattcttctttaaatatttggtagaatttaccagtgaagccatctggtcctgtacttttctttgttgggagattcttattgttgaatcaatctctttacttgttatagatcttttcagatttcctatttcttctgtgtaagtttagataattcatacgtttgtagaaatttgtctatttcatccaagttatctcatttgcaagataagttatttcacaaatttataatcatttttgtgcatttgttttttgaatcctgttgcagataaaaagtggaattaaaaaccaaataaaaagtggaattaaaaaccaaactcacttatgagtgagaacatgtggtgttttggttttctgttcctgtactagtttgctgaggataatggcttccaactccatccatgtccctgcaaaggacatgatctcatttttttttttgcacaatattccatggtatacatgtatcacatttttttaatccagtctatcattgatgggcatttaggttgattccatgtctttgccattgtgaatagtgctgcaataaatatatgcatgcatgtatctttataatagaatgatttatatcatggtttaatggtttttatatttgcccgtgcatttacctttaccaaagtcctttaatttgtcatatggctttgacttactgttttgtgtcctttcttttcaatgtgaagcactccagttagcatttcctctatggaagatctagtggtgcagacttccatggctcttgtttatccgtgaacgacttaatttctccctcatttctgaaggacgatgttgtcagatataggattcttggttgaaaggttttttcttttagcactttaagtacatcataacactgtcttctgatctccttagttttttatgagaaattggctattaatctgattgaggatccttgtacatgactagacacttctctcttgctcatttcaagattcattgcctttagtttttgacagtttgattataatgtgtcttgttgggggttatttgagtttataatacttgaagtttgttcagtctgaatttgtagatttaaatatttcagcagattgcaaaattttggaccattatttcttcaaatattctttctacctcattctgtctctcttctccttctgaaaataccataacacatatgtggttcatttgatggtgtcccaggagtctcttaggctctctttactttccttcctcttttttcctttctaatccttagattttataatctgaattgtcccatcttcaagttcacctatgctctcttgtgcttgctcaaattgtctgctttgcccctttagtgaagttttcatttccattatttgccattttaatgccaaatattctgtttggttcctttgataatttctgtttactaatagtatctttttgttcatatattattttcctgattttctttaattctttgtctatgttttcccttagctctttgagcatatttaatacacttgtttaaagtctttgtctagacttctttagggacagtttctatccacttattttgttttcttaagtgggccatagtttttttctgatttttgttgttattattactattattgaaaacaggagtgttgagttttatacttttgaatatataatgaatgttatatgtggctgaatattgattataataatgtgttaactctggaaataagattctctccaaccccagggttttctgtggtgttttgattgttgaaagctatagtagtctgtttaatgattttcccaaactattttgcaaagactgtatcctttctcatgtgtggtcactgaagtcgctattccttagcttctgttagctactgttttgacagtattttcttgaatgccaggagctaaaaaccaacaaaaccaaaaatctcttcttatgatctttgcaggttggtctgtgccaaggcactttttcaatacttagccatgcttgcaccaagcctagggatcagcctgaggtgaaagttttggtcttctcaggtttacttatgagcatgtgtcttaccctgggcatgttcatggccttctaaattccctcaagtacagaggtgctttttctaaaaatcttttccaatttatttactttttaaattatgtattttttatttttatagatttaggaggtacaagtgcaggtttgctacatggatatattgcataggggtgaagtctgggattttagagtaaccatcacccaaatagtgaacattttacccaataggtaatttctcatcccccatcaccttcccatcctcctaccttgctgagtctccaatgcatattattccactctctgtgttgtgaactttatttagctcccactcataagtgagaagaagcattatttgactttctgaattatttcacttaagataatggcctccagttccatccacattgctgcaaaagacatgattttattcctttttatggctgagtagtattccatggtgtgtatgatatatattatttatttatacatataatataaaataatatatatacacaaacacaccacattttctttatccaatcatttgttgatgggcacttggtttggttctattttttttcttttttgttcatgctgtccctgggtgggctcgaaggttggttctatattgacatagtttggatgtttgtttcctccaaatctcatgttaaaatgtgctccccagtgtttgaggtggggccagtaggaggtgtttggatcataggggtggattcctcatgaatggcttggtgccatctttgcagtaatgagtgaattcttgctccatttggtttgtgcaaaagctggactaatgtttaagagcctaacatctctcttacttcctcttgcatcatatgacatgcctgcttccctttcaccttcttccctgattgtaagcttcctgaggtcctcaccagaggcagatgctggcactatacttcttgtacagtctgcagaactgtgagccaaaataaacctcttttccttataatttccccagcctcagttatcctttatagctatgcaaaacagactaatagccgtatttttgttattgcaaatagtgctgcaataaacatgtgagtgcaggtattttttgtacagtgacttattttcctttggataaatacccagtggtgggactgctggattgaatggtagctctatttttagttctttgagagatctctatatagttttcaatagaggttgtactaattttcttttttttcttcaacttttaagttcaggggtacatatgcaagaggtgcagttttgttatgtaggtaaacatgtgccatggtggtttgctgcacaaattatcccatcacctaggtattaagcccagcatccattagctgttcttcctaatgctttccctccctctatccccccaaacaggccccagtgtgtgttgtttccccactccctgtgtccatgtgttctcataattcagctcccacttatgagtgagaacatgtgatgtttgcttttctgttcctgcgttagtttgctgaggataatggcttccaactccatccatgaccctgaaaaggacatgatctcattttttcatggctgcatagtattccatggtatacatgtaccacatttttttatccagtctatcattgatgggtatctagcttgattccatgtctttgctattgtgaatagtgctgcaatggacgtttgcatgcatatatctttataataggatgatttatattactttgggaatatacccagtaatgagattgctgggtcagatagtatttctgcctctgggtttttgaggactcgccacactgtcttctgcaatggttgaactaatttacactcccaccaacaatgtaaaaaatgttcctttgttcttacaacctcaccagcatctgttgtttcttgactttttagtaatagccattctgactgacatgagatggtatctcattgtggttttgacttgcatttctctaatgatcagtgatgttgagctttttttcatgtttgttggctgtatgtatgtcttcttttgagaagtgtctgttcatgacctttgctactttttaatggggctgtttgttttttttcttgtaaatttgcttaagttccttgtagactctggatattagacctttgtcagatggatagattgcaaaatttttctcccattctgtaggttgtctgttcactctgatgatagtttattttgctgtgcagaagctctttagtttaattagatcccatttgtcaatttttgcttttgttgcaattgcttttggcatttttgtcatgaaacctttgcctgtgcctatgtcctgaatggtattgcctagattttcttctaggttttttatttttttgttttttgagagagtctcagtctgtcaccaggctgggctggagtgcagtagagtgatttcagctcactgcaacctccaactccctggttcaagcaattgtcctgcctcagcctctggagtagctgggattacaggcacatgccaccacgcccagctagtttttgtatttttagtagaggcagggtttcaccatgttggctgggatggtctcgatctcctgatcttgtgatctgcccgcctcagcctcccaaagtgctgtgattacaggcgtaagccaccgcgtctggcctctaggttttttaaagttgtgggttttacatttaagcctttaatccatcttgagttaatttttgtatgtggtgtaaggaaggggtctaatttcatctttctgcatatggctagctaattctcccagcaccatttattaaatagagaatccttttcccattgcttgtttttgccgggtttgttgaagatcagatgattgtaggtgtgcagtcttatttctgagttttctatcctgttctattggtctatgtgtctgttcttgtaccagtaccatgctgttttggttactgtagccttatagtatcatttgaaattgggtagcatggtgcctccaacttcgttctttttgcttaggattgtcttggctattcaggcttttttttgtgtgccatatgaattttaaaatagttttcttctaattctgtggagaatgtcaatggtagtttaatgggaatagtattgaatctataaattactttaggcaatatggtcattttcacaatattgattcttcctgtctgtgagcatggaatgtttctccgtttgtttgtgtcccctctgatttctttgagcagtggtttgtagttctttttgaagaggtccttcacttcccttgttagctgtattcctaggtattttattctttctgtagcaattatgaatgggaattcattcatgatttggctctctgcttgcctgttgtcagtgtataggaatgctagcaagttttgcatattgattttatatcatgagactttgctgaagttgcttaccagcttaagaagcttttgggctgagatgatggggttttctagatacaggatcgtgtcatctgcaaagataatttgactacttctcttcctatttgaacaccgttgatttctttctcttgcctaattgccctggacagaacgtccaatattacgtttaatagaagtggtgaggccaagtgcggtggctaacgcctgtaatcccaacactttgggaggttgaggcgggtggatcacctgaggttaggagttcgagagcagcctggcccaacacggtgaaaccccatctctactgaaaatataaaaaagtagctgtgcatggtggcatacatctgtagtcccagctactcgggatgctaaggcaggagaatcacttgaacccgggaggcagaggttgcagtgagccgagatagtgccactgcactctagcctgagtgacagagtgaacctccatctcaagaaaaaaaaaaaagtggtgagagagggcattctcttgtgacggttttcaagggcaatgactgcctccagcttttgcccattcagtatgatattggctgtgggtttgtcatatatggctcttattttgaggtctgttccttcaacacctagtttagagtttttaacatgaaagaatgtttaattttaccaaaggccttttctgcatttattgagataatcatatggtttttgtcattggttctgcttatgtgatggattacgtttattgacttgcgtatgtcgaatcacccttgcatcccagggatgaagccaacttgattgtagtggataagctttttgatgtgctgctggattcggtttgccagtatattgttgaggatttttgcattgatgttcatcaagtatattgacctgaagttttgttgtggtcattgtagtatctctgccaggttttggtatcaggatgatgctggcctcatagaacaaattaggaagaagttcctcctttcaattttttgtaatggtttcagtagaaatggaactggctcttctttgtacctctggtagaattcaactgcaaatccatcaggtcctgggctttttttggtcggtaggctatttattactgcttcaatttcagaacttgttattggtctgttcagggtttcaatttcttcttggttcagtcttgggagggtgtatgtgttcaggaatttattttctagtttcttttctagatttttttagtttatctgcatagaagtgtttatagtgttctctgatggttgtttgtatttctgtggggtcagtggcaatatccctcttatcatttctgattgtgtttatttgattcttctctcttttcttctttattagtctagctagtgatctatcttattaattttttttttttttagaaaaccagcttctgaattcattgattttttgaagggttttccatgtctctctctcattcagttcagctctgatcttggttatttcttgtcttctgctagctttggggttttttgctcttggttctctagttcttttagttgaggtgttaggttgttaacttcagatctttctagctttttgatgtgggcatttagtgctataaatttctctgttaccactgctttagctgtatcccagagattctgatatgttatctctttgttctcattagtttgaaagaacttcttgatttctgccttaatttcattatttacctaaaatcattcaagagcaggttgttcaatttccatgtagttgtgtggttttgagtgagtttcttaatcttgagatctaatttgattccactgtggtctaagggactgtttattatgttttcagttcttctgcattcgctaaggagtgttttacttttgctatatgatcaattctagagtaagtgccatgtggtgatgagaagaatgtatattctgttgttttggagtggagagttctgtaagtatctattaggtccacttgatccagatctgagttcagatcctgaatatctttgttaattttctgtctcaatgatctgttaatattatcagtggagtgttaaagtatcccactattactgtgtgggagtctaagtctctttgtaggtctctaataacttgcgttatgaatctgggtgctcctgtattgggtgcatatatatttaggatagttagcttttcttgttgaaccctttactattacttgggtccagggagccaagcagcatcattctgtgagcctcacctccatggcaccccacaagttaagactactggcttggaattccagcctgccagtcgcgataggctggaatctgcttaagaaggaccaattccccagggagaggagcagtgccatctctgcagttgagtcaactcagctgttccagcctgccggctctggagagtccagacaatctggatgaagaagggtcctcaacaaaggagcacagctgcactaccaagaagcagccaggctgcttctgtaagtgggtccctgattctgttccttctcacaagggaccaccccccagggttatgtagggacaggtttcccaccttgctgggaatcctggggccagagtatacaaaactcctgggtctccgtgtgtgcctgagtggctactctgtcaggactccacacagctctgtgtagagagacccaaggacctggtgatactggcttatgagaggatcacctgatctgctggttgcaatgattcatgggagaagtgtggtttcccagggtggaatcacacaatcacttcaccacttcccttgacttgagggcagggattcctttgggtccatgtggctcctgggcaggccatcaccccaccctgcctttcttcattctctatgggtggacctgtttgcctagtcagtcccagcgcgagaacctggatatttcagttgaaaatgctgaattcacttaccactttcattcctctctgtgagtgccacagaccgcagctgcttccaattggccattttagtcttgtactaattttcatttccaccagcagtgtataagccttcccttttctcttcatcctcaccaatttctgttgttttttgactttttaataataatcattctgactagtgtgagacggtatctcactgtggttttgaatttctctgacgattagtgatattgagcattttttcatatgcttattggtcatttgtatgtcttcttttgaaaaatgtctattcctttgtccaaaaagtgcttttgagcactcccaaagaaattcccactagctcttgctcatgggccttaggcagtatattgtatatacttatacttttattgtacatatgtttactatatacagtatattgtatatagtttatgatttttgaatctattgtgaatgcagttttctcaatttcattttaattgttcattgttagcatattgaagtacacttgatttttattcatttcattctgagaaatgtagtttaaattctttgtaattcactgtgagttttttcatatattatgttgtttgtgagcaaagacagtcttcttactttccagtgtgggtaggctttctctctcttgcctcattacactggctacaacctctaatataatgttcaatacaactgggaatagtggatatccttgccttgttcttcatcttagtgggggaaatgtttcgtctttcaccatcaagaatgatgtgagctgtggggtttttttgtagatatcttttaacagattgaggaagacttctttggttcctagtttgttgagtatctttgttatgaataggagtaagaaatgctttttctacatctatcgatatgttcctgtggctcctgatttttatgttattgatatattatattcaattttggatattaaactcaccttgcattcctgtgattaatccctcttggtcattgtgtataatagtctttctaggttgctggaatcaatttgttaatactttgttaaagatttttgcaactacatttatgagacatattggctgaatttttcttgtgatgtttttgtctggttttggtataagaaaaatattcatgtttatagtattggtattgtttccctcttaaagatttgatagaattcatgagcaaagccacctgggcctgggcttttctttatggaaagatatttttattattagtttgttatatactttatgtatttattattgtcctattacttttactttttcttatacaggtgtattcagattcccatttcttcttgaattagtttaaggtgtctactttttttttttttttttttgagatggagttttgctcttgtcactcaggcaagtgcaatagcgcgatctcagctaactacaacctccgcctctgggttcaagcgattctcctgcctgagtagctgggattacaggcgcccaccaccaagccctgctaatttttattattattattattatttttagtagggacagggtttcaccatgttggccaggctggtctcgaactcgtggcctcaggtgatctgcccacctcggccccccaaagtgctgggattacaggcttgagccaccgtgcccggccttaaggtatctaatttgatagcacacagttgttcataatagtctcatcatttattttaatttctaaaaggatagtagtaatatttcatcttttctgattttggtaattggcatcttctctatttttatcttggtcattataactaaaggtttatcaattttggttgtcttctagaactgatttttggtcactgattttccatattacttttctgttttctatttcattgatttccactctcatttttcttattttcttccttctgattgctttgaatttaattgttctttttctagtttcctaaggtagaagcttagagtggtttgtgacctttcttcttcttctaatataagcatttaaagctataaatttccctctatgcactgttttaaatgcttcccacaaattttggtatactgtgtttttgttttcatttagttgaggatattatctaatttccctcataattttttcttcaaagtttcttaattttaagtatttggtgaattccaaataaaatttcttcccattgttaattttaactttaatgcccttgtgcttagaaaaaaatacttgctataattttacactttttgaacttatggagacatgtactatggcctagcctatggtctgtcctggtaaatgatccatgtgtgtttggaaagaatatgtgtcttgctgtcattggtgtggaaatttttataagtcacaggtcaagttggctgataatgtttttaagtcttctatatccttattggttttctgtcttttaaaagcagttattgggccaggcgcgatggctcacacctgtaatcccaacactccacaaggtcaggagattgagaccaccctggctaacatggtgaaacctcatctctactaaaaatataaaaaattagctgggtgtggtggcatgcacctgtagtcccagctacttgggaggctgagacaggagaatcatttgaagctgggtggcagaggttgcagtgagccaagattacaccactgcactccagtctgagtgacagagcgagactccatctcaaaaaaaagaaagaaagaaaaagaaaaaagcagttatttagagtagagtactaaaatctctatgactgctgaattgtttatttctcctttcaattatgccaggttttgcttcatgtcttttcaggctctgattgggtgcatacatatttataatcatgtctacttggtgtgttgattatcttatcatttaatcaactgtctttctttgtccctagttacatttgttttaaagtctgttttgtctgatattgatctagccatttaggctgtcttacaattactatttgcacggatatcttttttcatcttttcactttcaatctatatatgcctctgaatccaaagtgtatcttttggtagaaagcatatagttgggtcttccttttttatctagtctggaaatctctgccttttggctgaagtatttagtccatcttcacgtttaatgtaattattgattttgtggatttaaatttgccattttgctaaatgttttctatatacctatatactctctttcctctattcatttttccatgccttcttttatgttaacaaagtgccttttggtatgccattttcattcttcccttgattttttagactatatttcaaaagatgttttctaaacagtggttgtagggcttgctttgtttatcacaatccagtcagattaatactgacttaattctggtgaaatataacaatggttaaataccgaaagccttccctccaagatcaggaacaaaattaagatgcctgctttcaccactggtattccatattataccagaagctctagacagacaaattaggtgagaaaaataaacaaaagaaattcactttggaaatgcagaagtaaaactatctctacttgcagatgacatgatcctatatatatagaaaatcccaatgaatcctaaaaacaaatacacagtaacaacaaaatcaaactacggataatttttaaaatccagccaagtggcaggatgcaaaatcaacacacacaaaaaaagttgtgcttctatacaacctcaatgaacaattcaaaaaggaaattaagaaaattgttccatctgcaatagcacccaaaccaaaatatacctataataatgtatccaaggagatgaaaactacaaaactacattgaaaactatagaatgttacagaaagaaatttttgaaaacctaaataaatgcaaagacagctgatgttcatggattgggagacttaatattgttacgatgacaatattacccaaagtgatctacaaacacagtccttatcaagataccaatgcccctttttgcagaaataagaaagctaatcttcaaatttatatgtaattagaagaggccacaaatagctaaaacaatcttaaaaaagaacaacatggccgagtgcagtagctcacacctgtaatcccagcactttgggaggccgaggtgggcagatcacctgaggtcaggagtttgaaaccagcctggccaacatggtgaaaccccatctctactaaaaatacaaaattagccgggcgtggtcatgggtgcctgtaatcccagctacttgggaggttgaggcgggagaatcacttgaaccaaggaggcagaggttgcagtgagccaagatcgtggcactgcactctagcctgggcaacaagagcgagactccatctcaaaaaaaaaaagcaacgttgaaggactcatacttcctgatttcaaaatataccatgaagctgcaatagtcaaaatcgtgggttatggcataaggagagatatatagaccaatggaatggaattgagagttcagaatcactggcccattcattttcaatgaaggtgccaagtccattccatggggaaggaacagtctgttcaacaaattgtactagacattcacatacaaaagaatgaagttggacccttacttcataccatatacaaaatttaccacggaaattattgaagactaagtatatcaactcgaagtataaaattttagaataaaactgttgttggttgaattatgtcccccaaaagatatgttgaagttgacacccccagtagtcataaatgggacattttagaaataggctatttgcagatgtaatcaagttaagatgaggatgttagggtggggccttgtccaatatgactgaaggacatataggaaggggagaagggacacagacatggagtgtgcatgtgatgacagaggcagagactggagccatgcacctgccagccacagaaagccaaggatttctggcaaccacaagaagctaggaagaggaaaagaaggatcctccctgagacccctgagagggagcctggcccttctgacaccttaacgtcagacttcaggtgtgcagagctgtgagagaaaaactttttgtcgtttgaaactgcccagtttggggtactttgtgacagcagccctaggaaacaaatacagaaacataggtcaagaaatcacaaccttggacttggcaatgggttcttagatacaacaaaaacatgagcatcaaaataaattggccaggtgtagtggctcgtgtgtataatcccaacagtttgggaggccaaggcgggcagattacttgagcctaggagttcgagaccagccagggcaacatggtgaaactcagtctctacaaaaaatacaaaaattagccgggcgtggtggtgtgcacctgtaatcccaggtactcaggtggctgaggcaggaggatcgtttgaacccgggaggcagaggttgcagtgagccgagattgcaccactgcactccagcctgggcaacagagcaagactctgtttcaaaaaaaaaaaattagctgggcgtggtggcgagtgcctgtagtgccagctactggggaggctgtggtgggaggattacctgagctcagcgggtcgaggctgcagtgagccaagattgcaccactgcactccagcctaggtaggtaacagacctaaattgtctcaaaaaaaattgataaattgggcttcattgaaattaaaaacttttgtatatcaaagacaataccaagaaagtgataagaatggaagaaaatattttcaaattatgaattgataaaagcctagtatccagaatatataaagaactcctacaactcaacaaaaagcaagcaacccaatttaaaaatgggcagaagacttgaactgacatttctccaaagataacatgtaaatggtccacaagcacatgcaaggatgctccacgtcattagtcattaggaaacacaagacagaaccccagcatccattcatccctcgccaaaatggctgtaatcaaacaaatggaaaataggtactggcaagggcgtggagaaagcagagccctcgttcattgctggtgggaatttaaaatgacatactccctgcagaaacagtttagaagttcctcaaaaagttaaacaggccaagtgcactgctcatctttaatcccggcacttcgggaggccaaggcaggaggattgcttgagcccaggagtttgagatcagcctgggcaacatagcaagaccccaactctaaaaaacaatgttaaacatagaattaccctatggcccaattaccacacataacaactccactcctaggtatgtactcaagggattgaaagctagtgttcaaacaagtacatgtacatgtgtgttcatagcagcactattcacgtagccaaaaggtggaaacagcccacatgtcccacagtggaaaaatgaaacaaactggggcataaacataggatggaaaagtatttcaaccataaaatggaatacgtgctacaacactgtcgagcctcaaaaacacaatgctaagtgaaaaagccagacactaaaagtcctatattgtgtgattcgatgtataagaaatatctggaacaggcaaatcatacagatggaatacagattggtggctaccaaggacagggtctggggtgacttttggcttgatgaaaatgttttggaattagaaggtgataatgattatatggcattgtgaatgtactaaatgccactgatttgtctgctttaaaatgcttaatttaatgtaacgtaaattttgccttgatttttaaaaagtgctgtccaggtgtggtggctcatgcttgcaatcccagcactttgggagtccgtggcaggacgatagcttaaggccaggagtttgagaaaagcctgggcaacatagcaagactttggttataaaagagagattttgtttgtttgttttttacttttttttttttcgagacaaggtcttgctctgttgcccagactggagtgcagtaatatgaacacagcttattgcagcctcaacctcctaggctccagcgatccttcttcctcagcctcctgagtagctgggaccacaggcatgcaccatcatatccaggtaattttctttattttttgtagagatgggggtctcattttactgcccaggctggcctcaagggatcctcccgcttctcaaagtgctgggattacaggtgtgagccaccacaccaagccaaaaaagtttttaataaaagcttccggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaataaaataaaag

SEQ ID NO: 252 - DNA, 41086 bp, Homo sapiens
gtgcacaccaatatgttaataaggatcagtatttcaaagttactacatcgtcctgctacaaaatatgatgttttgcaatcgctgccttctgttctggccttggatgcaatgggctgcttctctgggataccgacaaatcaaaacatagcacctgaacaggagcatgaagtgagctcaatccttaatggtgtttacttgatagatatcaggaattgcactactgaaaacaacacaaacagcatgctgaaactaacagattcagtgaaaaactatgtaggttaaaaaagcttctacttaaagctcagacaatggatacacacgaggatctgcttaaaaagcagtagatgacacatgaccagctctgctcacagctgtgtcttctgcctgaaagtcagcacaggaggatttattgtgatggcacactagcatctgcagcaggtgctgaggaatgaaaaaaaaaaaaactacataaataaaggttcggaaaattacaaggtggtcatctgaaactagccccacataaagtcccactgcatcaaatggggccatatttaattgggtcactcttcagaacaatatctagcagagaaagccaccatgagctagaagattagatgaactgcagggcagagaacaaaaaatagggcagaaaccttgggttttctgccaagtgtagaaaaaatacattgcagcagactgtgcagaggcatgaccatcttttcattgcttgccaaaaatctaagtatggtttttaaaaattacaatggaaatagaagcaaatgttaaggaacaagaaccactatattttgaaaagataggtgagaagtgatgactaatcagtcaaaaaatatttgaatccctactatgtgcccattaattcactcagtacatatctgcttaatatcattaactgccagcagagaaaataaaagtgaaaaatctgtgctttccagagtttacagctaactggagagtcaagtcaaaccaatgtgaaagacttgagtagcagtgcaaggcagtattatactctgattattgccaaaatgatgcagacaataaatgtagataatatacgcaatgatgtagacaataattgcaaaattcagatgaaaaatatgtgagctgagctggaatttggaagaagctctcagagggtgaggatttatgctggatcttgaagaaagcttgtattctcatcctatgtctgcctttgactggtagaatagaataatttttttttttgagaccgagtcttgctctgtcaccaggctggagtgcagtggcacaatctcagctcactgcaacctctgcctcctgggttcaagcgattctcctgcttcaggctcctgagtagctgggactacaggcgcgcaccaccatgcccagctaatttttgtatttttagtagagacagggtttcaccatgttggccaggatggtctcgatatcttgacctcctgatccacctgcctcagcctcccaaagtgctgggattacaggcgtgagccaccacgcctggccaaatagaataattttaaatcgcaatacttctctggatttttatcttcatctattaaataggagttttagactaggtaatctctaaattcccttcctgttctaaaattccataattcaaggatataaagaaaaaaagaatgaaatgaataagagagtattttaaaaatgttttaggctgggcacgatggctcacgcctgtaaatcccaatgctttgggaggccgaggcgggaggactgcttgagcccaggagtttgagaccagcctgggcaacacagaaagacaccgtctctacaaaaaatttaaaaattagccaggtgtggttgtgtgtgtctgtagtccccacctacttgggaggctgaagcaggagtattgcttgagccagggaggtcgaggttgccgtgagccatgattgtgtcactgatctccagcctgggtgacagagtgagacactgtctcaaaaaaaaagtttcagataaatggaaaagaaagaagtgagcaggcattggagaaggggaaaaaaaagcctaatggtgtggtgtcaaaacaaaatcacagcctacctcatactatcttataatgtggtcctgcagaaaaacatctaccagctgggtgtggtggctcacgcctgtaattccaaaactttgggaggccaaggcgggtggatcacgatgttgggagatcaagaccatcatggccaacatggtgaaaccccgtctctactaaaaatacaaaaaattagttgggcatggtggtgcgcatctgtagtcccagctactcaggaggctaaggcaggagaattgcttgaacccaggaggcagaggttgcagtgagccgagattgtgccactgcactccagcctgggcaacagagcaagactccatctcaaaaaaaaaaaatctaccaaaagtctactgtagagtcagcaaaataaactgctacaatagaaaactagaggacatcatgcaggcacagtaagatagtggtcacttccatcacttgggagcagcagggcatgggagctgttgaaaaatgttctcaaggaggaaactgaatacagtgttcccctggttgggcactggtaaaggaggaagagactggaagcttcaggaggacctttctatttctgctgtatcctccgcacttcctctcacctacaacactatagattgtcacatggcaggcacacagtaaatatttgagtaattaattaatttgttaattacttaatgcatgcaccatgatataaatccttgaacaaagtaggcttccaataacaatgccatgatgatgaattttttaaaatttcactgaaaagtattactcagctggacacagtggctcacatctgtaatcccagccctttggtaggctgagacaggaggattgcttacggccaggagttcaagaccagcttgggcaatatagtgagatcctgtctttacaaaaaaatatttttttaaattagcttgggaggctgaggcaggaggatcgcttgagcctaagagttcgaggctgaagtgagctatgactgcaccactgcagtacagcctgagtgacagagtgagaccctgtttcaaaaaaagccaacaaaaaattactgttacaacttcaaattatattaatagtatagttttgattgtgtacctatgtgagaaatttgtatcatttttattaagaatgaattcttgaataactgacagtgaaagaacaaagttagagaagcattccaaagggccagagacataatatatcctgggaaacaggattatcctagagctagggcataagtgatatgaagaaaaaataaggctatggaggctggtagaggtggggttatagtcttataaaaaatgttgtcctggccgggcgcagtggctcacgcctgtaatcgcagcactttgcaggctgaggcgggcggatcacgaggtcaggagatcgagaccatcctggctaacatggtgaaaccctgtctctactaaaaataccaaaaattagctgggcgtggtggcgggcgcctgtagtcccagctactcggaaggctgaggcaggagaatggggtgaacccaggaggaggggcttgcagtgagccgagattgcaccactgcactccagcctgggcaacagagcgagactctgtctccaaaaaaaaaaaaaaaaaaaaaaagtggtcctataggcccgagggcccaagattaccaacttttttttttttttttttgagacagagagtcgctcttgttgcccaggctggagtgcagtgatgcgatctcagctcatggcaacctccacctcccaggttcaagcgattctcctgccttagcctcccaagtagctgggattacaggcatgcaccaccatgcctggctaattttttttttttcttttccgagacagagtctcgctctgtcgcccaggctggagtgcagtggcgcaagctcggctcactacaagctctgcctcccgggttcacgccattctcctgcctcagcctcccgagtagctgggactacaggcgcccgccaccatgcccggttaattttttaaaaaatatttttagtagagaccgtgtttcaccgtgttagtcaggatggtcttgatctcctgatctcgtgatcctcccgcctcggcctcccaaagtgttgggattacaggcaggagccaccgcgcccagccgctaattttgtattttagtagagatggggtttctccatattgttaaggttggtctcgaactcctgacctcaggtgatccacccaccttgacctcccaaggtgctgggattacaggcgcgagtcaccgtacccggcctctaaccttttatttttttagagatgagtctcactatgttgcccaggctggagtgcagtggctaatcacagtgaagatcatagagcactgcagtgttcaactcctaggctctggccatccttctgcctcaggctcccaagtagctgggactataggcagtgacaatgctctgggcttaatcttttgattctacagactttttttttctttttttgagacggagtctcgctctgtctccaggccagagtgcagtggcgtgatctcagctcactgcaacctccgcctcctgggttcaagctattctcctgcctcagcctcctgagtagctgggactacaggtacatgctaccacgcccagctaattttgtattttgagtagagatggggtttcacagtgttaaccaggagggtcttgatctcttgaccttgtgatctacctgcctcggcctcccaaagtgctgggattacaggtgtgagccaccgcgcccagctcaaacttcttttttaatgtcaaaaactgtacagattaccatgtgatagtaattataagtttagtacatattgattttttttttttttgagacgaagtttgctcttgttgcccaggctggagcgcaatggcgcgatctcagcttactgtaacctctgcctctcaggttcaagcaattctcctgcctcagcctcctgagtagctgggattacaggtgcctgccaccacacccggctaaattttgtatttttagtagagacggggtttcaccatgttgaccaggctcgtcttgaacgcctgacctcaggtggtccacctgcctcaggcctcccaaagtgctgggattacaggcgtgagccatcgcgcccggccagtatctactgattttaaaaatacacaatgaaaaaggttaaagtggattcactagtaattttacttagtttttttttagagacagggtcttgctctgtctcttatgttaaagtgcagtggcttgatcacggcccactgcagcctcaaactcctgggctcaagggatcctcccaactcagcctcccaagtaactgggagtacaggcatacaccatcacactctgctaatttttaaattgttttgtagagatggggtcttgctatgttgcttagactggtctccaactccctgccttaagtgatcctcccacctcggcttcccaaagtgttgggattacaggcatgagccacttcgccctgctatttcttttgagacaggatcttgccctgttacccaagctggagtgcagtagtgtggtcaaggttcactgcagccttgaactcctggactcaagagatccaccaacctcagcctcccaagtagctgggactacaggcatgtgctaccatacctggctaatttttaaaatttgttggtagagatggggtcttgctatgttgcccagaccagtcttgaactcctggcctcaagtgatcctcctgccttggtgctccaaagtgctgctatcacatgcatgagccaccataaccagctcaattttaagtaaaattttattcaacacaatttcaaactcttttttaaagtaatgagattttgtagacattaatttttctgtacatggacaaaagttagtgaaaatatagtgaacatttatgacctcctacaaactgagaaccactgctgtaatagtagccagagtagcaacatttagtgaatacttgataagtgccagttctaaacactgtgcacttattaattaataaaacaaccatgtgagataggctttattattatcctcatagatttcagagttgttttttggttttggtttgtctctttgtacctttcttctcttttcctttactaaagatctgaattttcaactggggacactgctgctctgctgtagcactgtatttccttgcctccttaatgtctacgatgactctgtgactaaatgaaaaatgagtagaaatgtgtatttggagaagtcttcttaaaaattgggggagggtgtacccttcctcttttttttttttttttttttttgagacagtctcgctctgtcaccaggctggagtgcagtggctcgatcttggctcactgcaacctctgcctcctgggttcaagagattctcctgcctcagtcttctgagtagctgggactataggcgtgtgccaccacacccagccaatttttgtatttttagtacagacagggtttcaccatgctggccaggatggtctccatctcttgaccttgtgatccgcccgcctcagcctcccaaagtgctggaattacaggcgtgagccactgtgcctggcccttttttgttttttgagacagtatcttgctctgtggcccaggctgggcagtccttctccctcagtctcccaaacagcttgaactacaggtgtgtaccaccacccctgctttttaaatttttttgtagagacaaggtcttactatgttgcccaggctggtctcaaactcctgagctcaagcaatcctcctgcctcagcctcccaaagtgctgggattccaagcatgagacaccatgcctggccctttctgcttcctgcatcaagaatgtcatggctggaagtgaacatgagggcaacactgtagggatgattgagcagtgaactcaaaggagcctgccgtgtcaatcctgaatggccggcttctggatttatgtgtgagagaagaaaatcctatcttgtttatttttatttatttattttcctgttacatggcaccaaacttaatcctaactgatttgccattttggaaacaagaaaactaaggttaagtaccttgcccgatgttacaaaattagtaaaagtgaagagacgactttcagcccatgaattcttactccagagcccaccttactcttacagtatattgcctcatgctacacaactataggaaatggatttgtcatagggaaataacacatgtgttctgttgaccagtattggatggggggctggggtatttcctttatgaagcagccctctttagctgaggcaattctgaaggtggctgactgatcactgagaggtgtctgctgacagcactcccagcagctgggggaatatgtcattcattcctgaagagggatctgggtggcacaccacagcatccattacccatgctggatatcatactcccttcctgtgcctgtggctgaactataaatcgactacagtttgctttatcaataagtccggatatattttcctaatcttttttaaatgcaccaatccaggcattgtttgtttgtttgcttgtttctgagatggagtcttgctctgttgcccaggttggagtgcagtggcactatctcggttcactgaaacctctgccacccaggttcaagcgattctcctgcctcagcctcccgagtagctgggataacaggcgcctgtcaccatgcccagctgattttcgtatttatagtagagacgggatttcaccatgttggccaggcaggtctcgaactcctgaccttgtgatccactcgcctcagcctcccaaagtgttgggattacaggcgtgagccatcacgcccagcccaggcattgttactaattgattgcagtttggcctttccctttcgttatccaaaacctggttggtgtgggagtataaaggcctgagcccttccaacccaggacaattctgaagggtcaccacagcttcagagttctacgtggagctggccgaagctttcactgaaacttcccagcagcccaacttcaccctctgctcatcctgttttcctctctttctttcccttcccttctgcaggtggtgatctcaagaacactccctaaaaaaacttcctattactaatctccatctcatagtctgttttctggataacccaacccatgacaccatggctttattcacacattaactgttcctaattggaaggaaagtacttaatacatctcaagaaaaagaaaactcagttgtaattaacgttatttattttggtctacccaatacactgtttcatagtaacatactgcccactggccagagaggagtgtcctatgctgggccaatcataaaatttcaccttcctgaacacagtaatgggtacaaggggtgggcacatgaccagccttggacaatcaaaatccttccctgaggatttttgtactgaaatctagaagacaaacctccctttcttctcagatcagagaaatgtcaagatattactctatggatgctggggccatatttgctgcctacaaggaaaaggaccatctgaagtagtgaataaagccaagcagaggggagaaacagaaagagttagaggtcctggaagcatcaaatcccctgtaggtactccagttcctactgctacaccaatagtagtactgtgaactatcctagtatcattctaataatttttttctttttcttttttgagacggagtctcgctgtcactcaggctggagtgcagtggtgcgatattggctcactgcaacctccacctcctgggttcaagcaattctcctgcctcagcctcccgagtagctgggattacaggcgtgtgccaccacacctggctaatttttgtatttttaatagagatggcgtttcaccatgttggccaggctgatctcaagctcctgacctcatgatctgcctgcctcagcctccccaagtgctgggattacaggcatgagccaccacacccggccataatttcttttcttaagctagttttaagttaggtttttttgattagcaatagaagaaatcttgcctacatatctgtgtatttcttatttctatgagctgccatcttctctaacctagtcctaccaaatgtccaaaatattgaggaacaaactataaaataatccacttttctacccaattccagcatgtcaaactttttatgggtcaaaatatactgaagacaatgtacgtgaaattgtgttgtgggcttaagaaagggggtcagaaggattatgttaagagaaatacaagacataatttttgcctttatttatttatttttgagacagagtctcgctttgtcaccaggctggagtgcagtggtgcggtctcggctcactgcaacctccacctcctgggttcaagtgattctcctgcttcagcctcctgagtagctgggaccacaggtgcatgcccccatgcctagctaatttttgtatttttagtaaatatggggtttcactatgttggccaggatggtctcaatctcttgacctcatgatccgcccacctcggcctcccaaagtgctgggattacaggcgtgagccactgcgcccagccgatttttgcctttaaagatgacttcatccaaacacaaaattcctacacctgctaccctataacagatgcttatccccaaactaaatctatataattatttaattaatgtatttattcttgacacagggtctcactccatcacccaggctggagtgcactggtgcgatcacagctcaccaaacctccacctcccagactcaaatgatcctcccacctcatcctcctgagtagctgggacacctggcctcccaattaaaccttaaaacattatatgttggccgggtgcggcggttcacgcctgtaatcccagcactttgtgaggccgaggtgggtggatcacgaggtcaggagtttgagaccagcctggctagcatggtgagacccccatctctactaaaaaaaaacaaaacaaaaaaatacaaaaaattagccgggcatggtggcatgcgcctgtaatcccagctacttgggaggctgaggcaggaaaactgcttgaacccaggaggcggaggttgcagtgaggtgagatcacgccactgcattccagcctgggtgagagtgagactccatctcccctcaaaaaaaaaaaaagaaaagaaaagaaagaaaaaaaaaacccatgatttgtctatgattggccgggcatggtggttcatgccttaatcccagcactttgggaggcccaggcagcaggattacctgaactcaggagttcagaatcagcctgggcaacatggcaaaaccctgtctgtacaaaaaatacaaaaattagctgcacgtggggcgggcacctgtagtcctagctacttccgggatcgaggccggaggatcacttgagctggggaggtcaagactgcagtgagctgagatccgaaatcgagccactgcactccagcctgggtgacagggcaagaccccatcttttaaaaaacaaaataaaacaaacaaaaaaaccacaagaaacattatttatctatgattacactgcctttacagttacatcatatttatgtctatacttgataacatattctaaaagacaggaatggactttttaaaaataattttttagcagctttagatctacagaaaaattgtgaaaatagtagagttcccatatatcccacaccgtttcccctgcattagtatggtgcatttgtcacaattaatgaatcagtactgatatattattattaactaacatccatactttattcagatttccttagtttttacctaatgtccttttcgtgttccaggatcccatccaggatacatttaatcatcatgtctccttaagcttctcttggccatgaaagattttccaattttccttgtttttgatgaccttgacaagtttgaggaatactggtcaagtattttttagaatgtccttccactgagatttgtcagatgtttttctcatgagtagactagggttatgagtctttgtgaagaagaccacacagagtgctacaatcatcatattgtatcaccaatacatactatcaacaggacatcactgttgatgttaactttgattacctggtttaaggaattgacttttaccttaatttgtttaatgtctaactcagaactacatatgggagggcacttaaacactgtcttaatatctggtttgtattcagtaggaggaacagcttgatgagacaaccatcaaaatggaaaaggccgggcgcggtggctcacgtctgtaatcccagcactttgggaggccgaggcgggcggatcacgaggtcaggagatcgagcccatcctggctaacacggtgaaaccccgtctttactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaaggaaaaaaaaatcctctggggaagagtggaaagaggattggtcatctcggccatttactacataaatgactttcggcaagttacctctgcacctgtaaaatggaataatggtacccaatagttctattaaacatctgttgaggaaatgtatgtgtatgtgttttgtacaatatttatacttttagatttgcctatgtaaaaatgaaaacactcgtgggaacagtaaatcttaagtagttaacataactttatagaataatttttttttctcttcagacggagtctcactctgttgcccaaggtggggtgcaatggcacgatctcggctcactgcaacctctgcctcaccgattcaagtgattctcctgcctcagcctcccgagtagctgaggctacaggggtgagccaccgcgcccggcctagaataattttcgattgctggttgagcagagcaaggccaatatgagttgaggaaagcagagatggaaaggctctttatagttaatgatttctcatttttgctttgcttccttttgccaaagtcggcttgtcatctgagagtggagaggatttgttagatcttatgaagccagagctcacttctgatgtgaaccaagtattaataattttggtggtggttttctgtactgcatctgagagagtaatcattgttctttgaagatgcaataattctacgctactacgggacttagggaaataatttttgaggataggaagcacagaataattaagatgacaagtcttcctgcctcaaaatcatatcactctgattcgaataaaaaataccaaggtttttccttcttgaggttttatactcatggaagttcttcaacctgaggtctgaaaaataaggcaaccccatcctctccttaaacaggttagagccagtacctttttatttctctatgcacggacaaaataattatgcaaaaaaaaaaaagaggcaggttttgtttttttttttgcactactgaaattcacacttaacatataaacaatctgctatatgcagacagcactggtgtttagagttcaatgatctggattcaagcctatttaaaaccagataagagaaagttcccaaacatctatgtgtcttggattcttcatctgtaaaattgcgttgttgagaagataatatgagactaggcgcgcaaaacaatttgttagagctattatttctaacccggaatgtgttcgctggcagtaacagtgcattagttacgattcatcgagggcagcttctggactttctgtttggaagcccagctgaggcaaaagcagcagtgcgtttaaaaattggagctcgccacattctgaaattctttcggttcgtgaaagcagtaacctaggaaacgagactggcaccacccctttcagtcctaaagcttggtttctcccgcttttctccattatgtttagggcatcgctattttacagtctttttgttttttctttccacatcattagcacaaaagagaaattccccttctacagaagcaagtacaaaacctttctagtcgctcctttttggcagcagctcacctactatttttttctattccgcggtcgcagccccagacgtcctcaaagacaaatattttcgcgagggccagtgtagggcaggaactccctaggccttgaatcaagggaatccagtagataacaacagaaaggactccgacccaggtacctgagacatctgagaccgccaaaattaacacaacaccctacgcgacagagaaaactctgggcggggagagagaaagagagcgagcgagcgagagagagagagagcgagagagagagagagagagagagagagagagagagagagagagagaaagagagcgagcgagagagagcgagagagcgagagagcgagagagcgagagagcgagagagagagagagagagagagagagagagagagagagagagagagagagagagagacgagaggaagcaacgttctcgcgacaagaggggtgtcgacggaaactcggaaatggtcccctagacgacccggccccagctagtgggtggggccagggtacatccgcccctttccggtttttttccccgcctcccaaccgtgaggtgttgggtttgggggacgctggcagctgggttctcccggttcccttgggcaggtgcagggtcgggttcaaagcctccggaacgcgttttggcctgatttgaggaggggggcggggagggacctgcggcttgcggccccgcccccttctccggctcgcagccgaccggtaagcccgcctcctccctcggccggccctggggccgtgtccgccgggcaactccagccgaggcctgggcttctgcctgcaggtgtctgcggcgaggcccctagggtacagcccgatttggccccatggtgggtttcggggccaaccggcgggctggccgcctgccctctctcgtgctggtggtgctgctggtggtgatcgtcgtcctcgccttcaactactggagcatctcctcccgccacgtcctgcttcaggaggaggtggccgagctgcagggccaggtccagcgcaccgaagtggcccgcgggcggctggaaaagcgcaattcggacctcttgctgttggtggacacgcacaagaaacagatcgaccagaaggaggccgactacggccgcctcagcagccggctgcaggccagagagggcctcgggaagagatgcgaggatgacaaggtaaggacgacccttttctcttcaaaccccatggtttcttttctccccggggtctggggcgggatgttaatccgctagctgttgtcttatgccttccagtatttcagtcctgaaggctcctttcacccccaacaaccctgtttctgtcagacttttcccagtttatcagtgccacgttctctggtccctgccagaaaaaaatgactgtaaattctggttctcaagagtggactgtgtgcagatgctgcctattctctaagctcagctggtgagttggcagtagtaatcatctggcctgtgtggcccccttaccttcaaagacacacaaatctggcgactgccaggtttggtgtggttattgtctcatttttattccgtgcacactgatcaatattaatttcgttatttaaagaacgaagccgcctctgactcctctacttatggtagtcatcatatattttttaagctgtgtgacttttaaaatctctatagggtgatgtattgaataactaaataatcagctatgactgcctttttgtgatcaaaatgttatgatagatgggccctcgagctatatgtgagacacacttgtgtcttggacatagttgatccatcattatctactcaatttgaattgttaatgaaatcagccaaaagattagaatctgaaaataaattttaagcagtggaatgtcatgtcagtgtcttcattgaaagaaaatagaatgaaattttgtatagctaagttgctattagggttggtgttttatgcagatggaaaactatacaaagttttaaatataaaaagtttaaaattgaactgtaatcatacttgctactaaataatccttgttttcattagctcattggtaactatattaatagtttatgacttagcaacttctgtaggtatagtagagttatgaaaatttctgggcaggatagtagatgcctttctatacacttctttggtaatcttcacatttttgtgtgtaaatgcccattataattacaagttttactttgcatatcaaaatcacttaagggtaagtcattatgaattaaactgtctgtgagcttctaactttcctgttgacagcctctacctggctttcttatttcatgaagattaaggccctcagctaagtgcttccctataaccccctcctcttcaccataacatagacatgctatgatagggtcaaggaatcagtacatttatatgtgcgctgcatgcttaactctaaagactgaaaaactctcgggcagagtaggtagaaatccatgaaagtttggagtattaaagtaaggtcttcctacttggcatggttgagcattacaattcacattcttctctctggtctcaaaggaaagtctcttgttgtaattaatactcttgattccattctttcatccattggactttttgttgttgtcgttgttgttgttgttgttgttttttgagacggagttttgtttttgttgcccaggcaggagtgcaatggcgtgatctcagctcactgcaacctccgcccccccggggttcaagcaattctcctgcttcagcctcctgagtagctgggattacaggcatgcaccaccacgcctggctaattttgtatttttagtagagaaggggtttctcaatgttggtcaggctggtcttgaactaccaacctcaggtgatccgcccgcctcagcctcccaaagtgctgggattacaggtgtgagccaccatgcccagcctctttttttttttttttttttaaagagacagggtctcattgtgttgcccaggctggagtgcagtagctgttacacaggcatgatgcactatagcattgaaatcctgagctcaagtgatcctcctgcttcagcctctgagtagctgggactgcaggtgtgcaccaccttgcccagctctactgaactgtctctttcagtttgtttcactttttaccttcaacagtatgtgggtgtcccctgttctcagtaaaggaaaaaaaatctgtatattcctttctcccaaccaacccatttgttttttcactttcattgctaaagtcaaattattgatggtctacaaatgttccatctacctattttttcataaccatcctaatcttaaaatgtctgccatctttctttcctccccttttttgaaactattctcttgaaggtcacaaatggcagtcttcctagtcaaaaccaaagaatatttttattcttactgtatttgacctcccagtagtttgatcctgttgattgtctctagctatttggaaactattttctttcttgcttctgttatactggactctccagtcttatcttcttcactatattctttgctggatttattttttctttccagtcacctagtaagggactctgttattgagcctttgctctcccataagagcagtattccccaaagtagtgttaaacagaatacccttcttgtaatatttcttaggtggtgaggagaaaaaaatgaaaaccttttttggagggaaatgttagtgtatcctcctcttggaattcataatgcctgctggaatataaaagctctgagaaatccattaataaagaaggctattcaattttgtttaactcagtcttgtttagtttatttgatcacaggttactattttcatggcctacctattatggcacagaataatatagcaaagcccactagtttgggaaatattgccctgggtatcttaactacttttaagtgtttggctaatattttatgcagctggctcacaagactgtatctcttattgaatgtcagttctgtgtgtgtatatgtgtatacatacatatatatatatatatatttttttttttttttagacagagtctcgctcggttaagcaggctggagtacagtggtgtgatctcggctcactgcaagctccgcctcctgggttcacgccattctctgcttcagcctcctgagtagctgggactacaggcgcccacctccatgcccggctaattttttgtatttttagtagagatggggtttcaccatgttagccaagatggtctcgatctcctgacctcgtgatccaccagccttggcctcccaaagtgctgagattacaggcgtgagccaccgcacccggctagttctgtatatttttaaaagttttttctttttttagttttgtagagatagggtgttgctatgttgcccaggctgctttcaaactcctggctccaagtgatcttgccttgggctcacaaagtgctgggattctaggtgtgtgccacagcacttggtgtgccacttctgtattttgagctggctataacaactttcttgggctgcttgtgaatgtctgttcttggggttaatgaggactctctgagctgcttagtagaaagggtagtcttggtctctgtattttaaacttaacagtttttcagggttttttttattgttattgttgtttgtttgttttgagacagggtcttgctctgtcacccaggctggagagcagtggtgcgatcatagtttactacagcctcaaactcctgggctcaagcgatcctcccacctcggcctcccaagtagctgggactataggtgcatgccaccatgatggtctaattttttattttttggtagagatgagggtcttattatcttgtccaggctggtctccagttcctggcctgaagtgatcctcctgccttggccttctaaagtgctgggtgtgagccaccatacttggccacttaacagttttagatctggaaaattattggaaaattagatctggaaaactaaacaagtgatcctcctgccttggccttctaaagtgccaggtgtgagctaccatacctggccacttaacagttttagatctggaaaattattgcaaagatagtacagggagtttttatataccccacacccagtcttccctattattaacatcttaacataagtatgatgcatttgtcacaattaatgaaccagtattgatatcttattatgaaagtccgtactttattcagatttcttcagttttcgcctgctgtccttttttaattccaggatctcatccagagttacgttacatttagacattatgtcttctgaagcttcttttcagcctttccttgttttttagaccttttcttgtttttgataatcttgacaattttaaggattactgattaggtgttttatatagaatgtccctcaattgggaattgtctgagtcttttctcaggattagactggagttgtgggttttcggacaaagaccacagaagtaaagtaccaatctcaacacatcataacatgggtatgtttttcaaaatgatttatcactacttatgttaacctctatcacctggcgtgagatagtgcttgtcaggtttctccactataatgtactcttaaaaaaaatctgtttccatactgtacactttggaagaaagtatgttcaccctcacttaatgagtgggtagttatgtttttcctccttaaggacagagtatcaacataaactatatggaattcttctgcaaaggagatttgtctcttctccctcatttattaacttaataatttacttgtatcggtatggactcatggatatttattttgtactttggcttataatccaatattagtttatttttttgttgctcaaattgttctggctctggctgttggagagctccttcattaactcctgtatccccttcttacttttatagtgccagaaagtacagagaatttccacataccctacacccagtttcattgtgacatacccctttcttactttttggtacttttagatgctctaggcctatctatacgtttcctactccagccctagagtcaaccatttctccaaggaaccttggttccttttattggagaatggcattagaaaccaaggtctgcagctgggcacggtggctcacgcctgtagtcccaacactttgggaggctgaggctagtggatttcttgaggtcaggagttcaagaccaccctgactaacatggtgaaaccccatctctacttaaaaatacaaaaattgggccagacacggtggctcacgcctgtaatcccagcactttgggaggccgaggtgggcagatcacaaggtcaggagttcgagaccagcctggctagcatggtgaaactccgtctctactaaaaatacaaaaaattagtcgggtatggtggtgcgcacctgtagtcccagctacttgggaggctgaggcaggagaattgcttgaacccggcaggcagaggttgcagtgagctgagatcacgccattgcactccagcctggaggacagcgagactccatctcaaaaaaaaaaaaaaaaacaccaccaccacaaaaaaaaacaaaaattaaccgggcatggtggggggcgcctgtaatcccagctacttgggaggagtatcgtttgaactgggaagcagaggttgcagtgagccaagattgtgccactgcactccagcctgggcaacagagtaagactctgtctcacaaaaaaaaaaaaagaaaccaaggtctgcttggcagatatgctcgttgctactataaggttatctttggaaatcaaggaatcctttctccagaggaatcagaaaggtgatatttggtttctttcacattattatgccattctgtcacttccagtctgttacctgggttactaaacacataaattcctttttttttttttttctgagatggagcctcactctgtcacccaggctggagcgcagtggcgcagtctcagctcacttcaacctccacccgccgggctgaagtgattctcctgcctcatcctcctgagtagctgagactacaggtgcatgccaccatgcctggctaatttttgattttttagtagagacagggtttcaccatgttggccaggctggtctttaactcctgacctcaagtgatctgcccaccttggcctcccaaagtgctggattacaggcatgacccaccacatccggccttgaacatggaaattctttaagggagctttaagttgctcctgtcttgtccaaagaagtgagaaacaacccccacttctctgagattccctcaaactttctgattttttaaacttccctctaaagggtttcagcctggaggggtgtattagtttgctagggctgccataacaaaatgccacagactaggtggcttaaacagcagaaatttattttctcacatttttgaaggttggaagtctaagaccaaggtgccagcagggttgtttttctctgaacttctctccttggcttgcagatggcaaccttcttgctgctttattgtgacatgatagtccctctgtatgcacacatccttggtgtcttttcctcttcttaaaaggatacgagtcatattggattagacccactgtaacttaagcactttaaagaccttgtctccaaatacagttacattctgagatcctggaggctgggacttcaacatgtgaatttgggggaaacacagttcatcttagaacaagggagatccaccacacatacacacacacacacacacacacacacacacagacacccttttatttcctcttttatcagaaaagtccttatttctctttcctcagtacagggcatgtctcttaactttgattattattctctctctctttgtcttttaaagagatggggtcttactacattgcccaggctagaatgcagtagctattcataggtgtgatcatagcacaccacagccaggaactcctggtctcaagtgaaggtcctcctgtttaagccttctgagtagctgaaactacaggtgtgcaccactgtgcttggctcctaaacttggattcttgcaaactgtagctcatactaaagctatgtggtccagctgtggcacgtcaagctcttgataaataaaaggagctgttagaatgtagaaaaagtcctcaaaattgtcgttttattacacacatacacacacatacacacacatcagttttgaggtttgaagctgaatagtaaatgaccttttttccctttaacaaccataattttccttgaggcagcctatgcctttagttgaatggggaaaaggtcatatgtcagaaaggaggatgagaagcgtattacaaaaaaatgctttttgggggaaaattttggaatataatagtagtctctcttattcttgagaggtttgagtaaattgattaaaattcttaaaacagtgcctactacattgttattctacagctacttccttatttcttttctgccttttttccaggatgggactctgtctgtgttcctgcccaagatctggtcccagccctagcctacctgcctcaccctttgctcctgaatgtctgactgtttttgttatttgcttgttttcagtttcctggttcatttccagttaggcttagttggctcctcccataggtgtcttagctgactccctagagcttgcctgttcttctgtaatttgagtatcaaccttctacagttctaatatgctgcacatgataattcctgcctttgcctctgcctcaccagccataatctggccaacttttaactgtaatttctacctcaaattattcataaaccaatcaaaactgataactcttccaaacgatatccctttcctaccttcttggttcctataaatgatgcccatgcaactgttatttaagactgaggttagaaatttggtgttgtctttgattccttcagtgtatcatattgagtgcttcaacatgcagaggagttacttgatcgaattaaaaaaaacgtcattctgactgcagaatagagaacttggcagatccctaactagtcccctttccttggtctccatttctttttgtcagttctcctgtgaagccagcctgaacttcctcaaaccttattttcagagtggctgtatgactcactgactacatcaggttagaattctgctgtctcatctttaaggtcttccatagaatggctctagctacctttgtctcccactatctcctgacccaaattgtatttcaggctgattgttttgcttacttttgccttcccacctgcctttctgtgtcatgttaattcctgtttctgtgcctttgttcctgctgtttgactcttagtttcttgcctcttttctgtatatttattataccaatttttttttgtttttttttttttaattgaggcagagtcttgctctgtcgcccaggctggagtgcagtggtgtgatcttggctcactgcaagctccgcctcccgggttcacaccattctcctgcctcagcctcctgagtagctaggactacaggcacccgccaccaggcccagctaaattttttgtattttgagtagagaaggggtttcaccatgttagtcaggatggtctccatcttgatctcctgacctcatgatccacccgccttggcctcccaaagtgttgggattacaggtgtgagccaccgcacctggccttttttttttttttttttgagatggagtcttgctctgttgcccaggctgcagtacagtgacgcaatcttggctcattgcaacctccgcctcccgggtttaagcgactctcctgcctcagcctcctgagtagctgggattacaggcacgcaccaccaggcctggctaaatttttttgtatttttaatagagatggggtttcaccatgttggccaagctggtctcgaactcctgaccttgtgaaccgtccaccttgacctcccaaagtgctgggattacaggcatgagccaccacacctggcctattctaccaatcttttatccagcttctgatccatgtccactatgaagccccctgggacttctgacctggaatatgcttttccttcttttctttttctttttttttttttttgagatggagttttgctcttgtcgcccaggttggagtgcaatggcgcgatctcagcttactgcaacctccgcctcccaggttcaagtgattctctagcctcagcctcccaagtagctgggattataggcacccaccaccatggccggctaatttttttttttttttttgtatttttagtaaagatggggttttaccacattggccaggctggtctcgaactcctaacctcaggtgatccacccacctgggcctcccaaagtgctgggattacaggtgtgagccactgctcccagccatgcttttccttctttatacaccatttacatttattgtttgagcttcattaacttattttgttcattttttactaatagcttattgtttgtgaacttcgttttctcaacgaaattttaagttccttgaggaaggactatgttttaaattttttcctgcgggaaaaattgttcttagtgctgttacaaaatgtacgaggttgatttgtatcccctaaaaggatatattgaagtctaaatcacctgtgaatgttatcttagtttgggaatagggtctttgcagatgtaatcaagttaaaatgaggtcatactggattagggtggcccctattccattataactggtatccttataagaaaaaaaaatagaattagggagaacaccaggtgcatgaatacacagagacacacagacacattgcagagaccgcatggcagataaaggcagagattggagttatgtttccacaaaccaaggaatgcccagggctaccagaagccagaagccaggagcctccccctagaggctccagtgggaacagggctttgccaacaccttgattttggacttctagcctctgaaaccatcctctagcactgtgagacaatacatttctgctttatgctattcagtttgtggcactttgttatatcagcctaggaaacaaatacacaaatgcatacttaaaagttaatttgattttttgactagataattgtttttgttttttttttttgagacagagtctcgctctgtcgcccaggctggagtgcagtggcgcgatctcagctcactgcaacctccacctcccgagttcaagtggttctcctgcttcttccttccgagtagctgggattacaggcacgcaccaccacacccagctaaattttgcatttttgatagagacagtgtttcaccatattggccaggctggtcttgaactcctgacctcaggtgatccgcccgcctcggcctcccaaattgactagataactactcttatataatatatactgtgtggcagtatggttcactggaaagaacaagggtttttggagtcaaacagacttgagtttataattctaccattatgttacctctccttaagcctgtttcttcactcataaaatgaagaggattcatgaagtaaaatatttagaggcctgtcccatacaaagcttgacatttaataatattggttcctttctttcatgggtgcattggtatagctaatcttgaagaaatttggggctaggtgtagtggctcatgcctataatcccagcactttgggtggctgaggcaggaggatcatgtgaggccaggaggttgaggctagcctgggcaacatagcaaaaaaaaaaaaaaaaaaaaaaaaaaagctgggcatggtgacacatgcccatagtcttaattgcttgggaggtttaagctggaggatcacttgagcccaggagtttgaagctgcagggagctatgattgtgccactgtgccctagcctgacaacagagcaagaccctgtctcaaaaaaagaaagaaaaggaaaaaagaaaagaagagaggagaggaggggaggggaggaggaaagagaaggaaggaaggaagggagggaaggaaggagggaaggagagaaagaggaagaaagagggagagggagagggaagaaagaaaagaaaggaagaagggagggaggaaggaaggaagaagtttagtcttgtattattctattgaaacccaagtatattaattcagttgacaaaaatttattaaatatattgggcacttactgtgctatacactaaaatgatctttgaaacaagttttcacttttctttgtctccctttcttatttttgtatttctctgttttttcttactctcctgataaaggactgagtaatctcaggaggttccatgaagatcataaaacaagctgctttttgaaaaatgatgactaggatttagttgtgcagaaaaaaggtaaaaggacattcaaggagctcccttttacttactccatagaggcaaacaaacagttcttatagtgtggcatgtaacatctgtctcctgaagtgacagggagtaccttttgacttatgacctcattaaacaggaggaactagtccttacaatttttggttgaagaccttaaagttccccatgttagcctcttcctcaaaagagagttaaagtttccttgaattcaaagtccaggcttttttctagggacagactgggcatgcagtaatttcagtttctcacagtgcttcaaggctctctttcttgttcttaattaactttatctaattttcttacactgtttctggccaggtagttcctcttttgaacaatgttgccacagagcttttgctcagatgcttttaatgtctgattctttctcttttccaaactacactttttccctgaggatgacttcaaaacttacatccacgaagctttttctatttaatataaaatgatttgctttccttttacaatttcaattttctatatccaatttaagttcaacttaggggaacattttttctcatttgatgattaacaaaggcctctcatagctcactgcagcctcagactcctggcctcaagtgatcctcccgcctcagcatctcaaagtgctgggattacaggcatgagccaccatgcctggctacattttcactcttaaacttgactctctatagcattttatactgatgatctctcctttctctcctttttgaaacttcttccctttagctttaataatacccatttatcttggttatcctatcattttcccactcaatgtttacatatgctgtgcttccatctttaaccccattttaatttctttattgaacaaatatgttcaagtttctattttggatcagttactatgctgcatgcatatcacatagtgaatgagtgaacaagacagatatggtatacattgactatggaacttacccttgagcaggggctatgaggggaagacctaacctattttagaggcttagggatgacattcttgagagttttagttgagtcctaaaaaaaagatcaggatttaatgaggcaaagattgagtgagaggtttgagataagaggctcaggagagatgaaaagagggttccagatgtagaatgttgcatattttattttattgcatattttaaagcacaggatatcagccgggtatggtgccacatgcctataatcccatttactcgggaggttgaggcaggagaattacttgaatccaggaggcagaggttgcagtgagccaagatcatgccaagtgcactccatcctgggctacagagggagaccctctctcaaaaaaaaaaaaaaacttaggagccaaggtcatggcaccactgtactccaggctgggcaacagagtgagatcctatctcaaaaaaaaaagttcaccatgtggaatgagggagctagaatgagtgtgataatatttgatgttgcactacaagactggattcagattgtgaaaagatttgtgagtcatgttaagggcaataggaagccattgattgactctcttttttacatttaattttttttttttttttgagatggagtcttactctgttgcccaggctggagtgcagtgtcacgatcttggctcactgcaacctctgtctcatgggttcaagcgattctcctgcctcagcctcccaagtagctgggactacatgcacatgccaccacacccagctaatttttgtatttttagtaaagacagggttttgccatgttgacgaggctggtctcaaactcctggcctcaagtgatctgttcacctcggcctcccaaagtgctgggattataggcatgagccaccacgcctagtggttctagtttttttcttgtcttccaatgatatattgtgaattttctttctttcctattttttttgagatggggtctcactctgttgcccaggctatagtgcagtgtcaccatctcagctcactgcaacctccacctcctagattcaatcgagcttcctgcctcagcctcccaggtagctgggactacaggtgcacagtaccacacccagctaatttttattttttttgtagagatggggtttcattgtgttgcccaggctggtcttgaactccaggacttaagtgatctgccggccttggcctcccaaagtgttgggattacaagcatgagccaccatatccagcctgtgaatttcttgactataaaaatatagtctaggctgggcgcagtggcttacacctgtaatcccagcgctttaggaagctgaggtgggcgtatcacgaggtccagaggtcaacaccatcctggccaacatggtgaaaccccgtctctactaaaaatacaaaaattagccgggcgtagtggcggacgcctgtagtcccagctacttgggaggctgaggcaggagaatcaattgaacctgggaggcagaggttgcagtgagtggagatcgcgccactgcactctagcctgggcgacagagcaatactccatctcaataaataaataaataaataaataaataaataaataaatagtctaaatctagtataaatctaacacttaatatttcatactattccctatgtctggactcagtaaatatttgatgattgatttagcaatttgtattgcttcttgaaccaacgggtgcataaatatgtactagggctaccacagatattatccacatatctgattgcactaccttttctggaagacataactaaaatattcagatgtaaaactactgcttgtcaactcatctttctagtatacatagaatatatcttttatttgaaacgtgttatagtagatctagaataatattttattcatttagaaactcaaaaatatttttctgattcaatttagtgtttaagtgaagagaacaaaaccttgggattagcttcatggggatataatgaaaaaaagtttgagttataagcatagcttggatttttgtttgttttttttggtgacagggtctcattctgtcacccaggctaaactgcagtggcatgatcatggctcactgcagccttgaccttctggactcaagcaatcctcctgcctcagcatctggagcagctaggactacaaacttgtgccatcacacctggctaattttttttttttttttttttttgagacagagtctcgccctgtcaccaggctggagtgcagtggtgtgatctcagctcaacgcaacttccacctcccaggttcaagcaattctcgtgccttagcctcctgagtagctgggattacagacatgcaccaccaggcctggctgatttttgtatttcagtagagacagggttttgttggccaagtaggtctcaaactcctgaccttaagtgatccgcctgactcggccttccaaagtgctaggattacaggtgtgaaccacggtgcctggccacacctggctaattttaaaattttgtagagatgtggtcttgctatgttccccagggctggtcttgaactcctggcctcaagtaatcctcccacctcaacctcccaaagtcctgggattacaggcataaaccaccatgcctggcctattcaagttttatcatgagattgcagtaattcagtcacgtcttcaggctccacttctttttttttttttttttttttttttttttgagacagagtttcactcttgtgtcaaggctggagtgcaatggcatgatctcggctcactgcagcctccgcctcacaggttcaagcaattctcttgtctcagcctcctgagtagctgggattacaggcgcccaccaccacacctggctaatttttgtacttttagtagagacagggtttcaccaggttggccaggctggtctcaaactcctgacctcaagtgatctgccctcctcagcctcccaaagtgctgggactacaggcataagccatcgctcccagccctccaggctctacttctatttctagttctctctctttctctcttactcagtcacttaggctgaatgcagtggtgcaatcacagctcactgtagcctcaacctcctggggtcaagcaattctcccacctcagcctcctgagtagctgggccacaggcctgagccatcactcctggctaatttttaaaaaatggtttgtagaccagggtcttgctatgttgcccaggctggtttcaaactcccatactcaagtgatcctcctgccctggcttcccaaagtactgggattacaggcataagccaccgtgcctagcctaattctaggtctcttgctatttgtaccacatctgcagttacttcctccactgaagtcttgaatcccctcaaaatcattcatgagagttggaatcaacttattccaaactcatgttcctgttaatattttagccttcttctatgaatcacaaatgttcttttttttgaggcacagtctctgttgcccaggctggagtacagtggcacaattcatggctcactgcagccttgacctccctggactcaggtgatcctcctatctcagccttccgagtagctgggactacaggcacatgccaccatacctggctaattttgtattttttgtagaggtggagttttgccatgttatccaggctggtctcaaaatcctaggcccaagcaatttgcctgccttggcctcccaaagtgatggaattaatggccactgtgcccagccacaaattattataattttttttttgagacagagtcttgatctgtcacttaggctggagtgcagtggtgcgatctcggctcactacaacctctaccccctgagctcaagtgatcctcccacttcagcctccgagtagctgggaccacaggtatgggcctctacacctggctaatttttctatttttagtagagacagggtctccccatgttgcccaggcccgtcttgaactcctgagcccaagtgtccacccgcctctgtctctcaaagtgctgagattatagacgtgagccactgcacccagcctctacaaatgttcttaatggcatctagattggtgaattctttctagaagactttcaatttattttgcccagatccatcagaggaattacatcatggtaggtatagccttatgaaaggtatttgttaaataataagatttgaaagtagaaattactccttgctccatgggttgctgttagcagacatgaaaagattaatgtccttgtaaatcttcatcagagatcttgggtgaccagggacattgtcagtgagcactagtattttgaaaggaatcttttttttaagtagtatatctcaacagtgaactgaaaatattcagtaaaccatgctgtaaacagatgtgctatcatacaggctttgttgttccatttatagagcgcagataaaacagatttagcacaattcttaaaagctaggattttaggaatggtaagtgagcgttggcttccacttaaagtcaccagctgtccctaacaggagaatcagcctgtcctttgaagctttgaaaccagatattgacttctctgcagctatgaaagttctagatggcatcttcttccaatagaaggctgtttcatttacatggaaaatgtgttgtttagtgtagccaccttcagtgatcttagctagattttctggataacttgctgcagctttttcatcagcacttgccacttccccttgcacctttatgttatggagattgctttttttttttaaacttcatgaaccaacctctgctggcttccgacttttcttgtacagcttctttacccttcacccttcatagaattgaagagagttaagtccttgctctggattaggctttggtttaagggaatattgtggttagtttgacctatctggaccatggaaactttctccatatcagcaacagtaaggctgttttgccttctcgttattcatgtgttcactaaagtaacactttgaatttccttaaagaatttttcctttgcattcacaatttggctgtttggcacaagaggcctagcttttggcctgtctatgttcttgacgtgcccttttcactaagcttaattatgtttagcttttgatttaaagtgagagacatacaactcttttacttgaacacttagaggtcattgtagtatcgttttgtctcaggaaatagggaagcctgaggagaggaagagagatgggggaatggttattccatggtaactcccgttatcgtctccccaacccttggcaacctctattctactttctgtttctataaagttgtttattctatttacacacacaacatttattgattaaactcactgtcctctatgagtgcagtttgtggtgcccccaattataataatattgaaggtcacagatcacagatcaccatgacagatgtaataaagaaaattttgaaatattttgagaattatcaaaatgtgacatagggacatgaagtgagcacatgttattggaaaaattgtgccaatacatttgctcgatgcagggttataagaaacgcataaagcaaggtacaataagacaaggtatgcctgtatccaagttatactgcttatcatcagggacttgtctcataagctggaaactaacatgatactaattcttttttttttttttttttgagacagagtctggctctgtggcccaggctgaagtgcagtggtacgatctccgctcactgtaagctctgcctcccaggttcacgccattctcctgcctcagcctcccgaatagctgggactacaggagcctaccaccacgcctggctaattttctgtatttttagtagagatggggtttcacagtgttagccaggatggtctctatctcctgacctcgtgatccgcccaccttggcctcccaaagtactgggattacaggcgtgagccaccgtgttcagcccacatgatactaattctcaatgggcagaatgaaataaaaccatttattgatatagtgctttatgattgttcaaagtttattatatgcataagtcatttatttgggaaagttgaataccatgtggtatgtgatagggatagaaagatagtaagattcccgttctttgaagaagtgagggaggcacacatagaaaaataatccataatgcatgattaaatgctatagtaaagctgcttacaaaggggtttgagaatacagaggaataactgattaacttcctcaggaagtcaagagcgaaataattcactgaaaaggtgatctttagtaatttaacaaaatgagaaagggataaggacaggaggaacataaatgaggccaggaaagctggaaagtatgttgtaccttcacagaaggtcaagcagtagaataggagagtgtaatataaggtacatggtattgagaagtaggggaaattatgtctgagttaaagctatttggggccagaataatgatgattattgttattactattttattgtggtaaaacatctataacaaaatttactatttttaccattttaagtgtataatttagtggcattaagtacattcacaatgttgtgtaaccatgattactaccatctatttctagaactttttcacgatcccaaaccaaacaaaacctctacccattaagcagtaattcccattgcccttccctccagcctgtggtaacctctattctagtttctgtgtctatgaatttgtctattctagatacctcatataggaggattatacaatatttgtccttttttatctggcttatttcacctagcataatgttttcaagattcatttatgttgtagcatgtatcagaacttcattcctctttatggctgataatattttattatgtgtatataccatgttttgcttttcattcatctgttgatgaacacttgagttcttcccctctttcagttattgtgagtaatgcctctataaacggtggtgtacaagtatctgtttgagtccctggtttcacttcttttatgtctagcagtggaaatgctgggccatattctatatttaacttttttttttagagacaaggtctctttctgtcacctaggctgggtacagtggcatgactgtggctcactgcagctttgacccacctcaagcgattctcccacctcagactcctgaatagccgggactgcaggtgtgtgcaccaaaagcacaggcaacaaaactaaaaattgacaaatgggattacatcaaattgaaaagctcctgtacagcaaaagaaaactatcaacagagtcaaaaggtacctacagagtaggagaagatatttggaaatcatatatctgataagggttaatatccaaaatatataaggaacttatacaatgtaataacaatgaacaacctgttttaaaaatgggcaaaggactggaatagacatttcttgaaagaagacatacaagtggccaacaggtacagtcatatggaaaaatgttcaacattattaatcatcagggaaatgcaaatcaaaactacagtgagatactatctcacacctgctagaatgattattgtcagaaaggtgaaagataacaaatgttggtgaggatgtggagaaaggggaacccttgaacattgttggtgggaatgtaaatagccatatggaaaacagtatgtagtttcctcagaagttaaaaatagaactatattatgatctggcaatcccacttctgagcatatatttaaaggaaggctaccagggactaggggaaggggcaaatgggatgttggtcaaggggtacatagtttcagttatgcaagatgagtaagttctggagatcaatgtatataagcatatcaaatcatcaaattgtgtaccttaaatatatacaatctttaattgtcaaatatcccttaataaaaaagtaattgagaaaaaagtaaataaaataaaaaaattctatgagattcccaatttattgttttagctaaaaaggctaaaagctaaagacttttttttcttttgtgttgtttttaagccagtcaaatttagcagtgggactttgtagaaatagtaaagaagacattctactcctttacatagtaatagctaatgtttattaagcccttaccatgtgccagccagtgttgttaacactttatctctggcataaactttttgacaatgctatgagtcagataatattttctcattttatagataaaagaactgaaacagagaaggtaaacagtatgtccaaggaaatagagctaacaagtagtgaattcagaattcagactcaggcaatctaattttagaggccccaccccctcaccagcttttggttttttttttgatacggagtttcactctgttgcccaggctggagtgcagtggcatgatcttggctcactgcaacctccgcctcctgggttcaagtgattctcatgcctcagcctcctgagtagctggaactacaggcaaatgccaccatgcctggctaatttttgtattttttgtagagactgggttttgcaatgttggccaagctggtctgaaactcctgacctcaagcgatctgcttgccgtggcctcccaaagtactgggattacgggcgtgagctgctgcacccagccagagccccttcttttaagcactatgctattgggtttctgcatagtcacagtcttaatttactttgtgcagcattaattacatgatgcaagtttaagaattatccagagaagagcaattaaaatcaccaagggatgaaagggtactcacaagagaaccaactaaaaagacttggaaaggctgggaggccaaggcgggaatctctctgagattaggagttcgagaccagcttgggcaacatagtgagagtctctctttctctctctctctctctatatatatatatatgtatatatatatatatatatacacacacacacccacacacacacacacacacacacatacatattcagatagccaggtgtggtgatgcacacctataatcccagctacctgagagattgaggtaggatcccaggagttgggatcaaactcctttgatcccaggaatttgaggctgcagtgagctatgattgtgccactgtactccagcctggatgacagtacaagaccctgtctcaatcaatcaatcagtcaattaaaaaatacataggccaggcacagtggctcacgcctgtaatcccagccctttgggaggccaaggcgggcggatcacgaggtcaggaatttgagaccagcctgaccaacgtggtgaaaccccatatctactaaaaatacaaaaattagctgggcatggtggcacacacctgtaatcccacttattcgggaggctgaggcaggagaatcgcttgaacccgggaggcggaggttgcagtgagccgagattgtgccacttcactccagcctgggcgacagagtgagacttcatttcaaacaacaacaacaacaaaacgaacaagcaaaaaacaaacatacatacatacctggaaaagttcttaaaagaacatatgactaaagaatatggatataaactttccataccaaatcctgcaaggtagttttatacttatacatgttctacttataaatgacccattcttatagattatgccactgccttgatgctacatgtggtatttcttaccttaactgaaaaagagaaaactattttagagcttagtggggaaagtttcttaacaggttttacttccctaaatggttcccctccctaagaggaaaaacatttttccccaaaaatgttggggaaatgcctccaattaaagaggcattccaggcaccataactttaatgtgaattaatggcatagtgcctgtatttttcaaatgaaattcaggacatgatgtctgaaaaagattgcttttctttttttttttattattgtggtaagtgtgtatgtggtaaaaaacacataccttcaaaggagtggggagagacagtccttcgaagggcctgggatgagaactagaaatatttgccaatgttaatgaactatcaaaagtcttgattattaattcattctaacataaacctaatataggattgcttttgtgtgtgtgtgtgtgtgatggagtctctccctgtcacccaggctggagtgcaatggcacgatcttggctcactgcaacctctgcctcccgggttcaagcgattctcctgcctcagcctcccaagtagctgggattacaggtgcccaccaccatgcctggctaatttttgtatttttagtatagatggggtttcaccatgttggccagagagatctcgaactcctgacctcaggtgatccacctgcctcggtctcccaaagtgctgggattacaggtttgagccaccatgccaagtcgttaacataggatttcaaatccttgaaatttaaagtttgtgaacttcaaacttgcatgttcttgggagaatgtaacaagaaagagattaaaaccgctgaataaaccataattgttctccaactttatctggacctctaatctattacctcttcctttctagcagccctatgtattctttactttcctccctatccagctgagattttgtttcaatttagtttcttgccattaccctctcttttacatgccaatttcaagcacagctgcagaaaatcatataaccagatttgcaggaatttatgatcagcaaactcaactgggttttcagtaacacgttacatattatatttctccaggcaacacaccctttccaacagctttcagatctttgccctccttaggcccatttaaactttttttctcctttctcaagcttagtaggtgatcttgtctcctgcttgaccaagaattggactgataaaactttaactaccaaatctgtaggaatacctacatctgtacccatctgtctttcctctttgttaaaataaaagaaggttcatccattctccagggccagcctctctacctgttctctggatccaatgtcttccatcttttcaaagactttgtagaattagtaatccagtcctcctcttatattcaccctctcagtctatgcttgctcctcagcatttaaaaaatagttgtctggcctggcgcggtggctcatgcctataatcccagcactttgggaggccaaagcaggcagatcacttgaggtcaggagttcgagaccagcctggccaacctggtgaaaccccgtctctactaaaaaatacaacaatggctgggtgcggtggctcacgcctgtaatcccagcactttgggaggccgaggcaggcggatcacgaggtcagcagatagagaccatcttggccaacatggtgaaaccccatctctactaaaatacaaaaaattagctgggcgtggtggcgtgctcctgtaatcccagctacttgggaggccgagacaggagaatcatttgaactcaggaggcggaggttgtagtgagctgagatcatgccattgcactccagcctgggcgacggagcaagactccatctcaaaaaaaaaaaaatacaaaaattagcctggtgtggtggtgggcacctgtaatcccagctacttgggaggctgaggcaggagaattgcttgaacccagtaggtggaggctgcagtgagccaaaattgtgccactcactgcactccagcctgggctacagagtgaaactccatatcaaaaataaaaaatatttgtcttacttcccctttccaggaaaatttcttgaaaagacattttatctctgcattttctgctttcatctgcattttctcctcctactcctgataatctcagcatcttttccccagcattctatgttcttggcttcttatctctcagtttacttcttagtctcctttgctgacttcacctgtattcattattaaatgttatagttcatagttttgtgtctgtaatcttctcattctactctcttactacgtcatcatactcacttataaaacttgttacactttatgtgctaatgactccaaatctgtatcctttatccagacttctctcttgtttcttatatattgctgtatctttaggctttacacagtgtctttcacttagcaggtgttcaataaatgtttctttgtgactggctgactgactaaataagtaaactttatagtaattctttgtgattcttcttaacagaccaagatcaaatcctttgtatccctaggtctagcacatagtgggtactcactaagtgctttataaatgactgattgaataaataatgaataagcaccacaataaaataaaatttcttaataagatgaatgagtgaatgaaaaaaaactttgtgctgttcattatagccagtcaagaccaaagaccttgtttattctctttgaaaatgtaactgggggccaggcgcagtggctcatgcctgtaatcccaacactttgggaggtcgaggtgggcagatcacaaggtcaggagattgagaccatcttggctaacacagtgaaaccccgtctctactaaaaatacaaaaaattagccgggtgttgtggcgggcgcctgtagtcccagctacttgggaggctgaggcaggagaatggcatgaacccaggaggcggagcttgcagtgagctgagatcgcgccactgcactgcagcctgggcaacagagcaaaactccgtctcaaaaaaaaaaaaagaaaagaaaagaaaatgtaactgggtaggccgggtgcggtggctcacacctgtaatcccagcattttgggaggccaaggcaggtggatcacctgaggtcaggagttcgagaccatcctggccaacatggtgaaaccccatctctactaaaaatacagaaattagctgggcatggtggtgtatgcctgtaatcccaccaactcagtaggctgaggtgggagaattgcttgaacctgggaggcggaggttgcagtgagccaagatcgcaccactgcattccactctgggcaataagagtgaaactccatctcaaaaaaaaaaaaaaaatgtaactgataactggatataaattatactaaaacttggtttaagaagacagtaattcattaacagataagtaaaagttgcagatgtgattggaatgttgactgcatactctgtgtgaactatgagtagtgagaataaaaaatgttaatcacctaccaggtctagtatatacacagtagtcacagacacagactctggacggggtctatttgagaaagtattcaaaacctcctgtaggtatatgactgaggacacagtttcctcatttgtgaaatggggaaaaataactatgcccactttcatagggaggttgtgagaattaaatgagataatgcttgtaaagcacttagcctaggacctggcacaaaaataatcatttaatacccgcttgttattattaatgctattccattttgatccagctggtataggtgttaaccatgctatagatgaataattgccaaacctggctgcttatcagaatcacgtaagatttttaaaattaaaattcctgggcctttcccagactactgaatcagactggaagtagaatatgtcttttttaaagctccccaggtgattctgagcatcagccaggtttggcagttatgttacagaagatagacttgtctctagaaatcatctgagtatgaaatataatcaagaaaaatatttctggtgtggagaaaaaggagtcaagaatgacatctgtagtaagccaattgtatataacctttggaataaatggtcatagttgtgctgattgcccaagaacagaccgtaatgaaaggaaagcaggcacagctgagccattttcaaggttcccccaaatggaaagagaagcagagcaactgagctgttaagagctgccaaaattaatttagagaagccacgtaggatggggaaacatgaaaagaacttcagaagagagctggtagaaaaataaaaatgaagtttttgatattgcaggaagaaagattaagggaaaataaatgaagtagctggggatgaacaagaagtactatagggaagtatcaggaaaaaagaattcttgctgaggaaaacaaataaagagcataaacaaagaacataaaactcaggagagaggtctcaggaaggacagtaaacacattttaagagattcacagggaaaaggccaaacagagcaaggataattggcctattatagatggactcaaaatcccaaagaaacaagtattacaaaaagagagggataaggtaaagcctaaaggcaatgacggcgataacaaggggaaataaatgaaggcgctcaaaagaaaccttgaagaataattaaaattgtgcaaatatggataaagtataacttaaggtaggagagtgtgtagtacaaagagtatgggacataaaagtctaggggatcattgagcaaacatttattcagtgtttatgggtatcaggaagtttatgtgctgttacctgtgtggaatatatttagaaaaaaa

SEQ ID NO: 253 - DNA, 43095 bp, Homo sapiens
caatgtaagtaaagagttgctggttatactggatacccaacagagcccaaaggaataatccaagcaactcataaaatgaaagacaggaagataagaaataaggaaggagagaaaaagataaaatgagacctgttataaatattatctgaaataacaagaactggaaattgaacaagtaatgggcacagggttcactgagatctccctagagcttcccttcatctggtgcaataacaaaggggaactactcttcattttaacctcagtgtctcagacactgtggcacttggagactttattaaaactcttctgcgccagcaaacacacacagacatttcgttaacatttttcagggtgcactgaagctctatgctaaaccatttatatatatttcaagaactgaatgcatagttgttacttgactccttaagacagaggaagaaatcttggtaagggtttccaatcagcaactttgtgtaatatatacttaagattggaatttgaattaacagaaattgagttaagacctggagaatcggggtggagaataaaatagtacatatcagcagtctaagaagaggtaagataaaaaaaacgggaagatattggggagaaaaatatttgctagacaccttcaatatttcacgcatatgtgactttatttatcccacttgataataatatcatgtagaaattactatgcttatttctagaagaaacttagactctgaacatagtgtaacttatgtaaagtcagaaagccagaaataacagaatcaatactctattccatgtcacagtgccaataatattaaaaattctgtgcttttgcttctttttcctacacaaaatgccttataatgagatagtgagtgatacagagagtgacaaaattccatagaaggcaaagaagaattgcttaatgagcttgaatttgtttatacttagaaagactatgaatgtaccctgttatagaaaaggatacaatatggtgattagctgttggtctttcttcatgcttcatatttcaaatggatttaactgaactcaaatttgattattaagaaacctgaatttataactgagcccaaggcccatataagacatgaggtaaaaagctcacatatagcagtagtaaataatatatttggaactaaataagcagatgtgtgctaaaaaatttgactttacccagagagaggtctgtcctttgctcctggcttctagaaggaaatatacacaatacctaataagagagtctttgtttattagactggggattggtcacactagatctgagggtagggactggccatgtcataaagatcaacaatatgacttagtgtggggactttgggtcatgtgacaccagtaaacctggagacggagttcaaccacatttgcaatcaatccagccatcatacctatataatgaaatcccaataaaaactctgaacaccaaagcttgggagaatttccctagttggcaatatgacttcatgcatattgtcacacattaatgccataagagtaatgcatgtttactccatgaaaggacaacaaattcttcagatttggacacctcagtttcttttctaagcatctctttatttgtctaattttaatctgtgtccttttcctgtaataaactgtaaccatgaacataatagctttcagtgagttctataagtacttctagtgaattattgaagctgagggtggttttggaaaacctctgaaattgcagttaatgacagaagtgagggtagtcttcgggactgtacccttaagttttgaagtttagagagctccaggctaatctaatttgatgtcacatttctttaaactgttagcaaggtcaataggctcttgtaaaagaacttcatatggtggaaaaccttcacagataatcattctcccttaccaatttactttaaattcccactaagggataccttccttctagatacctagaccctagaaaaggtgtggatctgcttcttgactcaattctgttgtattgtgttttttttctaataaaacactgttaaaattatcatcactttataagaagactcagtgtctgatagtgtaaatcctgcagattttttcttctttgaagaagttttggctcttctaaattctcgtatttttcctcataccttacttttctttcttttctttctcctttcactatacctgacagcaaatattgcaaatatagagccagattaatgttacatatctgaatttcaacctagtttcaaattttgaatttcctacctattagctgtaaatgatgggaaattacttaacttagcaaaactttgctgttccataaaatcagataccagtagaacttgtgtcatgaaatttggcgagaactaaatgagataatatatgtaagtagcagtagatgcaaagactgaaaaatagtagatatctaatcaataatagctattattactgtggttcttattatcataaattttattttcatcaactcatagtgtctatatcttgagaaagaagggaataagtacatttatttactctgaactcaaaattttaggagagacatagttcaagcttctacttggcagttcagcttctcacattcatggtgcgggtaaggagtgatactaggattatgtatggaaaatgaaaagaaggagaaaaaaacaaaggcctttacagaaaggtattcttaatatcaatcctttgtttgaggatttgtttatttatttgttttagatctcaattaagtctcgatgaattgcccgacgggaactgaaaagaacttttaaagccatggccgctagcagttggcagaagaatgtcttctcccaatgtcactgaaccccacctctcttccttcctgttggttaggaattccaggattggaagctgcacaacgctggctaggctttcccttctgtgttgtatatctgattgctcttgttggaaatcttatcattctatttgttatctggactgataaaaaccttcaccaacccatgttctactttctggccatgctgtcagtcatgacctgagtctttctacatctactatccccaagatgttgggcatcttctggttcagccttcaggagttgtgctttgggtgctgtgttgctcaagtcttttttatccattttttttgcagtcatggagagcattgtacttcttgtcatgggatttgatcgctatgtggctatttgcaaccccttcaggtagaccaagatcctcaccaacagaattactggtgtgattgctatggttgtggttcttagaagcttatgtatgattgctcccatcatttttctcctcatgaggctgccttactgtggacatagaatcatcccttatacctattgtgagcacatgggagtggctcgtctggcttgtgccagcatcagtgtcaatgtctctcatggtcttgggaatatttttatcttgtttctggatatgtttcttatcatcatctcctatgctagaattttatgcacagtctttcacctcccttcccaagaggcccacctgaaggctcttaatacctgtagctcccatatctgtgtcatcttagcattttttggcccagctctcttctcctttctcactcatcgctttggtcatggcatcccacagtatatccatattctcctggctaatctctatatatagtcattccccctgctcttaacccagtcatttatggagttaggaccaagcaaatccaggagcgggtagaaagtctctttactaaaaattgattgaatgggagagaatttcaggttataaaagtgtaagtcctaaaaagacaaaatttgtgataaaattaataaattgtttttgccaaaatggaccatcaattttatacatatatatattttatacagatgtgtgtgtatatttatttatttatacatatgtatgtatgcgtgtatgtttaaaaacatattggcagcaattgctagatgtatgtgtgtttatgcatgtctgagtgtgtatttgcaataatgttatctattgacccctaacacagaatatgccatataaaagtaagtttcaaggaggatcactttaattcactgaaaatgtcttcatttttctctcagatatgaataatggattgaatgagcattgaattccaagtgcaaaattattttttttggacatgatttttttaacattcacttttgcatttgagatttcggatcccagtcagattatgttccctttaatctatgctcttttctctgtctctctcacttgaacttttattctctttctctcaactctttttctgtgaaatggtttaagattttctttttattttttgtgttcacaatttctaccaaacagtagtacctaagtccctactgggcctctattgaaactgtcaatattaagccttaaataatttttcaaatgtagaaattttctttattattctctccttctttatttttatttcaccttttgaaacttgtatctatgtcagaaataaatacgctcaaaaatacctcgacacagaaatttatacagtattttataataaatacccagtcataaaatagctttatcaggtgagtagttgacacctcattactttaaggaataaagaatattaaactatatatgtgaaattaaattgatgattattaaaacttgtggacatttttttttttttagttactttgatattaactcttcccattgagtttgcatgtattttgtatgctaaattagtaaaaaaaaatcactaggaatgtcatagaattgggtgaaatgattgtggtagtaatattcaaaattgaatttgaccttatctcgcttgaacaatattccacttaggtcattcaggtctttaaaatgaaccttagactaccattttttattttctattgccatttttgaaaaccatgaatgtgttgtttatgtcaattttggccatatgcaggagggttacttaagcccaggatttcaagaccagcctaggcaacttatggagaccctgtttctataaaaaataataataaaattttttaaattatatttttatatactaataaaaaatttataaattaaaatcttgaaaattatatatttttaaatggcatcgatcattaaaaagtcaggaaacaacaggtgctggagaggatgtggagaaataggaacacttttacactgttggtggcactgtaaactagttcaaccattgtggaagtcagtgtggcgattcctcagggatctagaactagaaataccatttgacccagcaatcccattactgggtacatacccaaaggattataaatcatgctgctataaagacacatgcacacgtatgtttattgcggcactattcacaatagcaaagacttggaaccaagccaaatgtccaacaatgatagactggatgaagaaaatgtggcacatatacaccatggaatactatgcagccataaaaatgatgagttcatgtcctttgtagggacatggatgaagctggaaaccatcattctcagcaaactatcgcaaggacaaaaaaaccaaacactgcatgttctcactcataggtgggaattgaacaatgaaaacacatggacacaggaagcggaacgtcacacaccggggcctattgtggggtgggggcagcggggagggatagcattaggagatatacctaatgttaaatgatgagttaatgggtgcagcacacaatcatggcacatttatacatatgtaacaaacctgcacattgtgcacatgtaccctaaaacttaaagtataataaaaataaataaataaaataaataaataaataaataaatggcatcacagaacatcaaatgctttgacctaactctaacaaatgatatgcaaaacttctaaaataaaagcataataatccttcaaaggaactttttaaatacataaatacatgaaaagatatacctagttcatgatttggaataatcaataaccttttaaaaacattctctaaaattgaactatatattcaatgcaataaatattttaatgaatttgtttgcttatttgtcctcttgtttttgttttcaaagtgttataaacattttaaaagaaattggctggaaatcctgaagaacaaaattttaggatttatgttattatattccataatttattttatagtatcacttatgaaaactgtgaaatacttgtacaagaacagacaaaaagcagaaccacacagtccaaacacaaaaatacacatgtataaatgtataatttatgacaaacagctttttaataaatgaagcaagatcaaatgaatagccaaagtaaatcaattatatattgaaaaataattgcctctatgtcactgccctttcaatgtgatagttaatatcctctcatcaaggggttaatcttgacaatgtgagcaagatggactactaaaatgttccagctcttagttgcctcacaccgatagccagaacaatgaattaataattacattttaatgaaagtaactgaaggagaggagtgctcatttgtgagaccctgagcctagaaccctggctccacagccactccaagccactgtacttcgagcccagcgctgctgcagctgcttataggccatgtcaaatctgagggattctgtcagctgagtcccctcactgcgggaaaaattaaaaataagaggaccccaaaagcccttgacactaaggacataaacaaattgtgccaccactactgctgtgccactacaaacttctacagtctaagccactgaggcacccacagttattgctgacattaaactcagctcaggaagctgcacggagactatgctacacccatctggaaacagagtcaccacactcttcccaactggcacactaaaacccaactgcaggtgatagttgtcctgtataaaaaccactctggaaagtttggagataagcagatacacaggcatcaatatagagacacaagaaacatgaaaaggcaaagacatatgataccaccaaaggaacataacactgtagtaacagactccagtaaaaagaaaatcaacaaattgccaaagaaaaaaaatcaaaataatgatgctgagaagactcaataaaatacaagaatatacagcatagacaattcaataaaatcaggaaaacaattcatgaaacaaatgagaaattcaacagaagataaaaatcataaaaatcaaatagaaatcctgtagctgaagaattcaatgaataagttttcaagttacaatagagagattcaatagcagacttggtcaagcagaagaatctgttgacaggttgtttgaaataagtcaaagaaaaacaaaagaaggatttaaaaaagtaaagaaataatggtgttccttaatgggatgccattaagtaaacaaatatttgtattatgagaattctagaaggagaagagaaagaaaaggacaaaggaaacctatttaataaaataacagctgaaaactttccaaatatgaagagagatgtagatatccagatccgaaagctcaaaatcccctatgtaaattcaactcaagaaggtcctccccgaggcattataatgtcaaactgtcaaaagtccaagacaaaaagtctctaggcctttaggctatttggcatgaggaaacagtgaaaatagtgggaaaatatatccaatccttcaacacttttcagaagtaatgtcctcagggaacagctgggtttctgtttcaaaaggaagagaaacagaacatcagaagtggtttaaggccaaaaataatatcactgctcataaaaaattgattctagaagtcacagtgaaatagtcttgggaataggagaggggtaggtacagtgaccaattaggagatatatgattatatgatatgaccctaacagaactagaatttttatgttttaaaaataatgtaattcaatgccagaacacctcctacaatcaaagcactatactaagtgaactgaaggataaagttgacttaaacatcactctaatatcaatccataaaataatggaagacagaaaacacaaaaccaacacaaaataaaatttgcctgttataatagtggcacacactgatgtgaaaatacaaaagacacaaagattatatcagattgattcatatgaaaggtcattaagaagtataggacaattgagaaagtgctgaagcaaagtagaaatgagatgaagttatttcatatggaggacttttgattatcaaagacaagatgtgtgttcgggagtcatgtagtataatgaaagtataaaaagttgattgggtattgagtgaaggactttggcaacaatggtgtttgccccttattacataaagtctacagtatacaatggagaatgtaggggtcatgggaaggaattttaagcagaaattggatagagtcagacttgatttgggaagataaatgtggatacagtaaggaagatggacacaatgagggagaaacaggaacctcaggagttactttctcattaatcaaaagagaagtaatgaacacaagaacgtggcagatcaaaccagaatctctcttggaccacagacgacattgctgtttctgtgctaacaactcaaaatagtctgaacttaggaggcaaaaaataccaactaattgtctaatgtacttatttttccctcagtctatttctaactatagtcaggaaaaccaggctctgcagcatgtcctggtagtactatcgggtctactatgtcatcattcaggaagggagcctctcaggaaacactacctctgctctggctggaagggacaatataatatgttttataaggaaaacgtagaattttcttcactttctgccaaaagagctgaaacacatgaaagcctctcttcaaagactatctgttcaccattagttatagactgagaaggagaatcttggtgggttggaagaaagttgctgctattatctgcaggcatgcacactgccaataaacagagttgtaccacagagtctaatttgtctatttgagatgtcttctccttcatcttttgaagcctcaattgtaacagctgtgaaactacatcaggatttacacaaacatattaaaacagaaaagttgctgagaacagtttcatggtcacactgtgaagagttaatggtccaaaatcaatgctttcatggctcctgagggaagcggaattaacatcattccccaaacagattcctctctcttcaggatagctcccttcccatcctttcataacacatctgctcccctgagctaaggagttatatctagcatggtgtttctctgcagatgcagtgaagaggaataaagacttactatgacttaatgaccctcgagtccatgtttctgcccagaggattccgaagactaggctcggggattctgggacatgcctggtcatagggatgctctcactcactataaagttgcctccactttaccaagcaggcttgttgctcagaggcttcaaggggaacctaatcacggtctttaagaacctggactcatgctccaattctgctccaagtgagggctgggagaagaaatattacagaggtaagaatgcttgtgcaggagaagtgaaaagatacacaggagagaagaagagggcaaatgaggatagagaggccagattcttccacttttctgaggaattatcctaagcaccattgcaccattttcttcacagaggaacacaacagagcacatgggattggtgagggcagtggtgtaccaattagtaatgcacagaatttctgtctgtgtatctctctctctcccccctttctctctgcccctctctcttacacacacatacactcatacacacacattctcacagagtacactgttcacagccgaaacaccacaaatacagtcatatagtagcatggccatacttgttgtcaataagacaaaaggatgttattgcagacttcttttgtatgtgtttatttaaggtggtgggtgggtatcacatgtcaatattcaaatacaattacataggcattaacatatttggtctgtaaagttttattctctgtttccctcattgtctgagtgaatttaatgttgccagttgtaacttggttccctatatccctactactttatggaaccatccccaagccatttttattgtaagcacaatacccctgctagatcagccggactgaaccgccaatggcacagttatggaagagcctgaatgaaggtatttatccactttatccattcatcaactgctttggtctcaccaagattgggaaagctgtaagaataagaggagaaaattgtttcttttctaaatgagcagtattgggtcatatttgtatccataaaaatctagacataaatattaatgtctgactctgtgccatttcttcactttggcctcttctgagccattcctcctttatctaatcttaggccaaactgtgacataatttggactttttacaatgaaataacttctttctgctaacaggtgaattattttagctatcttgcatttaaataaacaaaatatttgggagcattaataaaataagtaagtataatttgttgaggatacactatgcactagcacctatacaaacattggtcttatttatcattaaaataaaccacattagttataatttatcatctcatttttacaggagaaaaaaaaactgatctatctggttaaagaatctgtccaagggtctcaagcaagtaaatggtttagcaggttttccagccatgtctgaaaagttttaaggtccacagaagacttctgtaatattctactacagtcagcaaaaaaataaaaatccaacaaagtaaaaaaaatcacaagttcaaaatgtgaactttggtgagcacaataagagaaaaattgctaattgttatgaatttgtcttttcagatggactccagtagggatctttgtcaatgtgcatatctagagaagaacaaacttaataatttgccctcaaaaaatgatcttgaggttattggccatacactgtctgctactgtggcatatagttataacagaaagaaggcaagaattcaggtaaaactgtgagagggtggatgtgctggcagctttgaattttactgtcagagaagcgtcctctttgccatctccctgggaatgtttttctcagctggcaaagtatcatgttgagacacagccacccttaagattgggctgactctggactgtaaatctcacaacacatcatcctagctatttcctcagactctcccaggtgaaatcacaaaaaccactgccctctgatttttcagcctggcatcttttcctcaatactggcaaacattatgttcttttttcaattttctctcagcttctcggggaccaagaaatgctcttgttcttctcatacagaatggggaattattaactcctttgcttgtgtacttctgctgtaaaatagctacctggcaaagttacaggacaactgatgtatgcagccacgtacataataaaacatgatttctctctctactcctatctctccaaccttctccgtctctctctctctctctctctctcactctctgtctctgtcacacacactcacacacaaacaaaagcacacttattacaaaccccaactctgattcaattaaatgctgaacaactgggaaccaacattcatgtggcagttttgagagtattacaatgattacccctggttctcaactcttagttgcagctattctctttgtagaaataaggccagtacatgcataaatattatacaatccaggttacattagttgctacagagttgtacagtgtctttagggatgcaaagttaaaataaggtaattttccttgttattgtcaaggaatcaatgaagagtccttaaaacattttaatttcaatattaaaatttgctaaatatttgatctgtttacacctgaaggtaggcacaattttgggacatgggaattttttttatgttactaactgatgttatagattgtaaggaagataaacataatttggcagatacacacaaggcattttattggaaggatatcagggaatcagaatgacaggatcttggagaaactggattgttcatgaagatttagaagcatcaaaattagtaattaatccataatagaaatgcacttatcagtttagctgagttagaaccaggaaagttctaacagagactgattaactacacttatgtgatgtcactgtataagatccttacgtttatattataataaaacatagaaagtggtagacagtagtacttctcctttgtactaggaatctttgtctcatctagaaactattgagatactcagaattttagtttctctgaattacatccataatatttatattattagacattagagcaaaatttaaatatttaatattaaaataatattaacaaactattatataaaacataatttggtactttttgttaaaatcactgtttttcaagaaattagttgtaaaaatggtatcattttcctttgcaaatatttttattgtctaagttaagataatagagctgaaatctcacaacatcatttacaatttcatttaatctgttatggtagcacctcatataacctctggaaaatttcactatgtacttatgagagaatgagagtgagaatggctaaaaattttctattataaaaatagttttgagcttgtgaacttctggaaaggtacttagaaaaccccagagatctcaagaccacacttcaaagaacacatggaatggtgatttcccaaaaagtaaagaagggctacttaggaaagtaatggaagggaatgccgtaatataaatatgcattgcattatgaaatttttcccattctttcaaatatctcaaagattacaaaacataaagccataagcaatattgcctatgatggatctcagaacaataatctgtgttgagaggcttcctcgattatcctctggaaagaagtgagtcttgaatgtttgtaaattaaccacctataccattacctctagcacactgataagagtctttctgtttcttcaggaacttgacaagagaggaccttaaagaaagtgagatccttcatacttaggaattcagtgacacttgctgggagaatgccttctatcaatgacacccacttctatccccccttcttcctcctgctaggaataccaggactggacactttacatatctggatttctttcccattctgtattgtgtacctgattgccattgtggggaatatgaccattctctttgtgatcaaaactgaacatagtctacaccagcccatgttctacttcctggccatgttgtctatgattgatctgggtctgtccacatccactatccccaaaatgctaggaatcttctggttcaacctccaagagatcagctttgggggatgccttcttcagatgttctttattcacatgtttacaggcatggagactgttctgttggtggtcatggcttatgaccgctttgttgccatctgcaaccctctccagtacaccatgatcctcaccaataaaaccatcagtatcctagcttctgtggttgttggaagaaatttagttcttgtaaccccatttgtgtttctcattctgcgtctgccattctgtgggcataacatcgtacctcacacatactgtgagcacaggggtctggccgggttggcctgtgcacccattaagatcaacataatctatgggctcatggtgatttcttatattattgtggatgtgatcttaattgcctcttcctatgtgcttatccttagagctgtttttcgccttccctctcaagatgtccgactaaaggccttcaatacctgtggttctcatgtctgtgttatgctgtgcttttacacaccagcatttttttcttttatgacacatcgttttggccaaaacattccccactatatccatattcttttggctaacctgtatgtggttgtcccacctgcccttaaccctgtcatttatggagtcaggaccaagcagatccgagagcaaattgtgaaaatatttgtacagaaagaataattctgtattaaagtttggataaatatatctatatacaacccaaattatcatcatctgagctccctttttaatcttctgtaacagttggtcatgcttgtcagattttttccttttgactggaagtgctttagtgttgacagataatgcaaacttaaaacctttgctgcctgtttcccctacttctctccaagtacctggacaaaggttagagattaatggagaaggtaactatgctgaaggttgaggtggctttggagtagaactgcttgtaaacaagggtgataggtagctccatttttttccatatgtcttctctctaggtaagtttagatcctgaaggatactgatcaaataaatctcattttatagatgaacaaaataagctgtaatccagcagtagtgtccgtttcatagctttgtattctttacagaatccaaaattttgttgttcttctccaaaatctttgactcccatgtttattttaatgctctctcagtcttgctgttactgccatttttgctcctttccttctttcagattcctgctctctctctttttgtgatggttaatactgagtgtcaactttatttgactgaaggatacaaagtattgatcctggttttgtctgtgagggtgttgccaaaagagattaacatttgagtcagtgggctgggaaaggcagacccaccttcaatctgggtgggcaccatctaatcagctgccaacgcagctagaatataaagcaggcagaaaaatgtgaaaagactagatgggcctagcctcccaggctacatccttctcctgtgctggatgcttcctcctcgaacgtcggactccaagttcctcagttttgggactcagagtggctctccttgatcttcagcttgcagatggcctattgtgggaccttgtgatcatgtgagttaatacttaattccccctttgtgtgtgtgtgtatgtgtacacacacacacacacacacacacatatatatatatatcctattagttcagtccctctagagaacactgactaatacacttttcttttacattcgttctctgataaagtaagtctttgtgaatttagggatatgagagactacagtgtgggtattacggagacatgttttctcacttgaagcaaagtcattttagatgtgactacttgtatgtgtcgcctgtctaattctaattctcaattctatctgacaatttcccttcagacaaaatatataaaacttatgagactttataaaacttagaaaaacaattaggctcaagctatggtaagcacagggccagacttgatatcgacttcaaaataatatcattataatttattaatcctgtagatctccaatatttagtcctattttcaaacttcagatatggctggagaatgtggtttgctttaaaatagataaaagagacattgaactgaaatttgtgacttatcagggtactcatgcttcaaaatcagaagaagtctccctcatgttctataatttagaaccactgtgtagtttgtatgacaatatacaaaatactcaaaagtacgcagataacgattttaggaaatgggggcggatatagccaagtagacaagaaaagcaacatcacctattcagtatctgtgaatctggacagttcttggtcttaacactggctaagcacaattcctgaattctatagtattttgtagattttctttaggtctgtatgcatgggttctaatttgatttttgcagcttctgcttcatgtacttaacattttatgggaacatagggttttaaatgtggaaatacattgaaacttgatctattccctttgtcttacaaataaaaaaaactgaggtctaaagaaagcaggtatttgtgtgcataaaatatacccatctttagcatcattctcatgtaacaagtgaaggaagatcactcagataaatccttttgactacaaattcttaactcttgcaggagatttaagtaggaaatattttatttatacgtgagaggcttcatcatgggtcccaagtggagatcaagtaaaaggagaggtagaacgagtagcctgggtttggtgttggtaatgagaagagggagaccacagaaactgagtacaggtgcaagtagtatagtgataaagagaagctgaaatcagcacagtcttcatcactgtggtccacagtactgagtggtaagcacagacgagcatccaggccctcaatagctgtaccatatataaacatgctaaataaagacaaagtttttttcttttctcagtgatatgaaagcatctgtgacatgtataatgcaactttctggttaaatatattgatgggagtcggaaaattttaatataagcgtaatagtgtccacagtgtagatgggagtgcaccataatgctggccctgaaatggttcataatcaaactggaacaccacacttaaacatggctgagcagagtcattgtactgggatcccttctctggacagtagttttctttcacgaaatcaaacaagatgggaccagaagggtgctgacaagctgaagaaaaaagacacaaaagataaatataattgagaaaatggtgacaaaaggaatgccaacctgaaataatagtatgagaatccagtgtaagtgtttattcaaatgcaaagctaaggatggccatctgggaaacacagaatccaaagaaatgaggtcaatgctccaaagttgaaaagttaaggttttacttatgtaggcagaaagcaaagaaatgtagcagaattaaagatttccccatacaaacttgatttatgagttacagcacattgattagttatagcttgttttctttttccaatttaaatgagtatttttaacattttaactttgacaatgtaatagtcatgaggtctttgtgtaaaacaaggaagaaggaagttaatcaataacgaagatcaaaaataaagagggaaagggtcttctctggcactcgttagtcttttacaacattctaaaaaacaatgtaggtaatggaaaaaggctaatttataatcaggcaaacaaatactacaacttcctaggttacagctatctgttagtgactcaagtcctataatcacattcttttaaggctcaaaataatttaaagtttcaacagctttggtcttgaattacttattttcattaaaaaaagacatcaatgccagagttaattatattctactggtattgaatattcgaagactatgccattttccataaaccttgctcaccccgtcaagcaatccttctccttaggaaccctttatgcatcacacggtattctacagaatatggaaaccagcctagctcatagactcttatgggatagtaagtgtgagaatattaatgctgtttatctctaactttatgttacccaccagcactttgggaacagacataattcagtgtaactgaaaataaacttccatgaagttcaattcagatacagtatcttcttgaatatgttccaacattgctccattcaattggtttattgatccataactcctatatcagtcagagccttgctatattatcctggtttcccaaaaaaacctttttaaaattccagatgcctgcagacttttccatttttctggtgccaaatttgaagaaaattctcaacagttttccaaagtgatttcaccattttacacttctaccaacaaaatatgaaaatcccaattgctcgacattcccaccaacatttggtgttgtcagtcatttgaatttagctactctagtgagtaaaaagcattatcccattgcagttttaatttttatttctctaataactaataatgatgtcaagtatatttttagctcttatgggccattttaaaatattcgcttgtgaagtatctattattcttttccaacaactacaaaattagctactttgagatatatttgaatgtagttcaaaagtcttaagaaattagaatccaaagataaaactacctatttcaaaataaacaataagagcagtaaattttacctatacttatacatgtttctatatacacatggatatttataaatatacagatgatccttgatttacaatgttttaattggacaattttttgactttagaatagtttgagtatatgcattcagtactttccttgacttacaatggaataaagccaagatcaacccctggtaaggtgtctgtaataccattgttattactaacaatgtcatgtctcttgaagacaatctagatcttcttacctcttgcatttccaaattccatttatttcatgctaattgcatcattactttggatgctgcattatccattgtcctgctcaagaataatgccttcaaaatattgaacaatattttcaatggatttgtttcttttttaatttttatggatacacagtaagtgcatatatttatggagtacatgagatgttttgatacaagcatgaaatgtgtaataaccacatcataatccagcaatcccactgctgggtatacaaacaaaaggaagaaaatcaatatatagaagagatatcagcactccagtgtttgttgcagcactgtttacaatagctaagatttggaagcaacctaaatgtccatcaacagatgaatggataaagaaaatgtggtacatatatacaacggagtactattcagccataaaatattttcaaattatcatgggtttattgcagcataaccccattgtaagttaaggagcatctatatataatatcatatattatgtattgtatattattacatgtgataaaagtaagtttaaatagaagaatctacaggaaaatctaaggctgcttattggcaatattagtgaaggttctagaaagcatagttagcaaactcaagctgaccccttaaactaagacaaatatataggcacagtttagaaattccacaagagactataaggatagtaagtgtgggaatgtttactctggggtccaaagaggagaaggagttcctggcatctggaggcccagagagcattgcagatagaagttgcaatttatttggaggtactcacagagcccgtggtgacctgcaggtcacctgcaatgaaggagcaggtgggaaccagaataaatatctcgacctcactcacttccccctcacctgctggtgcttcctattttctgaacccaagcagattctatgggacaaaagaggctattgatacagtacatagtcatgaatctcttaggacacagagtatagaatggacctagagaggccgaaaggagatctccagcacattggcccacataaacaaagggctggaggaaaattctgaacaaacatgaggcggccaatatttttatatattctcctttcaattactattgtgtgctatttatttcagtatttatttatttgtagcattagatactctcctttttgttctcagaatcctcttagaatcattttgaatttttttgtattcttttagacagcccaagaattataatgctgataaaaaatcatttggactaatatactgtgaaatataatctagtatgtttgcactgagaattgaaatgagaataaaaaagtaatggaataatcaccaggcatattcttagttttctcataattttagagtattctctctgtaaggccaaaagtaaaatgaaagaacattttatatgctaggggtattcttctatgtggtttataagattcatgggtattaaggaaaactttgggctttccaaagctttaattaatattgtaattcaaaaagatcaatatgataatgcatagtaagatatatccaattttataggaaacattagaaataatcaagaaaagtcactaacttttcatcctttacattcttttattgtaaaagaaatcaaagctccctgaagaaatgattttgaactcagaggtatacaaatagagatataacaaaaatatcttgaaaacttagttagcacaatagctcatgttcaagaaatgtagctgatttgactttcacgtatacataatgctcaaatggcacttgctgatttagcctgtatttaatgagcatctaattattatgttgtctaattcatatcaggagctcaataaaagaaggttgaatcaaggaacattggcttgtaggatgagcatgactgacatctagtggtaaaaataaatacttttttgtaaaatttatttatttattttgtaatttcaactcttagatttaggggctacatgtgtgggtttgtgacatgggtagattgtgtgattctgaagtttggggtatgaatgatcccatcacccactgatatggttaggctctgtgttcccacccaaatctcatcttgaattgtccgcataatccccacattagggttgggacctgttgggaggtgattggattgcagggttggtttcccccatgctgttctcatgatagtgagttatcatgagatctgatgtttttttaagtgtttgacagctccccctgcacgggcattctctttctctctcacctgctgccctgtaagatgtgcctcttccccttccgccatgactgttaagtttactgaggccttcccagccatgtggaactgtaagtcaattaaatctcttttctttataaatgacccagcctcagatatttacttatagcaacgtgaaaatgaactaatatacgcaggtggtaagcatattaccctataagtagtttttcaacccttgtcctcggcctctctcccacctttagtagtccccagtgtctgctgttcccatctttatgtccatgtgtaccaataaatacatttcctgaacaaataaatgacagtcatttaaatgaacaatctaatgaactaaaaaggtaaataactttttctactgaatatttatttatgttattgaacaccaaaaattctacttcaaataaggaatagaaataatgtccatttaataatatttagatatattgtcaaacactctgctgttctagtcaaatgcatgatctcacttactctgaaaaaaaaagtgtgaaatgtgttttgtcatttccgtcagccttgtgaatctataagaaggaacaagaagctgatagaggttaagaaatgttttcccagctacagaatctaagaaaaaaatatttaaatttatgttgcctaactccaaagtgttaacttcagagataatgttgtaaaagatttgtgaaaatgcatagccagtgttaatgtattaattaatttctaacaagtaagtgttgagcaccttccagacattaccttattatactgttacaatattgatataattttttctcattttccatttgagaaaaccaagacttagaatggcaaatgtaattgaacaagatcacagaataagagaatcaaaagatcatgttcttaatctgtaggttaaactgcttttctttctgtatatatatatattcattttgatatttctattaatattatgtatcgtgttagatgcattacacactcacaaaaatcatggaatgtaattcttgtaacagatatatctcatgaattggaaactgaagttagaattctatctctgccatttattaatgtacatatatttcagagatgactttaaggcgatgctgggttccttcttacagggctcttttcttgcctctctgtcaagagtaactaatcacctgataccacagtcagatttaaggtgtaagtgtgaggtcattatgcctctaactgaatagacccctgggacctgtgcagggaatgtacccactagaggatgcacagatcatcagcaagcagaaggtatctctgacaagataacctagagccctatcctcaggagtagggaaattttctgttttctctccaggtccagtgacacagcccacactttagggaagcccttcccaggggacaagaattctcatataactccttggctctgaatagtaagaactatgtcgcatacaggttgcagtctggggtatccggtccttcacagacaatttctcagatgcggggcagaggtaggtgagtcagctcctggttatgctgaaagagggtcctcaatgacagtaactaaagtgatttgtgggatgatggagctccagtgactcggccagagtctctgtagatagggccatcttctaaggaagtagcaagagaaagagatagtagttaagaaaaacccaaattcatagctgtagtcaagaacagactattacttaaggacatgataaaggaagaaaagcagtaaacaaacttcaaagagcattctgagagttaaaggaaaagagaaggataagtgttttaaaattaaaaaaaaaagagcatttcatgaagatgagaaggatgttaacagatcattccctggttatagctgtgtggtctgcttttcaagacctatgcacctatgactagttgttaggaatctcagatgctgaaacctcaaattttcacccgtccctggaattgccctcagatccaaggaactgcctcatctgaggtcatgtcgcatcacacagtgtggcccattgccaacaactagataatatagaaatacaaaaaaaataaaaaaggcttactttttttgtgtgtgtgggacaacttagagagatcaaaccatctccagagcttcatatcgtatcatttgaggcttcagatgtaactacatgataaagaagtttgtcttctgatccaatcctaccttcctggcttctttataagcatattttcccagagcctttctcaaaaatctttctgcccgccattctctatctcagatatgtttttaggaattcaatctaaaatactatatataacaatagggaagattattatttgcactcaactttcaatagccatttgtggatcctggcattaaaaaaatcatgttatcatggagataaatatgacactagttttgccttcaaagaaattataacctagtggtagatattcgccagtggttctcaaattggaataagcatcagaatcacctggagggctttttaacagattactggacccctcttcaagagcttctgattaaggtggtcttagttagtgtccaagaaatgtcatttataacaagttaccaggtgatgctgatgctattggtccagggaactcattttgaaaaccgctgataactcacgtaacagaaagatagattggcctttggaaaaataggaaaaaaaagaatggataatcttgaaataagcagattgaggcaggctatgtagattgtatgttaataaatctaggctatgtactatagtggtgactaaagctagacaggaaagtctcctcataagaggaaatatgaagaaagacatagagaagaaagcatgcagaaagtttgaagtgcagtttgactgcagtgtggagatgataatactgtaaagataggttaaaattaatgtttaagattcttcactgcattttatggaataaagacttttttcataaggatatggagcactactgaaattttattcttatggctcaggggtcggtgccctttttctataaagagagagagagttaatatttttaatattttcctgccatgagatctcagtcacaactcctcagatcttccattgtagattaaaagcagccacagacaatacataaatgaatgagaataattttgccccaataaaatttaatttacaaaaacaaatggtgggccagatttggtccatgggccatagtttgtgttctcagaaaatacttatgataatctgatttcaaaaattattttaattgcggactcaatgtaaagaaaagattgctttagactttgagtgtagaaatgttttacttcactgacaagagaaccactacacatttttttcagttgttgtgtttaattatgaaaagattgctaaggccatggtgaattaaatggctgtgacaatgtcaggaaattcaaagtcctacaccaaaattactttaagtgaacaatacaattctccaaagctaatattttagaaaataaaattcttgtaacaagcactgtcttaaggtgaaaaataatagctgttggatttgaaattgcatatcacaaaagaaaagctggatttatattcacaggaaacagtgaaaatataaaattaaacataaattttgttcctttggctgatttttctccattgcactcttaattctaccaaatttaggtattctttattcttccttatttcagtgacagattaaataatttagctctgtactttaatttttctgcaaacaaaattctctatagcttattcattaatacaattaatcatattgtgatatataacctctattttttaatctttgtaaatagccatgaataaatttaatgttttaagctaatcattgtattccaccattagcaggatgatcatcttattggcatttatggttgacccctgcggaagcattacattggaggaaacacaataactgaaaaaccaagtaagacaatttggtaataattcagatgaacaatgttagtctatgtatatcagtgaaaacagaaataggccaggtgtggcggcttacgcctgtaatcccaccactttgataggctgaggcaggcagatcagctgaggtcatgagttcaaggccagcctggccttgtctctactaaaaatacaaaaattagccgggcgtggtggtgggcacctgtaatcctagctactcaggaaggtgaggcaggagaatcgcttctacccaagtggtggaggttgcagtgagctgagattgtgccagtgtactccagcctgggaaacagagagagactccatctcaaaaagaagaaagaaaaagaaagaaaagaaaagtagaaaaactaaaatgtaggtaggaatataaatagagattttaaaaacagaacagggtataataatcagagaagactttgggaggctgaggcgagcagatcacgaggtcaggagatcaagacatcaagaccatcctggctaacatggtgaaacctcgtctctactaaaaaaaaaaaaaaaaaaaaaaaaattagccgggcgtggtggcaggcacctgtagtcccagctactcaggaggctgaggcaggagaatggcgtgaacccgagaggtggagcttgcagtgagctgagatagcaccactgcactccaacctgggcgacagagtgggacactgtgtcaaaaaaaaaaaaaaaaaatcagagaagaagaaaaaatttgaatgaaaaattattcagttttcaaatctttgtaactgtaaggatgttacatattaatagagatatgaaatacattgtatgagaaataaggatttaaaggcagcaagtggtgagtacaataaaaagagagggtctggagaaatatttctccttctccctattgaaagtaataatcatgatgatgattacagttatttaaaatccatgtggaaagtaatcacaccacatgtctataacttctaattttcaggacagtccctgcatgatgtggtgatcatgtgattaattttattacccccagcttacatataaaaaattactaatagcagtagctattgagtaagatatagtttttaattccctggcctgaatctcatttacctcctctgtaaatggggacagaagtgccaatttcagaactgctttaatctttaaataaaatcacatttcaaaagcactgaaaaaatacctggcacataatgtcagctagacgttttttccctctaacataaacttagttattattccttttagtaaaagacaaaatgtaaagaattctctgacagatcggatgctggggcaggggatagatgtaaatagaaagataaagctaatttgtggttattagtgggtgaaaggtattgatactgactcttttgtattgtaaacataacttttttatttttagacattcaaggggatacacgtgcaggtttgttacctgggcatattgcataatgctggggcataggcttctagtgaacccatcacccaaatagtgaacattgtacccaaaaggtagtttttcaactcttgcctctctacctccctccccacctttgtagtctctagtgtctgttgtttccatctttatgtccatgtgtacccattgtttatctcccacttataagtgagaacatatgctatttggttttctgtttctgcatgaattcacttagaataatggcttccagctgcattcatattgctgcaagggacattattctttgttatggctgtgtacttttctatggtgtatacgtcccacattttatttacccaatctaccactgatggacacttaggttgatttcatgactgctattgtgaatagtgctgtgataagcaaatcagtgcaggtgtatttttgatcagtccattttcctttgggtagatatccaatagcgggattcctagaaataatgatagttctatttttagttccttgggaaattttcatactgttttccatggaggttgagctaataaatccctaatactgtgtaagtgttcctttttctccacatccttaccaacatctgttattttttcactttttaataataaccattctgactggtgtgagatggtttctcactgtgtttttgtttttgttgttgtttgtctgcttgttcatttttgagccagagtctcattctgtcacccaggctggagtgaagtagcacaatcacggctcactgcagtcttgacctcccaggttccagtgatcttctcacctcaccctcctgagtagctgtaaccataggcgcacaccaccacaccaagctaattttttttttttttagatgaagtctccctatgtttcccaggctgatctggaattcctgggctcaagttatcctcccacctcggcctcccaaaatgctaggattacaggcataagccactgcacctggcctcattgtggttttaagttgcacttttttgatgattaatgatgatgaacattttttcatatgcttgttagctgtttgtgtgtctttttttgagaaatgtctattcaacctttgcccacgttttaattgggttttgtcttttgcttaattatttaagtccttattggttcttgatattagtcttctgtcagatgcatagtttgcaaatattttctcccattttgtaggttgtctgtttactctgtgaattgtttattttggctgcacagaatctttttagtgtaagtaaatcccatttgtttatttttgttttcattttcattgcatttgcttttgaagtctcaatcataaattatttgcctagggccaatgtccagaaaagtttttcctaggtcttttaggatttttgtagtttgaggcctcatattcaagtttttagtccattttgagttaattttgtatatggtaagaagtaggggtccagttttattcttctacatatggctagacaatttccctagcacatttactgaataagatatccttacccagttgattgtttttgttgactttaccaaagatcagttcgttgtaggtgtgtggctttacttctaggttctctattctgttccactgatttttgtgtcatgtttccagcaatgccatgctgttttggctactgcagccttggagtataatttgaagttgggtagtgtgatgcctttggctttgttctttttgcttaggattgctctgtctatttgggctcttttttggttccatattaattttagaatagttttttctaatttgaaaaaatggctttgggaatttcataggaatttcatagaatctgtagattgctttgggtcattttactgatagtgattcttccagattatgagtgtgaaatgtctttccgttagtttgcgttatctgtgatttctttcattggtgttttttagttctccttgtagagatctttcacctccttggttaaatgtatttctacatattttattattgtgtggctattttaaatgggtttgagttcttgatttggttctcagcttgaagaatactggtatatagaaatgctactcatctttgtatgttgattttgtgatactaactttcctataatcagatcccataaggagaaaaagatgattaatacaactcaggaaatgatcatatcataaagtatcttccctccctttagcagaatcgtgacatatcttgggaagcaattccacaccatgaaattggacagaatctgagaagatacaaacccaaatacacataccactatacttccaaagcagttctttgggcctgcattatagccaagtcatagggatagtttttctttaggattagtagcaccatattagaaatcattgcactcaaatgagcatcaaagtaatttgacccatggcactgatatggatatggcactgcccgaatctgactaacccaataactgaatgtattccatccatggcccagagcctaccacagaatacaccctgtagcagcaaagtttctaatcaagtcctagtctcatttgcacacacccaagcaccctacaggcctattatgttgcagattgcatccattgcacagagccagttacaaaccagactcaaccacaaggcacaccagaaagactcaattgtgacggtaaactagcctgctgtgaacttaaacatatcactgtccatcaatataccagggaaactattacagcattaatacaaactagactgtccccaatctgaggcaagtatctgacctcagtatcttttaaaaagatagagacaattacactgccactatctaggtggcattatgaagcgattgcccatttatataatgcgaaatggagaagacagaaaagatcataaatcacaaaaggcactgcaaagtatctgagagcatccagtgttttctattcaggaaagaaaacataatatagtgaagggcctttgaagttgtaagagggagcattgtttttctggaattatgcaatagttaccctatgtatctaaatttaaaaattttatttattatctcaaatccaaacaccaactaaccaatcctccacctttactgagtctcctctcacagagaatattcttaatttctcagatctaatttgcaagaatgtatcattcctcttatcattttcctcctcaatctcagtccagtgacattttacacacacacacacacacacacacacacttcaccttggctactctttacatcctgattaacaagtataattagcaataaatatatgctaatttaatgccatatggaagttttttcttagagactgaagggaggaaagacatgggaagtgcaggattgctatattttggaaactttctgcatggtttcctgtgtaagtgaggcaaatatttaaaagtgagagtgtctttttaactatatttcatattccctctctaggtctcttatgctatattatggagttaaagaatggattttctgtttccccaagaaatagacaccatgctgtgaaagaagttatggtttctcactggaagcaagaaaactcatgcaagaaatgtgtctgtagggaatggccaccaatatgcttcataccaacaatacacagtttcacccttccaccttcctcgtagtgggggtcccagggctggaagatgtgcatgtatggattggcttccccttctttgcagtgtatctaacagcccttctagggaacatcattatcctgtttgtgatacagactgaacagagcctccaccaacccatgttttacttcctagccatgttggccggcactgatctgggcttgtctacagcaaccatccccaagatgctgggaattttctggtttaatcttggagagattgcatttggtgcctgcatcacacagatgtataccattcatatatgcactggcctggagtctgtggtactgacagtcacgggcatagatcgctatattgccatctgcaaccccctgagatatagcatgatccttaccaacaaggtaatagccattctgggcatagtcatcattgtcaggactttggtatttgtgactccattcacatttctcatcctgagattgcctttctgtggtgtccggattatccctcatacctattgtgaacacatgggcttggcaaagttagcttgtgccagtattaatgttatatatggattgattgccttctcagtgggatacattgacatttctgtgattggattttcctatgtccagatcctccgagctgtcttccatctcccagcctgggatgcccggcctaaggcactcagcacatgtggctctcacgtctgtgttatgttggctttctacctgccagccctcttttccttcatgacacaccgctttggccacaacatccctcattacatccacattcttctggccaatctgtatgtggtttttccccctgctcttaactctgttatctatggggtcaaaacaaaacagatacgagagcaggtacttaggatactcaaccctaaaagcttttggcattttgaccccaagaggatcttccacaacaattcagttagacaataatgagatcataacaaaataaacactggaaacattttttttactacttctcttgcattcccacatgagccaatagcattatatcccctacaacgtctcatgatttcagtacggtctgttggaagttatagctcaaagattccaaaacaatctctctgtttcacccattaaaagtgcaaaaagtactcacacttaagccccatgatactacaaaatgcctaaagagaaacaaaggctttgtaaaagttattgcccagtaattgtcttgaatagcctttccacatgaagattctctgtatttacatatccaaagctgaagttcatgacgattaaaatgatgtggtatttcatcaaaaccaggcaggatacagtggcaagagaaattaactaggagtcataagatctagatttaaatacaggttatggccttacctaaaattttgacctgagcatttcacttagactctttgagttcacaataacaaattcatactgatttatagcattttatgagcagggatattgaagcttaaagtgaatgttgtgaaaatctgtgcagcttgtaaaacattaaaagatttggaaacaaaatgagtgcttactaaacataattatagtgtaattgttatttctaatgtatgtagatttcatttactaatccactctagtatacaatccctggtttgaggtcagctctccagatccagattatcccaacgcatgggcctcttcatggacctctcagctcttaccttcgtgaaagagactttcagtcaggagactataaagcttgaagagttaacaggtttctgtcttgggcttaaggactcagggaaatcccatcctccacagtctttgctagagtgggttttagggcagactgtaatagtgtggctgctgaaataatataaagtcattcttaataaggtatagaagataaataggacaatttatttctttgggtattctaggagctgcaaaaatgtgaagttggctcctaattggaaatggagccctgattgaaactcaaggtagaatgagcagaaatgtacagagaatagtgcgaaagtaataacaatataaataacagtataaattgacaagtggaagtaaactgaagtgatatgtcatataaatatataaagaaaaagtaaccaagtaatcattttctaagtagatattttgaaattgatacagaatttaaaaaaaactaaacagatcatttaacaaggaataaagatgacaaaaaattcattgtggagtgtcttctaagtaaaataccacttttcaattatagtttatttaatgtattattatataatatttcaactacgaaaatctcattttagagcctgaatatttacatttgtatatttaaaggctctaatatgttcaattttgttcactctacccaaaatatgttaaaccaccagaccacttaattttggtatcatacgttaagaacttcgactaagagttttcctgtatcatttctgagactttgctaaatgtcacgtgctccagaaagtgagtaatctgaatggaaatgggtaacagagaactttaatttctaaggagcatagaagctaatacagaagagaaaaccccattcattaccaagtatatgttccaggggctgtaacatgggagccaggagcatatttgaaaacagcacagtgtgcacatagaattcccaagaaaggaaagttgtttagggagtttatcaagctctagagttttttttttttttaactgaatttgtacaaagccatcaatactgcaagtcttggagcaggtcggctgagctatgccaaatgctatggtaaacactgaatattggtcatcttggctgagtccatgtctgtgaaacattggcatgcttcaagccaatctaaaagaattcaactttgtttattatttcaaaatttcaaggctgctgaaaggtaggtctttatacacagtcactttatttgctagctgagtattttcatcgggggcaactgatgaaaatgttgacttccactaacctaagcctgtccgttgttactatcgtatcttccagttcaacgtcagggaaatagtttttggtgctttccttgtttatatacagatgtttatgacttatctatgcactggcctggaatctggggtactgataatcctggccatagaccactatgtcgtaattcgcaatccactgagatataccatgattctcatgaacaatgtggtagccatcctaggaagtcatgataattagatctttaatctttatcatcccttttgagtttctcatcttgctgttgtcattctgtgctgcccatatcatcccccacaccaaatgtgagcacatgggcattgcccatctttcctgtgccagtatcagagccaataatatgtttgggatggttgcctttttgtgggatttattgaccttattgcaattggtttctcctatgtaaagaaactacacactgtttcacttaccaccatggaatggccagttcgaggctctcaatacctgtggttcccatgtttgtcatgctcatcttctacatcccagtattttttttctgatacactgcttggtgaaagcatccctgctatattcgtatatttctggccaatgtatatacggttgttctacctgtattcaaccctgttatctatgggatcaggaaaaaacagatcccagactagggtatagacctaaagacatttgatgatcagtcacttctagtcatgatgatatatatattgggatatatatgcaaatatatatacacatatatgtgtgtgactatatatgtgtatatgtatgtatatatttgtgtttgtattatttttttatttcaataggttttgggggaacaggtggtgtttggttatacgaataagttctttagtggtgatttttgagattttcttgcactcatcacccgagcagtgtacactgtacccattgtgtagtcttttatcccttgccctcttcccaccctttcacccaagtccccaaagtccactgtatcaatcttatgcctttgtgtcctcatagcttagctcccacatatgagtgagagtatatgaaatatgattttccattcctgagttacttcacttagaacaatagtctccaattccatccaggttgctgcaaataccattatctcgttcctttttatggctgagtagtattccatggtatatgtatgtaacccattttctttgcccactcgttgactgatgggcatttgggctggttccatactttttgcaattgcaaattgtgctgctataaatatgagtgtgcaagtatcctttttggtataatgacttctttttctctgagtagatacccagtagtgggattgctggatcaaacagtacatctacttttagttctttagggaaactccacacagttttccataatggttttactagtttacattcccaccaacagtgtaaaagtgttctcttttcactgcaaccaaaccaacatctataatttttgattttttgattatgctcattcttgcaagagtaagatggtatcgcattctggttttgatttgcatttccctggtaattagtgatgttgagcattttttcatatgcttgtcggccacttgcttatcttcttttgagaattatctattaatgttcttagcccatgtgctgatgggattttttttttcttgctgatttgtttgagttatttgtagatctggatatcagtcctttgttgagtgtgtagattgtgaagattttttcccactctgggggttgtctgtttgctctgctgattgtttcttctgttatgcagaagctttttagtttaattaagtaccacctatttatctttgtttttgttgcatttgcttttgggttcttggtcatgaagtctttgcctaagccaatgtctaaaagggtttttccgatgttatcatctagaatctttatggtttcagatattaaagtctttgactcatctggagttgatttttttatcaggtgagagatgaggatccagtttcattcttctacatgtggcttgccagttatcctagaaccatttgttgaatagggtgtcctttccccactttatgtttttgtttgctttatcaaagatcagttggctgcaagtatttgggtttatttctgggttctctattcttttccattggtctatgtgcccgtttttataccagtacaatgctcttttgctaactgtggtcgtatagtatagtttgacgtcgggtaatgtgatgccttcagatttgttattttttgcttagtcttgctttggctatgtgggctgttttttggttccatataaattttaggattgttttttctagttctgtgaagaatgatggtggtattttgatgggaattgcattgaatttgtagactgtttttggcagtatggtcattttcacaatttgattctacccatccatgagcatgggatgtgtttccatttgtttgtgtcatctatgatttctttcaacagtgttttgtagttttctttgtaaaggtgtttcacctccttggctaggtattttcctacatattttatatatattttttgaagctactgtaaaagaggctgagttcttgatttgattctcagcttggtcactgttggtgtatagcatagctactgatttgtgtacattaattttgtatcctgaaactggtgaatttgttgaccagttctaggagcttttggatgagtctttagggttttgtaggtatacaatcatattatcggcaaacagtgacagtttgacttcctgtttaccaatttgatacctgcgatttctttttcttgtctgattgctctgactaggacttccagcgctatgttgaatagaagtgatgagaaagggcatccttgtcttgtttcatttctcagagggaatgttttcaacttttccccattcagtataatgttggctgtgggtttgtcatagacggcttttattacattgaggtatgtcccttgtatgctgattttgctgagagttttaatcataaagcgaagctggattttgttgaatgctttttttgcatatattgagatgatcatgtgatttttgtttgtaattctgtttatatggtgtatcacatttattgacttgcagatgttaaaccatctctgcacacctggtataaaacccacttgaccatggtggattatctttttgatatgctgttggatttggctcgctagtaatttgttgagaatttttgcatctatgttaatcagggatagtggtcagtaattttctctttttgttatgtccttccatggttttgatattagtatgatactggcttcgtagaatgatttggggaggattccctctttttctatcctgtggaatagtgtcaataggattggtatgaattcttctttgaatgtctgaggattcagctgtgaatctgtctgggcctggactttttattgttggcaatttttaaattaccatttcaacctcactgcttgttattggtctgatcagagtttctatatctttcaggtttaatctggagggttgtatatttctgggaatttatccatctactctaggttttctagtttatccacataaaggtgttcatagtagctttgagtaatcttttgtatttccgttatgtaagtagtaatatctcctgttttatttctaattgagcttatttggatcttccctcttcttttcttggttaatctcaccaatgatccatcaattttatttatcttttcaaaggagcagcttactgttttatttatcttttatattttttgtttgtttgtttcttttttatttagttatgctctgatcttggttatttcttttcttctgttgatctggggtttggtttgttcttgtttctctagtttcttgaggtgtgaccttagattgtctatttgtgctctttcagattttctgatgtagacatttaaggctatgaactttcctcttagcattctttgctgtatcccagaaggtttgataggttgtgttactactgtcattcagttcaaagaattttttaatttccatcttgatttcacagttaacccaatgatcattcagaaacaggttatttaatttccatgcatttgcatggttttgggggttccttttagggttgatttccaatttgactccaccagggtatgacagggtacttgatataattttgattttcttaaatttactgagacttgttttgtggcctatcatatggtctatcttgtagaatgttccatgtgctgatgaatagaatgtatattctgcagttgttgggtagaatgttctgttaaatatctgttaagttcattttttgtagggtatagtttaagtccatttttttttgttgactttctgtcttgatgacttgtctagtgttgtcagtggagtattaaaataccccacattattgggttgccatctatctcatttcttaggtctagtagtaattgcgttataaatttgggagctccagtgttaggtgcatatatataggattgtgagattttcctgttggactaatccttttttcattatataatgtccttctttgtctcttttaactgctgttgctttaatgtttgtttggtctgaatagctacttctgctcgcttttggtgtccatttgtatggaatacctttttccactcctttaccttaagtttatatgagtcctgatctgttaggtgagtctcctaaagacagcagagacttggttggtgaattcttattcattctgccattctgtatcttttaggtggagtatttaggccatttacattcaattttagtattgagatgtgaggtactcttctgttcattacgctattaattgactgaatgcctgttttttttcattgtgttattgttatataggtcttgtgagatttatgctttaaggatgttctattttgatgtattttgaggatttgtttcaagatttagagctccttttagcagttcttgtaattctggcttggtagtggcaaattctctcagcatttgtttgtctgcagaagactgtatctttcctgcatttataatgcttagtttcactggatacaaaattcttgaccgataattgctttgtttaaagaggcaaaaaataggatcccaatttcttctagcttgcagggtttgtgctgagaaatctgctgttattctgataggttttcctttgtatgttacttgatgcttttgcctcatagctctattatttatttagttagttagttagttagttggactctcgttctgtcacccagggtggagtgcaatggtgtgaactcggctcccttgcctccaaggttcaagtaattctcctgcctcagcctccccggtagctggaactacaggcacatgccaccacacccagctaatttttgtacttttagtagagacagggtttcaccatgttagccagactggtcttgaactcctgacctcaagtgatccgcctacctaggcctcccaaagggttgggattacaggtgtgaaccaccactcccagccttgcctcacagctcttaagattctttcctttgtcttgactttagagaacctgatgactgtgtgcctaggtgaagatctgtttgcgatgagttttccaggtgttctttgaacttcttgtatttagatgtctagctctctggcaaggctggggaagttttccttgattattccctcaaatatgttttccaaactttgagatttctcttcttcctcaggaacatcaatcatccttaggtttggatgcttaacatagtcccaaacttcttggagactttgttcatttttttaatcattttttctttgtctttgatggattagattaatttgaaaaccttgtctttgagctctggagttatttcttctgcttgttcaattctattgcaagactttccagtgcattttgtatttctctaagtgtgtccttcatttccagaagttgtgtttgtttttttatttatgctgtctatttcactgaagatttttcctttcatatcctgtattatgtttttgatttctttaagttggatttcacctttttctggtgcctctttgatcagcttaataattgatcttctgaattctttttctggtaattcagagatttcatcttggtttggatccattgctggtgagctggtttgatcctttggaggtgttaaagaaccttgttttgtaatattaccagaattgtttctctgttccttctcatttgggtagactatgtcagagggaagatctgggacttaagggctgctgttcacattcttttgtcccataggggtgctcccttaatttggtgttctcccctttcccctagggatgaggcttcctgagacctgaactgcaatgactgattttgctcttctgggtctagccacccagtgtagctacagggctctgggctaatactggaaagtgtctgcaaagagtgctgtgatgtgatctgtcttcaggtctttcagccacagataccagcacctgctccggtggaggtagcaggggagttaagtggagtctgtgagggtccttagttgtatttttgtttagtgcactggttttgtgttggttggcctgcagccaggaggtggcatgttcaagagcacatcaactacagtactagaaggaggatgtatacttgccctggggttgtctggttacgtattcaggtttctcaggtggtgggcagcgccatagagctctcaggatattatgtcctttgtctttggcaaccagaacgggtagagaaagaccaccaggtgggggcagacataggtatgtctgagctcagactctccttgggtggagcttgctgcagctgctgtggggaataggggtgtgattcccagtccaatggagttatgttccctggtggattgtggctgcctctgctgagtcatacaggtcaccagagaagtgggacaaagacagcagtcacaggcctcaccccattcccatgtagccacagtcctaaatgctggtctcacttccatcatgccccacctaccacaccaagtgtttccaggcagctggtgaccagttctgagaacttgccccagaccgtcagccaccccactgagaaagcaagctgattcagagttttttggcatctcaaggagcctgcagaagcaatccagttccttcaaagggtctgtggattatctcagcttacctggcatgttcctgcagtaattcttggagaaaagttaatgatgtgagtctctacatgctgccctgtctctgactagcctcctatttgccatcttaatctcagtcttgattctgtgtttgtatttttatctttcttgactgaatagtgtataaagaaatgtatcacactatgattttttttcaaagtagcacatttttggttttgttttttttcctttttctgttcattttctatcttattgagttcggctcatttctattattttcttccttctattttttgaatatgcttttcccatctttttctagatttgtaaggcagaagcttatagaattgatttcagactctcatttttttcctaataaaaataattaatatgcttaatgctccattcacagcaatctgggctttttctaccttgcttctccaaattcttcaagcttctatctattacccagttcaaaaaccacttccatattttcaggtatttgttgtagcaacaactctactcccaatatcaatcttcctggtactgttttgtgctactataacaggatatcagagactgggtaatttataaactatagaactttatttggctcacagctctggaggctagaaagtccaaggtcaagtgacctgcttctggtgaaggccttgtcactgggtcatctcatggcagaaggcagaagggcaagagtgtatgtgcatgagaaagagagaagagagagaattagaaatggagagttgaatctgcttttataacaaacccactcccacgatagcagcactaattcattcatgagggcagggcccatgtgacataatcgcctcttaaaggtcctacctcccaatactgttgcattggggtttaagtttccaacacatgaatcttgagggacattcaaaccatagcagccatattatactgccatcattctactttaagttattgtgcccttctttatacaattaattccccaaaagcagagatgaataacatttgatcttttctcacaagaccaaacagtgattgtcacttaatctgactgagcagattattctgttatgtaaaactttttaaaactagtttgatgcactaatactttccacaaaccttcttacatgatttcccacatatttaaatgacttgtttatgaaatttttcctctttggtcagttgcttgacgatctgatcagtgccttgttattgcttagcaacgactgttgtattgaggtttccaagtttctccagaactgttttgccaggtcccaagctggcagaactgaatgcctttagcgtcctatttctcctgactatgcggccaatgtcatcctccattattttgtttccaaataagcagccagatccttagtagctcattgactttcagaattcattgagaacagaaagacaaggtatcttctggtattttgagaaaatatatgtcctttgaaaagttagctttaggagatacacctaatgctaaatgacgagttaatgggtgcagcacaccagcatggcacatgtatacatatgtaactaacctgcacattgtgcacatgtaccctaaaacttaaagtataataataataaaataaaataaaaaataaaaaaagagaaaagttaatgctaaacagagaatagaagtaagaaaatgcagtgtctttgaattggaaaaagaaagattgtacttcctctccaccaacaaaaagacagaagaaagaggagaacaaatgaattttctgacttgaagttataatcctacgagggaaaaaatgctgctcagtaactgcaggagttcttgaccactggaacctcccaggtgtcagctttttcacaaaatattggaatatttgaataaatctgggattatctaagggagggcagttgggaagaccagttgggtcagagaagcaatcataacacatatttaatatacctttatactgatggatgaagcttcaaattgacagttgagcagattgtcattaaataacgaaaagtacctaagtttttatccaaagcttaattgttcctctctttgctcctaaaactcaacatgctttctctcttagtacagaacctctgcatgtgtgtagttttcactgcctaaaataatcttttcatccttctttgcttaggtgattcctatttttctttcttgttcaacctacttaggtttacttaaaatgaccttacccaaccttcaatattatgttaggctgtcaggctccactgtaacaggcttctactgtagcacccagaaagtttctttctttgaaataactgaccacaactgtattgaagtgaggctcaatgcctacttttccattatacattatacttcctattaatggggacagataatatttacaaagtaccatatatcaggcactatgattagtattattcatgttacatcatttaataaatgcaattaacatgagatacatgctaagtttatgactattttccggaggaggaaatagatgcacaaagacataaaaacaacttgataaaggcttcacacacagcaagtagtgaaaccaaaatttgaacccaggaagtataattccagcatcaaggtgttaactaccacttcaccttcatttatgaaagtacaaaacaatgtagttcatctttgtaaataagaaaagctcaatatttattacatgaaatatccaccatacctctttaactgctatttcaatcagaattcttactttcaagcaacaaaaaataattctagatattttaagcaaagaaaaattattgaaaagatgatggatacctcacagaatcactaggaaaacagaaaagtaataaaataaaagaaaataaaaatacaaaccaagtaacaaccaggacctctgtaaaattaatccagagaactaattctgtgctgaagtgttattgcaaccactgctgaacttcagatgacatggtttatataaatagttcttttgtgtttatttcagatggttttcgaacattgatcaagtaactatatataatagtgaccactgtggaaaatcattttgatttaaaattttagtagttaatacatatgattcagttataattttagaaatttttgaggatttatgtctcgagaaacttctctgaagttcaatttacagttaaaagcatcataaaagcgattttaagtgaatgttttatagtgtattttaatatagtagacattataatatgttttaacagaataagtaat

SEQ ID NO: 254 - DNA, 52101 bp, Homo sapiens
cataaacctagtgggatttttgttatgttgtagaatataaacattttaatagcaaaacccagaaaattcctcatataaagggcatttatgaaaaacccgtggctgacatcatactcagtggtgaatatccaaagggataattaagcttttcccctaagatcatgaacaagacaagggtgcttgcttttatgactactatttaacattgtactggaagttcttgccagagcaattagccaagaaaaagaaagaaaaattattcaaattttaaaggaacgagtaaactacctttatttgcagaaaacataatattacatgtagaaaatcataaagaattcacaaaaaactattagaactgataaatgcagcaactttgcacaacacaagagcaatactcaatcagttgtattttgctgaacactggtgaagaaaattaatgaaggtctaaataaatggaaaaatatttatgttcatggattgggagatttaatactgttaaggtggtcactttcataaaagttatctatatatcatgttaaattcctattaaaatctcaatgtcttcttttgcagaatggagagagataaaactaaaatacatatagaagagaaaaggcccttgaatagccaaaacaatttaaaaatgaaaaacaaaagcgactcacattttcttattttaacacttactgcaaagctattatactcaaaaaagcatggtgctgacataagaatagtcataaaactcactggaatcaaattgagagttgagaaataaacccatatgtctctggtctattgattttgggccatgatttcatgaccattcagtgagaaaacaaatagtctggctgagtttaacacagcatgatgactgtaattaataataatgtactgttgtactttgattttgtaccctgaaattttactaaagtcgtttattagttctaggagccttttgacagagtctttaggattttctaggtataaaattacatagtcagcaaggagatagtttgacctccttttctatttggatgctttttatttctgtcttttgcctgattgctctggatagaacttccagtgccatgattaatagaagtggtgagagtaggcatcattgtcatgttctgattctcaagggaaataatttgagcttttgcccattcagtatgatgttggctgtggatttgtcatagatggctcattattttgaggtatgttccttcattgcctagtctgttgaggttttttttctcttatcatgaggggatgtgtagttttatcaaaagctttttctgtatctactgagatgatcttatggtttttgcttttaattcagtttatatggtgaatcatgtctattgatttgcctgtgttgaaacaaccgtgtatctcaggaaaaaaagcctacctgatcatggtatatgaacctttcaaagtgcctctgaatttggtttgctaatcttttgttgaggatttttgcatttatgtccataagaaatatagccctgaagttttttgttgttgttgttgtctctgccaggttttgggatcaggctgatgctggcttcatagaatgagttagagaggagacccttctccttgatttttttggatagtttcagtagaattggtatcagttattctatggatgtctagtagaatttggctgtaaatccgtctggtccaggacttttttttttattggtagtttctttactactgattcaatttcagaagatgctatttgtctattcaggattttaatctcttactgattcattttaagagattgtgtgcttcccaaaatttaaacatttcctccagattttctcatttgtgtgaacagaattgttcatagtggtgtctgaagatcttttgtatttctgtgagatcagttgtaacaccacctttgtcatttctgattgtgcctatttagatcctctctttttgtttgttaatctagctggggtctatcaatcttatttttttgaagaaccaagtattgatttcattaacattgtgtatatatttttgcatctaaatttcattaaggtcttttcttactttattttcttctgctagctttggggttggtgtattcttttttttctagttcctttaggtgcaaagttagtttgttaatttgagatctttctaccttcttgatgaagttatatggggctataaactttcttcttaacactactttgactgcatgccagagattttggtaaattgtgtccctatttcattaatttaaaataatttttcatttctgccttaattttgatgttcacctaggagttatccaagagtaaattgtttaatttccatgcatttgtgtggttttgagagcactttttagtaatgatttctatttttactgcactgtgatatgagagtatgtttggtatgatttcaatgtttttgaatttattgaggcttactttatgactaagcctgtaaccaatcttagaatatattccatatgacgatgagaagaatgtatattctgcggttgttgggtggggtgttttgtaaatgtctattatgtccaattggtcaagggtatagtttcagtgcagggctttgttgttagatttttgccttaatgatctggctaagactgtccgtggggtgttgaaatatcccattattgtgtggttgttttactctttctgtgggccaagaaaaagctgttttatgaatatagatgccccaatgttgaaaatgtacacatctaggatagttaaggcttcctgttagattgtaccctttatcattatgtcatgccctgtgctgtccttcttaatttttattggtttaaagtctgttttatctgatacaagaatagtgatcgatgctttttttcattttccatttcatggtacatctttctccatttctttactttgagcctgtggatatcattacatgtgagatggatcatttaaagacaccagatggttgggtcagtgtagaaaaatcagtagcatttctatacaccaataacatctaagctgagaatgaaatcaagagcacaatcccacttacagtagctgcaaataaaatgaaatacctaggaatacagctaaccaaggaggcaaaagatctctacaagagaactacgaaacactgctgaaagaaatcagagatgacacaaataaatggaaaaataatccatgctcatgaattggaagaatcaatatcataaaaatggcaatactactgaaagaaatttgcagattcaatgctatttctatcaaattatgaacatcgttcttcacagaactagaaaaaactattctaaaaagagtttacactcatagaacagaataaaaaacacagaaataaatttgcatggctacagtaatatgatcttcttgacactgacaaaaacaaacaatgaagtaaggaccccctattaaataaatggtgttggtgtaactgtttatccatatacagaagattgacgatggatctgtacctttcaccgtatacaaaaatcaactcaaaacggatcaaagatttaaatgtaagacctcaaactataaaaatcctaaaagacaaccatagaagtactcttcttgacattgaccttggcaaaaaatatttgggtaagtccccaaaagcaattgcaacaaaaacaaaaattgacaaaagggacctaaataaactaaaaaatattctgcacagtaaaagaaactatcaacagagacaatcccctacagaatgtgagaaaatattcacaaactatgcatctgacaaatatctaatatccagaatccacagagaacttaaatcaacaagcgaaaaacaatcctattaaaaaatgggcaaaggacatgaacagacatgtctcaaaagaagtcatataagcaaccaataaacatattgaaaatgctcagcattactagtcatcagagaaatgcaaatcaaaaccacagcaagataccatctcatataagttagaatggctattattaaaatgtccaaaaaaacacacacacacaaaaaaaaacaggtgctggtgaggctgcagaaaaagggaaaccttatacactgttgttgggaatgtaaattagcccagcaactgcggaaagcaaactggagatttctcaaagaacttaaaagagagctatcatctgacctaggaatttcattactgagtatatactcaaaggaaaataaataattctgcccaaaaacacatgcactcatgtgttcattgtcatcgctgtggtattcacaatagcaaacacatggaattaatccaggtgtccatcaatggtagattggattaaaaaaagtggtgcatatatccaccatggaatactatgcagccataaaaagaatgaaatcatattctttgcagcaacagagatggagccaaaggtcataattctaagcaagttaacacaggaaacgaaaatcaaatgttgcatggtctcacttataaatggaagctaaacaacacatggacataaatatgggaacaaaagacagtgtggactattagagggtggagggaggaagtaggctgaaaaactgcctatcaggtactatgttcactacctgagtgatggaattcacaccccaaaccttagcatcatgcaacagccccatgtaacaaacctgcacaagtaccccctgtatctgaaataagagttgaaatttactgtatatttcaaaatagctaaaagagaggattttcttttttaaattttattattattatactttaagttttagggtacatgtgcacaatgtgcaggtttgttacacatgtatacatgtgccacgattgtgtgctgcacccaataactcgtcatttacattaggtatatctcctaatgctatccctaccccctacccccaccccacaacaggccctagtgtgtgatgttccccttcctgtgtccatgtgttctcattgttcaattcccacctatgagtgagaacacgctgtgtttggttttctgtccttgtgatagtttgctgagaatgatagtttccagcttcatccatgtccctacaaaggacatgaactcatcattttttatggctgcatagtattccatggtgtagatgtgccacattttcttaatccagtctatcattgttggacatttggcttggttccaagtctttgctattgtgaatagtgccacaataaacatacgtgtgcgtgtgtctttatagcagcatgatttataatcctctgggtatgtacccagtaatgggatggctgggtcaaatggtatttctagttctaggtccctgaggaatcgccacactgacttccacaatggttgaactagtttacagtgccaccaacagtgtaaaagtgttcctatttctccacatcctctccagcacctgttgtttcctgactttttaatgattgccattctcactggtgtgagatggtatctcattgtggttttgatttccatttctctgatggacagtgatgatgagcattttttcatgtgtcttttggctgcataaatgaattcttttgagaagtgtctgttcatatccttcacccacttgttgatggggttatttgtttttttcttgtaaatttgtttgagttcattgtagattctggatattagccctttgtcagatgagtaggttgcaaaaattttctcccattctgtaggttgcctgttcactctgatggtggcttcttttgctgtgcagaagctctttagtttaattagatcccatttgtcaattttggcttttgttgccattgcttttggtgttttagacatgaagtccttgcccatgcctatgtcctgaatgatattgcctaggttttcttctagggtttttatggttttacgtctaacatttaagtctttaatccatcttgaattgattttagtataaggtgtaaggaagggatccagtttcagctttctacatatggctagccagttttcccagcaccatttattaaatggggaatcctttccccatttcttgtttctgtcaggtttgtcaaagaccagatagttgtagatatatggcattatttctgagggctctgttctgtttcattggtctatatctctgttttggtaccagtaccatgctgttttggttactgtagccttgtagcatagtttgaagtcacgtagcctgatgcctccagctttcttcttttggcttaggattgacttggtaatgcaggctcttttctggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaagaggtccttcacgtcccttgtatgttggattcctaggtattttattctctttgaagcaattgtgaatgggagttcactcatgatttggcaccctgtttgtctgttattggtgtataagaatgcttgtgattttttcacattgattttgtatcctgagactttgctgaagttgcttatcagcttaaggagattttgggctgagatgatggggttttctaaatatacaatcatgtcatctgcaaacagggacgatttgacttcctcttttcctaattgaataccctttatttccttctcctgcctcactgccctggccagaacttccaacactatgttgaataggagtagtgggagagggcatccctgtcttgtgccagttttcaaagggaatgcttccagtttttgtccattcagtatgatattggctgtgggtttgtcatagatagctcttattattctgagatacgtcccatcaatacctaatttattgagagtttttagcatgaagcgttgttgaattttgtcaaaggccttttgtcaccacaaggaaatgataaatatttgggtgacagatatgctaattatcatgatttgataattctacaacatacatatatatcaaaacatcacaattcaccccataatatataccattattatttatcaactaaaaatttaataaaactttaaaacaattgtgccaggacaactggatatgcacatgataaaagagggaagttggctgaggtgcggtagctcatgcctgtaatcccagcactttgggatgctgtagagggcggatcacgaggtcaggagattgagactatcttggccaacatagtgaaacctcatctctactaaaatacaaaatattagccaggtgtggtggtgtgtgcctgtaatcccagctacttgggaggctgaggcaggggaattgcttgaacgcaggaggtggagcttgcagtgagctgagattgcaccactgcactccagcctgacaacagagcaaggctccatctcaaaaaaaaaaaaaaaaaaaattgaagttgcacccttaaataacactatgtatatacaaaaattaaaatgaatcaaaaacttaaatataactaaaacaatgaaactcttagaataaaacatagggtatgtcatgacttcagatttgatttcttacatagggcaacaaaaacagagcaatgagttataaattagtgaatgaagcattaagatcaaaaacttttgtgaattaaataacactgtaaagagattgaaaagacaactcatagaatgggagaaaatatttgaaaatcacatatctgttaagagtttagtatacagaatatacaaagaaggactcatacaatgcgaccaaaaaaattgtaaaaacaattttaaaatgggcaaaccacttcaataggcatttatttaaagatatacaaatggccaatgtgcccaggcaaagatgctcaatatcatcagtcactggggaaatgaaaatcaaaaagacaatgacacatcattggacatctactatgattactataataattttaaacatggaaaatggcatgtgttagagaggatgtgataaatggaaacactcatacattgctggcaagaatgtaaattgatgtggtcactatggaatagtttggaactttcagggaaagttaaatgtagaattaccataagacccaagatttctacttcttaaaatgtactcaaagaattgaggccgggcgcagtagctcacacctgtaatcccagcactttgggaggcgaaggcgggcagatcacaaggtcaggagatcgagaccattctggcgaacaaggtgaaaccccgtctctagtaaaaatacaaaaaaattaaccgggtgtggtggcaggtgcctgtagtcccagctactcaggaggctgaagcaggagaatggcatgaacctgaggggcagagctttcagtgagcaaagatcatgccactgcactccagcctgggcaacagagcaagactccatctcaaaaaaaaaaaccaaaaaaaaaaaaaccaaaaaaaaaaacaaggaattgaaaacaggtgttaaaaaaaaaaaacaaaaaaacaagaatgttcatagcagtattattgacaaaagccgaaagatcgaaacaacccaatatccatcacttgatgaatgtataaacgtgtgatatatccatacaatggaattttatttagccataaaaagaaatgacgtactgataaatgctgcaacacagatgcaatttgaaatcatgataggtgaaagaaagcagacacaaaagcctacatattgcatgatctcatttacatgaaatatccataataaattggtaaagaaaatgcacagaaatagaaagtagattactggttttcaggggctggaagaagaaaagaatggggagtgactgcttaatgggtacagggttcacttttggagggatgaatattctgaagcgagatagtggtgatagttgccaaaattgtaaatgctctaagtgccactggattgtaaacttcaaaatatataaaatggtaaattttatgttatatgaattttgtcaatgtaagtaaagagttgctggttatactggatacccaacagagcccaaaggaataatccaagcaactcataaaatgaaagacaggaagataagaaataaggaaggagagaaaaagataaaatgagacctgttataaatattatctgaaataacaagaactggaaattgaacaagtaatgggcacagggttcactgagatctccctagagcttcccttcatctggtgcaataacaaaggggaactactcttcattttaacctcagtgtctcagacactgtggcacttggagactttattaaaactcttctgcgccagcaaacacacacagacatttcgttaacatttttcagggtgcactgaagctctatgctaaaccatttatatatatttcaagaactgaatgcatagttgttacttgactccttaagacagaggaagaaatcttggtaagggtttccaatcagcaactttgtgtaatatatacttaagattggaatttgaattaacagaaattgagttaagacctggagaatcggggtggagaataaaatagtacatatcagcagtctaagaagaggtaagataaaaaaaacgggaagatattggggagaaaaatatttgctagacaccttcaatatttcacgcatatgtgactttatttatcccacttgataataatatcatgtagaaattactatgcttatttctagaagaaacttagactctgaacatagtgtaacttatgtaaagtcagaaagccagaaataacagaatcaatactctattccatgtcacagtgccaataatattaaaaattctgtgcttttgcttctttttcctacacaaaatgccttataatgagatagtgagtgatacagagagtgacaaaattccatagaaggcaaagaagaattgcttaatgagcttgaatttgtttatacttagaaagactatgaatgtaccctgttatagaaaaggatacaatatggtgattagctgttggtctttcttcatgcttcatatttcaaatggatttaactgaactcaaatttgattattaagaaacctgaatttataactgagcccaaggcccatataagacatgaggtaaaaagctcacatatagcagtagtaaataatatatttggaactaaataagcagatgtgtgctaaaaaatttgactttacccagagagaggtctgtcctttgctcctggcttctagaaggaaatatacacaatacctaataagagagtctttgtttattagactggggattggtcacactagatctgagggtagggactggccatgtcataaagatcaacaatatgacttagtgtggggactttgggtcatgtgacaccagtaaacctggagacggagttcaaccacatttgcaatcaatccagccatcatacctatataatgaaatcccaataaaaactctgaacaccaaagcttgggagaatttccctagttggcaatatgacttcatgcatattgtcacacattaatgccataagagtaatgcatgtttactccatgaaaggacaacaaattcttcagatttggacacctcagtttcttttctaagcatctctttatttgtctaattttaatctgtgtccttttcctgtaataaactgtaaccatgaacataatagctttcagtgagttctataagtacttctagtgaattattgaagctgagggtggttttggaaaacctctgaaattgcagttaatgacagaagtgagggtagtcttcgggactgtacccttaagttttgaagtttagagagctccaggctaatctaatttgatgtcacatttctttaaactgttagcaaggtcaataggctcttgtaaaagaacttcatatggtggaaaaccttcacagataatcattctcccttaccaatttactttaaattcccactaagggataccttccttctagatacctagaccctagaaaaggtgtggatctgcttcttgactcaattctgttgtattgtgttttttttctaataaaacactgttaaaattatcatcactttataagaagactcagtgtctgatagtgtaaatcctgcagattttttcttctttgaagaagttttggctcttctaaattctcgtatttttcctcataccttacttttctttcttttctttctcctttcactatacctgacagcaaatattgcaaatatagagccagattaatgttacatatctgaatttcaacctagtttcaaattttgaatttcctacctattagctgtaaatgatgggaaattacttaacttagcaaaactttgctgttccataaaatcagataccagtagaacttgtgtcatgaaatttggcgagaactaaatgagataatatatgtaagtagcagtagatgcaaagactgaaaaatagtagatatctaatcaataatagctattattactgtggttcttattatcataaattttattttcatcaactcatagtgtctatatcttgagaaagaagggaataagtacatttatttactctgaactcaaaattttaggagagacatagttcaagcttctacttggcagttcagcttctcacattcatggtgcgggtaaggagtgatactaggattatgtatggaaaatgaaaagaaggagaaaaaaacaaaggcctttacagaaaggtattcttaatatcaatcctttgtttgaggatttgtttatttatttgttttagatctcaattaagtctcgatgaattgcccgacgggaactgaaaagaacttttaaagccatggccgctagcagttggcagaagaatgtcttctcccaatgtcactgaaccccacctctcttccttcctgttggttaggaattccaggattggaagctgcacaacgctggctaggctttcccttctgtgttgtatatctgattgctcttgttggaaatcttatcattctatttgttatctggactgataaaaaccttcaccaacccatgttctactttctggccatgctgtcagtcatgacctgagtctttctacatctactatccccaagatgttgggcatcttctggttcagccttcaggagttgtgctttgggtgctgtgttgctcaagtcttttttatccattttttttgcagtcatggagagcattgtacttcttgtcatgggatttgatcgctatgtggctatttgcaaccccttcaggtagaccaagatcctcaccaacagaattactggtgtgattgctatggttgtggttcttagaagcttatgtatgattgctcccatcatttttctcctcatgaggctgccttactgtggacatagaatcatcccttatacctattgtgagcacatgggagtggctcgtctggcttgtgccagcatcagtgtcaatgtctctcatggtcttgggaatatttttatcttgtttctggatatgtttcttatcatcatctcctatgctagaattttatgcacagtctttcacctcccttcccaagaggcccacctgaaggctcttaatacctgtagctcccatatctgtgtcatcttagcattttttggcccagctctcttctcctttctcactcatcgctttggtcatggcatcccacagtatatccatattctcctggctaatctctatatatagtcattccccctgctcttaacccagtcatttatggagttaggaccaagcaaatccaggagcgggtagaaagtctctttactaaaaattgattgaatgggagagaatttcaggttataaaagtgtaagtcctaaaaagacaaaatttgtgataaaattaataaattgtttttgccaaaatggaccatcaattttatacatatatatattttatacagatgtgtgtgtatatttatttatttatacatatgtatgtatgcgtgtatgtttaaaaacatattggcagcaattgctagatgtatgtgtgtttatgcatgtctgagtgtgtatttgcaataatgttatctattgacccctaacacagaatatgccatataaaagtaagtttcaaggaggatcactttaattcactgaaaatgtcttcatttttctctcagatatgaataatggattgaatgagcattgaattccaagtgcaaaattattttttttggacatgatttttttaacattcacttttgcatttgagatttcggatcccagtcagattatgttccctttaatctatgctcttttctctgtctctctcacttgaacttttattctctttctctcaactctttttctgtgaaatggtttaagattttctttttattttttgtgttcacaatttctaccaaacagtagtacctaagtccctactgggcctctattgaaactgtcaatattaagccttaaataatttttcaaatgtagaaattttctttattattctctccttctttatttttatttcaccttttgaaacttgtatctatgtcagaaataaatacgctcaaaaatacctcgacacagaaatttatacagtattttataataaatacccagtcataaaatagctttatcaggtgagtagttgacacctcattactttaaggaataaagaatattaaactatatatgtgaaattaaattgatgattattaaaacttgtggacatttttttttttttagttactttgatattaactcttcccattgagtttgcatgtattttgtatgctaaattagtaaaaaaaaatcactaggaatgtcatagaattgggtgaaatgattgtggtagtaatattcaaaattgaatttgaccttatctcgcttgaacaatattccacttaggtcattcaggtctttaaaatgaaccttagactaccattttttattttctattgccatttttgaaaaccatgaatgtgttgtttatgtcaattttggccatatgcaggagggttacttaagcccaggatttcaagaccagcctaggcaacttatggagaccctgtttctataaaaaataataataaaattttttaaattatatttttatatactaataaaaaatttataaattaaaatcttgaaaattatatatttttaaatggcatcgatcattaaaaagtcaggaaacaacaggtgctggagaggatgtggagaaataggaacacttttacactgttggtggcactgtaaactagttcaaccattgtggaagtcagtgtggcgattcctcagggatctagaactagaaataccatttgacccagcaatcccattactgggtacatacccaaaggattataaatcatgctgctataaagacacatgcacacgtatgtttattgcggcactattcacaatagcaaagacttggaaccaagccaaatgtccaacaatgatagactggatgaagaaaatgtggcacatatacaccatggaatactatgcagccataaaaatgatgagttcatgtcctttgtagggacatggatgaagctggaaaccatcattctcagcaaactatcgcaaggacaaaaaaaccaaacactgcatgttctcactcataggtgggaattgaacaatgaaaacacatggacacaggaagcggaacgtcacacaccggggcctattgtggggtgggggcagcggggagggatagcattaggagatatacctaatgttaaatgatgagttaatgggtgcagcacacaatcatggcacatttatacatatgtaacaaacctgcacattgtgcacatgtaccctaaaacttaaagtataataaaaataaataaataaaataaataaataaataaataaatggcatcacagaacatcaaatgctttgacctaactctaacaaatgatatgcaaaacttctaaaataaaagcataataatccttcaaaggaactttttaaatacataaatacatgaaaagatatacctagttcatgatttggaataatcaataaccttttaaaaacattctctaaaattgaactatatattcaatgcaataaatattttaatgaatttgtttgcttatttgtcctcttgtttttgttttcaaagtgttataaacattttaaaagaaattggctggaaatcctgaagaacaaaattttaggatttatgttattatattccataatttattttatagtatcacttatgaaaactgtgaaatacttgtacaagaacagacaaaaagcagaaccacacagtccaaacacaaaaatacacatgtataaatgtataatttatgacaaacagctttttaataaatgaagcaagatcaaatgaatagccaaagtaaatcaattatatattgaaaaataattgcctctatgtcactgccctttcaatgtgatagttaatatcctctcatcaaggggttaatcttgacaatgtgagcaagatggactactaaaatgttccagctcttagttgcctcacaccgatagccagaacaatgaattaataattacattttaatgaaagtaactgaaggagaggagtgctcatttgtgagaccctgagcctagaaccctggctccacagccactccaagccactgtacttcgagcccagcgctgctgcagctgcttataggccatgtcaaatctgagggattctgtcagctgagtcccctcactgcgggaaaaattaaaaataagaggaccccaaaagcccttgacactaaggacataaacaaattgtgccaccactactgctgtgccactacaaacttctacagtctaagccactgaggcacccacagttattgctgacattaaactcagctcaggaagctgcacggagactatgctacacccatctggaaacagagtcaccacactcttcccaactggcacactaaaacccaactgcaggtgatagttgtcctgtataaaaaccactctggaaagtttggagataagcagatacacaggcatcaatatagagacacaagaaacatgaaaaggcaaagacatatgataccaccaaaggaacataacactgtagtaacagactccagtaaaaagaaaatcaacaaattgccaaagaaaaaaaatcaaaataatgatgctgagaagactcaataaaatacaagaatatacagcatagacaattcaataaaatcaggaaaacaattcatgaaacaaatgagaaattcaacagaagataaaaatcataaaaatcaaatagaaatcctgtagctgaagaattcaatgaataagttttcaagttacaatagagagattcaatagcagacttggtcaagcagaagaatctgttgacaggttgtttgaaataagtcaaagaaaaacaaaagaaggatttaaaaaagtaaagaaataatggtgttccttaatgggatgccattaagtaaacaaatatttgtattatgagaattctagaaggagaagagaaagaaaaggacaaaggaaacctatttaataaaataacagctgaaaactttccaaatatgaagagagatgtagatatccagatccgaaagctcaaaatcccctatgtaaattcaactcaagaaggtcctccccgaggcattataatgtcaaactgtcaaaagtccaagacaaaaagtctctaggcctttaggctatttggcatgaggaaacagtgaaaatagtgggaaaatatatccaatccttcaacacttttcagaagtaatgtcctcagggaacagctgggtttctgtttcaaaaggaagagaaacagaacatcagaagtggtttaaggccaaaaataatatcactgctcataaaaaattgattctagaagtcacagtgaaatagtcttgggaataggagaggggtaggtacagtgaccaattaggagatatatgattatatgatatgaccctaacagaactagaatttttatgttttaaaaataatgtaattcaatgccagaacacctcctacaatcaaagcactatactaagtgaactgaaggataaagttgacttaaacatcactctaatatcaatccataaaataatggaagacagaaaacacaaaaccaacacaaaataaaatttgcctgttataatagtggcacacactgatgtgaaaatacaaaagacacaaagattatatcagattgattcatatgaaaggtcattaagaagtataggacaattgagaaagtgctgaagcaaagtagaaatgagatgaagttatttcatatggaggacttttgattatcaaagacaagatgtgtgttcgggagtcatgtagtataatgaaagtataaaaagttgattgggtattgagtgaaggactttggcaacaatggtgtttgccccttattacataaagtctacagtatacaatggagaatgtaggggtcatgggaaggaattttaagcagaaattggatagagtcagacttgatttgggaagataaatgtggatacagtaaggaagatggacacaatgagggagaaacaggaacctcaggagttactttctcattaatcaaaagagaagtaatgaacacaagaacgtggcagatcaaaccagaatctctcttggaccacagacgacattgctgtttctgtgctaacaactcaaaatagtctgaacttaggaggcaaaaaataccaactaattgtctaatgtacttatttttccctcagtctatttctaactatagtcaggaaaaccaggctctgcagcatgtcctggtagtactatcgggtctactatgtcatcattcaggaagggagcctctcaggaaacactacctctgctctggctggaagggacaatataatatgttttataaggaaaacgtagaattttcttcactttctgccaaaagagctgaaacacatgaaagcctctcttcaaagactatctgttcaccattagttatagactgagaaggagaatcttggtgggttggaagaaagttgctgctattatctgcaggcatgcacactgccaataaacagagttgtaccacagagtctaatttgtctatttgagatgtcttctccttcatcttttgaagcctcaattgtaacagctgtgaaactacatcaggatttacacaaacatattaaaacagaaaagttgctgagaacagtttcatggtcacactgtgaagagttaatggtccaaaatcaatgctttcatggctcctgagggaagcggaattaacatcattccccaaacagattcctctctcttcaggatagctcccttcccatcctttcataacacatctgctcccctgagctaaggagttatatctagcatggtgtttctctgcagatgcagtgaagaggaataaagacttactatgacttaatgaccctcgagtccatgtttctgcccagaggattccgaagactaggctcggggattctgggacatgcctggtcatagggatgctctcactcactataaagttgcctccactttaccaagcaggcttgttgctcagaggcttcaaggggaacctaatcacggtctttaagaacctggactcatgctccaattctgctccaagtgagggctgggagaagaaatattacagaggtaagaatgcttgtgcaggagaagtgaaaagatacacaggagagaagaagagggcaaatgaggatagagaggccagattcttccacttttctgaggaattatcctaagcaccattgcaccattttcttcacagaggaacacaacagagcacatgggattggtgagggcagtggtgtaccaattagtaatgcacagaatttctgtctgtgtatctctctctctcccccctttctctctgcccctctctcttacacacacatacactcatacacacacattctcacagagtacactgttcacagccgaaacaccacaaatacagtcatatagtagcatggccatacttgttgtcaataagacaaaaggatgttattgcagacttcttttgtatgtgtttatttaaggtggtgggtgggtatcacatgtcaatattcaaatacaattacataggcattaacatatttggtctgtaaagttttattctctgtttccctcattgtctgagtgaatttaatgttgccagttgtaacttggttccctatatccctactactttatggaaccatccccaagccatttttattgtaagcacaatacccctgctagatcagccggactgaaccgccaatggcacagttatggaagagcctgaatgaaggtatttatccactttatccattcatcaactgctttggtctcaccaagattgggaaagctgtaagaataagaggagaaaattgtttcttttctaaatgagcagtattgggtcatatttgtatccataaaaatctagacataaatattaatgtctgactctgtgccatttcttcactttggcctcttctgagccattcctcctttatctaatcttaggccaaactgtgacataatttggactttttacaatgaaataacttctttctgctaacaggtgaattattttagctatcttgcatttaaataaacaaaatatttgggagcattaataaaataagtaagtataatttgttgaggatacactatgcactagcacctatacaaacattggtcttatttatcattaaaataaaccacattagttataatttatcatctcatttttacaggagaaaaaaaaactgatctatctggttaaagaatctgtccaagggtctcaagcaagtaaatggtttagcaggttttccagccatgtctgaaaagttttaaggtccacagaagacttctgtaatattctactacagtcagcaaaaaaataaaaatccaacaaagtaaaaaaaatcacaagttcaaaatgtgaactttggtgagcacaataagagaaaaattgctaattgttatgaatttgtcttttcagatggactccagtagggatctttgtcaatgtgcatatctagagaagaacaaacttaataatttgccctcaaaaaatgatcttgaggttattggccatacactgtctgctactgtggcatatagttataacagaaagaaggcaagaattcaggtaaaactgtgagagggtggatgtgctggcagctttgaattttactgtcagagaagcgtcctctttgccatctccctgggaatgtttttctcagctggcaaagtatcatgttgagacacagccacccttaagattgggctgactctggactgtaaatctcacaacacatcatcctagctatttcctcagactctcccaggtgaaatcacaaaaaccactgccctctgatttttcagcctggcatcttttcctcaatactggcaaacattatgttcttttttcaattttctctcagcttctcggggaccaagaaatgctcttgttcttctcatacagaatggggaattattaactcctttgcttgtgtacttctgctgtaaaatagctacctggcaaagttacaggacaactgatgtatgcagccacgtacataataaaacatgatttctctctctactcctatctctccaaccttctccgtctctctctctctctctctctctcactctctgtctctgtcacacacactcacacacaaacaaaagcacacttattacaaaccccaactctgattcaattaaatgctgaacaactgggaaccaacattcatgtggcagttttgagagtattacaatgattacccctggttctcaactcttagttgcagctattctctttgtagaaataaggccagtacatgcataaatattatacaatccaggttacattagttgctacagagttgtacagtgtctttagggatgcaaagttaaaataaggtaattttccttgttattgtcaaggaatcaatgaagagtccttaaaacattttaatttcaatattaaaatttgctaaatatttgatctgtttacacctgaaggtaggcacaattttgggacatgggaattttttttatgttactaactgatgttatagattgtaaggaagataaacataatttggcagatacacacaaggcattttattggaaggatatcagggaatcagaatgacaggatcttggagaaactggattgttcatgaagatttagaagcatcaaaattagtaattaatccataatagaaatgcacttatcagtttagctgagttagaaccaggaaagttctaacagagactgattaactacacttatgtgatgtcactgtataagatccttacgtttatattataataaaacatagaaagtggtagacagtagtacttctcctttgtactaggaatctttgtctcatctagaaactattgagatactcagaattttagtttctctgaattacatccataatatttatattattagacattagagcaaaatttaaatatttaatattaaaataatattaacaaactattatataaaacataatttggtactttttgttaaaatcactgtttttcaagaaattagttgtaaaaatggtatcattttcctttgcaaatatttttattgtctaagttaagataatagagctgaaatctcacaacatcatttacaatttcatttaatctgttatggtagcacctcatataacctctggaaaatttcactatgtacttatgagagaatgagagtgagaatggctaaaaattttctattataaaaatagttttgagcttgtgaacttctggaaaggtacttagaaaaccccagagatctcaagaccacacttcaaagaacacatggaatggtgatttcccaaaaagtaaagaagggctacttaggaaagtaatggaagggaatgccgtaatataaatatgcattgcattatgaaatttttcccattctttcaaatatctcaaagattacaaaacataaagccataagcaatattgcctatgatggatctcagaacaataatctgtgttgagaggcttcctcgattatcctctggaaagaagtgagtcttgaatgtttgtaaattaaccacctataccattacctctagcacactgataagagtctttctgtttcttcaggaacttgacaagagaggaccttaaagaaagtgagatccttcatacttaggaattcagtgacacttgctgggagaatgccttctatcaatgacacccacttctatccccccttcttcctcctgctaggaataccaggactggacactttacatatctggatttctttcccattctgtattgtgtacctgattgccattgtggggaatatgaccattctctttgtgatcaaaactgaacatagtctacaccagcccatgttctacttcctggccatgttgtctatgattgatctgggtctgtccacatccactatccccaaaatgctaggaatcttctggttcaacctccaagagatcagctttgggggatgccttcttcagatgttctttattcacatgtttacaggcatggagactgttctgttggtggtcatggcttatgaccgctttgttgccatctgcaaccctctccagtacaccatgatcctcaccaataaaaccatcagtatcctagcttctgtggttgttggaagaaatttagttcttgtaaccccatttgtgtttctcattctgcgtctgccattctgtgggcataacatcgtacctcacacatactgtgagcacaggggtctggccgggttggcctgtgcacccattaagatcaacataatctatgggctcatggtgatttcttatattattgtggatgtgatcttaattgcctcttcctatgtgcttatccttagagctgtttttcgccttccctctcaagatgtccgactaaaggccttcaatacctgtggttctcatgtctgtgttatgctgtgcttttacacaccagcatttttttcttttatgacacatcgttttggccaaaacattccccactatatccatattcttttggctaacctgtatgtggttgtcccacctgcccttaaccctgtcatttatggagtcaggaccaagcagatccgagagcaaattgtgaaaatatttgtacagaaagaataattctgtattaaagtttggataaatatatctatatacaacccaaattatcatcatctgagctccctttttaatcttctgtaacagttggtcatgcttgtcagattttttccttttgactggaagtgctttagtgttgacagataatgcaaacttaaaacctttgctgcctgtttcccctacttctctccaagtacctggacaaaggttagagattaatggagaaggtaactatgctgaaggttgaggtggctttggagtagaactgcttgtaaacaagggtgataggtagctccatttttttccatatgtcttctctctaggtaagtttagatcctgaaggatactgatcaaataaatctcattttatagatgaacaaaataagctgtaatccagcagtagtgtccgtttcatagctttgtattctttacagaatccaaaattttgttgttcttctccaaaatctttgactcccatgtttattttaatgctctctcagtcttgctgttactgccatttttgctcctttccttctttcagattcctgctctctctctttttgtgatggttaatactgagtgtcaactttatttgactgaaggatacaaagtattgatcctggttttgtctgtgagggtgttgccaaaagagattaacatttgagtcagtgggctgggaaaggcagacccaccttcaatctgggtgggcaccatctaatcagctgccaacgcagctagaatataaagcaggcagaaaaatgtgaaaagactagatgggcctagcctcccaggctacatccttctcctgtgctggatgcttcctcctcgaacgtcggactccaagttcctcagttttgggactcagagtggctctccttgatcttcagcttgcagatggcctattgtgggaccttgtgatcatgtgagttaatacttaattccccctttgtgtgtgtgtgtatgtgtacacacacacacacacacacacacatatatatatatatcctattagttcagtccctctagagaacactgactaatacacttttcttttacattcgttctctgataaagtaagtctttgtgaatttagggatatgagagactacagtgtgggtattacggagacatgttttctcacttgaagcaaagtcattttagatgtgactacttgtatgtgtcgcctgtctaattctaattctcaattctatctgacaatttcccttcagacaaaatatataaaacttatgagactttataaaacttagaaaaacaattaggctcaagctatggtaagcacagggccagacttgatatcgacttcaaaataatatcattataatttattaatcctgtagatctccaatatttagtcctattttcaaacttcagatatggctggagaatgtggtttgctttaaaatagataaaagagacattgaactgaaatttgtgacttatcagggtactcatgcttcaaaatcagaagaagtctccctcatgttctataatttagaaccactgtgtagtttgtatgacaatatacaaaatactcaaaagtacgcagataacgattttaggaaatgggggcggatatagccaagtagacaagaaaagcaacatcacctattcagtatctgtgaatctggacagttcttggtcttaacactggctaagcacaattcctgaattctatagtattttgtagattttctttaggtctgtatgcatgggttctaatttgatttttgcagcttctgcttcatgtacttaacattttatgggaacatagggttttaaatgtggaaatacattgaaacttgatctattccctttgtcttacaaataaaaaaaactgaggtctaaagaaagcaggtatttgtgtgcataaaatatacccatctttagcatcattctcatgtaacaagtgaaggaagatcactcagataaatccttttgactacaaattcttaactcttgcaggagatttaagtaggaaatattttatttatacgtgagaggcttcatcatgggtcccaagtggagatcaagtaaaaggagaggtagaacgagtagcctgggtttggtgttggtaatgagaagagggagaccacagaaactgagtacaggtgcaagtagtatagtgataaagagaagctgaaatcagcacagtcttcatcactgtggtccacagtactgagtggtaagcacagacgagcatccaggccctcaatagctgtaccatatataaacatgctaaataaagacaaagtttttttcttttctcagtgatatgaaagcatctgtgacatgtataatgcaactttctggttaaatatattgatgggagtcggaaaattttaatataagcgtaatagtgtccacagtgtagatgggagtgcaccataatgctggccctgaaatggttcataatcaaactggaacaccacacttaaacatggctgagcagagtcattgtactgggatcccttctctggacagtagttttctttcacgaaatcaaacaagatgggaccagaagggtgctgacaagctgaagaaaaaagacacaaaagataaatataattgagaaaatggtgacaaaaggaatgccaacctgaaataatagtatgagaatccagtgtaagtgtttattcaaatgcaaagctaaggatggccatctgggaaacacagaatccaaagaaatgaggtcaatgctccaaagttgaaaagttaaggttttacttatgtaggcagaaagcaaagaaatgtagcagaattaaagatttccccatacaaacttgatttatgagttacagcacattgattagttatagcttgttttctttttccaatttaaatgagtatttttaacattttaactttgacaatgtaatagtcatgaggtctttgtgtaaaacaaggaagaaggaagttaatcaataacgaagatcaaaaataaagagggaaagggtcttctctggcactcgttagtcttttacaacattctaaaaaacaatgtaggtaatggaaaaaggctaatttataatcaggcaaacaaatactacaacttcctaggttacagctatctgttagtgactcaagtcctataatcacattcttttaaggctcaaaataatttaaagtttcaacagctttggtcttgaattacttattttcattaaaaaaagacatcaatgccagagttaattatattctactggtattgaatattcgaagactatgccattttccataaaccttgctcaccccgtcaagcaatccttctccttaggaaccctttatgcatcacacggtattctacagaatatggaaaccagcctagctcatagactcttatgggatagtaagtgtgagaatattaatgctgtttatctctaactttatgttacccaccagcactttgggaacagacataattcagtgtaactgaaaataaacttccatgaagttcaattcagatacagtatcttcttgaatatgttccaacattgctccattcaattggtttattgatccataactcctatatcagtcagagccttgctatattatcctggtttcccaaaaaaacctttttaaaattccagatgcctgcagacttttccatttttctggtgccaaatttgaagaaaattctcaacagttttccaaagtgatttcaccattttacacttctaccaacaaaatatgaaaatcccaattgctcgacattcccaccaacatttggtgttgtcagtcatttgaatttagctactctagtgagtaaaaagcattatcccattgcagttttaatttttatttctctaataactaataatgatgtcaagtatatttttagctcttatgggccattttaaaatattcgcttgtgaagtatctattattcttttccaacaactacaaaattagctactttgagatatatttgaatgtagttcaaaagtcttaagaaattagaatccaaagataaaactacctatttcaaaataaacaataagagcagtaaattttacctatacttatacatgtttctatatacacatggatatttataaatatacagatgatccttgatttacaatgttttaattggacaattttttgactttagaatagtttgagtatatgcattcagtactttccttgacttacaatggaataaagccaagatcaacccctggtaaggtgtctgtaataccattgttattactaacaatgtcatgtctcttgaagacaatctagatcttcttacctcttgcatttccaaattccatttatttcatgctaattgcatcattactttggatgctgcattatccattgtcctgctcaagaataatgccttcaaaatattgaacaatattttcaatggatttgtttcttttttaatttttatggatacacagtaagtgcatatatttatggagtacatgagatgttttgatacaagcatgaaatgtgtaataaccacatcataatccagcaatcccactgctgggtatacaaacaaaaggaagaaaatcaatatatagaagagatatcagcactccagtgtttgttgcagcactgtttacaatagctaagatttggaagcaacctaaatgtccatcaacagatgaatggataaagaaaatgtggtacatatatacaacggagtactattcagccataaaatattttcaaattatcatgggtttattgcagcataaccccattgtaagttaaggagcatctatatataatatcatatattatgtattgtatattattacatgtgataaaagtaagtttaaatagaagaatctacaggaaaatctaaggctgcttattggcaatattagtgaaggttctagaaagcatagttagcaaactcaagctgaccccttaaactaagacaaatatataggcacagtttagaaattccacaagagactataaggatagtaagtgtgggaatgtttactctggggtccaaagaggagaaggagttcctggcatctggaggcccagagagcattgcagatagaagttgcaatttatttggaggtactcacagagcccgtggtgacctgcaggtcacctgcaatgaaggagcaggtgggaaccagaataaatatctcgacctcactcacttccccctcacctgctggtgcttcctattttctgaacccaagcagattctatgggacaaaagaggctattgatacagtacatagtcatgaatctcttaggacacagagtatagaatggacctagagaggccgaaaggagatctccagcacattggcccacataaacaaagggctggaggaaaattctgaacaaacatgaggcggccaatatttttatatattctcctttcaattactattgtgtgctatttatttcagtatttatttatttgtagcattagatactctcctttttgttctcagaatcctcttagaatcattttgaatttttttgtattcttttagacagcccaagaattataatgctgataaaaaatcatttggactaatatactgtgaaatataatctagtatgtttgcactgagaattgaaatgagaataaaaaagtaatggaataatcaccaggcatattcttagttttctcataattttagagtattctctctgtaaggccaaaagtaaaatgaaagaacattttatatgctaggggtattcttctatgtggtttataagattcatgggtattaaggaaaactttgggctttccaaagctttaattaatattgtaattcaaaaagatcaatatgataatgcatagtaagatatatccaattttataggaaacattagaaataatcaagaaaagtcactaacttttcatcctttacattcttttattgtaaaagaaatcaaagctccctgaagaaatgattttgaactcagaggtatacaaatagagatataacaaaaatatcttgaaaacttagttagcacaatagctcatgttcaagaaatgtagctgatttgactttcacgtatacataatgctcaaatggcacttgctgatttagcctgtatttaatgagcatctaattattatgttgtctaattcatatcaggagctcaataaaagaaggttgaatcaaggaacattggcttgtaggatgagcatgactgacatctagtggtaaaaataaatacttttttgtaaaatttatttatttattttgtaatttcaactcttagatttaggggctacatgtgtgggtttgtgacatgggtagattgtgtgattctgaagtttggggtatgaatgatcccatcacccactgatatggttaggctctgtgttcccacccaaatctcatcttgaattgtccgcataatccccacattagggttgggacctgttgggaggtgattggattgcagggttggtttcccccatgctgttctcatgatagtgagttatcatgagatctgatgtttttttaagtgtttgacagctccccctgcacgggcattctctttctctctcacctgctgccctgtaagatgtgcctcttccccttccgccatgactgttaagtttactgaggccttcccagccatgtggaactgtaagtcaattaaatctcttttctttataaatgacccagcctcagatatttacttatagcaacgtgaaaatgaactaatatacgcaggtggtaagcatattaccctataagtagtttttcaacccttgtcctcggcctctctcccacctttagtagtccccagtgtctgctgttcccatctttatgtccatgtgtaccaataaatacatttcctgaacaaataaatgacagtcatttaaatgaacaatctaatgaactaaaaaggtaaataactttttctactgaatatttatttatgttattgaacaccaaaaattctacttcaaataaggaatagaaataatgtccatttaataatatttagatatattgtcaaacactctgctgttctagtcaaatgcatgatctcacttactctgaaaaaaaaagtgtgaaatgtgttttgtcatttccgtcagccttgtgaatctataagaaggaacaagaagctgatagaggttaagaaatgttttcccagctacagaatctaagaaaaaaatatttaaatttatgttgcctaactccaaagtgttaacttcagagataatgttgtaaaagatttgtgaaaatgcatagccagtgttaatgtattaattaatttctaacaagtaagtgttgagcaccttccagacattaccttattatactgttacaatattgatataattttttctcattttccatttgagaaaaccaagacttagaatggcaaatgtaattgaacaagatcacagaataagagaatcaaaagatcatgttcttaatctgtaggttaaactgcttttctttctgtatatatatatattcattttgatatttctattaatattatgtatcgtgttagatgcattacacactcacaaaaatcatggaatgtaattcttgtaacagatatatctcatgaattggaaactgaagttagaattctatctctgccatttattaatgtacatatatttcagagatgactttaaggcgatgctgggttccttcttacagggctcttttcttgcctctctgtcaagagtaactaatcacctgataccacagtcagatttaaggtgtaagtgtgaggtcattatgcctctaactgaatagacccctgggacctgtgcagggaatgtacccactagaggatgcacagatcatcagcaagcagaaggtatctctgacaagataacctagagccctatcctcaggagtagggaaattttctgttttctctccaggtccagtgacacagcccacactttagggaagcccttcccaggggacaagaattctcatataactccttggctctgaatagtaagaactatgtcgcatacaggttgcagtctggggtatccggtccttcacagacaatttctcagatgcggggcagaggtaggtgagtcagctcctggttatgctgaaagagggtcctcaatgacagtaactaaagtgatttgtgggatgatggagctccagtgactcggccagagtctctgtagatagggccatcttctaaggaagtagcaagagaaagagatagtagttaagaaaaacccaaattcatagctgtagtcaagaacagactattacttaaggacatgataaaggaagaaaagcagtaaacaaacttcaaagagcattctgagagttaaaggaaaagagaaggataagtgttttaaaattaaaaaaaaaagagcatttcatgaagatgagaaggatgttaacagatcattccctggttatagctgtgtggtctgcttttcaagacctatgcacctatgactagttgttaggaatctcagatgctgaaacctcaaattttcacccgtccctggaattgccctcagatccaaggaactgcctcatctgaggtcatgtcgcatcacacagtgtggcccattgccaacaactagataatatagaaatacaaaaaaaataaaaaaggcttactttttttgtgtgtgtgggacaacttagagagatcaaaccatctccagagcttcatatcgtatcatttgaggcttcagatgtaactacatgataaagaagtttgtcttctgatccaatcctaccttcctggcttctttataagcatattttcccagagcctttctcaaaaatctttctgcccgccattctctatctcagatatgtttttaggaattcaatctaaaatactatatataacaatagggaagattattatttgcactcaactttcaatagccatttgtggatcctggcattaaaaaaatcatgttatcatggagataaatatgacactagttttgccttcaaagaaattataacctagtggtagatattcgccagtggttctcaaattggaataagcatcagaatcacctggagggctttttaacagattactggacccctcttcaagagcttctgattaaggtggtcttagttagtgtccaagaaatgtcatttataacaagttaccaggtgatgctgatgctattggtccagggaactcattttgaaaaccgctgataactcacgtaacagaaagatagattggcctttggaaaaataggaaaaaaaagaatggataatcttgaaataagcagattgaggcaggctatgtagattgtatgttaataaatctaggctatgtactatagtggtgactaaagctagacaggaaagtctcctcataagaggaaatatgaagaaagacatagagaagaaagcatgcagaaagtttgaagtgcagtttgactgcagtgtggagatgataatactgtaaagataggttaaaattaatgtttaagattcttcactgcattttatggaataaagacttttttcataaggatatggagcactactgaaattttattcttatggctcaggggtcggtgccctttttctataaagagagagagagttaatatttttaatattttcctgccatgagatctcagtcacaactcctcagatcttccattgtagattaaaagcagccacagacaatacataaatgaatgagaataattttgccccaataaaatttaatttacaaaaacaaatggtgggccagatttggtccatgggccatagtttgtgttctcagaaaatacttatgataatctgatttcaaaaattattttaattgcggactcaatgtaaagaaaagattgctttagactttgagtgtagaaatgttttacttcactgacaagagaaccactacacatttttttcagttgttgtgtttaattatgaaaagattgctaaggccatggtgaattaaatggctgtgacaatgtcaggaaattcaaagtcctacaccaaaattactttaagtgaacaatacaattctccaaagctaatattttagaaaataaaattcttgtaacaagcactgtcttaaggtgaaaaataatagctgttggatttgaaattgcatatcacaaaagaaaagctggatttatattcacaggaaacagtgaaaatataaaattaaacataaattttgttcctttggctgatttttctccattgcactcttaattctaccaaatttaggtattctttattcttccttatttcagtgacagattaaataatttagctctgtactttaatttttctgcaaacaaaattctctatagcttattcattaatacaattaatcatattgtgatatataacctctattttttaatctttgtaaatagccatgaataaatttaatgttttaagctaatcattgtattccaccattagcaggatgatcatcttattggcatttatggttgacccctgcggaagcattacattggaggaaacacaataactgaaaaaccaagtaagacaatttggtaataattcagatgaacaatgttagtctatgtatatcagtgaaaacagaaataggccaggtgtggcggcttacgcctgtaatcccaccactttgataggctgaggcaggcagatcagctgaggtcatgagttcaaggccagcctggccttgtctctactaaaaatacaaaaattagccgggcgtggtggtgggcacctgtaatcctagctactcaggaaggtgaggcaggagaatcgcttctacccaagtggtggaggttgcagtgagctgagattgtgccagtgtactccagcctgggaaacagagagagactccatctcaaaaagaagaaagaaaaagaaagaaaagaaaagtagaaaaactaaaatgtaggtaggaatataaatagagattttaaaaacagaacagggtataataatcagagaagactttgggaggctgaggcgagcagatcacgaggtcaggagatcaagacatcaagaccatcctggctaacatggtgaaacctcgtctctactaaaaaaaaaaaaaaaaaaaaaaaaattagccgggcgtggtggcaggcacctgtagtcccagctactcaggaggctgaggcaggagaatggcgtgaacccgagaggtggagcttgcagtgagctgagatagcaccactgcactccaacctgggcgacagagtgggacactgtgtcaaaaaaaaaaaaaaaaaatcagagaagaagaaaaaatttgaatgaaaaattattcagttttcaaatctttgtaactgtaaggatgttacatattaatagagatatgaaatacattgtatgagaaataaggatttaaaggcagcaagtggtgagtacaataaaaagagagggtctggagaaatatttctccttctccctattgaaagtaataatcatgatgatgattacagttatttaaaatccatgtggaaagtaatcacaccacatgtctataacttctaattttcaggacagtccctgcatgatgtggtgatcatgtgattaattttattacccccagcttacatataaaaaattactaatagcagtagctattgagtaagatatagtttttaattccctggcctgaatctcatttacctcctctgtaaatggggacagaagtgccaatttcagaactgctttaatctttaaataaaatcacatttcaaaagcactgaaaaaatacctggcacataatgtcagctagacgttttttccctctaacataaacttagttattattccttttagtaaaagacaaaatgtaaagaattctctgacagatcggatgctggggcaggggatagatgtaaatagaaagataaagctaatttgtggttattagtgggtgaaaggtattgatactgactcttttgtattgtaaacataacttttttatttttagacattcaaggggatacacgtgcaggtttgttacctgggcatattgcataatgctggggcataggcttctagtgaacccatcacccaaatagtgaacattgtacccaaaaggtagtttttcaactcttgcctctctacctccctccccacctttgtagtctctagtgtctgttgtttccatctttatgtccatgtgtacccattgtttatctcccacttataagtgagaacatatgctatttggttttctgtttctgcatgaattcacttagaataatggcttccagctgcattcatattgctgcaagggacattattctttgttatggctgtgtacttttctatggtgtatacgtcccacattttatttacccaatctaccactgatggacacttaggttgatttcatgactgctattgtgaatagtgctgtgataagcaaatcagtgcaggtgtatttttgatcagtccattttcctttgggtagatatccaatagcgggattcctagaaataatgatagttctatttttagttccttgggaaattttcatactgttttccatggaggttgagctaataaatccctaatactgtgtaagtgttcctttttctccacatccttaccaacatctgttattttttcactttttaataataaccattctgactggtgtgagatggtttctcactgtgtttttgtttttgttgttgtttgtctgcttgttcatttttgagccagagtctcattctgtcacccaggctggagtgaagtagcacaatcacggctcactgcagtcttgacctcccaggttccagtgatcttctcacctcaccctcctgagtagctgtaaccataggcgcacaccaccacaccaagctaattttttttttttttagatgaagtctccctatgtttcccaggctgatctggaattcctgggctcaagttatcctcccacctcggcctcccaaaatgctaggattacaggcataagccactgcacctggcctcattgtggttttaagttgcacttttttgatgattaatgatgatgaacattttttcatatgcttgttagctgtttgtgtgtctttttttgagaaatgtctattcaacctttgcccacgttttaattgggttttgtcttttgcttaattatttaagtccttattggttcttgatattagtcttctgtcagatgcatagtttgcaaatattttctcccattttgtaggttgtctgtttactctgtgaattgtttattttggctgcacagaatctttttagtgtaagtaaatcccatttgtttatttttgttttcattttcattgcatttgcttttgaagtctcaatcataaattatttgcctagggccaatgtccagaaaagtttttcctaggtcttttaggatttttgtagtttgaggcctcatattcaagtttttagtccattttgagttaattttgtatatggtaagaagtaggggtccagttttattcttctacatatggctagacaatttccctagcacatttactgaataagatatccttacccagttgattgtttttgttgactttaccaaagatcagttcgttgtaggtgtgtggctttacttctaggttctctattctgttccactgatttttgtgtcatgtttccagcaatgccatgctgttttggctactgcagccttggagtataatttgaagttgggtagtgtgatgcctttggctttgttctttttgcttaggattgctctgtctatttgggctcttttttggttccatattaattttagaatagttttttctaatttgaaaaaatggctttgggaatttcataggaatttcatagaatctgtagattgctttgggtcattttactgatagtgattcttccagattatgagtgtgaaatgtctttccgttagtttgcgttatctgtgatttctttcattggtgttttttagttctccttgtagagatctttcacctccttggttaaatgtatttctacatattttattattgtgtggctattttaaatgggtttgagttcttgatttggttctcagcttgaagaatactggtatatagaaatgctactcatctttgtatgttgattttgtgatactaactttcctataatcagatcccataaggagaaaaagatgattaatacaactcaggaaatgatcatatcataaagtatcttccctccctttagcagaatcgtgacatatcttgggaagcaattccacaccatgaaattggacagaatctgagaagatacaaacccaaatacacataccactatacttccaaagcagttctttgggcctgcattatagccaagtcatagggatagtttttctttaggattagtagcaccatattagaaatcattgcactcaaatgagcatcaaagtaatttgacccatggcactgatatggatatggcactgcccgaatctgactaacccaataactgaatgtattccatccatggcccagagcctaccacagaatacaccctgtagcagcaaagtttctaatcaagtcctagtctcatttgcacacacccaagcaccctacaggcctattatgttgcagattgcatccattgcacagagccagttacaaaccagactcaaccacaaggcacaccagaaagactcaattgtgacggtaaactagcctgctgtgaacttaaacatatcactgtccatcaatataccagggaaactattacagcattaatacaaactagactgtccccaatctgaggcaagtatctgacctcagtatcttttaaaaagatagagacaattacactgccactatctaggtggcattatgaagcgattgcccatttatataatgcgaaatggagaagacagaaaagatcataaatcacaaaaggcactgcaaagtatctgagagcatccagtgttttctattcaggaaagaaaacataatatagtgaagggcctttgaagttgtaagagggagcattgtttttctggaattatgcaatagttaccctatgtatctaaatttaaaaattttatttattatctcaaatccaaacaccaactaaccaatcctccacctttactgagtctcctctcacagagaatattcttaatttctcagatctaatttgcaagaatgtatcattcctcttatcattttcctcctcaatctcagtccagtgacattttacacacacacacacacacacacacacacttcaccttggctactctttacatcctgattaacaagtataattagcaataaatatatgctaatttaatgccatatggaagttttttcttagagactgaagggaggaaagacatgggaagtgcaggattgctatattttggaaactttctgcatggtttcctgtgtaagtgaggcaaatatttaaaagtgagagtgtctttttaactatatttcatattccctctctaggtctcttatgctatattatggagttaaagaatggattttctgtttccccaagaaatagacaccatgctgtgaaagaagttatggtttctcactggaagcaagaaaactcatgcaagaaatgtgtctgtagggaatggccaccaatatgcttcataccaacaatacacagtttcacccttccaccttcctcgtagtgggggtcccagggctggaagatgtgcatgtatggattggcttccccttctttgcagtgtatctaacagcccttctagggaacatcattatcctgtttgtgatacagactgaacagagcctccaccaacccatgttttacttcctagccatgttggccggcactgatctgggcttgtctacagcaaccatccccaagatgctgggaattttctggtttaatcttggagagattgcatttggtgcctgcatcacacagatgtataccattcatatatgcactggcctggagtctgtggtactgacagtcacgggcatagatcgctatattgccatctgcaaccccctgagatatagcatgatccttaccaacaaggtaatagccattctgggcatagtcatcattgtcaggactttggtatttgtgactccattcacatttctcatcctgagattgcctttctgtggtgtccggattatccctcatacctattgtgaacacatgggcttggcaaagttagcttgtgccagtattaatgttatatatggattgattgccttctcagtgggatacattgacatttctgtgattggattttcctatgtccagatcctccgagctgtcttccatctcccagcctgggatgcccggcctaaggcactcagcacatgtggctctcacgtctgtgttatgttggctttctacctgccagccctcttttccttcatgacacaccgctttggccacaacatccctcattacatccacattcttctggccaatctgtatgtggtttttccccctgctcttaactctgttatctatggggtcaaaacaaaacagatacgagagcaggtacttaggatactcaaccctaaaagcttttggcattttgaccccaagaggatcttccacaacaattcagttagacaataatgagatcataacaaaataaacactggaaacattttttttactacttctcttgcattcccacatgagccaatagcattatatcccctacaacgtctcatgatttcagtacggtctgttggaagttatagctcaaagattccaaaacaatctctctgtttcacccattaaaagtgcaaaaagtactcacacttaagccccatgatactacaaaatgcctaaagagaaacaaaggctttgtaaaagttattgcccagtaattgtcttgaatagcctttccacatgaagattctctgtatttacatatccaaagctgaagttcatgacgattaaaatgatgtggtatttcatcaaaaccaggcaggatacagtggcaagagaaattaactaggagtcataagatctagatttaaatacaggttatggccttacctaaaattttgacctgagcatttcacttagactctttgagttcacaataacaaattcatactgatttatagcattttatgagcagggatattgaagcttaaagtgaatgttgtgaaaatctgtgcagcttgtaaaacattaaaagatttggaaacaaaatgagtgcttactaaacataattatagtgtaattgttatttctaatgtatgtagatttcatttactaatccactctagtatacaatccctggtttgaggtcagctctccagatccagattatcccaacgcatgggcctcttcatggacctctcagctcttaccttcgtgaaagagactttcagtcaggagactataaagcttgaagagttaacaggtttctgtcttgggcttaaggactcagggaaatcccatcctccacagtctttgctagagtgggttttagggcagactgtaatagtgtggctgctgaaataatataaagtcattcttaataaggtatagaagataaataggacaatttatttctttgggtattctaggagctgcaaaaatgtgaagttggctcctaattggaaatggagccctgattgaaactcaaggtagaatgagcagaaatgtacagagaatagtgcgaaagtaataacaatataaataacagtataaattgacaagtggaagtaaactgaagtgatatgtcatataaatatataaagaaaaagtaaccaagtaatcattttctaagtagatattttgaaattgatacagaatttaaaaaaaactaaacagatcatttaacaaggaataaagatgacaaaaaattcattgtggagtgtcttctaagtaaaataccacttttcaattatagtttatttaatgtattattatataatatttcaactacgaaaatctcattttagagcctgaatatttacatttgtatatttaaaggctctaatatgttcaattttgttcactctacccaaaatatgttaaaccaccagaccacttaattttggtatcatacgttaagaacttcgactaagagttttcctgtatcatttctgagactttgctaaatgtcacgtgctccagaaagtgagtaatctgaatggaaatgggtaacagagaactttaatttctaaggagcatagaagctaatacagaagagaaaaccccattcattaccaagtatatgttccaggggctgtaacatgggagccaggagcatatttgaaaacagcacagtgtgcacatagaattcccaagaaaggaaagttgtttagggagtttatcaagctctagagttttttttttttttaactgaatttgtacaaagccatcaatactgcaagtcttggagcaggtcggctgagctatgccaaatgctatggtaaacactgaatattggtcatcttggctgagtccatgtctgtgaaacattggcatgcttcaagccaatctaaaagaattcaactttgtttattatttcaaaatttcaaggctgctgaaaggtaggtctttatacacagtcactttatttgctagctgagtattttcatcgggggcaactgatgaaaatgttgacttccactaacctaagcctgtccgttgttactatcgtatcttccagttcaacgtcagggaaatagtttttggtgctttccttgtttatatacagatgtttatgacttatctatgcactggcctggaatctggggtactgataatcctggccatagaccactatgtcgtaattcgcaatccactgagatataccatgattctcatgaacaatgtggtagccatcctaggaagtcatgataattagatctttaatctttatcatcccttttgagtttctcatcttgctgttgtcattctgtgctgcccatatcatcccccacaccaaatgtgagcacatgggcattgcccatctttcctgtgccagtatcagagccaataatatgtttgggatggttgcctttttgtgggatttattgaccttattgcaattggtttctcctatgtaaagaaactacacactgtttcacttaccaccatggaatggccagttcgaggctctcaatacctgtggttcccatgtttgtcatgctcatcttctacatcccagtattttttttctgatacactgcttggtgaaagcatccctgctatattcgtatatttctggccaatgtatatacggttgttctacctgtattcaaccctgttatctatgggatcaggaaaaaacagatcccagactagggtatagacctaaagacatttgatgatcagtcacttctagtcatgatgatatatatattgggatatatatgcaaatatatatacacatatatgtgtgtgactatatatgtgtatatgtatgtatatatttgtgtttgtattatttttttatttcaataggttttgggggaacaggtggtgtttggttatacgaataagttctttagtggtgatttttgagattttcttgcactcatcacccgagcagtgtacactgtacccattgtgtagtcttttatcccttgccctcttcccaccctttcacccaagtccccaaagtccactgtatcaatcttatgcctttgtgtcctcatagcttagctcccacatatgagtgagagtatatgaaatatgattttccattcctgagttacttcacttagaacaatagtctccaattccatccaggttgctgcaaataccattatctcgttcctttttatggctgagtagtattccatggtatatgtatgtaacccattttctttgcccactcgttgactgatgggcatttgggctggttccatactttttgcaattgcaaattgtgctgctataaatatgagtgtgcaagtatcctttttggtataatgacttctttttctctgagtagatacccagtagtgggattgctggatcaaacagtacatctacttttagttctttagggaaactccacacagttttccataatggttttactagtttacattcccaccaacagtgtaaaagtgttctcttttcactgcaaccaaaccaacatctataatttttgattttttgattatgctcattcttgcaagagtaagatggtatcgcattctggttttgatttgcatttccctggtaattagtgatgttgagcattttttcatatgcttgtcggccacttgcttatcttcttttgagaattatctattaatgttcttagcccatgtgctgatgggattttttttttcttgctgatttgtttgagttatttgtagatctggatatcagtcctttgttgagtgtgtagattgtgaagattttttcccactctgggggttgtctgtttgctctgctgattgtttcttctgttatgcagaagctttttagtttaattaagtaccacctatttatctttgtttttgttgcatttgcttttgggttcttggtcatgaagtctttgcctaagccaatgtctaaaagggtttttccgatgttatcatctagaatctttatggtttcagatattaaagtctttgactcatctggagttgatttttttatcaggtgagagatgaggatccagtttcattcttctacatgtggcttgccagttatcctagaaccatttgttgaatagggtgtcctttccccactttatgtttttgtttgctttatcaaagatcagttggctgcaagtatttgggtttatttctgggttctctattcttttccattggtctatgtgcccgtttttataccagtacaatgctcttttgctaactgtggtcgtatagtatagtttgacgtcgggtaatgtgatgccttcagatttgttattttttgcttagtcttgctttggctatgtgggctgttttttggttccatataaattttaggattgttttttctagttctgtgaagaatgatggtggtattttgatgggaattgcattgaatttgtagactgtttttggcagtatggtcattttcacaatttgattctacccatccatgagcatgggatgtgtttccatttgtttgtgtcatctatgatttctttcaacagtgttttgtagttttctttgtaaaggtgtttcacctccttggctaggtattttcctacatattttatatatattttttgaagctactgtaaaagaggctgagttcttgatttgattctcagcttggtcactgttggtgtatagcatagctactgatttgtgtacattaattttgtatcctgaaactggtgaatttgttgaccagttctaggagcttttggatgagtctttagggttttgtaggtatacaatcatattatcggcaaacagtgacagtttgacttcctgtttaccaatttgatacctgcgatttctttttcttgtctgattgctctgactaggacttccagcgctatgttgaatagaagtgatgagaaagggcatccttgtcttgtttcatttctcagagggaatgttttcaacttttccccattcagtataatgttggctgtgggtttgtcatagacggcttttattacattgaggtatgtcccttgtatgctgattttgctgagagttttaatcataaagcgaagctggattttgttgaatgctttttttgcatatattgagatgatcatgtgatttttgtttgtaattctgtttatatggtgtatcacatttattgacttgcagatgttaaaccatctctgcacacctggtataaaacccacttgaccatggtggattatctttttgatatgctgttggatttggctcgctagtaatttgttgagaatttttgcatctatgttaatcagggatagtggtcagtaattttctctttttgttatgtccttccatggttttgatattagtatgatactggcttcgtagaatgatttggggaggattccctctttttctatcctgtggaatagtgtcaataggattggtatgaattcttctttgaatgtctgaggattcagctgtgaatctgtctgggcctggactttttattgttggcaatttttaaattaccatttcaacctcactgcttgttattggtctgatcagagtttctatatctttcaggtttaatctggagggttgtatatttctgggaatttatccatctactctaggttttctagtttatccacataaaggtgttcatagtagctttgagtaatcttttgtatttccgttatgtaagtagtaatatctcctgttttatttctaattgagcttatttggatcttccctcttcttttcttggttaatctcaccaatgatccatcaattttatttatcttttcaaaggagcagcttactgttttatttatcttttatattttttgtttgtttgtttcttttttatttagttatgctctgatcttggttatttcttttcttctgttgatctggggtttggtttgttcttgtttctctagtttcttgaggtgtgaccttagattgtctatttgtgctctttcagattttctgatgtagacatttaaggctatgaactttcctcttagcattctttgctgtatcccagaaggtttgataggttgtgttactactgtcattcagttcaaagaattttttaatttccatcttgatttcacagttaacccaatgatcattcagaaacaggttatttaatttccatgcatttgcatggttttgggggttccttttagggttgatttccaatttgactccaccagggtatgacagggtacttgatataattttgattttcttaaatttactgagacttgttttgtggcctatcatatggtctatcttgtagaatgttccatgtgctgatgaatagaatgtatattctgcagttgttgggtagaatgttctgttaaatatctgttaagttcattttttgtagggtatagtttaagtccatttttttttgttgactttctgtcttgatgacttgtctagtgttgtcagtggagtattaaaataccccacattattgggttgccatctatctcatttcttaggtctagtagtaattgcgttataaatttgggagctccagtgttaggtgcatatatataggattgtgagattttcctgttggactaatccttttttcattatataatgtccttctttgtctcttttaactgctgttgctttaatgtttgtttggtctgaatagctacttctgctcgcttttggtgtccatttgtatggaatacctttttccactcctttaccttaagtttatatgagtcctgatctgttaggtgagtctcctaaagacagcagagacttggttggtgaattcttattcattctgccattctgtatcttttaggtggagtatttaggccatttacattcaattttagtattgagatgtgaggtactcttctgttcattacgctattaattgactgaatgcctgttttttttcattgtgttattgttatataggtcttgtgagatttatgctttaaggatgttctattttgatgtattttgaggatttgtttcaagatttagagctccttttagcagttcttgtaattctggcttggtagtggcaaattctctcagcatttgtttgtctgcagaagactgtatctttcctgcatttataatgcttagtttcactggatacaaaattcttgaccgataattgctttgtttaaagaggcaaaaaataggatcccaatttcttctagcttgcagggtttgtgctgagaaatctgctgttattctgataggttttcctttgtatgttacttgatgcttttgcctcatagctctattatttatttagttagttagttagttagttggactctcgttctgtcacccagggtggagtgcaatggtgtgaactcggctcccttgcctccaaggttcaagtaattctcctgcctcagcctccccggtagctggaactacaggcacatgccaccacacccagctaatttttgtacttttagtagagacagggtttcaccatgttagccagactggtcttgaactcctgacctcaagtgatccgcctacctaggcctcccaaagggttgggattacaggtgtgaaccaccactcccagccttgcctcacagctcttaagattctttcctttgtcttgactttagagaacctgatgactgtgtgcctaggtgaagatctgtttgcgatgagttttccaggtgttctttgaacttcttgtatttagatgtctagctctctggcaaggctggggaagttttccttgattattccctcaaatatgttttccaaactttgagatttctcttcttcctcaggaacatcaatcatccttaggtttggatgcttaacatagtcccaaacttcttggagactttgttcatttttttaatcattttttctttgtctttgatggattagattaatttgaaaaccttgtctttgagctctggagttatttcttctgcttgttcaattctattgcaagactttccagtgcattttgtatttctctaagtgtgtccttcatttccagaagttgtgtttgtttttttatttatgctgtctatttcactgaagatttttcctttcatatcctgtattatgtttttgatttctttaagttggatttcacctttttctggtgcctctttgatcagcttaataattgatcttctgaattctttttctggtaattcagagatttcatcttggtttggatccattgctggtgagctggtttgatcctttggaggtgttaaagaaccttgttttgtaatattaccagaattgtttctctgttccttctcatttgggtagactatgtcagagggaagatctgggacttaagggctgctgttcacattcttttgtcccataggggtgctcccttaatttggtgttctcccctttcccctagggatgaggcttcctgagacctgaactgcaatgactgattttgctcttctgggtctagccacccagtgtagctacagggctctgggctaatactggaaagtgtctgcaaagagtgctgtgatgtgatctgtcttcaggtctttcagccacagataccagcacctgctccggtggaggtagcaggggagttaagtggagtctgtgagggtccttagttgtatttttgtttagtgcactggttttgtgttggttggcctgcagccaggaggtggcatgttcaagagcacatcaactacagtactagaaggaggatgtatacttgccctggggttgtctggttacgtattcaggtttctcaggtggtgggcagcgccatagagctctcaggatattatgtcctttgtctttggcaaccagaacgggtagagaaagaccaccaggtgggggcagacataggtatgtctgagctcagactctccttgggtggagcttgctgcagctgctgtggggaataggggtgtgattcccagtccaatggagttatgttccctggtggattgtggctgcctctgctgagtcatacaggtcaccagagaagtgggacaaagacagcagtcacaggcctcaccccattcccatgtagccacagtcctaaatgctggtctcacttccatcatgccccacctaccacaccaagtgtttccaggcagctggtgaccagttctgagaacttgccccagaccgtcagccaccccactgagaaagcaagctgattcagagttttttggcatctcaaggagcctgcagaagcaatccagttccttcaaagggtctgtggattatctcagcttacctggcatgttcctgcagtaattcttggagaaaagttaatgatgtgagtctctacatgctgccctgtctctgactagcctcctatttgccatcttaatctcagtcttgattctgtgtttgtatttttatctttcttgactgaatagtgtataaagaaatgtatcacactatgattttttttcaaagtagcacatttttggttttgttttttttcctttttctgttcattttctatcttattgagttcggctcatttctattattttcttccttctattttttgaatatgcttttcccatctttttctagatttgtaaggcagaagcttatagaattgatttcagactctcatttttttcctaataaaaataattaatatgcttaatgctccattcacagcaatctgggctttttctaccttgcttctccaaattcttcaagcttctatctattacccagttcaaaaaccacttccatattttcaggtatttgttgtagcaacaactctactcccaatatcaatcttcctggtactgttttgtgctactataacaggatatcagagactgggtaatttataaactatagaactttatttggctcacagctctggaggctagaaagtccaaggtcaagtgacctgcttctggtgaaggccttgtcactgggtcatctcatggcagaaggcagaagggcaagagtgtatgtgcatgagaaagagagaagagagagaattagaaatggagagttgaatctgcttttataacaaacccactcccacgatagcagcactaattcattcatgagggcagggcccatgtgacataatcgcctcttaaaggtcctacctcccaatactgttgcattggggtttaagtttccaacacatgaatcttgagggacattcaaaccatagcagccatattatactgccatcattctactttaagttattgtgcccttctttatacaattaattccccaaaagcagagatgaataacatttgatcttttctcacaagaccaaacagtgattgtcacttaatctgactgagcagattattctgttatgtaaaactttttaaaactagtttgatgcactaatactttccacaaaccttcttacatgatttcccacatatttaaatgacttgtttatgaaatttttcctctttggtcagttgcttgacgatctgatcagtgccttgttattgcttagcaacgactgttgtattgaggtttccaagtttctccagaactgttttgccaggtcccaagctggcagaactgaatgcctttagcgtcctatttctcctgactatgcggccaatgtcatcctccattattttgtttccaaataagcagccagatccttagtagctcattgactttcagaattcattgagaacagaaagacaaggtatcttctggtattttgagaaaatatatgtcctttgaaaagttagctttaggagatacacctaatgctaaatgacgagttaatgggtgcagcacaccagcatggcacatgtatacatatgtaactaacctgcacattgtgcacatgtaccctaaaacttaaagtataataataataaaataaaataaaaaataaaaaaagagaaaagttaatgctaaacagagaatagaagtaagaaaatgcagtgtctttgaattggaaaaagaaagattgtacttcctctccaccaacaaaaagacagaagaaagaggagaacaaatgaattttctgacttgaagttataatcctacgagggaaaaaatgctgctcagtaactgcaggagttcttgaccactggaacctcccaggtgtcagctttttcacaaaatattggaatatttgaataaatctgggattatctaagggagggcagttgggaagaccagttgggtcagagaagcaatcataacacatatttaatatacctttatactgatggatgaagcttcaaattgacagttgagcagattgtcattaaataacgaaaagtacctaagtttttatccaaagcttaattgttcctctctttgctcctaaaactcaacatgctttctctcttagtacagaacctctgcatgtgtgtagttttcactgcctaaaataatcttttcatccttctttgcttaggtgattcctatttttctttcttgttcaacctacttaggtttacttaaaatgaccttacccaaccttcaatattatgttaggctgtcaggctccactgtaacaggcttctactgtagcacccagaaagtttctttctttgaaataactgaccacaactgtattgaagtgaggctcaatgcctacttttccattatacattatacttcctattaatggggacagataatatttacaaagtaccatatatcaggcactatgattagtattattcatgttacatcatttaataaatgcaattaacatgagatacatgctaagtttatgactattttccggaggaggaaatagatgcacaaagacataaaaacaacttgataaaggcttcacacacagcaagtagtgaaaccaaaatttgaacccaggaagtataattccagcatcaaggtgttaactaccacttcaccttcatttatgaaagtacaaaacaatgtagttcatctttgtaaataagaaaagctcaatatttattacatgaaatatccaccatacctctttaactgctatttcaatcagaattcttactttcaagcaacaaaaaataattctagatattttaagcaaagaaaaattattgaaaagatgatggatacctcacagaatcactaggaaaacagaaaagtaataaaataaaagaaaataaaaatacaaaccaagtaacaaccaggacctctgtaaaattaatccagagaactaattctgtgctgaagtgttattgcaaccactgctgaacttcagatgacatggtttatataaatagttcttttgtgtttatttcagatggttttcgaacattgatcaagtaactatatataatagtgaccactgtggaaaatcattttgatttaaaattttagtagttaatacatatgattcagttataattttagaaatttttgaggatttatgtctcgagaaacttctctgaagttcaatttacagttaaaagcatcataaaagcgattttaagtgaatgttttatagtgtattttaatatagtagacattataatatgttttaacagaataagtaat

SEQ ID NO: 255 - DNA, 53831 bp, Homo sapiens
caatgtaagtaaagagttgctggttatactggatacccaacagagcccaaaggaataatccaagcaactcataaaatgaaagacaggaagataagaaataaggaaggagagaaaaagataaaatgagacctgttataaatattatctgaaataacaagaactggaaattgaacaagtaatgggcacagggttcactgagatctccctagagcttcccttcatctggtgcaataacaaaggggaactactcttcattttaacctcagtgtctcagacactgtggcacttggagactttattaaaactcttctgcgccagcaaacacacacagacatttcgttaacatttttcagggtgcactgaagctctatgctaaaccatttatatatatttcaagaactgaatgcatagttgttacttgactccttaagacagaggaagaaatcttggtaagggtttccaatcagcaactttgtgtaatatatacttaagattggaatttgaattaacagaaattgagttaagacctggagaatcggggtggagaataaaatagtacatatcagcagtctaagaagaggtaagataaaaaaaacgggaagatattggggagaaaaatatttgctagacaccttcaatatttcacgcatatgtgactttatttatcccacttgataataatatcatgtagaaattactatgcttatttctagaagaaacttagactctgaacatagtgtaacttatgtaaagtcagaaagccagaaataacagaatcaatactctattccatgtcacagtgccaataatattaaaaattctgtgcttttgcttctttttcctacacaaaatgccttataatgagatagtgagtgatacagagagtgacaaaattccatagaaggcaaagaagaattgcttaatgagcttgaatttgtttatacttagaaagactatgaatgtaccctgttatagaaaaggatacaatatggtgattagctgttggtctttcttcatgcttcatatttcaaatggatttaactgaactcaaatttgattattaagaaacctgaatttataactgagcccaaggcccatataagacatgaggtaaaaagctcacatatagcagtagtaaataatatatttggaactaaataagcagatgtgtgctaaaaaatttgactttacccagagagaggtctgtcctttgctcctggcttctagaaggaaatatacacaatacctaataagagagtctttgtttattagactggggattggtcacactagatctgagggtagggactggccatgtcataaagatcaacaatatgacttagtgtggggactttgggtcatgtgacaccagtaaacctggagacggagttcaaccacatttgcaatcaatccagccatcatacctatataatgaaatcccaataaaaactctgaacaccaaagcttgggagaatttccctagttggcaatatgacttcatgcatattgtcacacattaatgccataagagtaatgcatgtttactccatgaaaggacaacaaattcttcagatttggacacctcagtttcttttctaagcatctctttatttgtctaattttaatctgtgtccttttcctgtaataaactgtaaccatgaacataatagctttcagtgagttctataagtacttctagtgaattattgaagctgagggtggttttggaaaacctctgaaattgcagttaatgacagaagtgagggtagtcttcgggactgtacccttaagttttgaagtttagagagctccaggctaatctaatttgatgtcacatttctttaaactgttagcaaggtcaataggctcttgtaaaagaacttcatatggtggaaaaccttcacagataatcattctcccttaccaatttactttaaattcccactaagggataccttccttctagatacctagaccctagaaaaggtgtggatctgcttcttgactcaattctgttgtattgtgttttttttctaataaaacactgttaaaattatcatcactttataagaagactcagtgtctgatagtgtaaatcctgcagattttttcttctttgaagaagttttggctcttctaaattctcgtatttttcctcataccttacttttctttcttttctttctcctttcactatacctgacagcaaatattgcaaatatagagccagattaatgttacatatctgaatttcaacctagtttcaaattttgaatttcctacctattagctgtaaatgatgggaaattacttaacttagcaaaactttgctgttccataaaatcagataccagtagaacttgtgtcatgaaatttggcgagaactaaatgagataatatatgtaagtagcagtagatgcaaagactgaaaaatagtagatatctaatcaataatagctattattactgtggttcttattatcataaattttattttcatcaactcatagtgtctatatcttgagaaagaagggaataagtacatttatttactctgaactcaaaattttaggagagacatagttcaagcttctacttggcagttcagcttctcacattcatggtgcgggtaaggagtgatactaggattatgtatggaaaatgaaaagaaggagaaaaaaacaaaggcctttacagaaaggtattcttaatatcaatcctttgtttgaggatttgtttatttatttgttttagatctcaattaagtctcgatgaattgcccgacgggaactgaaaagaacttttaaagccatggccgctagcagttggcagaagaatgtcttctcccaatgtcactgaaccccacctctcttccttcctgttggttaggaattccaggattggaagctgcacaacgctggctaggctttcccttctgtgttgtatatctgattgctcttgttggaaatcttatcattctatttgttatctggactgataaaaaccttcaccaacccatgttctactttctggccatgctgtcagtcatgacctgagtctttctacatctactatccccaagatgttgggcatcttctggttcagccttcaggagttgtgctttgggtgctgtgttgctcaagtcttttttatccattttttttgcagtcatggagagcattgtacttcttgtcatgggatttgatcgctatgtggctatttgcaaccccttcaggtagaccaagatcctcaccaacagaattactggtgtgattgctatggttgtggttcttagaagcttatgtatgattgctcccatcatttttctcctcatgaggctgccttactgtggacatagaatcatcccttatacctattgtgagcacatgggagtggctcgtctggcttgtgccagcatcagtgtcaatgtctctcatggtcttgggaatatttttatcttgtttctggatatgtttcttatcatcatctcctatgctagaattttatgcacagtctttcacctcccttcccaagaggcccacctgaaggctcttaatacctgtagctcccatatctgtgtcatcttagcattttttggcccagctctcttctcctttctcactcatcgctttggtcatggcatcccacagtatatccatattctcctggctaatctctatatatagtcattccccctgctcttaacccagtcatttatggagttaggaccaagcaaatccaggagcgggtagaaagtctctttactaaaaattgattgaatgggagagaatttcaggttataaaagtgtaagtcctaaaaagacaaaatttgtgataaaattaataaattgtttttgccaaaatggaccatcaattttatacatatatatattttatacagatgtgtgtgtatatttatttatttatacatatgtatgtatgcgtgtatgtttaaaaacatattggcagcaattgctagatgtatgtgtgtttatgcatgtctgagtgtgtatttgcaataatgttatctattgacccctaacacagaatatgccatataaaagtaagtttcaaggaggatcactttaattcactgaaaatgtcttcatttttctctcagatatgaataatggattgaatgagcattgaattccaagtgcaaaattattttttttggacatgatttttttaacattcacttttgcatttgagatttcggatcccagtcagattatgttccctttaatctatgctcttttctctgtctctctcacttgaacttttattctctttctctcaactctttttctgtgaaatggtttaagattttctttttattttttgtgttcacaatttctaccaaacagtagtacctaagtccctactgggcctctattgaaactgtcaatattaagccttaaataatttttcaaatgtagaaattttctttattattctctccttctttatttttatttcaccttttgaaacttgtatctatgtcagaaataaatacgctcaaaaatacctcgacacagaaatttatacagtattttataataaatacccagtcataaaatagctttatcaggtgagtagttgacacctcattactttaaggaataaagaatattaaactatatatgtgaaattaaattgatgattattaaaacttgtggacatttttttttttttagttactttgatattaactcttcccattgagtttgcatgtattttgtatgctaaattagtaaaaaaaaatcactaggaatgtcatagaattgggtgaaatgattgtggtagtaatattcaaaattgaatttgaccttatctcgcttgaacaatattccacttaggtcattcaggtctttaaaatgaaccttagactaccattttttattttctattgccatttttgaaaaccatgaatgtgttgtttatgtcaattttggccatatgcaggagggttacttaagcccaggatttcaagaccagcctaggcaacttatggagaccctgtttctataaaaaataataataaaattttttaaattatatttttatatactaataaaaaatttataaattaaaatcttgaaaattatatatttttaaatggcatcgatcattaaaaagtcaggaaacaacaggtgctggagaggatgtggagaaataggaacacttttacactgttggtggcactgtaaactagttcaaccattgtggaagtcagtgtggcgattcctcagggatctagaactagaaataccatttgacccagcaatcccattactgggtacatacccaaaggattataaatcatgctgctataaagacacatgcacacgtatgtttattgcggcactattcacaatagcaaagacttggaaccaagccaaatgtccaacaatgatagactggatgaagaaaatgtggcacatatacaccatggaatactatgcagccataaaaatgatgagttcatgtcctttgtagggacatggatgaagctggaaaccatcattctcagcaaactatcgcaaggacaaaaaaaccaaacactgcatgttctcactcataggtgggaattgaacaatgaaaacacatggacacaggaagcggaacgtcacacaccggggcctattgtggggtgggggcagcggggagggatagcattaggagatatacctaatgttaaatgatgagttaatgggtgcagcacacaatcatggcacatttatacatatgtaacaaacctgcacattgtgcacatgtaccctaaaacttaaagtataataaaaataaataaataaaataaataaataaataaataaatggcatcacagaacatcaaatgctttgacctaactctaacaaatgatatgcaaaacttctaaaataaaagcataataatccttcaaaggaactttttaaatacataaatacatgaaaagatatacctagttcatgatttggaataatcaataaccttttaaaaacattctctaaaattgaactatatattcaatgcaataaatattttaatgaatttgtttgcttatttgtcctcttgtttttgttttcaaagtgttataaacattttaaaagaaattggctggaaatcctgaagaacaaaattttaggatttatgttattatattccataatttattttatagtatcacttatgaaaactgtgaaatacttgtacaagaacagacaaaaagcagaaccacacagtccaaacacaaaaatacacatgtataaatgtataatttatgacaaacagctttttaataaatgaagcaagatcaaatgaatagccaaagtaaatcaattatatattgaaaaataattgcctctatgtcactgccctttcaatgtgatagttaatatcctctcatcaaggggttaatcttgacaatgtgagcaagatggactactaaaatgttccagctcttagttgcctcacaccgatagccagaacaatgaattaataattacattttaatgaaagtaactgaaggagaggagtgctcatttgtgagaccctgagcctagaaccctggctccacagccactccaagccactgtacttcgagcccagcgctgctgcagctgcttataggccatgtcaaatctgagggattctgtcagctgagtcccctcactgcgggaaaaattaaaaataagaggaccccaaaagcccttgacactaaggacataaacaaattgtgccaccactactgctgtgccactacaaacttctacagtctaagccactgaggcacccacagttattgctgacattaaactcagctcaggaagctgcacggagactatgctacacccatctggaaacagagtcaccacactcttcccaactggcacactaaaacccaactgcaggtgatagttgtcctgtataaaaaccactctggaaagtttggagataagcagatacacaggcatcaatatagagacacaagaaacatgaaaaggcaaagacatatgataccaccaaaggaacataacactgtagtaacagactccagtaaaaagaaaatcaacaaattgccaaagaaaaaaaatcaaaataatgatgctgagaagactcaataaaatacaagaatatacagcatagacaattcaataaaatcaggaaaacaattcatgaaacaaatgagaaattcaacagaagataaaaatcataaaaatcaaatagaaatcctgtagctgaagaattcaatgaataagttttcaagttacaatagagagattcaatagcagacttggtcaagcagaagaatctgttgacaggttgtttgaaataagtcaaagaaaaacaaaagaaggatttaaaaaagtaaagaaataatggtgttccttaatgggatgccattaagtaaacaaatatttgtattatgagaattctagaaggagaagagaaagaaaaggacaaaggaaacctatttaataaaataacagctgaaaactttccaaatatgaagagagatgtagatatccagatccgaaagctcaaaatcccctatgtaaattcaactcaagaaggtcctccccgaggcattataatgtcaaactgtcaaaagtccaagacaaaaagtctctaggcctttaggctatttggcatgaggaaacagtgaaaatagtgggaaaatatatccaatccttcaacacttttcagaagtaatgtcctcagggaacagctgggtttctgtttcaaaaggaagagaaacagaacatcagaagtggtttaaggccaaaaataatatcactgctcataaaaaattgattctagaagtcacagtgaaatagtcttgggaataggagaggggtaggtacagtgaccaattaggagatatatgattatatgatatgaccctaacagaactagaatttttatgttttaaaaataatgtaattcaatgccagaacacctcctacaatcaaagcactatactaagtgaactgaaggataaagttgacttaaacatcactctaatatcaatccataaaataatggaagacagaaaacacaaaaccaacacaaaataaaatttgcctgttataatagtggcacacactgatgtgaaaatacaaaagacacaaagattatatcagattgattcatatgaaaggtcattaagaagtataggacaattgagaaagtgctgaagcaaagtagaaatgagatgaagttatttcatatggaggacttttgattatcaaagacaagatgtgtgttcgggagtcatgtagtataatgaaagtataaaaagttgattgggtattgagtgaaggactttggcaacaatggtgtttgccccttattacataaagtctacagtatacaatggagaatgtaggggtcatgggaaggaattttaagcagaaattggatagagtcagacttgatttgggaagataaatgtggatacagtaaggaagatggacacaatgagggagaaacaggaacctcaggagttactttctcattaatcaaaagagaagtaatgaacacaagaacgtggcagatcaaaccagaatctctcttggaccacagacgacattgctgtttctgtgctaacaactcaaaatagtctgaacttaggaggcaaaaaataccaactaattgtctaatgtacttatttttccctcagtctatttctaactatagtcaggaaaaccaggctctgcagcatgtcctggtagtactatcgggtctactatgtcatcattcaggaagggagcctctcaggaaacactacctctgctctggctggaagggacaatataatatgttttataaggaaaacgtagaattttcttcactttctgccaaaagagctgaaacacatgaaagcctctcttcaaagactatctgttcaccattagttatagactgagaaggagaatcttggtgggttggaagaaagttgctgctattatctgcaggcatgcacactgccaataaacagagttgtaccacagagtctaatttgtctatttgagatgtcttctccttcatcttttgaagcctcaattgtaacagctgtgaaactacatcaggatttacacaaacatattaaaacagaaaagttgctgagaacagtttcatggtcacactgtgaagagttaatggtccaaaatcaatgctttcatggctcctgagggaagcggaattaacatcattccccaaacagattcctctctcttcaggatagctcccttcccatcctttcataacacatctgctcccctgagctaaggagttatatctagcatggtgtttctctgcagatgcagtgaagaggaataaagacttactatgacttaatgaccctcgagtccatgtttctgcccagaggattccgaagactaggctcggggattctgggacatgcctggtcatagggatgctctcactcactataaagttgcctccactttaccaagcaggcttgttgctcagaggcttcaaggggaacctaatcacggtctttaagaacctggactcatgctccaattctgctccaagtgagggctgggagaagaaatattacagaggtaagaatgcttgtgcaggagaagtgaaaagatacacaggagagaagaagagggcaaatgaggatagagaggccagattcttccacttttctgaggaattatcctaagcaccattgcaccattttcttcacagaggaacacaacagagcacatgggattggtgagggcagtggtgtaccaattagtaatgcacagaatttctgtctgtgtatctctctctctcccccctttctctctgcccctctctcttacacacacatacactcatacacacacattctcacagagtacactgttcacagccgaaacaccacaaatacagtcatatagtagcatggccatacttgttgtcaataagacaaaaggatgttattgcagacttcttttgtatgtgtttatttaaggtggtgggtgggtatcacatgtcaatattcaaatacaattacataggcattaacatatttggtctgtaaagttttattctctgtttccctcattgtctgagtgaatttaatgttgccagttgtaacttggttccctatatccctactactttatggaaccatccccaagccatttttattgtaagcacaatacccctgctagatcagccggactgaaccgccaatggcacagttatggaagagcctgaatgaaggtatttatccactttatccattcatcaactgctttggtctcaccaagattgggaaagctgtaagaataagaggagaaaattgtttcttttctaaatgagcagtattgggtcatatttgtatccataaaaatctagacataaatattaatgtctgactctgtgccatttcttcactttggcctcttctgagccattcctcctttatctaatcttaggccaaactgtgacataatttggactttttacaatgaaataacttctttctgctaacaggtgaattattttagctatcttgcatttaaataaacaaaatatttgggagcattaataaaataagtaagtataatttgttgaggatacactatgcactagcacctatacaaacattggtcttatttatcattaaaataaaccacattagttataatttatcatctcatttttacaggagaaaaaaaaactgatctatctggttaaagaatctgtccaagggtctcaagcaagtaaatggtttagcaggttttccagccatgtctgaaaagttttaaggtccacagaagacttctgtaatattctactacagtcagcaaaaaaataaaaatccaacaaagtaaaaaaaatcacaagttcaaaatgtgaactttggtgagcacaataagagaaaaattgctaattgttatgaatttgtcttttcagatggactccagtagggatctttgtcaatgtgcatatctagagaagaacaaacttaataatttgccctcaaaaaatgatcttgaggttattggccatacactgtctgctactgtggcatatagttataacagaaagaaggcaagaattcaggtaaaactgtgagagggtggatgtgctggcagctttgaattttactgtcagagaagcgtcctctttgccatctccctgggaatgtttttctcagctggcaaagtatcatgttgagacacagccacccttaagattgggctgactctggactgtaaatctcacaacacatcatcctagctatttcctcagactctcccaggtgaaatcacaaaaaccactgccctctgatttttcagcctggcatcttttcctcaatactggcaaacattatgttcttttttcaattttctctcagcttctcggggaccaagaaatgctcttgttcttctcatacagaatggggaattattaactcctttgcttgtgtacttctgctgtaaaatagctacctggcaaagttacaggacaactgatgtatgcagccacgtacataataaaacatgatttctctctctactcctatctctccaaccttctccgtctctctctctctctctctctctcactctctgtctctgtcacacacactcacacacaaacaaaagcacacttattacaaaccccaactctgattcaattaaatgctgaacaactgggaaccaacattcatgtggcagttttgagagtattacaatgattacccctggttctcaactcttagttgcagctattctctttgtagaaataaggccagtacatgcataaatattatacaatccaggttacattagttgctacagagttgtacagtgtctttagggatgcaaagttaaaataaggtaattttccttgttattgtcaaggaatcaatgaagagtccttaaaacattttaatttcaatattaaaatttgctaaatatttgatctgtttacacctgaaggtaggcacaattttgggacatgggaattttttttatgttactaactgatgttatagattgtaaggaagataaacataatttggcagatacacacaaggcattttattggaaggatatcagggaatcagaatgacaggatcttggagaaactggattgttcatgaagatttagaagcatcaaaattagtaattaatccataatagaaatgcacttatcagtttagctgagttagaaccaggaaagttctaacagagactgattaactacacttatgtgatgtcactgtataagatccttacgtttatattataataaaacatagaaagtggtagacagtagtacttctcctttgtactaggaatctttgtctcatctagaaactattgagatactcagaattttagtttctctgaattacatccataatatttatattattagacattagagcaaaatttaaatatttaatattaaaataatattaacaaactattatataaaacataatttggtactttttgttaaaatcactgtttttcaagaaattagttgtaaaaatggtatcattttcctttgcaaatatttttattgtctaagttaagataatagagctgaaatctcacaacatcatttacaatttcatttaatctgttatggtagcacctcatataacctctggaaaatttcactatgtacttatgagagaatgagagtgagaatggctaaaaattttctattataaaaatagttttgagcttgtgaacttctggaaaggtacttagaaaaccccagagatctcaagaccacacttcaaagaacacatggaatggtgatttcccaaaaagtaaagaagggctacttaggaaagtaatggaagggaatgccgtaatataaatatgcattgcattatgaaatttttcccattctttcaaatatctcaaagattacaaaacataaagccataagcaatattgcctatgatggatctcagaacaataatctgtgttgagaggcttcctcgattatcctctggaaagaagtgagtcttgaatgtttgtaaattaaccacctataccattacctctagcacactgataagagtctttctgtttcttcaggaacttgacaagagaggaccttaaagaaagtgagatccttcatacttaggaattcagtgacacttgctgggagaatgccttctatcaatgacacccacttctatccccccttcttcctcctgctaggaataccaggactggacactttacatatctggatttctttcccattctgtattgtgtacctgattgccattgtggggaatatgaccattctctttgtgatcaaaactgaacatagtctacaccagcccatgttctacttcctggccatgttgtctatgattgatctgggtctgtccacatccactatccccaaaatgctaggaatcttctggttcaacctccaagagatcagctttgggggatgccttcttcagatgttctttattcacatgtttacaggcatggagactgttctgttggtggtcatggcttatgaccgctttgttgccatctgcaaccctctccagtacaccatgatcctcaccaataaaaccatcagtatcctagcttctgtggttgttggaagaaatttagttcttgtaaccccatttgtgtttctcattctgcgtctgccattctgtgggcataacatcgtacctcacacatactgtgagcacaggggtctggccgggttggcctgtgcacccattaagatcaacataatctatgggctcatggtgatttcttatattattgtggatgtgatcttaattgcctcttcctatgtgcttatccttagagctgtttttcgccttccctctcaagatgtccgactaaaggccttcaatacctgtggttctcatgtctgtgttatgctgtgcttttacacaccagcatttttttcttttatgacacatcgttttggccaaaacattccccactatatccatattcttttggctaacctgtatgtggttgtcccacctgcccttaaccctgtcatttatggagtcaggaccaagcagatccgagagcaaattgtgaaaatatttgtacagaaagaataattctgtattaaagtttggataaatatatctatatacaacccaaattatcatcatctgagctccctttttaatcttctgtaacagttggtcatgcttgtcagattttttccttttgactggaagtgctttagtgttgacagataatgcaaacttaaaacctttgctgcctgtttcccctacttctctccaagtacctggacaaaggttagagattaatggagaaggtaactatgctgaaggttgaggtggctttggagtagaactgcttgtaaacaagggtgataggtagctccatttttttccatatgtcttctctctaggtaagtttagatcctgaaggatactgatcaaataaatctcattttatagatgaacaaaataagctgtaatccagcagtagtgtccgtttcatagctttgtattctttacagaatccaaaattttgttgttcttctccaaaatctttgactcccatgtttattttaatgctctctcagtcttgctgttactgccatttttgctcctttccttctttcagattcctgctctctctctttttgtgatggttaatactgagtgtcaactttatttgactgaaggatacaaagtattgatcctggttttgtctgtgagggtgttgccaaaagagattaacatttgagtcagtgggctgggaaaggcagacccaccttcaatctgggtgggcaccatctaatcagctgccaacgcagctagaatataaagcaggcagaaaaatgtgaaaagactagatgggcctagcctcccaggctacatccttctcctgtgctggatgcttcctcctcgaacgtcggactccaagttcctcagttttgggactcagagtggctctccttgatcttcagcttgcagatggcctattgtgggaccttgtgatcatgtgagttaatacttaattccccctttgtgtgtgtgtgtatgtgtacacacacacacacacacacacacatatatatatatatcctattagttcagtccctctagagaacactgactaatacacttttcttttacattcgttctctgataaagtaagtctttgtgaatttagggatatgagagactacagtgtgggtattacggagacatgttttctcacttgaagcaaagtcattttagatgtgactacttgtatgtgtcgcctgtctaattctaattctcaattctatctgacaatttcccttcagacaaaatatataaaacttatgagactttataaaacttagaaaaacaattaggctcaagctatggtaagcacagggccagacttgatatcgacttcaaaataatatcattataatttattaatcctgtagatctccaatatttagtcctattttcaaacttcagatatggctggagaatgtggtttgctttaaaatagataaaagagacattgaactgaaatttgtgacttatcagggtactcatgcttcaaaatcagaagaagtctccctcatgttctataatttagaaccactgtgtagtttgtatgacaatatacaaaatactcaaaagtacgcagataacgattttaggaaatgggggcggatatagccaagtagacaagaaaagcaacatcacctattcagtatctgtgaatctggacagttcttggtcttaacactggctaagcacaattcctgaattctatagtattttgtagattttctttaggtctgtatgcatgggttctaatttgatttttgcagcttctgcttcatgtacttaacattttatgggaacatagggttttaaatgtggaaatacattgaaacttgatctattccctttgtcttacaaataaaaaaaactgaggtctaaagaaagcaggtatttgtgtgcataaaatatacccatctttagcatcattctcatgtaacaagtgaaggaagatcactcagataaatccttttgactacaaattcttaactcttgcaggagatttaagtaggaaatattttatttatacgtgagaggcttcatcatgggtcccaagtggagatcaagtaaaaggagaggtagaacgagtagcctgggtttggtgttggtaatgagaagagggagaccacagaaactgagtacaggtgcaagtagtatagtgataaagagaagctgaaatcagcacagtcttcatcactgtggtccacagtactgagtggtaagcacagacgagcatccaggccctcaatagctgtaccatatataaacatgctaaataaagacaaagtttttttcttttctcagtgatatgaaagcatctgtgacatgtataatgcaactttctggttaaatatattgatgggagtcggaaaattttaatataagcgtaatagtgtccacagtgtagatgggagtgcaccataatgctggccctgaaatggttcataatcaaactggaacaccacacttaaacatggctgagcagagtcattgtactgggatcccttctctggacagtagttttctttcacgaaatcaaacaagatgggaccagaagggtgctgacaagctgaagaaaaaagacacaaaagataaatataattgagaaaatggtgacaaaaggaatgccaacctgaaataatagtatgagaatccagtgtaagtgtttattcaaatgcaaagctaaggatggccatctgggaaacacagaatccaaagaaatgaggtcaatgctccaaagttgaaaagttaaggttttacttatgtaggcagaaagcaaagaaatgtagcagaattaaagatttccccatacaaacttgatttatgagttacagcacattgattagttatagcttgttttctttttccaatttaaatgagtatttttaacattttaactttgacaatgtaatagtcatgaggtctttgtgtaaaacaaggaagaaggaagttaatcaataacgaagatcaaaaataaagagggaaagggtcttctctggcactcgttagtcttttacaacattctaaaaaacaatgtaggtaatggaaaaaggctaatttataatcaggcaaacaaatactacaacttcctaggttacagctatctgttagtgactcaagtcctataatcacattcttttaaggctcaaaataatttaaagtttcaacagctttggtcttgaattacttattttcattaaaaaaagacatcaatgccagagttaattatattctactggtattgaatattcgaagactatgccattttccataaaccttgctcaccccgtcaagcaatccttctccttaggaaccctttatgcatcacacggtattctacagaatatggaaaccagcctagctcatagactcttatgggatagtaagtgtgagaatattaatgctgtttatctctaactttatgttacccaccagcactttgggaacagacataattcagtgtaactgaaaataaacttccatgaagttcaattcagatacagtatcttcttgaatatgttccaacattgctccattcaattggtttattgatccataactcctatatcagtcagagccttgctatattatcctggtttcccaaaaaaacctttttaaaattccagatgcctgcagacttttccatttttctggtgccaaatttgaagaaaattctcaacagttttccaaagtgatttcaccattttacacttctaccaacaaaatatgaaaatcccaattgctcgacattcccaccaacatttggtgttgtcagtcatttgaatttagctactctagtgagtaaaaagcattatcccattgcagttttaatttttatttctctaataactaataatgatgtcaagtatatttttagctcttatgggccattttaaaatattcgcttgtgaagtatctattattcttttccaacaactacaaaattagctactttgagatatatttgaatgtagttcaaaagtcttaagaaattagaatccaaagataaaactacctatttcaaaataaacaataagagcagtaaattttacctatacttatacatgtttctatatacacatggatatttataaatatacagatgatccttgatttacaatgttttaattggacaattttttgactttagaatagtttgagtatatgcattcagtactttccttgacttacaatggaataaagccaagatcaacccctggtaaggtgtctgtaataccattgttattactaacaatgtcatgtctcttgaagacaatctagatcttcttacctcttgcatttccaaattccatttatttcatgctaattgcatcattactttggatgctgcattatccattgtcctgctcaagaataatgccttcaaaatattgaacaatattttcaatggatttgtttcttttttaatttttatggatacacagtaagtgcatatatttatggagtacatgagatgttttgatacaagcatgaaatgtgtaataaccacatcataatccagcaatcccactgctgggtatacaaacaaaaggaagaaaatcaatatatagaagagatatcagcactccagtgtttgttgcagcactgtttacaatagctaagatttggaagcaacctaaatgtccatcaacagatgaatggataaagaaaatgtggtacatatatacaacggagtactattcagccataaaatattttcaaattatcatgggtttattgcagcataaccccattgtaagttaaggagcatctatatataatatcatatattatgtattgtatattattacatgtgataaaagtaagtttaaatagaagaatctacaggaaaatctaaggctgcttattggcaatattagtgaaggttctagaaagcatagttagcaaactcaagctgaccccttaaactaagacaaatatataggcacagtttagaaattccacaagagactataaggatagtaagtgtgggaatgtttactctggggtccaaagaggagaaggagttcctggcatctggaggcccagagagcattgcagatagaagttgcaatttatttggaggtactcacagagcccgtggtgacctgcaggtcacctgcaatgaaggagcaggtgggaaccagaataaatatctcgacctcactcacttccccctcacctgctggtgcttcctattttctgaacccaagcagattctatgggacaaaagaggctattgatacagtacatagtcatgaatctcttaggacacagagtatagaatggacctagagaggccgaaaggagatctccagcacattggcccacataaacaaagggctggaggaaaattctgaacaaacatgaggcggccaatatttttatatattctcctttcaattactattgtgtgctatttatttcagtatttatttatttgtagcattagatactctcctttttgttctcagaatcctcttagaatcattttgaatttttttgtattcttttagacagcccaagaattataatgctgataaaaaatcatttggactaatatactgtgaaatataatctagtatgtttgcactgagaattgaaatgagaataaaaaagtaatggaataatcaccaggcatattcttagttttctcataattttagagtattctctctgtaaggccaaaagtaaaatgaaagaacattttatatgctaggggtattcttctatgtggtttataagattcatgggtattaaggaaaactttgggctttccaaagctttaattaatattgtaattcaaaaagatcaatatgataatgcatagtaagatatatccaattttataggaaacattagaaataatcaagaaaagtcactaacttttcatcctttacattcttttattgtaaaagaaatcaaagctccctgaagaaatgattttgaactcagaggtatacaaatagagatataacaaaaatatcttgaaaacttagttagcacaatagctcatgttcaagaaatgtagctgatttgactttcacgtatacataatgctcaaatggcacttgctgatttagcctgtatttaatgagcatctaattattatgttgtctaattcatatcaggagctcaataaaagaaggttgaatcaaggaacattggcttgtaggatgagcatgactgacatctagtggtaaaaataaatacttttttgtaaaatttatttatttattttgtaatttcaactcttagatttaggggctacatgtgtgggtttgtgacatgggtagattgtgtgattctgaagtttggggtatgaatgatcccatcacccactgatatggttaggctctgtgttcccacccaaatctcatcttgaattgtccgcataatccccacattagggttgggacctgttgggaggtgattggattgcagggttggtttcccccatgctgttctcatgatagtgagttatcatgagatctgatgtttttttaagtgtttgacagctccccctgcacgggcattctctttctctctcacctgctgccctgtaagatgtgcctcttccccttccgccatgactgttaagtttactgaggccttcccagccatgtggaactgtaagtcaattaaatctcttttctttataaatgacccagcctcagatatttacttatagcaacgtgaaaatgaactaatatacgcaggtggtaagcatattaccctataagtagtttttcaacccttgtcctcggcctctctcccacctttagtagtccccagtgtctgctgttcccatctttatgtccatgtgtaccaataaatacatttcctgaacaaataaatgacagtcatttaaatgaacaatctaatgaactaaaaaggtaaataactttttctactgaatatttatttatgttattgaacaccaaaaattctacttcaaataaggaatagaaataatgtccatttaataatatttagatatattgtcaaacactctgctgttctagtcaaatgcatgatctcacttactctgaaaaaaaaagtgtgaaatgtgttttgtcatttccgtcagccttgtgaatctataagaaggaacaagaagctgatagaggttaagaaatgttttcccagctacagaatctaagaaaaaaatatttaaatttatgttgcctaactccaaagtgttaacttcagagataatgttgtaaaagatttgtgaaaatgcatagccagtgttaatgtattaattaatttctaacaagtaagtgttgagcaccttccagacattaccttattatactgttacaatattgatataattttttctcattttccatttgagaaaaccaagacttagaatggcaaatgtaattgaacaagatcacagaataagagaatcaaaagatcatgttcttaatctgtaggttaaactgcttttctttctgtatatatatatattcattttgatatttctattaatattatgtatcgtgttagatgcattacacactcacaaaaatcatggaatgtaattcttgtaacagatatatctcatgaattggaaactgaagttagaattctatctctgccatttattaatgtacatatatttcagagatgactttaaggcgatgctgggttccttcttacagggctcttttcttgcctctctgtcaagagtaactaatcacctgataccacagtcagatttaaggtgtaagtgtgaggtcattatgcctctaactgaatagacccctgggacctgtgcagggaatgtacccactagaggatgcacagatcatcagcaagcagaaggtatctctgacaagataacctagagccctatcctcaggagtagggaaattttctgttttctctccaggtccagtgacacagcccacactttagggaagcccttcccaggggacaagaattctcatataactccttggctctgaatagtaagaactatgtcgcatacaggttgcagtctggggtatccggtccttcacagacaatttctcagatgcggggcagaggtaggtgagtcagctcctggttatgctgaaagagggtcctcaatgacagtaactaaagtgatttgtgggatgatggagctccagtgactcggccagagtctctgtagatagggccatcttctaaggaagtagcaagagaaagagatagtagttaagaaaaacccaaattcatagctgtagtcaagaacagactattacttaaggacatgataaaggaagaaaagcagtaaacaaacttcaaagagcattctgagagttaaaggaaaagagaaggataagtgttttaaaattaaaaaaaaaagagcatttcatgaagatgagaaggatgttaacagatcattccctggttatagctgtgtggtctgcttttcaagacctatgcacctatgactagttgttaggaatctcagatgctgaaacctcaaattttcacccgtccctggaattgccctcagatccaaggaactgcctcatctgaggtcatgtcgcatcacacagtgtggcccattgccaacaactagataatatagaaatacaaaaaaaataaaaaaggcttactttttttgtgtgtgtgggacaacttagagagatcaaaccatctccagagcttcatatcgtatcatttgaggcttcagatgtaactacatgataaagaagtttgtcttctgatccaatcctaccttcctggcttctttataagcatattttcccagagcctttctcaaaaatctttctgcccgccattctctatctcagatatgtttttaggaattcaatctaaaatactatatataacaatagggaagattattatttgcactcaactttcaatagccatttgtggatcctggcattaaaaaaatcatgttatcatggagataaatatgacactagttttgccttcaaagaaattataacctagtggtagatattcgccagtggttctcaaattggaataagcatcagaatcacctggagggctttttaacagattactggacccctcttcaagagcttctgattaaggtggtcttagttagtgtccaagaaatgtcatttataacaagttaccaggtgatgctgatgctattggtccagggaactcattttgaaaaccgctgataactcacgtaacagaaagatagattggcctttggaaaaataggaaaaaaaagaatggataatcttgaaataagcagattgaggcaggctatgtagattgtatgttaataaatctaggctatgtactatagtggtgactaaagctagacaggaaagtctcctcataagaggaaatatgaagaaagacatagagaagaaagcatgcagaaagtttgaagtgcagtttgactgcagtgtggagatgataatactgtaaagataggttaaaattaatgtttaagattcttcactgcattttatggaataaagacttttttcataaggatatggagcactactgaaattttattcttatggctcaggggtcggtgccctttttctataaagagagagagagttaatatttttaatattttcctgccatgagatctcagtcacaactcctcagatcttccattgtagattaaaagcagccacagacaatacataaatgaatgagaataattttgccccaataaaatttaatttacaaaaacaaatggtgggccagatttggtccatgggccatagtttgtgttctcagaaaatacttatgataatctgatttcaaaaattattttaattgcggactcaatgtaaagaaaagattgctttagactttgagtgtagaaatgttttacttcactgacaagagaaccactacacatttttttcagttgttgtgtttaattatgaaaagattgctaaggccatggtgaattaaatggctgtgacaatgtcaggaaattcaaagtcctacaccaaaattactttaagtgaacaatacaattctccaaagctaatattttagaaaataaaattcttgtaacaagcactgtcttaaggtgaaaaataatagctgttggatttgaaattgcatatcacaaaagaaaagctggatttatattcacaggaaacagtgaaaatataaaattaaacataaattttgttcctttggctgatttttctccattgcactcttaattctaccaaatttaggtattctttattcttccttatttcagtgacagattaaataatttagctctgtactttaatttttctgcaaacaaaattctctatagcttattcattaatacaattaatcatattgtgatatataacctctattttttaatctttgtaaatagccatgaataaatttaatgttttaagctaatcattgtattccaccattagcaggatgatcatcttattggcatttatggttgacccctgcggaagcattacattggaggaaacacaataactgaaaaaccaagtaagacaatttggtaataattcagatgaacaatgttagtctatgtatatcagtgaaaacagaaataggccaggtgtggcggcttacgcctgtaatcccaccactttgataggctgaggcaggcagatcagctgaggtcatgagttcaaggccagcctggccttgtctctactaaaaatacaaaaattagccgggcgtggtggtgggcacctgtaatcctagctactcaggaaggtgaggcaggagaatcgcttctacccaagtggtggaggttgcagtgagctgagattgtgccagtgtactccagcctgggaaacagagagagactccatctcaaaaagaagaaagaaaaagaaagaaaagaaaagtagaaaaactaaaatgtaggtaggaatataaatagagattttaaaaacagaacagggtataataatcagagaagactttgggaggctgaggcgagcagatcacgaggtcaggagatcaagacatcaagaccatcctggctaacatggtgaaacctcgtctctactaaaaaaaaaaaaaaaaaaaaaaaaattagccgggcgtggtggcaggcacctgtagtcccagctactcaggaggctgaggcaggagaatggcgtgaacccgagaggtggagcttgcagtgagctgagatagcaccactgcactccaacctgggcgacagagtgggacactgtgtcaaaaaaaaaaaaaaaaaatcagagaagaagaaaaaatttgaatgaaaaattattcagttttcaaatctttgtaactgtaaggatgttacatattaatagagatatgaaatacattgtatgagaaataaggatttaaaggcagcaagtggtgagtacaataaaaagagagggtctggagaaatatttctccttctccctattgaaagtaataatcatgatgatgattacagttatttaaaatccatgtggaaagtaatcacaccacatgtctataacttctaattttcaggacagtccctgcatgatgtggtgatcatgtgattaattttattacccccagcttacatataaaaaattactaatagcagtagctattgagtaagatatagtttttaattccctggcctgaatctcatttacctcctctgtaaatggggacagaagtgccaatttcagaactgctttaatctttaaataaaatcacatttcaaaagcactgaaaaaatacctggcacataatgtcagctagacgttttttccctctaacataaacttagttattattccttttagtaaaagacaaaatgtaaagaattctctgacagatcggatgctggggcaggggatagatgtaaatagaaagataaagctaatttgtggttattagtgggtgaaaggtattgatactgactcttttgtattgtaaacataacttttttatttttagacattcaaggggatacacgtgcaggtttgttacctgggcatattgcataatgctggggcataggcttctagtgaacccatcacccaaatagtgaacattgtacccaaaaggtagtttttcaactcttgcctctctacctccctccccacctttgtagtctctagtgtctgttgtttccatctttatgtccatgtgtacccattgtttatctcccacttataagtgagaacatatgctatttggttttctgtttctgcatgaattcacttagaataatggcttccagctgcattcatattgctgcaagggacattattctttgttatggctgtgtacttttctatggtgtatacgtcccacattttatttacccaatctaccactgatggacacttaggttgatttcatgactgctattgtgaatagtgctgtgataagcaaatcagtgcaggtgtatttttgatcagtccattttcctttgggtagatatccaatagcgggattcctagaaataatgatagttctatttttagttccttgggaaattttcatactgttttccatggaggttgagctaataaatccctaatactgtgtaagtgttcctttttctccacatccttaccaacatctgttattttttcactttttaataataaccattctgactggtgtgagatggtttctcactgtgtttttgtttttgttgttgtttgtctgcttgttcatttttgagccagagtctcattctgtcacccaggctggagtgaagtagcacaatcacggctcactgcagtcttgacctcccaggttccagtgatcttctcacctcaccctcctgagtagctgtaaccataggcgcacaccaccacaccaagctaattttttttttttttagatgaagtctccctatgtttcccaggctgatctggaattcctgggctcaagttatcctcccacctcggcctcccaaaatgctaggattacaggcataagccactgcacctggcctcattgtggttttaagttgcacttttttgatgattaatgatgatgaacattttttcatatgcttgttagctgtttgtgtgtctttttttgagaaatgtctattcaacctttgcccacgttttaattgggttttgtcttttgcttaattatttaagtccttattggttcttgatattagtcttctgtcagatgcatagtttgcaaatattttctcccattttgtaggttgtctgtttactctgtgaattgtttattttggctgcacagaatctttttagtgtaagtaaatcccatttgtttatttttgttttcattttcattgcatttgcttttgaagtctcaatcataaattatttgcctagggccaatgtccagaaaagtttttcctaggtcttttaggatttttgtagtttgaggcctcatattcaagtttttagtccattttgagttaattttgtatatggtaagaagtaggggtccagttttattcttctacatatggctagacaatttccctagcacatttactgaataagatatccttacccagttgattgtttttgttgactttaccaaagatcagttcgttgtaggtgtgtggctttacttctaggttctctattctgttccactgatttttgtgtcatgtttccagcaatgccatgctgttttggctactgcagccttggagtataatttgaagttgggtagtgtgatgcctttggctttgttctttttgcttaggattgctctgtctatttgggctcttttttggttccatattaattttagaatagttttttctaatttgaaaaaatggctttgggaatttcataggaatttcatagaatctgtagattgctttgggtcattttactgatagtgattcttccagattatgagtgtgaaatgtctttccgttagtttgcgttatctgtgatttctttcattggtgttttttagttctccttgtagagatctttcacctccttggttaaatgtatttctacatattttattattgtgtggctattttaaatgggtttgagttcttgatttggttctcagcttgaagaatactggtatatagaaatgctactcatctttgtatgttgattttgtgatactaactttcctataatcagatcccataaggagaaaaagatgattaatacaactcaggaaatgatcatatcataaagtatcttccctccctttagcagaatcgtgacatatcttgggaagcaattccacaccatgaaattggacagaatctgagaagatacaaacccaaatacacataccactatacttccaaagcagttctttgggcctgcattatagccaagtcatagggatagtttttctttaggattagtagcaccatattagaaatcattgcactcaaatgagcatcaaagtaatttgacccatggcactgatatggatatggcactgcccgaatctgactaacccaataactgaatgtattccatccatggcccagagcctaccacagaatacaccctgtagcagcaaagtttctaatcaagtcctagtctcatttgcacacacccaagcaccctacaggcctattatgttgcagattgcatccattgcacagagccagttacaaaccagactcaaccacaaggcacaccagaaagactcaattgtgacggtaaactagcctgctgtgaacttaaacatatcactgtccatcaatataccagggaaactattacagcattaatacaaactagactgtccccaatctgaggcaagtatctgacctcagtatcttttaaaaagatagagacaattacactgccactatctaggtggcattatgaagcgattgcccatttatataatgcgaaatggagaagacagaaaagatcataaatcacaaaaggcactgcaaagtatctgagagcatccagtgttttctattcaggaaagaaaacataatatagtgaagggcctttgaagttgtaagagggagcattgtttttctggaattatgcaatagttaccctatgtatctaaatttaaaaattttatttattatctcaaatccaaacaccaactaaccaatcctccacctttactgagtctcctctcacagagaatattcttaatttctcagatctaatttgcaagaatgtatcattcctcttatcattttcctcctcaatctcagtccagtgacattttacacacacacacacacacacacacacacttcaccttggctactctttacatcctgattaacaagtataattagcaataaatatatgctaatttaatgccatatggaagttttttcttagagactgaagggaggaaagacatgggaagtgcaggattgctatattttggaaactttctgcatggtttcctgtgtaagtgaggcaaatatttaaaagtgagagtgtctttttaactatatttcatattccctctctaggtctcttatgctatattatggagttaaagaatggattttctgtttccccaagaaatagacaccatgctgtgaaagaagttatggtttctcactggaagcaagaaaactcatgcaagaaatgtgtctgtagggaatggccaccaatatgcttcataccaacaatacacagtttcacccttccaccttcctcgtagtgggggtcccagggctggaagatgtgcatgtatggattggcttccccttctttgcagtgtatctaacagcccttctagggaacatcattatcctgtttgtgatacagactgaacagagcctccaccaacccatgttttacttcctagccatgttggccggcactgatctgggcttgtctacagcaaccatccccaagatgctgggaattttctggtttaatcttggagagattgcatttggtgcctgcatcacacagatgtataccattcatatatgcactggcctggagtctgtggtactgacagtcacgggcatagatcgctatattgccatctgcaaccccctgagatatagcatgatccttaccaacaaggtaatagccattctgggcatagtcatcattgtcaggactttggtatttgtgactccattcacatttctcatcctgagattgcctttctgtggtgtccggattatccctcatacctattgtgaacacatgggcttggcaaagttagcttgtgccagtattaatgttatatatggattgattgccttctcagtgggatacattgacatttctgtgattggattttcctatgtccagatcctccgagctgtcttccatctcccagcctgggatgcccggcctaaggcactcagcacatgtggctctcacgtctgtgttatgttggctttctacctgccagccctcttttccttcatgacacaccgctttggccacaacatccctcattacatccacattcttctggccaatctgtatgtggtttttccccctgctcttaactctgttatctatggggtcaaaacaaaacagatacgagagcaggtacttaggatactcaaccctaaaagcttttggcattttgaccccaagaggatcttccacaacaattcagttagacaataatgagatcataacaaaataaacactggaaacattttttttactacttctcttgcattcccacatgagccaatagcattatatcccctacaacgtctcatgatttcagtacggtctgttggaagttatagctcaaagattccaaaacaatctctctgtttcacccattaaaagtgcaaaaagtactcacacttaagccccatgatactacaaaatgcctaaagagaaacaaaggctttgtaaaagttattgcccagtaattgtcttgaatagcctttccacatgaagattctctgtatttacatatccaaagctgaagttcatgacgattaaaatgatgtggtatttcatcaaaaccaggcaggatacagtggcaagagaaattaactaggagtcataagatctagatttaaatacaggttatggccttacctaaaattttgacctgagcatttcacttagactctttgagttcacaataacaaattcatactgatttatagcattttatgagcagggatattgaagcttaaagtgaatgttgtgaaaatctgtgcagcttgtaaaacattaaaagatttggaaacaaaatgagtgcttactaaacataattatagtgtaattgttatttctaatgtatgtagatttcatttactaatccactctagtatacaatccctggtttgaggtcagctctccagatccagattatcccaacgcatgggcctcttcatggacctctcagctcttaccttcgtgaaagagactttcagtcaggagactataaagcttgaagagttaacaggtttctgtcttgggcttaaggactcagggaaatcccatcctccacagtctttgctagagtgggttttagggcagactgtaatagtgtggctgctgaaataatataaagtcattcttaataaggtatagaagataaataggacaatttatttctttgggtattctaggagctgcaaaaatgtgaagttggctcctaattggaaatggagccctgattgaaactcaaggtagaatgagcagaaatgtacagagaatagtgcgaaagtaataacaatataaataacagtataaattgacaagtggaagtaaactgaagtgatatgtcatataaatatataaagaaaaagtaaccaagtaatcattttctaagtagatattttgaaattgatacagaatttaaaaaaaactaaacagatcatttaacaaggaataaagatgacaaaaaattcattgtggagtgtcttctaagtaaaataccacttttcaattatagtttatttaatgtattattatataatatttcaactacgaaaatctcattttagagcctgaatatttacatttgtatatttaaaggctctaatatgttcaattttgttcactctacccaaaatatgttaaaccaccagaccacttaattttggtatcatacgttaagaacttcgactaagagttttcctgtatcatttctgagactttgctaaatgtcacgtgctccagaaagtgagtaatctgaatggaaatgggtaacagagaactttaatttctaaggagcatagaagctaatacagaagagaaaaccccattcattaccaagtatatgttccaggggctgtaacatgggagccaggagcatatttgaaaacagcacagtgtgcacatagaattcccaagaaaggaaagttgtttagggagtttatcaagctctagagttttttttttttttaactgaatttgtacaaagccatcaatactgcaagtcttggagcaggtcggctgagctatgccaaatgctatggtaaacactgaatattggtcatcttggctgagtccatgtctgtgaaacattggcatgcttcaagccaatctaaaagaattcaactttgtttattatttcaaaatttcaaggctgctgaaaggtaggtctttatacacagtcactttatttgctagctgagtattttcatcgggggcaactgatgaaaatgttgacttccactaacctaagcctgtccgttgttactatcgtatcttccagttcaacgtcagggaaatagtttttggtgctttccttgtttatatacagatgtttatgacttatctatgcactggcctggaatctggggtactgataatcctggccatagaccactatgtcgtaattcgcaatccactgagatataccatgattctcatgaacaatgtggtagccatcctaggaagtcatgataattagatctttaatctttatcatcccttttgagtttctcatcttgctgttgtcattctgtgctgcccatatcatcccccacaccaaatgtgagcacatgggcattgcccatctttcctgtgccagtatcagagccaataatatgtttgggatggttgcctttttgtgggatttattgaccttattgcaattggtttctcctatgtaaagaaactacacactgtttcacttaccaccatggaatggccagttcgaggctctcaatacctgtggttcccatgtttgtcatgctcatcttctacatcccagtattttttttctgatacactgcttggtgaaagcatccctgctatattcgtatatttctggccaatgtatatacggttgttctacctgtattcaaccctgttatctatgggatcaggaaaaaacagatcccagactagggtatagacctaaagacatttgatgatcagtcacttctagtcatgatgatatatatattgggatatatatgcaaatatatatacacatatatgtgtgtgactatatatgtgtatatgtatgtatatatttgtgtttgtattatttttttatttcaataggttttgggggaacaggtggtgtttggttatacgaataagttctttagtggtgatttttgagattttcttgcactcatcacccgagcagtgtacactgtacccattgtgtagtcttttatcccttgccctcttcccaccctttcacccaagtccccaaagtccactgtatcaatcttatgcctttgtgtcctcatagcttagctcccacatatgagtgagagtatatgaaatatgattttccattcctgagttacttcacttagaacaatagtctccaattccatccaggttgctgcaaataccattatctcgttcctttttatggctgagtagtattccatggtatatgtatgtaacccattttctttgcccactcgttgactgatgggcatttgggctggttccatactttttgcaattgcaaattgtgctgctataaatatgagtgtgcaagtatcctttttggtataatgacttctttttctctgagtagatacccagtagtgggattgctggatcaaacagtacatctacttttagttctttagggaaactccacacagttttccataatggttttactagtttacattcccaccaacagtgtaaaagtgttctcttttcactgcaaccaaaccaacatctataatttttgattttttgattatgctcattcttgcaagagtaagatggtatcgcattctggttttgatttgcatttccctggtaattagtgatgttgagcattttttcatatgcttgtcggccacttgcttatcttcttttgagaattatctattaatgttcttagcccatgtgctgatgggattttttttttcttgctgatttgtttgagttatttgtagatctggatatcagtcctttgttgagtgtgtagattgtgaagattttttcccactctgggggttgtctgtttgctctgctgattgtttcttctgttatgcagaagctttttagtttaattaagtaccacctatttatctttgtttttgttgcatttgcttttgggttcttggtcatgaagtctttgcctaagccaatgtctaaaagggtttttccgatgttatcatctagaatctttatggtttcagatattaaagtctttgactcatctggagttgatttttttatcaggtgagagatgaggatccagtttcattcttctacatgtggcttgccagttatcctagaaccatttgttgaatagggtgtcctttccccactttatgtttttgtttgctttatcaaagatcagttggctgcaagtatttgggtttatttctgggttctctattcttttccattggtctatgtgcccgtttttataccagtacaatgctcttttgctaactgtggtcgtatagtatagtttgacgtcgggtaatgtgatgccttcagatttgttattttttgcttagtcttgctttggctatgtgggctgttttttggttccatataaattttaggattgttttttctagttctgtgaagaatgatggtggtattttgatgggaattgcattgaatttgtagactgtttttggcagtatggtcattttcacaatttgattctacccatccatgagcatgggatgtgtttccatttgtttgtgtcatctatgatttctttcaacagtgttttgtagttttctttgtaaaggtgtttcacctccttggctaggtattttcctacatattttatatatattttttgaagctactgtaaaagaggctgagttcttgatttgattctcagcttggtcactgttggtgtatagcatagctactgatttgtgtacattaattttgtatcctgaaactggtgaatttgttgaccagttctaggagcttttggatgagtctttagggttttgtaggtatacaatcatattatcggcaaacagtgacagtttgacttcctgtttaccaatttgatacctgcgatttctttttcttgtctgattgctctgactaggacttccagcgctatgttgaatagaagtgatgagaaagggcatccttgtcttgtttcatttctcagagggaatgttttcaacttttccccattcagtataatgttggctgtgggtttgtcatagacggcttttattacattgaggtatgtcccttgtatgctgattttgctgagagttttaatcataaagcgaagctggattttgttgaatgctttttttgcatatattgagatgatcatgtgatttttgtttgtaattctgtttatatggtgtatcacatttattgacttgcagatgttaaaccatctctgcacacctggtataaaacccacttgaccatggtggattatctttttgatatgctgttggatttggctcgctagtaatttgttgagaatttttgcatctatgttaatcagggatagtggtcagtaattttctctttttgttatgtccttccatggttttgatattagtatgatactggcttcgtagaatgatttggggaggattccctctttttctatcctgtggaatagtgtcaataggattggtatgaattcttctttgaatgtctgaggattcagctgtgaatctgtctgggcctggactttttattgttggcaatttttaaattaccatttcaacctcactgcttgttattggtctgatcagagtttctatatctttcaggtttaatctggagggttgtatatttctgggaatttatccatctactctaggttttctagtttatccacataaaggtgttcatagtagctttgagtaatcttttgtatttccgttatgtaagtagtaatatctcctgttttatttctaattgagcttatttggatcttccctcttcttttcttggttaatctcaccaatgatccatcaattttatttatcttttcaaaggagcagcttactgttttatttatcttttatattttttgtttgtttgtttcttttttatttagttatgctctgatcttggttatttcttttcttctgttgatctggggtttggtttgttcttgtttctctagtttcttgaggtgtgaccttagattgtctatttgtgctctttcagattttctgatgtagacatttaaggctatgaactttcctcttagcattctttgctgtatcccagaaggtttgataggttgtgttactactgtcattcagttcaaagaattttttaatttccatcttgatttcacagttaacccaatgatcattcagaaacaggttatttaatttccatgcatttgcatggttttgggggttccttttagggttgatttccaatttgactccaccagggtatgacagggtacttgatataattttgattttcttaaatttactgagacttgttttgtggcctatcatatggtctatcttgtagaatgttccatgtgctgatgaatagaatgtatattctgcagttgttgggtagaatgttctgttaaatatctgttaagttcattttttgtagggtatagtttaagtccatttttttttgttgactttctgtcttgatgacttgtctagtgttgtcagtggagtattaaaataccccacattattgggttgccatctatctcatttcttaggtctagtagtaattgcgttataaatttgggagctccagtgttaggtgcatatatataggattgtgagattttcctgttggactaatccttttttcattatataatgtccttctttgtctcttttaactgctgttgctttaatgtttgtttggtctgaatagctacttctgctcgcttttggtgtccatttgtatggaatacctttttccactcctttaccttaagtttatatgagtcctgatctgttaggtgagtctcctaaagacagcagagacttggttggtgaattcttattcattctgccattctgtatcttttaggtggagtatttaggccatttacattcaattttagtattgagatgtgaggtactcttctgttcattacgctattaattgactgaatgcctgttttttttcattgtgttattgttatataggtcttgtgagatttatgctttaaggatgttctattttgatgtattttgaggatttgtttcaagatttagagctccttttagcagttcttgtaattctggcttggtagtggcaaattctctcagcatttgtttgtctgcagaagactgtatctttcctgcatttataatgcttagtttcactggatacaaaattcttgaccgataattgctttgtttaaagaggcaaaaaataggatcccaatttcttctagcttgcagggtttgtgctgagaaatctgctgttattctgataggttttcctttgtatgttacttgatgcttttgcctcatagctctattatttatttagttagttagttagttagttggactctcgttctgtcacccagggtggagtgcaatggtgtgaactcggctcccttgcctccaaggttcaagtaattctcctgcctcagcctccccggtagctggaactacaggcacatgccaccacacccagctaatttttgtacttttagtagagacagggtttcaccatgttagccagactggtcttgaactcctgacctcaagtgatccgcctacctaggcctcccaaagggttgggattacaggtgtgaaccaccactcccagccttgcctcacagctcttaagattctttcctttgtcttgactttagagaacctgatgactgtgtgcctaggtgaagatctgtttgcgatgagttttccaggtgttctttgaacttcttgtatttagatgtctagctctctggcaaggctggggaagttttccttgattattccctcaaatatgttttccaaactttgagatttctcttcttcctcaggaacatcaatcatccttaggtttggatgcttaacatagtcccaaacttcttggagactttgttcatttttttaatcattttttctttgtctttgatggattagattaatttgaaaaccttgtctttgagctctggagttatttcttctgcttgttcaattctattgcaagactttccagtgcattttgtatttctctaagtgtgtccttcatttccagaagttgtgtttgtttttttatttatgctgtctatttcactgaagatttttcctttcatatcctgtattatgtttttgatttctttaagttggatttcacctttttctggtgcctctttgatcagcttaataattgatcttctgaattctttttctggtaattcagagatttcatcttggtttggatccattgctggtgagctggtttgatcctttggaggtgttaaagaaccttgttttgtaatattaccagaattgtttctctgttccttctcatttgggtagactatgtcagagggaagatctgggacttaagggctgctgttcacattcttttgtcccataggggtgctcccttaatttggtgttctcccctttcccctagggatgaggcttcctgagacctgaactgcaatgactgattttgctcttctgggtctagccacccagtgtagctacagggctctgggctaatactggaaagtgtctgcaaagagtgctgtgatgtgatctgtcttcaggtctttcagccacagataccagcacctgctccggtggaggtagcaggggagttaagtggagtctgtgagggtccttagttgtatttttgtttagtgcactggttttgtgttggttggcctgcagccaggaggtggcatgttcaagagcacatcaactacagtactagaaggaggatgtatacttgccctggggttgtctggttacgtattcaggtttctcaggtggtgggcagcgccatagagctctcaggatattatgtcctttgtctttggcaaccagaacgggtagagaaagaccaccaggtgggggcagacataggtatgtctgagctcagactctccttgggtggagcttgctgcagctgctgtggggaataggggtgtgattcccagtccaatggagttatgttccctggtggattgtggctgcctctgctgagtcatacaggtcaccagagaagtgggacaaagacagcagtcacaggcctcaccccattcccatgtagccacagtcctaaatgctggtctcacttccatcatgccccacctaccacaccaagtgtttccaggcagctggtgaccagttctgagaacttgccccagaccgtcagccaccccactgagaaagcaagctgattcagagttttttggcatctcaaggagcctgcagaagcaatccagttccttcaaagggtctgtggattatctcagcttacctggcatgttcctgcagtaattcttggagaaaagttaatgatgtgagtctctacatgctgccctgtctctgactagcctcctatttgccatcttaatctcagtcttgattctgtgtttgtatttttatctttcttgactgaatagtgtataaagaaatgtatcacactatgattttttttcaaagtagcacatttttggttttgttttttttcctttttctgttcattttctatcttattgagttcggctcatttctattattttcttccttctattttttgaatatgcttttcccatctttttctagatttgtaaggcagaagcttatagaattgatttcagactctcatttttttcctaataaaaataattaatatgcttaatgctccattcacagcaatctgggctttttctaccttgcttctccaaattcttcaagcttctatctattacccagttcaaaaaccacttccatattttcaggtatttgttgtagcaacaactctactcccaatatcaatcttcctggtactgttttgtgctactataacaggatatcagagactgggtaatttataaactatagaactttatttggctcacagctctggaggctagaaagtccaaggtcaagtgacctgcttctggtgaaggccttgtcactgggtcatctcatggcagaaggcagaagggcaagagtgtatgtgcatgagaaagagagaagagagagaattagaaatggagagttgaatctgcttttataacaaacccactcccacgatagcagcactaattcattcatgagggcagggcccatgtgacataatcgcctcttaaaggtcctacctcccaatactgttgcattggggtttaagtttccaacacatgaatcttgagggacattcaaaccatagcagccatattatactgccatcattctactttaagttattgtgcccttctttatacaattaattccccaaaagcagagatgaataacatttgatcttttctcacaagaccaaacagtgattgtcacttaatctgactgagcagattattctgttatgtaaaactttttaaaactagtttgatgcactaatactttccacaaaccttcttacatgatttcccacatatttaaatgacttgtttatgaaatttttcctctttggtcagttgcttgacgatctgatcagtgccttgttattgcttagcaacgactgttgtattgaggtttccaagtttctccagaactgttttgccaggtcccaagctggcagaactgaatgcctttagcgtcctatttctcctgactatgcggccaatgtcatcctccattattttgtttccaaataagcagccagatccttagtagctcattgactttcagaattcattgagaacagaaagacaaggtatcttctggtattttgagaaaatatatgtcctttgaaaagttagctttaggagatacacctaatgctaaatgacgagttaatgggtgcagcacaccagcatggcacatgtatacatatgtaactaacctgcacattgtgcacatgtaccctaaaacttaaagtataataataataaaataaaataaaaaataaaaaaagagaaaagttaatgctaaacagagaatagaagtaagaaaatgcagtgtctttgaattggaaaaagaaagattgtacttcctctccaccaacaaaaagacagaagaaagaggagaacaaatgaattttctgacttgaagttataatcctacgagggaaaaaatgctgctcagtaactgcaggagttcttgaccactggaacctcccaggtgtcagctttttcacaaaatattggaatatttgaataaatctgggattatctaagggagggcagttgggaagaccagttgggtcagagaagcaatcataacacatatttaatatacctttatactgatggatgaagcttcaaattgacagttgagcagattgtcattaaataacgaaaagtacctaagtttttatccaaagcttaattgttcctctctttgctcctaaaactcaacatgctttctctcttagtacagaacctctgcatgtgtgtagttttcactgcctaaaataatcttttcatccttctttgcttaggtgattcctatttttctttcttgttcaacctacttaggtttacttaaaatgaccttacccaaccttcaatattatgttaggctgtcaggctccactgtaacaggcttctactgtagcacccagaaagtttctttctttgaaataactgaccacaactgtattgaagtgaggctcaatgcctacttttccattatacattatacttcctattaatggggacagataatatttacaaagtaccatatatcaggcactatgattagtattattcatgttacatcatttaataaatgcaattaacatgagatacatgctaagtttatgactattttccggaggaggaaatagatgcacaaagacataaaaacaacttgataaaggcttcacacacagcaagtagtgaaaccaaaatttgaacccaggaagtataattccagcatcaaggtgttaactaccacttcaccttcatttatgaaagtacaaaacaatgtagttcatctttgtaaataagaaaagctcaatatttattacatgaaatatccaccatacctctttaactgctatttcaatcagaattcttactttcaagcaacaaaaaataattctagatattttaagcaaagaaaaattattgaaaagatgatggatacctcacagaatcactaggaaaacagaaaagtaataaaataaaagaaaataaaaatacaaaccaagtaacaaccaggacctctgtaaaattaatccagagaactaattctgtgctgaagtgttattgcaaccactgctgaacttcagatgacatggtttatataaatagttcttttgtgtttatttcagatggttttcgaacattgatcaagtaactatatataatagtgaccactgtggaaaatcattttgatttaaaattttagtagttaatacatatgattcagttataattttagaaatttttgaggatttatgtctcgagaaacttctctgaagttcaatttacagttaaaagcatcataaaagcgattttaagtgaatgttttatagtgtattttaatatagtagacattataatatgttttaacagaataagtaatgaaaataatgtttttctaactaacacactcaatcctttttgtttgtttgatagccctctttttacactagcatgtactaggaaaccataggtagacagtaaatgcaaacaagaaaataatttttctactaatgtacatactgatatcaaaaggacacaagtcctaacttttttacatttataatattgtctttcacaagattgtgggcatagctcaactaatgtttactgatttatattaatgatagcaaaatgttagaatacggtaactttttgaagatggccgaataggaacagctccagtctacagctcccagcgtgaccaatgcagaagatgggtgatttctgcatttccaactgaggtaccgggttcatctcattggggagtgtcagaaagtgggtgcaggacagtgggtgcagcgcaccgagcgtgagccaaagcagggcaaggcactgcctcacccaggaagcgcaaggggtcagggaattccctttcctagtcaaagaaaggggtgacagacagcacctggaaaatcgggtcacttccaccctaatactgtgcttttccaatggtcttagcaaatggcacaccaggagattatatcccgcgcttggcttggagggtcctacacccacggagcctcgctcattgctagcacagctgtctgagatcaaactgcaaggcggcagtgaggctgggggaggggtgcccgccactgccaaggcttgagtaggtaaacaaagtggcgtggaagctcaaactgggtggagcccaccgcagctcaaggaggcctgcctgactccacctctgagggcagggcatagccaaacaaaaggaaggagaaacctctgcagacttaaatgttcctgtctgacagctttgaagagagcagtggttctcccagcacgcagctggagatctgagaacgggtagactgcctcctcaagtgggtccctgacccctgaaccccgagcagcctaactgggaggcaccccccagcaggggcatactgacacctcacacagcagggtattccaacagacttgcagctgagggtcctgtctgttagaaggaaaactaacaaacagaaaggacatccacaccaaaaacccacctgtacatcaccatcatcaaagaccaaaagtagataaaaccacaaagatggggaaaaaacagaacagaaaaactggaaactctaaaaagcagagcacctgtcctcctccaaaggaacgcagttcctcaccagcaacggaacaaagctggatggagaatgactttgacgagctgagagaagaaggcttcagacgatcaaattactctgagctacgggaggatattcaagccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatgagcaatggaagatgaaatgaatgaaatgaagcgtgaagggaagtttagagaaaaaagaataaaaagaaagaacaaagcctccaagaaatatgggactatatgaaaagaccaaatctacgtctgattggtgtatctgaaagtgacagggagaatggaaccaagttggtaaacactctgcaggataccatccaggagaacttccccaacctagcaaggcaggccaacattcagattcaggaaatacagagaacgccacaaagatactccttaagaagagcaactccatgacacataattgtcagattcaccaaagttgaaatggaaaaaatgttaagggcagccagagagaaaggttgggttacccacaaagggaagcccatcagactaacagcagatctctcagcagaaactctataagccagaagagagtgggggccaatattcaacatttttaaagacaataactttcaacccagaatttcatatccagccaaactaagcttcataagtgaaggagaaataaaatactttacagataagcaaatgctgagagattttgtcaccaccaggcctgccctaaaagagctcctgaaggaagcactaaacatggaaaggaacaaccggtaccagccactgcaaaaatatgccaaattgtaaagaccatcaaggctaggaagaaactgcatcaactaacgagcaaaatcaccagctaacatcataatgacaggatcaaattcacacataacaatactcaccataaatgtaaatgggctaaatgctccaattaaaaggcacagactggcaaactggataaagagtcaagactcatcagtgtgctgtattcaggaaacccatctcatgtgcagagacacacataggctcaatataaagggacggaggaagatctaccaagaaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtccttagtgacctacaaagagacttagactcccacacaataataatgggagactttaacaccccactgtcaacattagacagatcaacgagacagaaagttaacaaggatatccaggaattgaactcagctctgcaccaagcagacctaatagacatctacagaaccctccaccccaaatctacataaaatacattcttttcagcaccatacctattccaaaattgaccacatagttggaagtaaagcactcctcagcaaatgtaaaagaacagaaattataacaaactgtctctaagaccacagtgcaatcaaacaagaactcaggaataagaagttcactcaaaatcactcaactacatggaaactgaacaacctgctcctgaatgactactgggtacataacaaaatgaaggcagaaataaagatgttatttgaaatcaatgagaacaaagacacaacataccagaatctctgggacacattcaaagcagtgtgtagagggaaatctatagcacaaaatgcccacaggagaaagcagaaaagatctaaaattgacacactaacatcacaattaaaagaactagagaatcaagagcaaacacattcaaaagctagcagaaggcaagaaataactaagatcagagtagcactgaaggaaatagagacacaaaaaacccttcaaaaaaatcaatgaatccaggaattagttttttgaaaagatcaacaaaattggtagaccgctagcaagactaataaagaagaaaagagagaagaatcaaatagacacaataaaaaatgaaaaagggtatatcaccactgatcccacagaaatacaaactaccatcaaagaatactacaaacacctctatgcaaataaactagaaaatctagaagaaatggataaattcctcgacacatacactatcccaagactaaaccaggaagaagttgaatctctgaacagaccaatcacaggctctgaaattgtggcaataatcaatagcttaccaaccaaaaaaagtccaggaccagatggattcacagccgaattctaccagaagtacaaggaggagctggtaccattccttctgaaactattccaatcaatagaaaaagagggaatcctccctaactcattttatgaggccagcatcatcctgataccaaagcctggcaaagacacaaccaaaaaaaagaattttaggccaatatccttgatgaacattgatgcaaaaatcctcagtaaaatactggcaaaccgaatccagcagcacatcaaaaaacttatccacgatgatcaagtgggcttcatccccgggatgcaagcctggttcaacatacacaaatcaataaatgtaatccagcatataaacagaaccaaagacaaaaaccacatgattatctcaatagatgcagaaaaggcctttgacaaaattcaacaacccttcatgctaaaaaaaactctcaataaattaggtattgatgggacgtatctcaaaataataagagctatctatgacaaacccacagccaatatcatactgaatgggcaaaaactggaagcattccctttgaaaactggcaaaagacagggatgccctctctcacccaacataatcctatctctgctgcattcctgctaccttagtgtaatggttctgttaatgaactgtagacatacaaacctcttggtcttataacaaaatggtataggtttagtttatcattgttattgattttagactgagggaatgatgaaatcagtgccatacatggagtgcttaaaactgtaatgccaaactaacggtctttctttatctgtcatggagaattagaggacaaagtttgggacaacaacagctgctagaaagaaagacaaaaatttagaaagtataaagccaagtatggaaagctcaaattctatatataaactttgccatgtctttggttaattcctgaaccaagcatgcataaagcagacacaaagacattcagataaaaataagaggtgagcaagacggctgaacaggaacagctccagtctagggcccagcgtgagcgacgcagaagatgggtgatttctgcatttccatctgagctttgaagagagtagcagttctcccagcacacagctggagatctgagaacgggcagattgcctcctcaagttggtccttgacccccgagcagcctaactgggaggcaccctcaagtaggggcagactgacacctcacatggctgggtactcctctgagacaaaacttccagaggaacaatcaggcagcagcatttgtggttcaccaagatccgctgttctacagccaccgctgttctgcagccaccgctgctgatacccaggcaaacagggtctggagtggacctctagcaaactccaacagacctgcagctgagggtcctgtctgttagaagggaaactaacaaaccgaaaggacatccacaccaaaatcccttctgtacgtcaccatcatcaaagaccaaaagtagataaaaccacaaagatggggaaaaaacagagcagaaaaactggaaactctaaaaagcagagtgcctctcctcctccaaaggaatgcagctcctcaccaccaacggaacaaagctggatggaaaaagactttgacgagctgagagaagaaggcttcagatgatcaaactactccaagctacaggaggaaattcaaaccaatggcaaagaagttaaaaactttgaaaaaaaattagacaaatagataactagaagaaccaacgaagagaagtccttaaaggagctgatggagctgaaagccaaggctcaagaactacgtgaagaatgcagaagcctcaggagctgatgtgatcaactggaagaaggggtatcagtgatggaagatgaaataaatgaaatgaagcgagaagggaagttcagagaaaaaagaataaaaagaaatgaacaaagcctccaagaaatatgggacgatgtgaaacatagtgttggaagttatggccagggcaattaggcaggagaaggaaataaagggtattcaattaggaaaagaggaagtcaaattgtccctgtttgcagatgacatgattgtatatctagaaaacccccatcgtctcagcccaaaatctccttaacctgataagcaacttcagtaaagtctcaagatacaaaatcaatgtgcaaaaatcacaagcattcttatacaccaataacagacaaacagagagccaaatcatgagtgaactcccattcacaattgcttcaaagagaataaaatacctaggaatccaacttaaaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactaaagttcatatggaaccaaaaaagagcccgcatcaccaagtcaatcctaagccaaaagaacaaagctagaggcatcacgctacctgacttcaaactatactacaaggctacagtaaccaaaacagcatgatactggtaccaaaacagagatctagaccaatggaacagaacagagccctcagaaataatgccgcatatctgcaaccatatgatctttgaaaaacctgacaaaaataagcaatggggaaaggattccctatttaataaatggtgctgggaaaactggctagccatatgtagaaagctgaaactggatcccttccttacaccttacacaaaaattaattcaaggtggattaaagacttacatgttagatctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcatctgcacagcaaaagaaactaccatcagagtgaacaggcaacctacaaaatgggagaaaatttttgcaacctactcatctgacaaagggctaatatccagaatctacaatgaattcaaacaaatttacaagaaaaaaacaaacaaacccatcaacaagtgggcaaaggatatgagcagacacttctcaaaagaagacatttatgcagccaaaaaacacatgaaaaaatgcacatcatcactggccatcagagaaatgcaaatcaaaactacaatgagacaccatctcacaccagttagaatggtgatcattaaaaagtcaggaaacaacaggtgctggagaggatgtggagaaataggaacacttttacactcttggtgggactgtaaactagttcaaccattgtggaagtcagtgtggcgattcctcagggatctagaactagaaataccatttgacctagccatcccattactgagtacatacccaaaggattataaatcatgctgctgtaaagacacatgcacacgtatgtttattgcggtactattcacaatagcaaagacttggaaccaacccaaatgtccaacaacgatagactggattaagaaaatgtggcacatatacaccgtggaatactatgcagccataaaaaatgaagagttcatgtcctttgtagggacatggatgaagctggaaaccatcattctcagcaaactaccacaaggacaaaaaaaccaaacaccgcatgttctcactcataggtgggaattgaacaatgagaacacatggacacaggaaggggaacatcacacaccagggcctgttgtggggtggggggaggggagagggatagcattaggagatatacctaatgctaaatgacaagttaatgggtgcagcacaccaacatggcacatgtatacatatgtaacaaacctgcacattgtgcacatgtaccctaaaacttaaagtataataataataaaaataaataaaaaataaaagaggtgagttagtatttgaactgctattcaagagcatgattttgtagattgcattgaaccaggttaattcccctgctaaaacaaacacttcaacactgtttggaagactataacagaatccatagcatccacaacataacatttacagtattcagcacactatcctaaatttcccgacatacaaagaactagaaaacaataatctggtctcaatagaaaacataatcaaatgagaccaaagaccaaattcaagattactcaaatatcaaattagccactgagaaatttcagaaagctaatatatctatgcccattgaagtgaaggaaaatatatagtgataaatgaaaagataataaattttagaagcgaaataatatcttaaaaacaagtgaaaattctaaaacagaaaaatacaccttacattaaaaatctactgaatgtgctgagcagcaaagtggatatgacagaacaatgagccagtgaacttgaagatggcatgataaaaattatctaatctgaagatggcagaatacatgcctacccctttcatccccccagctggaacaccaaattttaacaactatctgcacacagaagagcactatcacaagaactcaaaatcaggtgagcagtcacagtacctgttttaaactttatacgatggaaagaggcattgaggagggcaagagagacagtcttaaatcagattccactcctccctcattaccccctcaccccctacaaatggcagcggctgtgctttgtggagagagaatctgttaactttggggaggaagaatgcattgactgggagactttacactgaactcagtgctgccctttcacagcagagaataaagctgtgctgggcccagccagcacccacagatggcgggagcatatggaccagccctagccagagaggaattgcccataccagtggtcagaacttgagtttcttggcaagccttgccactgtgggccaaagtgctctagggtcctaggtaaacttgaaaggcagtctagaacacaagaactgaaatttctaggcaactcctagtgccaggctgggcttagagtcagtgaattagggagtcatgtgacctagggagacaccagatggcatggctaagggagggcttgcacattctttcccaaaccccaggcagtgcagcttgcagcaatgaaggtgactccttccttctgcttatggagaggagagcaaagagtaaagagggctttgtcttgcattttggataccagctcagccacagagagggcaccaggcagagtcatgaggcctccattacaagccctaactcccagacaacatttctagacacaccctgggccaagatggaaacccccaaccttgaagggaaagacctgatcctggcatgactcatcatctgctgactaacgagcccttgtgttctgaataaccaccagaaatacccagggagtatgccatgggccttgggccttcagacatacatgctggcttcaagggtgacctagcacattcctagctttagtggttatggtaaaaataaaaataaaaataataaaacacctcctgtttgaggaaatcagaggtaaaagtaaagggtaactttctcttgcactccaggtaccagcttggtcatagtggggtagagtaacaagcagcctcttggagtccctaagtccaggcctaggctcttagacaacatttctggacctgcctgggctagaggggagccccctgccctgaagggtgagtcccaggcctggcagcattcaccataagctgactaaagagctcttgggctttaagtgaacattggtggtggctgagcagttatcttgtagactggtggtgacagtggccacagggagaggcctgtgggagaggctttcctgcctgtggaaaggggatgcatgagtgtgaaaaactttgtattgtggtttgagtgctagcttagttgtactaagatagaacatcaggaaaactactaaggtttttgactctaatccctggctcccagatagcatctttggacatacccagatcctgggggaactcagcacccagaagggaagggtcttaagcaaggcacaatgctgtgctgatgtcaggtctgactcatcacagtcccagtgctggtggcccagggatgcttgcatcaccacactcccagatccagatggctcagcacagagacagagactccatatgtttgagaaaagtaagggaaaagaaaaagaatctttgtttggtaatccagataattattctgaaacatatccaagaccaccaaggtcatacctctacaagtctgcaaaaaacaagtattattgggtttgggccccaagtccttttaattacctggaaattgaaggataggtacaaagagactgtggagaccacaataaatacctaactcttcaatgcccagacactgaagaacatctaaagcatcaacaccatccaggaaaacatggcctcaacaaatgaactaaataaggcaccagggagcaatcctggagaaacagagatatgtaatctttcagatggagaattcaaggtagctgttctgagaaaactcaaaagaaattcaagataacacagaaggaattcaaaattttatcagataaatttaacaaacagatggaaataattaaacagaatcaagcagaaattctagagttgaaaaatgcaattgacatactaaagtgcatcagagtctcttaatagcagaactgattaagaagaagaaagaattagtgaacttgaaaacaggctatgtgaaaatagtcggaggaaacaaaaaaaataaaagacaatgaagcacacctacaatatctagaaaaaaaaaacccgaaaagtgaaaatctaagagatattgtccttaaagaggaggtagagaaagagataaagatagaaagtttattcaaagagatgatgttagagaactccccaaaccaagagaaagatattaacattcaagtacaaaaaggttatagaataccaagcagatttgacccaaagaagactacctcaaggtatttaataatcaaactcccagatgtcaaggaggt
